United States Patent 9,328,346 (POLYCOMB-ASSOCIATED NON-CODING RNAS) - sequence listing, part 139

SEQ ID NO: 192035 - RNA, 476529 nt, Homo sapiens
aguggcguccguuguaagugcuaugacaacagggcgaagauggcucagaguuaggcuggagaggggaggugucccuuccgcugcggccgucggguuucugcuacaucccauucaccgccuccuccauccuuuccuccucggugugagcagcaggacuugcauuuguucucgccugccuagugucuuccaagggauagaugccguuuccucugcuggucucugggggugacggggggcgcaggggagcuucuugggggaaucacuccaacucuguggagcugguggugcugccugguggggcucucucuuugcccgggacguggaacaacuuucagcuggaggacgagagggaauagugaagcuaaagguugcuuuucucugcaccguccguucuugcucccucugcuccaucacugggaccuugucaggcguucauaaagcaaaauuugccgaacgaggguucgcagaaagguggggcagagcucaucugacguggcaucagguaagaugguaugucuguuguuaaacuucggguacaugaauacccuuuccauguuuuauuuugugaacaagauucucuaaugcaguauaaugguuuggagucuguaaggugauugauuucuuagauguuugcacugaaauaaacaaacacuaggagcacaaaguguaugagauucugugaguacuuuugagaaaaaagggaugagaauuuuuaaggauuccauugaggaaugucacuuggagcaugagcauccuccugagacacuucaacaggucugugaguaaaugggcaaagcaguucccagccuacgacugaaguaggaugcauguacuaauacccccaauccuucuaguaauaggauuauuguuucuccucuuguuacuuggagaccacaacaguuuagaugagcugcgcugauuuuaucagcaccuccugccagucaaauccugccuuugacuucaauuuccuggagaaauguauuuuuuuggguaucucacuuuuacuuuaaaaaugaaaccguaucuuacagguauacacaucuuacauguccucauugauaaacaacuugaaagaugcugcaggauaagcuaugggucuuaaguuggccagcauucagagaaagauuuucuaacuuauuagcauuuuauaaagaaaacaauuacugagauuuuuuucaugaauauacggaagaauuaaaaaaaaaacuagaaaacccagaaguuuuuaaagaagaauuuuaaaaaacuuuauuuugaaaauaaguuacaaguuauuugucagaguuuaagggauuuuuccuuguguguaauugucgugguuaaauuacaacuauacacuuauauuuaugguacaacuucuugauagaaaugcucacugaagggaaaaaauccaacagcaauaguauauauaguaauuuuaaaacuuuuacaccuuuugagggauguaguaagucuuacgcuuuagaauacuuugaaauauuuuugaaaauuauuaaaauacaugaaauuauuauaaaacaucccugcugguuaauaacauuuccauuagugauuacuaucagucuuugugagucccauuuaaaauuucgguccagagggugaguuuggcauucguaauugugucuugcacagaacacacuaccaccgucucuuucaacuaccacuacuaccacugucucuccuacuagcacuguuucuacuguuggguuauuacugacaucuauugaguacuugcuauggguugagccauuuuauccuccuccacccuagaacaauugagauacuagaggauaagggacuuguuuaagaucauguaguguaacguggucagaaagugcacccagagcuguccuacuccaaauuuuguguuauuuugcccuuugagucuuuuguugaaaauuccaacagugagcccuuguauuauugccuucaaaagcaguauacuucuuuugaacacuacaugcauuugucaucuuucuuugacuggaagaccugauuucuacuuucuuaaauuuggugugacacuggcauaaccuggagaaagcaaagcucugaaaaugaacaacagcugcaaggucuguuuccagaacugaccuucaaaccuguauguuuuuuccacagcauucuuugggguuauuguuuucacagcugaucauauuguaggacuaggucaaugagguguucaagaccagccugggcaacauagugagaccucgucuuugccgagcauggcagaaaaaauaaaaauuauuaaaacuuuuuaaaauauuaaaaaaagaacaauagcaaauuaaauucagaaggucagcaaaaaaaggucagccaccucuuaaaugaaaccuaaaucugaguaaacuuguuguagaaaaaaaaguauucaaaacaaaaaagugucaagugaagaguauagaagagaauuucuggaguuuaggggauaaggagauuaucucccauuuauuauucuaauaaggcauuagaaacuaaucuguuaugccuguuuauaggacugcaccuguuacaaccuucaaauuauugucuucuaaucauccuuuaacaauuuaaucaaauuuaugacauacuugccuguaguuugaacuuguaguguuuagaauuagugugaauagagcuauugcuuuuauagucuacauggaggggcgugugcauaggccguuuguuuaggguucuggaguagacagucuggguuuagguaccgcacaucacuuaacuagugagaccacuggcacggauuucuuaacuucucuguauucaaggauaccugaauaauaguaucuacaauuuacuuuguaguuuuguuaugaauaucaaaauagaaugcuugcaaagcauuuagaauccugacuggcuuuaguaaaugauuaguagauacuuuccuuuaaggcgaagucauuaaaaaccugguuuuuauuuuccaauuacuuaaagacaaaucagugagcaacuggaaaucaacacugaaugaaaaggggauaaaaugcaaaccucgguuccuuauucaagacaguuaacuaaacugaauuaaaaaaacauuguauacauauuuuauuuuuuguuauuuaaaacacuuuuuguuuauuuuguaacccaaaagccagguuucaugaccaaaaaauguuuuauuacuauuguuccuuaccaucuuuccuaaccugucaguaccagaccucccacaccuaccugcuuaucuuaauaucucaaugucaaggccuauaucuuuccuagauuggaauacagauuagcauuuuauuugugucucaauuuauggcuaauuuuucauuuucuugaugacuugggaugucuuccaggagaaagggcagaauuuauuuugcugaccuucugaauuuaauuugcuauuguucuuuuuuuaauauuuaaaaaaguuguaauaauuuuuauuuuuucugccaugcuuggcaaagaugaggucucacuauguugcgcaggcugguccugaacuccuuagcucaagugaucaauccgccuuggccucccaaagugcugggauuacaggugugugccaccacaccuggccuaaugguaaauguggccaaaauacaggaguguucugcuuuaaaaaaaaaugaaaguuuauggggaauuugaagcauaaccaaaagcaugaagaauaacaaaaugaacccccauguauccaucaucauuuguuaucuuuaaaaaaaaacagcuuuguugaaauacaauucaaauaccauacaauucacccauuuaacacauaaaauucaguuccuuuuuuguauauucacagauacauguaaccauuaccacagccaaguuuggaauauuuuuaucaacucaaaaagaaaccucgcaucccuuagcuauaacucuccuucucucuuccuucuccccuacccccagaccuaagcaacuaagaaucuacuuucugucuuuaugaauuugccuauccuggauauuuuauauaaacagaaucauauaauagguggccuuuuguuacuggcuucuuuaacuuagcauguuuuuaagagccagauaugucugauucuaaaaccuauaugcuuuuauuuauuuauguuguaacauauaucaguauuuuguucuuuucuuuuuuauggccaaauaauauuccacuguauggaugcuuccuuuuguuuauauauucaucagcugauggacauuuggguuguuuccaaauuuuagauauuaugaauaaugcuacuauaaacauuuauguguaaguuuuuuuguaugcacauauguuuucauugcccuuggauagauacuucagugucagauugcugggucauaugguaauucuguguuuaaguguuagaggaacuucuagauuccuuuccaaagugguugcaucguuuugcauucucacuagcaguauaugagggcucugauuucuuuacauccucaccaaugcuuauuacuaucugacuucgauucugucauaguaggugugaagucauaucucauaguuuugauuuguguuucccuaaugacuaauuaugcugagcauuuuuuuuuugaaacggaguuuugcucuuguucccuaggcuggagugcaauggugugguuuuggcccacugcaaccccugccuccagguucaagcaauucuccugccucagccucccaaguaauugggcuuacaggcaccugccaucacgccuggcuauuuuuuuuuuuuuuuuuuuuuguauuuuuaguggagaugggguuucaccauguuggccaggcuggucucgaacuucuggccucaggugauccacccaccuuggccucccaacgugcugggauuacaggcgugagccacugcgccuggccuugagcaucuuuuuauguucuuauuggccauuuguauaucuuacuuggaaaaauaccuauucagacccauuguucauuuuuaauugacuuuuuuaaauuacugaguuguaugaguucuuguauauuaucagauacaugauuugcaaauauuuucucccaucauuucaucuucuugauggugaccuuugaaaccuaaaaguuuuuaguuuugauaaagucuacuuuauucauuuauuuuguuuuuuugagauagagucucacucugcugcccaagcugagaggugugguggcaugauuuuagcucacagcaaccucaaacucuugggcucaauccucaaacuccugccucagccucucaaguagcugggauuauaggcacacacaaccaugcccagcuuauuuuuucuuuuuuguauagaugcggucucgcuuuguugcccaggcucuucucaaucucucaggcuuaagcaguuuccuugccucagccucccaaaguguugggauuacaggcgucagccacugcaccuggcuuuauuuauuuauuuugagacagggucuugcucugucauccaggcuggagugcaguggugcaaucauggcucucuguagccucagccuuccagugucaagcaauucucccaccuuagccuccccaguagcugggacuacaggcacacaccacugcaccuggcuaauuuuuauauuuuuuguagugauggggucucaucauguugcacaggcugggcucagacuucuggcucaagcaguccuccugccuuggccucucaaaguauuggaauuacaggcauuagccaccaugccuugcccuuauuuauuuuuuauugcucacguuucuggugucaaaucuaagaauccauugccaaaucugaggucauaaagauuuauuuauauagucuucuaagaguuucaagaguuuauaguuuuagcuauacauuagcuuauacuuagaucuuugacauauuuugaguuaauuuuaaaaauauuauucgagguaaguguccgauuucauucuucugcaugucacuauucggucaucuuagacccauuuguugcaauuacucuuugaaugaucguggcaccuuuguugaaaaucaguugaucauagauguauggguuuauuucuggacucucaguauuuuccauuuauguuuaugucuauccuuaugcuagugccauacuggcuuaauuauuguugcuuuaguaaguuuugauauggggaagugugaguucucuaccuuuguucuuuuuuaauuuugagauuguuuuugcuauucugggucccuggaaauuccauacaaauuuuagaauaaccuuguugauuucuacagagaagccaucugggaaucugauagggauugcauugaaucuguagauugauuugggaaguauugccguccuaacaauauugagucuucagauccaugaacaugagauguuuuccauuuauuuagaucuucuuuaauuucuauaacaauguuuucauaguuuucagaguauaaguuuuacacuucuuuuguuaaauuuauuccuaaguauucuuuuuuuuuuuguuuuuugagauggggucuuucucuguugcccaggcuggaguguaguggugugaucacagcucacuguaaucuugaacuccugagcugaagugauccucuugccucagccuccuguguagcuaguauuacaggugcgcaccagcauaccuggcuaacuuauguauuuuacucuuuugggugcuauuguaaauguaauuauuuuuaaaauuucauuuuggauuguucauugcaagaauauagaaauaucauggauauuuguauauuuauuuuauauccugcaaccuugcuuaacucauuuauuaguucuaauaguuuuuucccaaauuccuuaggauuuucuauauacaagauuaugucaucugugaguaaagauaguuuuacuucuuuuuuuccaauuuggaagccuuuuauuuccuuuucuuaccuaauugcuauaguugagagcauccaguaugauuuugaauagaaguggugaaugcagacauccuugucuugugccugaucuuaggaggaaaguguucgguuuacacuauuaaguaugauguaagcuguggauuuugcauagaugucuuuuaucagugugaggaaccuucuauuccuaguguuuugaguguuuuuuuauaauggaagaguuggauuuauggaggugaucaaguggcuuuugauuuagauuguauugauuuuacauuaacucauuucuggauguuaaggaugccuaccuugcauuccucaggcaacaccauuuagucauguuauauaauacuuuuuauauauuauuggauucaauuagcuaguaguauuuuguugaggauuuuugcauccauaugcauaagggauauuggucuauuguuuucuugugauguguuugguuuuggcucaggguaauuagauuuauaaaaugaggugggaaguauccucuccucuuuuauuuuuuggagugguuuuugaagaauugggauaauuuugcuuuaauuguuuaguagaguccaccaguggaucugucuuggccuggccuuuucuuuguggauaguuuuuugauuacuaauucaauuucuuuauuuauuauggaucuauuuagauuuuuuauuucuucuugagucagcagagggucuccucuguucuuggguguaucaguggauuauacccaagcccucagcuccuccuggguguccuuccugugcugucggugcccagaguccggaggggaccgagguguuaggggacugguguaucagcacugcccugagcgcacacacaccuggccggguugcgacagcaccugggcucggcuucaacuuugguucgaaauuggagugggcacugggaguugggagaggccagggagcgggagugggcacuuccaaacugcaggggcaggggugcuucccgggcccccgacagugcagggaugcuugggucuggagcugugauuggguagcugcagaugugcccaggagcgcagggcuccuggcccuccaaccugguagggggcggggcuccugccuguucccagcccccacuggcuccgcagagugggcagccccugccaugccucccccgcugcagccagugucuucgcaguggcugccaucacugcugccuaaguugucuuuugaaauccacccauuuuuuuaucaaaggaaauuagugguaucccaacuuuguacugaugagaguuugugguuucuuaauuucuugggagugggcagugcuccuucucugcuucuaccuuugaaacuggagagacgcacuugggaaacaaaugaugacuauugauuaucagcccaaauuguuguuuuuuucuauuguucauuaauucuuuaaagauguaaguccuuauuguucaauaaauuaucgucuacaauggugcaugauaacacuucggacauugggggaacaaacauacaagauguuuauguaauggaauuuaugaaauucugcuaugcaugaccuuauguuugcccuggcaugaaagucauuguuguugcucugaaauauuguuguucugaaauaauuaagguagccauggucuugugaggaagagccauuuguuggacauagguuuaaaaauuagcccuuccuccacagucuuuaaagauuaaaauaaagcaaacaaacaacacaaaaaucauucuauccacaugcuuuuucaguuuuuugauauuaaauugcagauuauuggcagccuaaugaggcaggggacuagagacgagggagagaguaugcagaagcaagguccugcaauuagcugugugagguaugggaaucauguaacuuaucugggccucuccuauaaaaugagaggaccagcugauugauggauacuuuccagcuguuuuaggucuuugauuugaaaaaugauuuuuuuuaagcccucaaaagguaacggacggcagagguccucugaaaaagaaggggaaaacuggagcucugcuguaagaaaauauccacuuaggcaaucagguaucaguuacaucagugccucuucaaccuuaaggugcaugugauucaccuggagauacuguuuggggaggaugagauucaacauuucucauaagcuuuugagugauacagaugcugcugauccagggauuacaccuggaguagcaagggaccaaacucugugaaaagggggauuucaggagcuaacgaaguggugggugaauaaggaaaaauugauagagcaggagaaacaauaaugauauauauauuuuuaagagacagggucuggcuuuguuguccaggcuggagugcaggggugcaaucauggcucacuguagccucaacuccugggcucuaguggagacuggcuaauauuuuuuuuuuggugggggggaaagauggggucuugcuauguugcccaggcucgucucaaacuccuggccugaacugauucuccugccuuggccucucaaagugcuggcauuacagacaugaaccacugugccuugccaagaaggauguaaaugaugccuuuguuauuuugucaguacaaguagauuucuaauuuucgguuagaaguuaaugagaaaugaggccaggugugguggcucaugccuguaaucccagcacuuugggaggcugaggucggcggaucaccuaaguucaggaguucaagaccagccugaccaacauggagaaaccccgucucuacuaaaaauacaaaauuagcugggcgugguggcgcaugccuguaauaccagcuauucaggaggcugaggcaggagaauugcuugaacccaggaaguggagguugcggugagcugagauugugccauugcacuccagccugggcaacaagagugaaacucugucucaaaaacaaaaacaaaaaacaaaacaaaacaaaaaaacaaguuaaugagaaaugaaugucuucuauaggcauuccuauuuguagacauuguuggaaaguucuuucauauuggaggauucuuuugauucuuuuuuugucuuuuuuauuuuaacagcccacuagaucauaauauuggaggauuuuuuguauucauucuagcaagcugaaaaaauuuauugacucacagguuuuuaaggccauuuucauaggauagcuacuuugacuugaugcaguauuuauauucaaacuccagcuuugucucuuguggucacuuaucugaggauuuugacuuuuuaaaaauguaucauucauuaucauugacagaaaaaucucuucucuuucuccuuuacuugguuuaguauguucucuaggcaggccccaugaaguuuucuuuucugucuguguuaggcaaagguaagacccccuuugaguguuguauaguucuuacuuucuuauuuucucuccuugagacuuuugaaccggcugaugcaggagugagcagaggaucacuuacucuuugguugguuacuacuaauuucuguccuuagcuaugucucccaauagagcuuaugccuccaagucuucauccuuuaugguguaucaggagcacuugauacaguuggucacucccuuuuucuagauacauuuuuuuuuuccacuuccuucgagauaacucacuucuggcuuuguuuugaucucagugaaugccccuguuaagcuucugguagauuccucuucuuuuucuuuuuuuuggagauggagucucacucugucacccaggcugaagugcaguggcgugaucuuggcucacugcaagcuccaccuccugguucaugccguucuccugccucagccucccgaguagcugggacuacaggcacccgccaccacacccggcuaauuuuuuguauuuuuaguagagaugggguuucaccguguuagccaggauggucucgaucuccugaccucgugaucugccugccucggccucccaaagugcugggauuacaggcaugagccaccgcacccagccggauuccuccucuucuuaaccucuguaccacuccuuugucuucuaagcuugugucugguuuucuucagauaucccaucaugcaccuuuucccuuuccugauuaugcuuuucauccuuuuaucguagccauccuucauagccaugaagaugacuaugcuguguccugugaguccuccuagggaaucauuggcauuucaagugugaauuuggguaauauuuugcucugagcugcaagugaaugauguauccucauucucauaguccaguaauauggcauauuacaauucuccuagguacuuggcauauauagugagaauauaugggauuuauugaauacuguuacuuuccucucaaaaauccaauaaaaguguaauacagauauuauuauguuuuuugaaugcuugcuaccagauuugaaauuuaguaaucugacaauuuguaugguuauauaaugucauuaguaauaacaaauggugcaaauauuuuucagaaagucucccacauauuuugaaacucaugauaaauuuguuuaccuguuagauauuuguucacuuccaucaacucccaguguuuaucuaacuucuuucuuagcauaagcagaguacuauggauggaauuuucuuucuuuuuucuccugguauuuguuuuuuuaaacuaaucauuuugaaauaauuuuagacucacuuagaaguugcaaaaauaaugguuucccaaugaaaacaguacagugaucaaaaccaucaaauuuguuuuuuucguagagacugggucucuguuacauaggcuggagugcugugucuugaucaaagcucacugcaggcuggcauggugguucacgccuauaauuccaccacuuugggaggccgagauggguggauugcuugaggucaggaguuggagaccagccuggucaacauggggaaacuccaucucuacuaaaauacaaaaauuagcugggcguguuggcaggugucuguaaucccagcuacuugagaggcugaggcaggagaucgccugaacuugggagguagagguugcagugaguugggauugugccacuauacuccagccugggugacagagcaagacuccauuccucacuccccaaaaaagcucacugcagccucgaacuccugggcucaauugauccucucaccucagacuccugacaguaguugggacuacaggcauggaccacuaugcccaucuaauuuuuuuauuccuuguagagauggggucucccuauguugcccaggcuaauuauagauguuagccaccgugcccagcccaccauuaaauugauguuaguauaauacuaaaguuaaacuauagauuugauuuggauuuuaccagguuuuauguuagaugcacuuuuuuuuuguagauaguucuaagaaauuaaucccaaagaaauugccuuuuauuauuagcuccucauaguuacacccuccuguaaaccuagcaaccaccuaucuguucuacauuaguaugauuuugucauuuugagaguuagaaauguaauuauuuaauauuuuagcuuuuuggauuuuuuuuucauucagcauaaugcucuugcagucuauccaaguugcaagugucaguuauguuuuaaauucuuuuuuuuuuucucgagauggagucucgcucuuuugcccaggccggacugcaguggugcuaucucggcucacugcaagcucugccucccggguucaugccauucuccugccucagcuucccgaguaacugggacuacccgcccggcuaauuuuuuguauucuuaguagagacgggguuucaccguguuagccaagaugguuuugaucuccugaccucgugauccgcccgccucggccucccaaagugcugggauuacaggugugagccaccgcgccuggccuaaauucucaaguuauauugguaugguguagauguaccauaguguguuuaaccagaacacugaguuuuuuucuuuaauguaaguuuaaaacaucauaaaaggggaucaaaaccagagcaauggcuaacacuuauugagugcuuauuaugugccagguauuguacuaaguggucuacuguauuccuuuuuguaaaaaacuaaaacuguauauuuuuuauuuuuaauugugguaaaauaaugugacauaaaauugaacaucuaaccauuuuuaacuauauaguucaguaaugguaaguaaauugacauuauugugcaaccaaucuccagaacuucucaucuugcgaagucaacacuauauaccuauuaacaguucuccuuucucccuagccccugacaaucaccauucuuaauguuucugugacuauucuagguaccucacauaaguggaaucauaugguauuugucuuuuugugacuggcuuauuuuacuuaacaugauguccucaagguucaucuacauagcagaugucaguuuccuuccuuuuuaaggcugcauaauauuccauuguauggguauaccacauuuucuuuauccauuuauccauugauggauguuuagguugguucugccucuugguuauugugaauuaugauacaguaaauccguguguaaaaauaucucucugagauugucuuuaauucuuuuggauauccaccaagaagugggauggcuggaucaaaauuucuagguuuaacuuuuuuuuuuuugagauggagucucgcucugucgcccaggcaggagugcaguggcgcgaucucggcucacugcaaccucugccucccagguucauggcauucucuugccuuagccucccgaguagcugggacuacaggcgccugccaccacaccuggcuaaguuuuuauauuuuuaguagagacgggguaucacuguguuagccaggauggucucgaucuccugaccucaugauccacccgccuuggcaucccaaagugcugggauuacaggccugagccacugugcccggcccuauguuuaauuuuuugugggaccuacccacuguuuuccauaguagcuacaccauuuuauauucccaccaacagcguacagagauuccaauuucuccauguccuugccaacacuuguuauuuuguguuuuuuucuucuugcaaucaucauucuuaggucgaauauauuuuuguuuuuuuugauaauggaugugaggugauauuguuuugauaugcaaaucaaaaauuuugaacugauuuucaguucaaaauuagugauuuugagcaucuuuucauaugcuccuuggccauuuguauaucuuuuuuguuguuguuugagacagagccucacuccguaacccaggcuggaguacaguggcaugaccuuggcucacugcaaccuccgccuccuggguucaagcaguucuuuugccuuagccuccugaguggcugggauuacaggugcccacuaccaugccuggcuaauuuuuguauuuuaguagagaugagguuucacuauguuggccaggcuggucuugaacucuuggccccaagugauccuccugccucugccucccaagaugcugggauuacaaguaugagccaccgcacccagcucauuuguguaucuucuuuggagaugugucuguucagguucuuuugcccauuuuuuaaugggaugguuuguuuuuguuguuguuguugaguuguaggaguucuuuauguauccuggauauuaauuccuuaucauauauaugacuugcacauauuuuuuccaguucuguaggaaacugcauucuuauuuaaucaucacaacaccacucuuaccuuuauuuuguaaaugagaaagcgaaaguacagagauguucaguaacuuuuaguaaccuuccacugguugcaugguuaacaugugguggcacaggaauucaaacucacacagguugccucuagaggcuauacuuucccaccacauuauuuacagccaauuucuuggccaacuuuguauaaaaacaaaugaccuugguuucuaugauuagcucauguggaaugcuuacuuuaagaggcagguuggucuacauuuuaaaaaaguagagcugauccucauuauuggcagacucuguaucauuugugaauuugccuacuugcuaaaauuuauuuguaacccccaaaucagugcuugcgaugcuuuuguggucauuugugaucaagugcaaaggaguaaaaauugagucaccugaugcacauguucccagcugauguuaaacaauggcuuucuuguuucaguucucauaccguaaacaaguguccuuucauggucuacaguauuuagugucauguuuucucccacauuuucguagguuguuuuuggagggggaugugguguuuucacuguuuaaaauggucugcaaauguaauacugaagugcugucuaauguuccuaaaagcaagaaggcugugauguaucuuguggagaacagacagauggucccugacuuaccaugguuugacuuaugauuuuucaacuuuaggauguugugagagugauacacauucaauagaaaccauacuucaaauuuugaauuuugauuuuuucccugguauauuaaauguguuuuugacuuaaaauauuuucaauuuaugauggaucuauugagauguaaucccaucauaaauugaaaagcaucuguacaugaaauuagauaagguuaguucagccugaguucuagugcuggugggcaugauucccauaguaaugaaucagcaauacauauuaaauaagguaucuuuaaauagaaacacacaaaaaacuacauuauguauugauugguugaagaaaauguuguuacuagaagcuugcaggaaucugucuaacccuguguuucuccuaggagcaaugguucaguauuugcuaauucauuguuuauggcggccuuauacagaauaacuuucgugaauaaggagaauugacugcacuucguagcuaccauuuaaaucgguguaacaugaaggaaaaccucauuuauguuaaauaaaugaacuguuguagagucccagggcaugugaugcuguguuguaauucaaaagguccaagugcuuucacaucugccauaucagcaacucagugguagguagggcugguauaugcucauucuagauaagaaaucaaaguaaggagagguuguuuggguugcccaaggacacacggauaguuagugguauaaaugguccugcagcccaauuuuccugcuucuuuuuuggugugaauuucccucuucuaucuugccuuucuauaacuaacauagcaagaggaagugaaugcuuuuugaguaccuauagcauaccaguuccagggcuagucacuaaugcauuugaucucauuugucucagcaacucuuuguaauaggagauggaguuggcccuccguguccccggguuucacauccauggauucaaccaacugcagauugaaaccuguggauauggaagacugacuguacuagguauacuaggucauuauauauaauaagggacuugagcaucuggggauuuuucaucuguggggucuuggaaccaaucuuccacagguacaaagggccaacucuagugcagucucgccaaugacuagacugaaaggaaguuagguauuucacugaagacuuacauguuaaauagugcugauggaauuugaaucuugauccuccaaagaaucuguucuuuuguuauuuucugcaguucucuccuaaauguuuuagaagagagaauuagcacaacauaaauguauaauuucucagcccaauuuacuaacgguguugcaaaauaucugauuaaugcuuccagccauuuggauuugugguuucaaauauguguacaaaauauuaaaaaguuaauauagaaauguccuucucagaucuguccaaguuuaauuugcuaugccuuaagacauaauuauuaguucauagugugaaguagauuauuauaaauguuuucuuuuuagugugaaagaaaaugucuuuauuuaaagcccgugauugguggucuacuauucugggagauaaagaagaauuugaucaaggcuguuugugucuggcuaauguugacaauaguggaaauggacaagguaagcaacuuacaaccauacaucuuggaugaaaguuuuaaagagaucaaauaagacugggcacgguggccgacugcuguaaucucaguucuuuugggaggccgacgugggcagaucacgaggucaggaguacgagaccagccuggccaacauggugaaacacugucucuacuaaaaauacaaaauuagcugggcuugguggugggcaucuguaaucccagcuaccugggaggcugaggcaggagaaucgcuugaacccagaaggcagagguugcggugagcugagauagugccacuacacuccaaccugggcaacagagcaaggcuccaucucaaaaaaaaaaaaaaaaaaaagagauaaaaaugacuugcuuuugaaaauguguacuuuuuagaacuuaauugaacuaucauaauuguaccuaauuuugaagguaguuuuuuuuaauaauauuuagguaucagacugauaacuauagucuuucuguuuuguuuauguucugguuuguacugauucugucauauuguuugcuggaauuuaguaaaaauuauaugacaucacuucauuuguaucaaaauuuggucuuguaggggacaguuaguaaaauauuuuguauuuugaaaaauuuccuuuuguagaaauucuuuacaagaaaaauaaauuuauuggaccuggaaaccauucauaccauaaugaaauuacacuagcucuauuuggugguagaaaacaauuguuaaauccuugcuuucauuaucauauuauaauacuaaaaccuacauucuagcuuauucuuaugcaucuucauguuuuuuaagugaccuuucaaacaguuuaauucuguauuauuguaucauugcuauuugaaauuuguauuugguuuauagucaugggcuuuuuuuuugugaucuagucauuacccucuuaaaaagaaaacuuauuauaacuauucuuuuguuuacugcauauaaauauuauccccuuacauuuuuuaaaaauuguuuuucuugccuauaauuaaaacagugggaucugcaggaaaaugugaaaggagaaaauuguauugguaaagcagaagagugggaguacuaaacugcacagagcaccuacuaaguuguuuugaaggaaaauuuggucccugauuuuccacugauaggagaugggaaggccuucuauucagaggauauuggaagguuccucaacccugccucugcccccgcuauuuguuaaagcaugugaugccccaguuauuuggccauguaagagucaugccacagaaauaccugccagagagaacaauuucaaacccacuucugccuaaacuaucuaaaguucagcuugguuggaaacuauacuuacugauuaucugaauaacauacuguacacucauucauuucuauuagagcucacuacuggggugcuaccaguagguuacgaauaugcugagauacugcuucccucacaguuuguggugagcugugagcagcuuccucuguuuuccgaagcuugcuauacaaaaaucauuacauauguguguuccacauagacaacacucaucauuguguuccaaagccugugucauaauauuguggggugauuauuauauauggagauuuucuaucccagacacaugagaugcuauaagauuguauucuccagggguagguggggugaugugacuuagguuuccuaauuuuugauaaguuccaaaauugaaugcuggcauucucaaguuugagaauuauuuuuguugaucuuauagaauggaaaguuaacaagagcaguuuuggauaugcucuguuuaagauaggaaugucuaguuuacagaauagagguagagauuuggggaugaacaauaugguguuuauauuuggagcucugagaacaggugaaaaugcacagggagagaaguugaaauaagaggggaggagguauaggacuguaaccuggagaauaugaggaucaacaggggaagugugggaagaguaguagauucugaaaagagcaggcagagaggcaggaaaacuaauuaggcugguaacugggaagcagugcaguggugugaucuuggcucacugcaaccuccaccucccggguucaagcaauucuccugccuuagccucccaaguagcugggauuacaggugccugccaccacacccagcuaauuuuuguauuuuuaguagagacaggguuuugccauguuggccaggcuggucgcgaacuccugaccuugggugauccaccugccucggccucacaaagugcugggauuacaggcaugagccacugcaccuggccuuuuuuuuuuuuuuuuuaauggagacaggucuugcucugcugcccaggauggagugcaguggcaugaucauggcucacugcagccucaaccucccaggugugccccaccaugccuggcuaauuuuuauuuuuauuuuuuuuguacagacagugucuccuuguguugcccaggcuggucuugaacuuccugggcucaagugauccuccugccuuggccucccaaagugcugggauuauuggcgugagccacugagccuggccuaaaaguuuucaugcucuuuagcagcaagugguucauuaguguccaugacaagaguggaugugugggcacaaugguaaugagaucuagauuugcaauguaugaauggggagugagugggagguggggagacuauuuauggcucuuuaaagaaacuuagcugugaauugaagaagggaggaugaugauuuggagaccauggagggucaagggaagugggaaaaauucaauguguagaauagaggcuuucauugauggagcagggacccagagaggacagucagagaugggaucaggugugcagauggaaggauuaaccuuggacagauguggaagcuuuuuuccacagugccagaggaaagaagguaagaauguauaccgauguagagaaauuugcaggucaaguugggagguugaaacaguaaugucaguugaccucuacuuuuuuuuaggugaucagacagugagagaagaguuacagggauccugaaauucuuuagaagaagccgaguaaaacacagaaggauuccuuguuaaucuugauaguacaauugaaauugaacaccccaugcauuuaaauggcacuuacuuuccuaauucucucaacucaagauucagacucuugagagagauagugagaaugagggagagagagaggaucugaauaauacaauuuagauuacaugccaaccuguggccuggagggaaaguuuauuucuagaauuggaguagagagcaaauaagacugacuaauggcuuuucauuuaaugccugcauguucauuaauuccuggggaaucccauauuuaauuguagcuugaaaucugugagagucagacuuaucugagaucugguuacuauacuaguccugcaaaguauuuuaauagucguacauauacauuuuguuucaguggguuagcuuguuaccauguggacuuggccauccugaccuccucuuaucccugaagauagggcuauauugaccuauccaugaaucuugguuauuuagugaguaaaaguggggauuuagggcaugacaggauacaugggaagcucagcggggaauguuuuaggaagguuuaaagguuuaagucuucuccaacccuucuggacuccauuauaacaguauaauuccauucuuccugaucagugccuuuacuuuuacuuaagaaggcuggagagauuugucaggucauuuguuauuguaauuuaaaacuuaaagaaucagucucugaaugagcuucucagugauuaagccccacuaucugaguaguaaguggugagaaauguuucugcagaguaccaaagacccugaguuuuauucuuuacccuuagaugacaauuuugagauuuaaaccuaucauucuuuuauuuuaaauuauccaauuuaauuuaaauaaagcuaucuucgauaaagcuaucuuacaugugguuugguguuccuccuuguucagcuggcuauggcagcagcuguccagucuacuagaguuucaccugcaaugggcacagggucccagaugacuagagaugauaacuugauuaauuguucuguuacaauguaaagugauacuuaaccccaccuagaacaugaaugggaguguucugugaaagggcauauacgcaaaguggcccucaaauacugaaggagcugagaaccaaagauugaggcagacaaauccaguuugucaguauacagugauuuauuaggugaacuuaugggcagaaauguccugggcaguugcaagacaggcagcucuccacaccacaacccccagacccagggcuuguaucuuggggaaaaaaaguauacaugcucugagaagaauguguagguggcuaugagugucacagccuaugauguaugcagcaacaucaagugcuguuuuggaggaaaggcaaaacuuaaaaugaauagauguuucugcauaaagaguaauacaucaacuagagaucuuagaggaguucuuggacuugaguuuagucaggagucacauggcagauuagcauuuaaaauaaaguuacucuuguccccacaaggaaucuuacuguuuuguaccgcauuucaggucaagaaccaauucccauacuuuggaggccaaggcagguagauugcuugaguccagaaguuugagaccagcccagacaacauggcaaaaccacaucccuacaaaaaauacaaaaauuagcugggcaugaaggcauaugccuguauucccagccacucaggaggcugaggugggaggaucaauugagccugggagguugaggcugcaacaagcugugauugcaucacuguacucaagccugggcaacagagugagacccugucucaaaggaaaaaaaaaaagaagaaccaauuccaaauaugcuugcauguuugcaugccugcaguuuauuuucuagugcucauuucuauaucaguuaucuuuuuuuuuggccacaagugacaggaaacugauagauuuaaguacagaaggugcuggaaugaauguaagauagcuuucccaaugcaggcagaguugaacugaacaagccuuuaguggggacaggaaugggcauggcuccagagaccuuguaagccuccaguauugaaguucccaggauuauaccucucucauaggguuauuaugaggauuuuuuuuuucuugagauggagucuugcugugucacccaggcuggaguacaguggcacugucucggcucaaugcagccuccacuucccggauuccagcgauucuccugccucagccuccuggguagcugggauuacgggcaugcgccaccacaccuagcuaauuuuuucuauuuuuaguagagauaggguuucaacauguuggccaggcuggucucgaacuccugaucucaagugaucugccugccucggcuucccaaggugcuaggauuacaggcaugagccacugcacccagccuuuuuuuuuuuuuuuuuuuuuuucagugacaaggucuuguucuuucgcccaggcuagaguacaguggcacgauuagagcucacugcagccuugaacuccuuggcucaagcaguccuuccaccucagccucccaaguagcugggacuacaggggcaugccacugcacucagcuuugcaugccauucccuccaugucucuguucuguccucuuaaaggacacuaauugaguuugaucacacaucuaauuaacuggaccucauuuuaacuugauuacaugugcaaagacucuguuuccaaaucaggucacauucagagguaccugggguuaugacuuuaacguaucuuuuuuuggggggacacaauuuaacuuacaacacccauucuaucauuuccccugcuuguacuuaagaugaaacauugcuuaucaaggcacucuaucuagugacgacucagaauccuuuuuaauacaguguuuucgacagccacaagcaguuauagaguuggccucuaugauggaaucaguuuacaacauuguacuaguccuuugauaaaggggcuugcuuugauugaguuaaauuaugacuuugauaccaaauaaagguuuaggaaaaaaugcaauauguuaguacauuugacuauagggauguaaagcuauuuaugaaagcuguguguuauuaaaauaaguacucuuuaauuacaccuuuuuugacagaguggccuuuguguauaaagcaagacugaauucuuuuaauuuuuagauuucucuuuuacacauuagaaagcuuauuuccuaagagauuugcuaauguuuguuucucccucuaucuuuuuuuuuuuaaauucucuacagauaaaauaauuguggguagcuuuaugggauaccuaaggaucuuuagcccccauccugcaaaaacaggagauggagcucaagccgaagauuugcuucuagaaguggaucuacgagauccaguacuucaaguggaaguaggaaaguuuguuucguaaguaagcccacuaauucugguauuuuacuuggaguaugucaauccuuuacagugucacuuuuguguauucuucaaagaagacuauccaugaauuaaauauauuuucuggauauugucaccuagggguuucucacguauggaaugcuuuuuauguggaaacuguacauuuaagauauaauaauuuagggccuuuuaauaguaauagacuuaagaugccugacauuaucagaagcuuaaaaacaaagagauaagcuuuugaaaauaaccaaauaaagaaauaaauaagaaguaucuacuuauuuaaaguuauauaaguguccauuuauaauuagaugaaguagcagauaaccauuacuuuuugguucauagcuuugagguuuuaaaaugaauaguuauuugggguagagaugcccuaucguuucuugaaagaagucaguucaacccacaaaguaagucuucccccuacaagagcuuuguuucaaaguacuuuauucuuaaaucuaauuuauuuuagaaaacuguuuauuaguuugaacuuuggguaauaugucugcuuuuuauuuacugaugauauugcugauccucuuauuuucauacacaaacuuucuuaaaauuaagcuuguauuucuucaucauuuagaaguacgaugaacacuuaucaaguagccagagucaguuugccuccucuuuuugagcucccuuuugccuuuuuaaaucugggcaguacccuaagcucuggauuuuggcauucuacauuuguuuaucauaauuuauuggccccaggggccauuuagucagggcccuaacuccugcuugaaaaccaaacaaccacucaugagcauucacauucuucuagugauauguuuuauucuguugggaagcuguagcuuagaugcuuuaggcugggauaugagaugagacuuuuaugcuuugugacaggcuggauugcggagauuuugugaccgaagugguugguaaauaucuacuccaucuaaaagcagauggugauuagguucccaucaugugccuaggacauauuaggugugauggauuuacaaaguaaggagacaaaagcauccuuccugcuaaaaaguguuuuuaccuuaccauuaaaaaagugaaacacagccaauaaucauucuguauaguaguccuuaaguauagcccucaucuaugugcucacauuggaaggggaggaaguuaacguuguuaaguagauaguauacuaggccuuucuaugacaucaugcucuuuuccugagcaugguggaaaacuuguuuugaauguccaggguacauauacaaaauuuccaaaggugauacugauuaugugauagucauguauauuugcauuuucuacuaguagagcaaaugaugaguauauauuaauuguaacaauguuuugcagauguuaucuaauaagauucuuauuuguaaauaagauacuaacacucugaaaguuuaaaugaucauacauauaguaaggugcagagucagaacccccaccuaggucugcagacuucaauuauaguccuugcaguuuagaacagucuguucuaaacaggcguuguacacuggaggccugcuuguacaugugagccuguucaguauuuuauuuuguuuuauuuugaggcggaguuucacucucgucgcccagacuggagugcaauggcgugaucucagcuugcugcaaccuccgccucccagauucaagcaauucuccugccucagccucccaaguagcugggacuacaggcacgugccaccaugccuggcuaauuuuuguauuuuuaguagagacaggguuucaccauguuggccaggcuggucucgaacuucugaucucaggagauccaccgcccccucccaccucagccucccaaaaugcuggauuacaggugugagccauuacaccuggccgccugcucaguauuuuaaauuuaaaagagcugucaacauuuaagaaccaagagauuucacauaaaacccaaugcuuucuggcuuuucuugaaaaauguggggcucuggccccaagcccagaaccaaguaauagccaccuccuuuagucugguucagucuccaguuaaucacagccauuuacacucuuuacucauuaacaaccccuggcuugauccuugaaaacugaauuuaggaucucuagacugugccaugcuaguuucuggaaaccacuugagauaggcugggaauuguuguggugauauugguaguuuauuucuauuugagauuuaguccaaacagaaauauuuucaauacuuguaauaaaauuucagauauggaagugauauaugcuacuuguaauaaugauugguguuuugugauguuuuaaccuuuccaagaugguuucacauuauuuuauuucauuucauugaaccucuuauuuuucaugagaaauaggcucagggagauuuuagugacuugcccaaagucacggaugaauuagucagaaagccaggacuagaacuuggauuucuuuauugaaagaaauagcacuuagggaaggaccucagaucugacuuuuucuuggaagcucuguuggcuucaaucugaaggcagugccuugaggcagaguacuugagccucugggguugucacauuggcuguuuauuguuauauuuauuuuucaguuuagaauguuaucuaaugaauuguuuuguuuacucacaguggcugugguuaugagaucuuuuugaaauuauuuuacaacuuuuugguuacgucuaaagcuaauauuggaaaacuuuaaaaacuuucucuguuuuucagagguaccgaaaugcuacauuuggcuguguuacauucuagaaaacuuugugucuacucugucucagguaagaaauauuuuuaccaauguagaauuuauauuacaaauugggcuuaauguuauaugagaauagauauucccuagugcugacuugguagagaacacaaaacauuuaguugaauguuuucuugucuugguuaacauuuucccauuuuucauuuauucuuucagauacuuaggcuauuacauuuucauggucuacuauuucuguguauauguaucuuucuagcagaggauuccucuuaaucaccugccucuccagaauuguuuccgggauugccugugacuaauagaggccaauucuggguacuuaagacacuugagucuuaagaaauguucuacaauaacaaaauugauuagaugcuaagucauagugguuugaaguacauuuucuuuggugaaccucaaguauuuucucuuuaccguuccaauuucuugguuuuugguugucuucacucagucaggcuucaucagguuucauucucugacaugguucuguggguacaaguauagugugcgguuugguuuuuauuaaaauuauaguaugugguuugguuuuuauuauauuuuauuuuggccuuuauuaaauguaagauauaacuuaaaaauuuuuauuucaauuauuagauaaguuuaguucaaguugagaguuauuuuaauggaugucaguguugggggcauuuuuuuuauggguaugagaaaacuaagugucugugaggcuguuccuuuuaccagagauccucuccuuuggagcuugcuguaaauguuaccuucuaggauuuggauuucucagacuuauucucuucauuugggcuuucuuuguauuuugcuuucaauuugaguaaugaugcauauuuacugacugaguuggauauucuuaggcagucucuuuucagggugaagaucuuuuagauuuccaaggcaggcuugguaaccuggcgugguauaugguagacauccaguaaauacuuguugaaugaaugaaugaacaaauuucuggguagugcugaggcaauugacaguggcuuucuuuauuacucuucaccauguucuguuuucguccccuucucuguuaccacuaucauuuuauuucccacucuguuuaugucagaggccugauaaagugugcucucauugauuuuaugguaaaggacaugguuucauguugcuccuccuagugucagggcauuuauuuaguaugccagaguaaauggagaagguauuaucauacgauauaggcuacuuuauugcauggaucuaguuguucuucuguuuuugaccguaagccuguuauuuuacuaaguggguuacacaagccauggaggagaauuugccuacaguuauaguuacccagaauacuucuuuggcaauuaguuccuucugaagcuccaugggggcucuaagcagggcagagaggaggguaucuuagaagcuagaaauucgauuagacacuaggccuucccugguccugcucgaacuaugggccaaaaagacagaugccucuggaguuccacuggggcuuagagcacagacaagggauaaaaaguguacuuaucagaaaaacguacugaaagaaacuggcauauuaggugacaauuuguuuauggcauauugauauccuucaaguaaguguugaaaaugaaaguuauuugcuaugggaauggugauuuuauagcucuuuuauucuuuguguucauuuaaaagcuuuguauucucuggggacuaggaguuguccaaacuacauucucuuaggccccaccucacuucccuucugucuuucauuucuucagccucuugugaugugggcugacaauuuguauauuuuuccuggcuugggcuuaaauugagaagcaugggaauguuuuuguucucuugaauauguuucuugaaguuccagauugaacuuuuaccuagcuuuuacugucacaggggaagcacaaacauuuucuaauuuaagugaaaccacuagugucagcagacaaacgugugagcugaacuugacauccuuuucuucaacugcucccuucucaaauauuuucaaacuagaggagccuuucuaaggucagucuccuggacauaccuaacaacccuuaauagucagaggcuauuuugcuaacuucuuuuugguggguuaugugucaucaaauguaugcuuaauauagagaaaaaaacagggucuugcugaccugaaguuggccuaucuuaucauacucugguaaagagaaagcaucacauggcaucucagauuucuuucugaugggcuucaguuucugaauaaaugguuacagaugugugagugugagccguacugauuauguuguuuuaaauauuauuuuccaaaagauguguacuucucaagaggcauuuacuaaacaucugacauauuuauagaauuuuaaugguuuccaugaggagggcaaaaaagaugugguucuuuacuuuugacagucuuacguaaucugauuuacuuaauauguaauggcuuugaguuuaacauccuuagauugcucagcaguuaccuaaaauugcaccgaaaacuguugucaaagugaccucugauuuuccagagaauuuuuugguuuaaaucagaucuuguuuaaguaaggccuguugcauaaauguuugaauauucauguauuuucuaauugaugaaacuuuauaauguauguagacuauaaucauauaugcuauauucaguccauauaucccagggcaaaaccuaugcaaauaauuuuaauauuaugucacugaugcuuuuuuagggagaaaauggucagaaauauuagauucccaaauacuucuuuuauuccaagguaguuaucuaaggaaaauugucuuuuucuccauaguugcauuauuaaauuuuaaagugcuauuaccugacauuuaagauguaucagugcauuuggaguuuuuacacaaagccuagugucguuucaugccaaguuuaaauauuggcugcugacaccuauguucauugacaugaguuccuaauguuccugcuugcauuuuggcuagcaggcauguauaggugcuuuucuuauucagagggauugaucugguuguagauguuguuaaaagaaaaaccuuagucaaaugaaauuuaacagaguuuaauugagcaaagaaugauuugugaauugggcagucucuugagccagaguaggcugagagagacuccagcacagccacaugguaaaagacgauuuauagacagaaaaaggaaagugacagacagaaaaaggaaagagauguacagaaaauagaaugagguacagaaacggucagguugguuacagcuugagguuuaccuuauuugaacauaguuugaacaacuggccuccuuugauuggccaaaacucagugauuggcacaagaguagguuacagucuauuuccaccuccauuuagguuauaguucacuauguacagagaaaccuuuaggcugagcuuaaaagauguaaggaggcagcuuuaggcuaaacuugauuuaacaauuuuccucuuuuggucauccucucaauuuugagagauugaccacaacuagucauugaugucacuaucaccauuguaaaugugcuuauuucaucucaaaacccacugagaaauagcagaacaguggauuuuguaagguaggaacaaggaauuuaguuuauuuuuuguaaagguuagaguagaggguacuuccuuaugcuggaauguccuguuuagaggagaaaaacaaaaccuggucuguucuaggagcuuuguguuuccuuaagaucuuaguuugauuaugucacauuuaacaugagugacuucauuuuggcuuggucuugucuguugggaccuagugcaugaguucaguccaaaacaauggccuuccauaauuuuauuuuaaaacuucccccuuuuagucagguucucacauaggugagagugugaccaaaacuuagggccuuaguuccacucucuuuuaacaucaauuuuggguuucuggucucaggaugucauucauagguuacagugcccucauggucacacaucuuuuuaagcucuuguccuucuaguugaagagagaucauguggcacucuagagauggcugcaugcaaacauuuaaaacuuuugagagaauauagcacacuagggagauuacuauuuugacuaucaggaggauaauaccaagaguuuggagcaugcuucuuagccaggguccccaugaaccaaaccaacuaaaauuaaauagaucaaagaaugagcuagauaaagagucuguucguuuuaaauaagcagucucuuuguuaguucccuguaacugaaucucuauaaugcucaaugugaugcauuucuccauggccaacaagaagugccagcaagugcacagauacugcuguuuagccaguaaguaaucuagagcaguucuauuauuuagcauaacuuucauaagagaauacaaagucuguugugugaccauagccuuuaggguagaaucuucuauaaagccuaucaugagggauacauuucuaauuauugccucauuuacuucaaaccauggaaaaggagaccuaacaaaugaugucuauuuagaagaaugaagacuucuuggaaauguucucuuuaaccugugacguagguuaagaggaguggaccaauguccuguuucuaacugauuaugaggcaacaaaugugucauuaaaauuucucaccugcauugggccuucgucuuuuaucuauugaggcauaagguauuccauguauaaggcuggcugcaaaauccuucacaaauuaaaguauacucuaugaauacacacaauagacccucuuuucacuucuauuguucauggaagcauaagcaagaaaaaauagguaagagucuccugauagcagagaagucuugaucugugaucuugagaaaaagcugucuauaucauggauaccaucuucuucuggggagaaacuuuccuguuuagcuuuacuuuaagguugccaauggguguacaguuccaagaguggaggggcccuuuugaguugugagauuauuaacucaaaauuucaaggucccaaaguguugcugcaauguagauggcaagggcagucuuucucugguauucucagaagauucaaucuuuguguucuagauuuugaagggguugauuguccucagucagcagacugugaaaagcuuucuucaccagguggaaauauacuuugacaaauagagcuaauguuauaacaucagcccucuugcaugggaaagcuuuuauacaaccagaagacaugcauugaaaaugacaauugaaugaaaucuuucuauaaauguuuaaauggcucaucagcuagcagaaauguaccugaaauuuugguugucuuuccaggaauauggguuugaaaagcaaacauugguuguaaacucuuuuagcaacauggaacagucacuacacuaauuaauacuuuuuuuuuuauuauacuuuaaguucuaggguacauguacaacgugcagguuuguuacauagguauacuugugcuaugucgguuugcugccaccauuaacucgucauuuacauuagguauuucuucuaaugcuaucccugccccugcaccccaccccacgacaggcccuguuaugugauguuccccacccuguguccaaguguucucauuguucaguucccaccuaugagugagaacaugcaguguuugguuuucuguccuugugaucguuugcucagaaugaugguuuccagcuucauccaugucccugcaaaggacaugaacucauccuuuuuuauggcugcauaguauuccaugguguauaugggcuacauuuucuuaauccagucuaucauugauggacauuuggguugguuccaagucuuugcuauugugaauagugccauaaaaaacauacguauacaugugucuuuauaguagcaugauuuauaauccuuuggguguauacccaguaaugggauugcuggguuaaaugguauuucugguuacagauccuugaggaauugccacacugccuuccacgaugguugaacuaguuuacacucccaccaacagugugaaagcauuccuauuucuccucauccucuccagcaucuguugcuuccugacuuuuuaaugauugccauucuaacugaugugagaugguaucucauugugguuuugauuugcauuucucugaugaccagugaugaugagcauuuuuucaugugucuguugggugcauagaugucuucuuuugagaagugucuguucauauccuuugcccacuuguugauggaauuguuuguuuuuuucuuguaaauuuguuuaaguucuuuguagauucuggauauuagcccuuugucagauggguagauugcaaaaacuuucucccauucuguagguugccuguucacgcugcugguaguuuucuuuuuuugcucaugaaguccuugcccaugccuguguccugaaugauauugccuagguuuucuucuaggguuuuuaugguuuuaggucuaacauuuaagucuuuaaucuaucuugaauuaauuuuguauaagguguaaggaagggauccaguuucagcuuucuacauauggcuagccaguuuucccagcaccauuuauuaaauaggguaucuuuuccccauuucuuguuuuugucagcuuuguaaagaucagaugguuguagacgugugguguuauugguuauaugccauugguaauggcauugaaucuauaaauuaccuugggcaguauggccauuuucacuguauggauucuuccuauccaugagcauggaauguucuuccauuuguuuguguccucuuuuauuuuguugagcagugguuuguaguucuccuugaagagguccuucacaucccuuguaaguuggauucuuagguauuuuauucucuuuguaacaguugugaaugggaguucacucaugauuuggcucuguuugucuguuguugauguauaggagugcuugugauuuuugcacauugauuuuguauacugagacuuugcuaaacuuucuuaucagcuuaaggagauuuugggcugagacgaugggguuuucuagauuuacaaucaugucauuugcacacagggacaauuugauuucccuuuuuccuaauugaauacccuuuauuucuuucucuugccugauugcccuggccagaacuuccaacacuauguugaauaggagucgugagagagggcaucucugucuugugccuguuuucaaagggaaugcuuccaguuuuugcccauucaguaugauauuggcuguggguuucucauaaguagcucuuauuauuuugagauacguuccaucaauaccuaguuuauugagaguuguuagcaugaaggguucuugaauuuuguagaggcguuuucugcaucuauugagauaaucaugugguuuuugucauugguucuguuuauaugauggauuauguuuauugauuugcauauguuaaaccagccuugcaucccagggaugaagcugacuugaucgugguggauaaacuuuuugaugugcugcuggauuugguaugccaguauucuauugaggauuuucgugucaguguuccucagggauauuggucuaaaauucucuuuuuuuugcugugucucugccagccuuugguaucaggaugaugcuggccucauaaaaacaguuagggaagauucccucuuuuucuauugauuggaauaguuucagaagguaugguaccaccuccucuuuguaccucugguagaauucggcugugaguccaucuggucuuggacuuuuuuugguugguaugcuauuaauuauugccucaauuucagaaccuguuauuugucuauucagagauccaacuucuuccugguuuagucuugggcggguguauguguccaggaauuuauccauuucuucuagauuuucuaguuuuuuugcauagagguguuuauaguauucucugaugguaguuuguauuucugugagaucaguggugauauccccuuuaucauuuuuuguugcgucuauuugauucuucucuguuuucuucucuauuagucuugcuagaggucuaucaauuuuguugaucuuuucaaaaaaccagcuccuggauucacugauuuuuugaaggguuuuuugugucucuauuuccuucaguucuucucugaucuuaguuauuucuugccuucugcuagcuuuugaauauguuuucucuugcuucucuaguucuuuuaauugugauguuagggugucuauuuuagaucuuuccugcuuucucuugugggcuuuuagugcuauaaguuucccucuacacacugcuuuaaaugugucccagagauuuugguacguugugucuuuguucccauugguuucaaagaacaucuuuauuucugccuucauuucguuauguacccaguagucauucaggagcagguuguucaguuuccauguaguugugcaguuuugaaugaguuucuuaauccugaguucuaauuugauugcacuguggucugagagacaguuuguuaugauuucuguucuuuugcauuugcugaggaguguuuuacuuccaaucauguggucaauuuuugaauaagugcgauguggugcugagaagaauguauacucuguugauuuggauggagaguucuguagaugucuauuagguacgcuuggugcacagcugaguucaaguccuggauauccuuguuaacuuucugucucguugaucugucuaauguugacagugggguguuaaagucucccauuauuauugugugggagucuaagucucuuuguaagucucuaaaaacuugcuuuaugaaucugggugcuccaguauugggugcauauauauuuaggacaguuagcucuucuuguugaauugaucccuuuaccauuauguaauggccuucuuugucucuuuugaucuuuguugguuuaaagucuguuuuaucagagacuaggauugcaaccccugcuuuuuuuuguuuuccauuugcuugguagaucuuccuuuauccuuuuauuuugagccuaugugugucucugcaugugagaugggucuccugaauacaguacacugaugggucuggacucuauccaauuugccagucugugucuuuuaacuggggcauuuaggccauuuacauuuaagguuaauauuguuaugugugaauuugauccugucauuaugauguuagcugguuauuuugcccguugguugaugcaguuucuuccuagcaucgauggucuuuacaauuuggcguguuuuugcgguggcugauaccggucuuuccuuuccauguuuagugcuuccuugaggagcucuuguaaggcaggucugguggugacgaaaucucucagcauuugcuugucuguaaagaauuuuauuucuccuucacuuauuaagcuuaguuuggcuggauaugagauucuggguugaaaauuguuuucuuuaagaauguugaauauugucccccacucucuucuggcuuguagaguuucugccgagagauccgcuguuagucugaugggcuucccuuuguggguaaccugaccuuucuuucuggcugcccuuaacauuuuuuccuucauuucaaccuuggugaaucugacaauuaugugucuuggguuugcucuucuugaggagugucuuuguggcauuaucuguauuuccugaauuugaauguuggccugccuugcuagguuggggaaguucuccuggauaauauccagcagaguguuuuccaacuugguuccauucuccccaucacuuucagguacaccagucaaacguagauuuggucuuuucacauaguuccauauuucuuggaggcuuuguucguuuuuuuuuuuacucuuuuuucucuaaacuucucuucucgcuuuaugucauuaauuugauuuucaaucaacgauagccuuucuuccacuugauugaaucagcuauugaagcuugugcaugugucuuguaguucuugugccaugguuucagcuccaucaggucauuuaaggucuucuucucuacacuguuuauucuaguuagccauucaucuaaucuuuuuucaagguuuuuagcuucguugugauggguucgaacauccuccuuuagcuuggagaaguuuguuauuaccgaccuucugaagccuacuucugucagcucgucaaacucauucuccgucaagcuuuguuccguugcuggcaaggagcugcaauccuuuggaggagaagaggugcucugguuuuuagaauuuucagcuuuucugcucugguuucuccccaucuuugugguuuuaucugccuuuggucuuugauguuggugaccuacagaugggguuuggguguggauguccuuuuuguugauguugaugcuauuccuuuuuguuuguuaguuuuccuucuaacagucaggucccucagcugcaggucuguucgagugugcuggagguccacuccagacacuguuugucuggguaucagcagcagaggcugcagaacagcaaauaucgcagaagagcaaauauugcugccugauccuuccucuggaagcuucuucccagaagggcacccuccuguaugaggugucagucaaccccuacugggagguaucucccaguuaggcuacucaggguucagggacccacuugaggaggcagucugucuguucucagagcuaaaacaccaugcugggagaaccauuggucuuuucagagcugucagauagggagguuuaagucugcagaaguuucugcugccuuuuguucagcuaugcccugccuccagagguggagucuacagaggcagauggccuugcuaagcugcggugggcuccgccaaguuugagcuuccuccagccgcuuuguuuaccuacucaagccucagcaauggcggaugccccucccccugccaggcugcugccucacagguugaucucagacugcugcgcuaguagugagcaaggcuccaugggcgugggacccaccuagccaggcgugggauccaccuagccaggcgugggauauaaucuccuggugugccauuugcugagacuguuggaaaagggcaguauuugggcaggagugucccguuuuuccacguacagucugucacggcuucccuuggcuaggaaagggauaucccccaaccccuugcacuuccugggugaggugaugccccacccugcuuuaccucacccuccgugggcugcacccacuguccaaccagucccaaugagaugaaccagguagcucaguuggaaaugcaaaaaucacccgucuucugugucagucacgcugggagcugcagaucagagcuguuccuaugugaccaccuuccaauuaauacauuuuuaauuuggauaauuuuaucucuuccaugaugagucauagaaugcagagcuuuuaauaacaaaagcuuuaaggacucaggaagcacaagguggcuguccagguucuccaugaguccaugcuuaauguuggacuuaauguccucuuaaauaacaguuguuucuccaauuuagguucacagcacugauaacugaaaguuauagguauuuugacuuggaucauggaguucguucacauuguauauauaaacaauuucaguacugucugguuuagcauaaaaaucugacaaaguauuuucuugguauugaauauuuuuguccugcuuggguuagcaguuuuauaaacuagucagucuguucauuaaaguucugagaauucuuuuuuuuuuuuuuuuugaaauggagucuagcucuguugcccaggcuggagugcagugguacaaucucagcucauugcaaccucugccucccggguucaagcgacucuccugccucagccuccuggguggcugggauugcaggugcccaccaccauguccagcuaauuuuuguauuuuaguagagaugggguucacuguguuggccaggcuguucuugaacuccugaccuugugauccacccuccucagccucccaaagugcugggaguacaagcaugagccaccacgaucagccuuaaauucugggaauucuuaccccauccaaauuauaugauccuaaaguuaccagaaaccuguauucaagagugcuugucgggguccuuucuauccuuucaugaaccuccuuaaagauaccauacucuaggauuuuggaugcuuguaaaguuuucaggaacugcguuaaaauuaagcaauuaacuguggaaauaacuuuaaaugauuauaaagacauaauugacaaggaaauguugucauuuauauggccuauaauaacauaacaaccauaaauaugacugauagcauaugcccagacauacuagaauuuuagaaaucccauacaauuuugguacauauauuaauaacauauucauuaaaauguaacuugaagauuaaaaaucauuucauguuugacagugcuucccguguaauuuaaccuuucagauaauccuguuuaucuccuuuuggcugcuucaggugcccucuguagcaucccaaaguuagaggcugaaagagacuuaauuuugaccugaaauuugguuuugggaagcccaucaaauugucaagguuuuauaacacuugaccaagauaggaucacaggucaccauaaaauaauggucauucguuuagccaaagugauaauuacaagaauuuuuuuuugaaaaagaagaaaccuguacucuuugauagaggagacucagucuuucaguuauaagaccuaagacagcaugacagauccuaucucuuuuuccuccuccuuuuuuuccuuuuugcaguuuacucaacgcauaaaugaaaauauuuuacugugucuuauuaauaaaugcuacacaaauuuuuguucaaaagagaaauuaaauuuuacuuuuguauuaguguauuauaaauacuaaagcuaauuuuaauaaaaucucauaaauaaauuuaucuaaucugucuucucuuaaccacacaagauuuccauaaaccuuucauuuugcauuuuccagcuuucuauauucaucuuguuuuuucuauuuuuuuacuccuucaauuugaaaccuauaagaaaccucaaaccagauaauauuuuuaacacauaucuuugugcuuuuuuaacuuuccucaugaaaagcauaucuugcuuuuuuuuauuuauuuuuuauuguacuuuaaguuuuaggguacaugugcacauugugcagguuaguuacauauguauacaugugccaugcuggugugcugcacccacuaacucaucaucuagcauuagguauaucucccaaugcuaucccuccccgcuccccccaccccaccacaguccccagagugugauauuccccuuccuguguccaugugaucucauuguucaauucccaccugugagugagaauaugcgguguuugguuuuuuguccuugcgauaguuuacugagaaugaugcuuuccaauuucauccaugucccuacaaaggacaugaacucaucauuuuuuauggcugcauaguauuccaugguguauaugugccacauuuucuuaauccagucuaucauuguugggcauuuggguugguuccaagucuuugcuauugugaauaaugccgcaauaaacauacgugugcaugugucuuuauagcagcaugacuuagaguucuuuggguauauacccaguaaugggauggcugggucaaaugguauuucuaguucuagaucccugaggaaucgccauacugacuuccacaaugguugaacuaguuuacagucccaccaacaguguaaaaguguuccuauuucuccacauccucuccagcaccugucguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuguaaaucuguuugaguucauuguagauucuggauauuagcccuuugucagaugaguagguugcgaaaauugucucccauuuuguagguugccuguucacucugaugguaguuucuuuugcugugcagaagcucuuuaguuuaauuagaucccauuugucaauuuugucuuuuguugccauugcuuuugguguuuuagauaugaaguccuugcccaugccuauguucugaaugguaaugccuagguuuucuucuaggguuuuuaugguuuuaggucuaacguuuaagucuuuaauccaucuugaauugauuuuuguauaagguguaaucacagccgaauucuaccagagguacaaggaggaacugguaccauuccuucugaaacuauuccaaucaauagaaaaagagggaauccucccuaacucauuuuaugaggccagcaucauucugauaccaaagccuggaagagacacaaccaaaaaagagaauuuuagaccaauauacuugaugaacauugaugcaaaaauccucaauaaaauacuggcaaaccgaauccagcagcacaucaaaaagcuuauccaccaugaucaagugggcuucaucccugggaugcaaggcugguucaauauaugcaaaucaauaaauguaauccagcauauaaacagagccaaagacaaaaaccacaugauuaucucaauagaugcagaaaaggccuuugacaaaauucaacaacccuucaugcuaaaaacucucaauaaauuagguauugaugggauguauuucaaaauaauaagagcuaucuaugacaaacccacagccaauaucauacugaaugggcaaaaacuggaagcauucccuuugaaaacuggcacaagacagggaugcccucucucaccacuccuauucagcauaguguuggaaguucuggccagggcaauuaggcaggagaaggaaauaaaggguauucaauuaggaaaaaaggaagucaaauugucccuguuugcggaugacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacugccauucacaauugcuucaaagagauuaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucaugaaaauggccauacugcccaagguaauuuacagauucaaugccauccccaucaagcuaccaaugccuuucuucacagaacuggaaaaaacuacuuuaaaguucauauggaaugaaaaaagagcccgcaucgccaagucaaucccaagccagaagaacaaagcuggaggcaucacacuaccugacuucaaacuauacuacaaggcuacaguaaccaaaacagcaugguacugguaccaaaacagagauauagaucaauggaacagaacagagcccucagaaauaacgccgcauaucuacaacuaucugaucuuugacaaaccugagaaaaacaagcaguggggaaaggauucccuauuuaauaaauggugcugggaaaacuggcuagccauauguagaaagcugaaacauaucuugcuuuuguuuauacacuauguauacaaaauuguuucaucucuaguagcuuuaauuacauauaucaacuaaaauuuuaacucuuaguaaccuuaauuucugauuaaaacccuagaaaauaauuucgaacuaauuuuauaucaguauuugugauaaaaacuauuuuuuuaaguuuuuagaaagauuuuucuucaaauuauuguuuuuuaacagaccuaaauauauguagcuuuucuguaucauauaaaaauaacaucaacguauacagacaaacucauguuuaauaauuaauguuucaauauuuuaacuuauaaaugacucagacauuuuaugauuauuauuuaauuuaauauaacaugaccugaagauuuuaaauuacugaaaauaauuuugaaaauaugacacagguacccuccuuaaugucuucccuuagucauucugggugccaaguagccucaugguacccaggaggcuuaugaaggucaaggccucucugaguccugacauaccaggugcaauggucaggauagaagacagggcugugaagacuauaucuggaggauucaaccccuccccaaauagccaguaggcaagcaggaaagcaggggagaagggagcauauugggcuugguucuggcuuguagcugauggucuaggcacuaagaacaugccucuaggccgggugugguggcucacaccuguaaucccagcacuuugggaggccgaggugggccgaucaugaagucaggagauugagaucauccuggcuaacaccgugaaaccccaucucuacuaaaaaauacaaaaaauuagcuggacaugguggcgggcgccuguagucccagcuacucgggaggcugaggcaggagaauggcauuaacccaggcgguggagcuugcagugagccaagaucgugccacugcacuccagccugggugacagagcgagacucugucucaaaaaaaaaauaauaaaaaaaaaaaaugaaaagaacacgacucuagaccucgucauguccaccuaugcagacccccaaauccagaggcucuaaaccaaaaacagcucacagucaaucaagcaaauaucuuguuauauuuaacugauaauuuugaagcuauuccuauuuuagcaacaauuuuagaauuugcuuuauuuaccaaauauuaucacagacacauaacacacauggacaugaaagauuuucauuugcuagcuuuuaaauaguuuuccuuuucccuauuuggucuauuaaucuuccaguuacuuguuucauugcccuaagcaauuguuaaccaggcaacaaauuugcauuucuaaaauaacucuuagguacaacaacaaaaaauuauauuccauauguacauagcuaagauuuuaggccuaaauauuguaucaucauuugucucaaaccaaggaaaaaauggugcucccauaaaaguucaguuaagacaacauggccagaaaggcaccuuaaucaaaggugugacuuaugccaauuuaaaacaaugggaagaguuucuaauauacacaggcagacauccuuaaaaauggugauuuccuuaauagauguaaauuucuuuugcagaaggguuucaagauagccaaugaaauuccagaaaggcauauuuuaguucaauagguguucuuaauuuagcuacuguuucuuaacuaaaauuacugaguucagaguggagcccauuaaggaauagggggaagaaagcauccucuaugccuggacucagcaugguugcaucugaaaaagaagcaagccuauuuugccugagggccugccuuuuauaaacacuuuaucuuuaguugcuuaagcuuuuuauuugccuuuuauaaagagucuuuuaauaaaaauauugaaaaauuuggccgagugcaguggcucacgucuguaaucccaguauuuugggaggcugaggcggguggaucacgaggucaggagaucgagaccauccuggcuaacaccgugaaaccccaucucuauuaaaaaauacaaaaaaucagcugggcgugguggcaggucccagcuacucgcgaggaugaggcaggagaauggugugaaccugggaggcggagcuugcagugagcugagauugcgccacugcacuccagccuuggcaacagagcgagacuccauccuaaaaaaaaaaaaaaaaaauugaaaaauuuuagaagcuuccacaggucaauagccaucccuagaugagacuauuuggggagccaucauuuucaaauuuacaucuuuggugcaguguuguucauuuggaacauuccacauuuguaacuuaucuuuaguaauauuuugccauuucuguuagacuuuacugcuucuggggccuaauacuuaugcacguauaagcuggaaguuacucaguucuucagaaacuaagguucccauuuuuaccucaaauauuggcuuuggcucucagaccuccuuggucaaccuagccaaugacuuuucccuaucuaagugugcaagaaaaaugaaacaaaguggguagaacacagaaauuucugcuaauuuccaagagcuaaacuuuauaccgccugcaauauuuccauuuacuaccaguuuuuuucugaccuagucagauauaagaagcccccuuacuggauacaagacaguuaauuaucagauccagucugauccuagauccagucugauccuagacccaguccaguuucuguugugacuuccaaacccaguuuggaucagaaauuugcucaaagaaacuaggagagcucaaaacacaaauauguggagcuucugaaucugagagagaacuuaccaugauccccaguugcugugagagagcaauggacacaauaggccuaguggguaccucgcuuggucgcucagcucuccuggggguuguuagaaccucuacuuuggaucccacuucugacaccaucuguuaaaagaaaaacuuuagccaaauuaaauuuaacagcauuuaauugaacaaagaacaauuugugaguugggcagccucuugagccagaguaggcucagagagacuccagugcagccacauaguagaagauuuauagacagaaaaaugaaagagguguacagaaaauggaaugagguacagaaacagcuggauuguuuacaacucagcauucaccccauuugaacaugguuugaucagcugaccgccuuuggccaaaacucgaugauuggcacaagggaagguuacagucuguuuacacuuccauuuauguuauaguucauuauguacagaaaaaccuuuaggcugaacuuaaaauauguaaggaggcagcuuuaggcuaaacuugauuuaacaguucagaaugaaauuugaaauuucuuuagggauaaaccaggugacucuuggagcugcucuuucugguuucuuggaggcuagaacucucuucagguuaauaccguauguguuucccucacccauguggcugguuugguugugauuccuccucagcuuccuggcaccucaaugauuuuacuaccauuuagaauccagaaagccuucauccuccaucaaggucagcaggcaaauuuaagccuuuauguuuguuucuuauucuauugguauauaaaaucuauuuuuggccaggugcggugacucaugccuguaaucccagcacuuugggaggccgaggcgaguggaacaccugaggucaggaguuugagaccagccuggccaacauggugaaacccugucuguacuaaaaauacaaaaauuagcugggugugguggcaggugccuguaaucccagcuacucaggaggcugaggcaagagaauugcuugaauccaggagucagagcagugaguggaaauugugccacugaacuccauccugugcaacagagugagacucugucuuuaaaaaauaaaaauaaaaaaaaaaacaacaaaacuaauguuaauuaaccauuuguggggaccauggaacugaguagaaaugauucuccuucaagaaauccuccccugauaguuuuuccucuuuuaacuauuaaaagacaaacuuaagacaauuuaaauuuaauggccuuuaacugagcaaagaauaccucagguguugggcagcccucacaaccaccagaggagguucagagcgcucugcucuucaacaugagcaggaaacauuuauggacagacaaugcaagugagguacagaaacagcuucauuccugacagcuuagcauuuaccuuacuugaacauggucuggucaguuggcugccuacgauuggcugaaugucagcuaccaugauuggccaggcugagaaaggcaaaagggagggaaaaaaaaaucuuuacuuaucuuagguucuccagcuggggcucuauaaauuagacuggccaaagacuaauuaacaauaggaaaaacaagcagaaauuuauuaacauaugcauugcucauguacacauaggaauauuccauaaggagugacucaaaaggguaguuggaccuugggcuaacauagcauuuuaggugaaauaaaagaaaauggguuuugggcuucuguacacagaaggcaaguuaugggaaggugaccagaaaaagugugguaaacaaggguugcuuaguaaaguuuguuauggugauuuaaguugaggccuucuccauugaaaagagcuaaggguacuccucuuccugguacaagggagggagacuuuuuuuuauaaauggagauuucuuuuuuuaaaugacgaccuguuuuuagagcuuuuccggcuaguucccuguguccuuuugcucaaaauaauccauaugccaaagaguccuguuugaggugucauauucugguacccugcaguggaaaagacauauucuugaagcuguuuucuuuggggaaauugucguugacaggauccauggacaguaaaaucuuuacugggugcgaggaccacauucccugaaaguuguuaaaugguggacaacugggcagcaggauacaauacauaguaccugguucuaaagauuugguuuagguucuaaaagucugguuugaauacucaguucucuaccuugaauacuguaugauuuuggggaaauuucuguaaauuuguuuugaacuuaaggugcuucaauucuaaaacggaaauaaaaauauauucuuacaaucucaguguauguugguaaauucuucuggacaaacaaacccaaaacaaauaaaugcuccuauauaaauuuauaaauaaauaaguacacauacauauauuuuuagauauuuuuagugauugaguacuacccaguuugaggacuauugcauuugcuuuaugauaauuuaaaauuuuccuuaacuuuuacauuuuggauuaaugagugaugcuucuuuauggaaaaaauugcuuucugaauccuuuuucuuuccaacacacuuuuuaaucauaauguucuugcucuauauguauaaaauacagauaaauacucuuuucucauuuggaaagaacuagaaagugaagcacaugcagucuauuaaaugcagaguauuuuucuguguuuggaaggagauucuucuuggcagacuucaaauaaaaaacauuuuccuauuuacuuguugagggaagcuuagaaaauuucucaauuaaauuagaauauaauuaggggcuugaauauuuugagaguugggguaggaacacuaauugcuugaaaguguuggggauuuuuuuuucuuagacacuuugagucauuucuuugcucuauuaauguuuauaaaugcagagaacuuauuuauuucagaucugaaauuagaggguuuuguuguuauuuaaauaauuacacuuuacucagauauaaucugucuaauaaaaauagaauauaaaguguccccaggguaauauuuugucuaaugguguaauuuagcugagauguaaauuguuuuaacuguacuggcuuugugugucaucaguaugcuaauuuuucacaauacauaauauuuuagugcuuugccauuauaauuucccuaaaauuacuuagaaucggaguaguggaugagaacaaauuaauguuuuuuaguguacacaaauacaaaguaauccuuuuuuuuuuuuccuuaggaaccuuggguaauguggaacaugggaaccaaugucagaugaaauugauguaugaacauaaucuucagagaacagccugcaauaugaccuauggaucauuuggugguguaaaagguaauuugcuuuuaaucaugaguaugcuauuucaagugacagauuuagaauauuuggucauauaaaacagaggauuaagugguuugacucucagaaagaguuaaaauagacauuuuauugaaaccuuuguauccaaaugcccaagcaagucuauggccauaccacccugaaugugccugauaucgucugaucuuggaagcuaaucagggucaggccugguuaguacuuggauaggagaccaaauacccaaucaaaauaauaaaaaaaaaccuuuaaacauuggaagucuuugauuuuuauauaaccagcauauuuuuauauggucuauagaaacauuucuaaaacugccuuuucuacagauuuugucuuuuauauauaagcugacugaaacugagcucuuuuugugugugauggaacugugguaccugacugucucucucaguggaaaaaaugguugaccuuauugacaggaagucacugcucuaccugcuacaggcaggauaaagcugcaaacaccucucuccacucuacccauaucuggggcugcuguacaggguugugugggucguuucugcacagggcagcuggaagagugggggaugugggucugaaauacagacuugauccugcucaucgagccaugcuuucuggcuuggaguaaaucuacccagaggaaggggugcuuuuucuguguuucacaaaggcaucaccuuuaucuagcacuggcucagugagacuggguuccucccaccuuggcagaggggugucuuuuucuaauuagcacaaaggccaccuucauuguguccacucagucccagagcuuccagauucaccaaggcuuggugcuugcuuguguacacucuugcuguuggcaugggagggcucuuauuuccaaaccaacuucucucccugcaccgugacaggguaguagaggagcugguggugcuggauugaggauaggaagccagguggugacacuuaccugugugauugugugacucugugugcauauguaucuauguuccugugccaccugcagagcauguaacuagggauuuuauaauaucuuagcucuuccuggacucauguuuuaugaguucauuguuuaacuguugcauuguauuuuuccuuagcaacaugagaaaaugacuucauuuuggaaguauuauucauuugugugaacucaguuuuuuuuuuuuauuaauacauacagauaaagacaaggaauaauugaauuuggguauaccaagcagcaucagggauauuuuugguggugaugugcaaauaaauauuuugcauaacugaagugaugugaaacaaaacacuugguuagguuggaggacugcuugaguaacaggaauguuuggauuacuugaacgauaaggagauaucuagaguuagaugaagagagaaauuuagaugaggggagagucugucagugaagugcuuccucagcuuuuagaacugauuuuuacuguucuuugaaaaaaugucugaccugauuagggaaccuaggccucccuuguuuaauuagcuauuuucaauucacuuuucccuacugaaucuccaaaaagcaaauuacuaaauuccauacaucauaaaaaaauuauaacaugagaaaaaagugcuuuggccaaauaaaaguguuuuuugauagcauaacagugguucuuuaggucacaucaaauguuauauagcagggauccccgauccccaagcuacagauguguagugguccaugaccuguuaggaaccggguuucacagcaggaggugagcggcaggugagugagcaaagcuucaucuguauuuacagccacuccccaucacuugcauuagccugagcugcgccuucugucagaucuggcugcaugagauucucauaggagcacaaacucuauugugaacugugcaugcaagggaucuagguugugugcucuuaugcaaaucuaaugccugaucaucugucauugccucccaucaugccaagaugggaccaucuaguugcaggaaaacaagcucagggcuucuacugauccuacacugugucgaguuguguaauuauuucauuauauauuacaauguaauaauaauagaaauaaagugcacaauaaauguaaugugcugagucaucccgaaaucuucccccuuccuggucuguggaaaaauugucuuccacaaaacugguccuugaugccaaaaagguuggggaccacuauuauauagauugcaguguacuuuuuauuuuauuaucagaucaaguuaacccuguuggauacacugaguucucaauuucucuucaaagaaucaguauaucaguauguucaguucuuuguccuucauuuuaaagcuuaacuuccuuguaguuucaguaaauagccuuuuccaccaguuuuaaucaguaguucacaucuguuccccuggucaccugcucuguccugacuuauccugguugccugcuuugaccucagucagcccuggucacccgcucugaccuaagucaccuuuaguuaccuguuccauaaccgucuuuccugccaaacugcucaccccgccacucuggcucauaccccuguucucuuuaaaauagccaaucagaauuagcuuagacugugugguccaacccuagccaauaggggaacaacacagcaguaggggguaccugugucaggaauaagaaucccuuccccucccuuguucagguguacucucaccauugcuccaucugcaaguugcacccuucuauagauguaaaauugccuugcugagaauuuuuuuuuuuuuuuuuugagauggagucucgcucugucaucaggcuggagugcagcggugugaucucggcucacugcaaccuccgacucccugguucaacaauucuaccucagccucccgaguagcugggauuacaggcacaugccaccacgcccagcuaauuuuuguauuuucaguagagaugggguuucaccauguuggccaggauggucucuaucuccugaccucgugacccgccugccucagccucucaaagugcuaggauuacaggcgugagccacugcaccuggccgagaaaauucuuugagcacuaguucuucuuuucggcaccgaggacaagcauuuguuuguaacaaucugguggcccguaugggagcccauucucuccuggagaacaggucuccaguugccucuuguagggagaaaugucccacugccuuguugcgguagccucagggugagagacuggggauccaccuggugugacaaauaaacccaggcuagcaaccuggggaaaaggauccucacauaccguggcgaccagguaacucugugcacagagcgagguaagaaacaucauaaaggcgacaaaguauuuccuuggcggucgggauauucagggugcugaauguguaugugaaugaucacaagcacuccuacuugaggugcugcuugugugaaugguacaaaguacuacugcugugcugagugaguggguccuaucugcgauuccguggucaccucauauggcuuagggaggauccugucauaggauuuguaccagcaugccgaugccaagagggacuuagaucucccccaggggagcugccagaguggacgaagugcaagaagggugcaaggagccuucugcagguggaacuaaaggauaggugggacacuucuaauaugagaaauugaaccuaacagcccuagcauaccucuagagaauaauaggugagacauuucuauauacuucuuuguaccuggaaaucccaaagugcugggauuacagaugugaggcaccaugcccagccaaaucuuuuauuauuuuuaauauaacuuggaaaugcuguucgagacagaaagccaauuuucaccuuugcauuaguacacuauugaugucaaccaauucuuaauaaaaccuuauagacaaaucuauccaauuuuaguuugaucauaagauaagauucuuauaaaccuugcauauaacccuuuacaccuuuuuuuguuguaguuguuaaaaagcagaucagugcucuaagaaaagccuguugugcuuuuauuccaauguucaauuuauggaaaaauggaauaauacaccuuuaacuuuagccgauauguucacacacagaauuucuuuuacaagauuaauuuuucaccaaccuuccacaacuuguucaaaccuuuggcuuuuucccaucuaacuuaaaacaauccuuggccgggcgugguggcucacgccuguaaucccagcacuuugggaggccgaggcaggcggaucacgaggucaggagaucgagaccauccuggcuaacacggugaaaccccgucucuacuaaaaauacaaaaacaaaauuagcugggcaugguggugggugccuguaaucucagcuacccgggaggcugagguggcagaauggcgugaacccaggaggcggagcuugcagugagccgagaucgcaccacugcacuccagccugggugacagagcgagacuccgucucaaacaaaacaaaacaaaacaaaacaaaaaacuauccuuuaacccucuaaacuaggcaaaaagaaaaaaaaauccacauuuccaugccuucuuauaaucuuuuuucaaaagcacauuucauuuuccugacacaccuugcauauaaaacucuuucucuaguagucucaauuauauguuacacuguuaacucuuagaaacuuacuuuuggugaaaaaucugguaaauacaugauuuuaauuauguacuagguguggagccuagggcaccagacagaagugcagauaaggugugacucucauguauaguuaggggauguggcuaacuccacauguccccaggccuuacuuaaaaucuaacggcuccacagcaguuaaguugaacaauuuucaagagucaaagaagcaguuuaugaccuuaaagcauuuaucaaaccuaauaucugaccugccuaauuuagaccaagugucuuuauuuuacuaauaaucuuuaaagcuguguuuuuauuucccaaagauuacuuaagucacgugaacuaaaaggcauuauagucuuaauuuuuuuauaauauuuaagugccuauuauuuuuaaaccaauuaaucagaacuuauauagauauauauaaacaucacacacacaacacauauaaauacacagacaaaagaagauccaauaguuguaagauuuuucauuugccaguuucuaaguuucccuuuaaagcauucaguuucuagccuuaauaaacagguauagguggaaggcgaaacagaucccccaaaauuaaggguuccauuuuuauaccagauccuggaucccaaaaaagggauggguagcagcccauuucccaugggagucuuaucucucaguaggggauggggacauuuccauaccuucuagguggccaagagcaugcuucucugauccaaacauggaaagagcugaguguccccccauaacuuccauuagcuguccccaaaaguguauuuccuaccuaguuauuacgcaugaaaucucucgcauaauaugaaguaauuucuaauacccccaaaaguaaaaaaugugagagggaucuauuuucaauucuuaggguuccacgagggaaacagaugucuuuuuuuccccccaaaauggagucugcagcaccuccucuguuuuucccaaggugucccaagcuguuaaauauuaucuuagguccucucgugugcaucaagaaugucaagaagacaaaauggagaaaauucaguugacugagaagaaaaaaccccuuuuccagaaaaacacaauccacgaagaggaaaaaaaaacauaaaggccuuuaaaauguacguauaacuuggauaucugcuuuuaaguaagcugacuuuuaaccauagugcuccuuaaaaaaaauuccuuauaaaccucuuauuacccuacuuuaaccaggccaaacagacaauauuucuggcuuuuaaauguuaccaaaaguaaccucacaggugaaaccaauaagccuuaguuacuaagcuacagcacuggacaguuuccauugcccuucccagaaagagccuagagcagucaauuuugagcuugcaaaagcuuuuaacugcuugagauaauuuuuagagcucugacauaaacuccaaaauuccuguccuccagauggcugagaacaagagaaaguacugccacguacuuaaaaggucaagcucccaaggacauaaaacaagacaagcggggaaccucauucaguuuuuuuuuguuuguuugcuucaggaaccugcagcaaaguuuguagcugacuaguuugcugggcuagcuugaacagcaggcuuguucuaagcccauguguccuaagcccauguucaaucuuaagguacuccucuuuaugacagaauauaguaaaaaacauuuauagcagaaaguuccccagaguugcuauagcuuaagaccagccucacaaauccuuuuucucauuaauuaaaauauugcaagagguagugauuuuuaccacaccuauaagcaguuugcacacagagagagagagagagagagagagugagagaagaaaggcaagggaagggagaaaagcauugccugcaguggggugggaagacgaggagcuuaggggaagcuagagaaagacccaccauugcagugacacuaaacaaaguucaggugguugcuuguaauuugcuaagggaucuuuuccagcagucccaucagcuuucaaguuuccccuuuuggggagaaaagaagcuccccauguccggugauccuguacaugccuaauccccccacagccaucagcaaagagcgcaaggcagauuaauccaaagaaaauagugguuaacaucccauaaugccaaauucauuuuuaaccaagagauuuuacugagaggggccucuaaccgccuaaaucuuaagaagaacucuaaccuuccuaaguugggucucgaacccaaauuugucgagaauccuuacuuuuuauuaagagggucauuuaacccauucugucuuaggagagacuuuaaaucuucuaaguugggccucuaauccaccacuuaaccauagucggccaauggguucugcauucuguuuccuuugggucaggagucuccuucguaucguucuuucaugguucaccaggagaauguuacuggaaagggguccugaucuagacccccagacaggguucuuggaucucaaacaagaaagaauucagggcaaguucauagaguaaagugacagcaaguuuauuaacaaaguaaaggaauaaaagaauggcuacuccauuggcagagcagcccugagggcugcugauuggcuauuuuaugauuauuuauugauuaaaugcuaaacaagggauggauuauuuaugaguuuuccaggaaaagggugggcaauuuccccagaacugagguuuccuccccucuuuagaccauacaauguaauucccugauguugccauggcauuuguaaauugacauggcacuagugggagugucuuuuagcaugcuaaugcauuauaauuagugauaaugaguagugaggacaaccagaggucacuuuggucgccaucuugguuuugguggguuuuggcuggcuucuuuacuacauacuguuuuaucaguaaggucuuugugacuguaccuugugccaaccuccugucuuauccugugacuuggaaugucuaaccuucugggaaugcagcccaguaggucucagccucauuuuacccagucccuauucacgguggagucgcuuugguuccgaugcuucugacaaagcuaugaaugaacaucuuuuuacauaaaucuuuaucuacauuucugauuauuuccuuaggauagaguggagagguugaguuauuaagucagacacuuguaaaauauuuuuuuccaauaugaaaguagcuuuaguccuuaaauacuguauaaauugcaaaaaguucagaacuuagguagaagaaaguaagacuccaagacuuguacauuucauaagaaagcccacuuucuaagccugaugucuuuaauguauauuuagugugcaccuuuccaguagugagugggugauucuuuuaauuggaaagcuucccuggaguugauguuauuuaaaaaagaaaccuaaaaauccuuguuuucuacuuuccucuauuucauauggcaucuuauggaauuauuguuugguauucaugucaugucucaauaaaggaauuaaacaaaacuaaagcccaacacaguuuuaagcaaauguguuauuuaaauuauggaaaggcagugggagaagaggugugcaguauuuugugugugcgucaaaaugaacuaacacuagauggcaguccucuauaacuuuuggccuuaguugcugcugcuuuagaauaagguauggcaagaaaucacuaauggaggaauguugaucccauaauaaugcuuugucuuuuauuaaaaauaaauguaacuucuuugaguugcacaacaggguggguuuuuaaaagacaguuaauuauaacagauaacagaauauaauauaaaagcgcuuucuagcugugcuucucaaacuuuuaacuuuuuuaaaacuuuuaaguugcauuugaauuauaaggggaucgugauuaaaaugcggauucuuguaagucugaaauuggaccuuaaaugcugaauuucugacaauauuccagguaaugcuaagcugcagugaucuagaggugugcuauagcccuaugucugcaaaaugcuuauuuuguaucaggcaguguucuaagagcuuuuacagguugaaaaaguaacugugagugguggagggaggauuucuacccagccugucugcaucuagaggcuucugguauuagucacacuaaacugccuccuugauugggcugugagugaauuuaccuccucccccauucagaaaaaacuuuccuaucagaauggaguguaguuugguuuggcuaaaguuaagugcauaucuuugauucuucauagauuaugggaaauauguuaacuucugggucguauguuugcuuuuucaguuuuauuuuucugguuggugcuuugguuuguaagaaaaguccaaaaaaauuuaaaauuccuccaaaaauuauaauauuaauugguuguauugggcuuuuauuuauuuauuuuugcagaggggaaguguguuugaaguuaaaaauguucguuguuuuuuaaaauuuaaauccaagcugcuuuuuugaaggaauaugugauuuuggguucuaaaaaaauauuaguuuaucuuuguuuuuuaugcucuugacaaauuaaugcuugcaaaauuuagugaguagcauaagcauagacaaacaaguuacaguuuggacauauacuaaaucaauuuugaaaagguagauuuuaauagauuuaagauauguuaguaauauugguggaauuuauuuguuuugguaauuugaacucuacuuguuuuugaaaaaagaacaaaaugauauuuuugccagauuuucacuugcuuuuguuucuuuguguuacuaaaauuuccaaugguuguuaacaugguauuuuaccuaguuaagacaaacuugccauuucaaaauaauauuuggaaaaagacagcauuaauauugauucacagaaagccaguggugaagaaaauaauauuguuuuaaggucaacagcugcauauacuuaacguaguaaaauaagauacuucuuguagucuauguaguaucaagauauuugagcuagaauuucuuucacugauagucugauuuagagucccuguaguaacugacccaaaguccucaguuacccgaaauuuaccuuguuggcugugaaaagaugaugaaccuuauauaggaaucuuucaaguguguaacagggacacugggaaggaauuguugguuuguuguaggugcuugggcacuuucagggacugaagcaagucugguguguuguuccucccuuacaucaucucucuuugucccuccgucuguccauccccucauccauucgaugcauauuuacuaagaauucugagugcccaggcacuguguuaguuuucuuggaauagacagauaaggaaaagacaguuuaugggcuggccaugguggcucaugccuguaaucccagcacuuugggaggcugaggugggcggagacuugaggucaggaguucgagaccagccuggccaacgugguaaaaccccaucucuacuuaaaauacaaaaaaauuagcugggcacgguggugggugccuguaaucccagcuacuugggaggcugagacaggagaaaucgcuugaacccaggaggcggagguugcagugagccgagauugcaucauugcacuccagccugggcgacagagcgagacuccgucucgaaaaaagaaaaaagacaguuuauguucucaaguagcucacaaucuaggaguaauaaagaugaaggguuaacuauaaaauaaugaggcaaaucaugauagagaugaauaugugcaaaacgaugcccuaggauuagagcagcucccuguaguugagugaauguguguguguguguguguguguguguguguggcgggugggggugggguaggguggggggaggggcgggggcgaggggaguaaaugagaguggggagugugcuguuaccuuuuuuauuccagcccuucauuuuuauccucuuuaauccagagauuaguaauucccaguuucaauuuuauggucuucaguauggucuuuagccuuuguugcccaaagguugaaccauucaaauuccuucugguauaguuuguuccucucaagaagauuacuuuucagacuuuauagugcuuuaaaaaccuugccauuuuuaggcuacuaaauugacuuuuuaacuuauagcauaaagcccucaguaagggacaauuauuuucuuuagcuaccagcugaucuuuaauggagaaggauauagugcucuucaagaguacuaugacuauguuuguugagaaugacaaauuuaaggguagggauaagaagaggaacuagcacagagauuaaggaauauaaauuuagagacagaagagcauggugucauggaaggagagggaagggagagauuccaagaggcacugaaggacuugagaguucagagguuaagcagcuggaguauuggaaagaaaauguuggauuuggucauuugcaagucauuggugauuuuagggagaauaauuuuaacagaaggguaggaacauuggucauguugcacuggaaugaggaauucauagagaagaaauggaaaucccaaaggaaaggugcuuuguaaagggguuugggcaugaagguaggugcaauuaaagccauagccagaggggaacauguuuuauaagggggggagaagucuuugagaacacaucaugaaaucuuaaucugauaaaccaaaugccuuucauagauaguauuuugcugaaaaaauuugaccugaauacauuuuuacuuuuauuuuauuuuauuuuuuuguuuuagagacagggucuagcauugucacccaggcugagugcggugguacgaucucagcuuacugcaaccucugccucccgaguucaagcaguccuccugccucagccuccugaguagcugggacuacagaugugcgcuaccaugccaggcuauuuguuuuuuuuuguagugacgggguuuugccauauugcccaggcuggucucaaauuccugggcucaagcgaucugccugccucagccucucagagugcuaggauuauaggcaugagccauugugccuggccccauuuuuauuuuuaaaauuauguuguuuugauuaugaugugccuauaauuuaaaacauuguuucucaucguguaauuugugccuuauagcccuguugaauuauugccuucuuuucauaauaaauaugugguuuauggggaaaaagccuauuuaauacuucaugagauuaaaagucagacccuuuggaaaaaaaagaaaaggaaaagaaauacuuuauuagaaauuaucacuauuacaccaccaucugguucuuucuucaauguuuuuuuaauuaaaaaaaaauaguugcugggugugguggcucacgccuguaaucccagcacuuugggaggcugaggggggcggaucacgaggucaggagaucaagaccauccuggccaacauggugaaaccccgccucuacuaaaaauacaaaaauuagcugggcgugguggcaugugccuguagucccagcuacucaggaagcugaggcaggagaaucgcuugaacccaggaggcagaggcugcagugagccgagaucgagccacugcacuccacugcacuccagagugagacucugucuuaaaaaaaaaaaaaaaaaaaguagauacaaggucuggcuauguugcccaggcuggucuugaagucuugggcucagccaguaugccugccuaggccucccaaagugcugggauuacaggugugagccaccgugacuggcucuuucuucaauuuuuaucuuuaucaacaucuuaaacuuauuugcuuuccuuuaaaaaauuucuuuucuugauuauagagcuuuguuuuacauggggauuuuuuuuuuuuuuuuuuugagacugagucucgcucugucgcccaggcuggagugcaguggcgcaaucucggcucacugcaagcuccgccucccggguucacgccauucuccugccucagccuccugagcagcuggguccacaggcacccgccaccacacucggcuaacuuuuuguauuuuugguagaggauacauggggauauuuauauuuugagcuuaccuguuaacacacaacucaagaguuaaauguuaccgucaaaaauccaaaccucccauuuccugcagaggccauaauucugcuuuuucauguggauuuagauguacuuuuguuuucuuuccaaccuugucuuugguaaaacugaagacucccuugguugcaacuaacaguuggcuuaagcaagaauaggaaguugacuggcuaacgucacuugagccuucucugugaucagaucugguuucucucuuuucaucucuugcuuccauuuccugggauaggcuauuuccuucugguuacaugauggcuauagcagcuuuaaaucuuuacuugucacauucuaguccauguaaaagagguucuuccuuucucguagaaggcucaacaaaagucuguuuccaacucacaggcucugguugggccaucucugaaccaaucauugccaccaaaggaaugugauuaacuugagccugagccacaggugugggaaguccucuuaccacuaaggguaagaguggagagggaagagggguggauuuccagaggaauaucagugaauaauuaacuguggugaaucugaggacuuuggaggugaucaagaaaaaagacauggcuaucagauggcaguagaacacaauaagcuuuauuugcguggugcuuuggcaggauugcauucaagaggaggucccuuacagcaagagaccuuccagagagagugagguggccucaacccagaaggggcagaggucaggggagcuuucuggggagagaggaccuagaguggggcuuagguguccagguugcugagaagcaggacuggggagggcagcagcaacauacagucuuuuacaugcucaggguuuguuuuaccuguagcuaguggauguugggugcaguuuuucaggguaugcaaaacaggcugaaaauauccuuauuugggcuauguuuaaagcaauugauauaaaaauuugaauuugguauccgugagcuuugaguuaauggucagucugaaugaagaaguaaacaacauggggucaauauauaaaggggucaccuuuaaccugguucuguagcauuaaugaaagagagugaaauaggugcuggguggccaaaaaacuguaaauauccaccuugcuuuugguuucacuuucucuccuaggaccucccugugguacuaccuuagaacugacaggagaggccagcaguggugauuugagagugugcccucagguguguauaugaauuggagaaggcagggccuaagcaguuaaaggauaugcucuguccugggcugaaugcagccucauucugguacaguguguggggauaauugcuugaaauguuuguguguauuuugaggauuuguuguaauugaauuuaauugagugcuuugcaaaaucauuugucaugauuuuaggcuugguaugcauagauauuuaaauucgggggcaugucucaaauuauuuacagaagagauugaaacuugaaauaauguaaguuaugauuuuuacuuuaucuuuuccucacuuucaguauucuucacaugaggauguauauacuuuuguuauaaaaguagucuuguucacagaggcauauuuaaaacauauguaccgguaaaaaaaaaaaaaguaaaugauuaagcaccaccucccaaacgcaaccacugaaaacauauauguggacaguagaauauaauccagaauguuucaacuugagcuaacccagaguaauuuuagaguaauuuuacaguuucuggaauuuagucaucuuaccaccuaaagggcccaaccagugaaaagcauguuuaucaugucaagucuggugcuguauaauggaaugcaagcaaguuaugacaauaaauguuaaauggaaaagccuuuacuuuauaugcauauaucuugaagucaguugaguaauuuauucaauauugguguuuauuuuguauuaaaauauaugaauuuacuagaagacagaaaaaaaucugcgugauuugggucaagcugcaaauaggaaaaguggcauauuauaagauauuccuaaauauuuagugaugauacauuucaccugcaauucgugcacuugaaaucaaaacuugucuuuccuuuaagauggcaaaaauauauagaauaauauaaaaacugugcacauuuuauauuuggggaaagaccucuugaacugcacauaagcuucugcuuauucuuucuaacuugcuuuucagguuacuuuuucagucuauauacuuggaauaaugcucuuaaaugacuuucguuacauuaaaccugagauuuccugacacguaguaguguccuaguccauuuguguugcuauaccaaaacaccugagacuggguaauuuauaaagaacagacauuuauuucucacaggucuggaggcugggaaguccaaaaucaaggugccagcagguucagugugcagcuagggccuguuccucauagauggcaccaccuugguguccucacauggcagaagaacagaggagcagaagagcaaagggccuaagcuacuucccuccauucuuucacaaggcacuaauccauucgugagggugaagcucucauuacuuaaucacuucccaaaaggccacaccucuuaauaccacuacaaugggaauuaauuuucaacacaggaauuuuggaugacguucagaccauagcaaguagucucuuacagucauuuuagaucuaucccuuuuacauccuauccauauuauguggauuugggcugcugugacccaguggucacaugacccacugguuguuggagauuugguaaaugauaccauaaccauuuuucacuuguuaacaaacugccccucaauuauaaugugguaucuccuauauauaucuauauaucugucuguuaggguuuuauuuggguucuuuuuuuuguuguuuuaguuauuuagccucccauaucacuuugucacuguguguuuguuuuguuuaauucauauucuuauuaaauugcucaguagugugaaauguuuuuagagaccuuuguucugauucuugguucuguuuuucuucaucugucuuucgcauauugucuuccccugucccucucucugccuuuuuuuuuuuuuuuuuuuguaguauguuuguggguuugccaggccagccucuuuaccuugcuugagcaaucaagcuuagcuuggcccacucuguuugggccuguuugcuuuuuuauggugcuggugaauuuuucuugccuucuuuccuacccaaucagagaggaguuuguuuuccuuccugacguacuguuuugacgguuggauaucaugcagugugucugcuuaucaccuaucuaggggcaguggagaagacauggggaggaagaaggguugucuguagcagccuuacuguaggauuuggcuucaacccucucuuuugugauuuugcuaagcaucuugaauuacugucacacuaccugguuggucuguaaccuguuaucuuggaaggcugagagauauucuuagauuuuggaucuucucucuuacuauucaucaguuuuccuugagucagugccauuuguugcuucccuuguuuguauuucauuagaagcuguuuccauucgccacccccuacuuuucuucugguccucugugggugugugugaggcuucacauggcaauuccuccucucgccugucuuccacuucuucuacucaucauaauugcuggagauauuuauuuagcuuggcugcuauuuuuuauggucuauggccuuuccugcuuuuuucuuuuugcagaaaaaauaccaaaaugauaaaaccuguauuuuucuuuucugaccagaaggaaugugguaaagguagaacuuaugguauuaugggcauuuccauuucucugggcugucuacaucuccccuccccuuccuggauuugucuuccuauaaguuugagaguuuuaaugaaauuuucagaauuuuguuuauucacagccucaccccuccuucuccuuauguggaguuuggucuuagcagcuucacaaaaugcaccaaguccagcccugaagauucuuggaaacaucugcuuuauggucaccauauuuuaaagauugugguaugaaauuguguucuuucuuugguuucauugccauugguguauguuugcuauuuucuauaauuuacuuauuuauuuguuuaauccacgaaguuacauuuuuuaaagggucuuuaaaacuaaucccaaugcuggauuugaaaaacgaauguucaucauaaaaauuccuguggauucagcaguucaguuguuugaauaauucugguagacuuauuuaguacagauuaauuucauuguauuugaugugaauaucuuuuuuccagauuguuauuggcuuuuaaacuguguaaguguuuuaauguggucagaucauucuuuucuuguacacuuuauuucuucuaagcuuagaaacuucucuuccaugcagaauuuugauguuucuguuuccuggaguuugauuaucuagcaggaauuuuuauauuuauuuauagagaagacuauguggagagagagcuaguauuuauucucuucuauauguugugguauugcauuuagcccagugagauaacauaaucaccauuuuuucauacugggagacuggagaucagagagauagagguguuucuccagacacauccaggcauagcuaucugauuugaacccagagcuaucugauuccaaagcucauguucuuccuaauauaguaacuguuauuuaauugccuugcuaguuagagagaaggucuauguguucugagaaaggaaugagagggagguuuuucuauaagcuuccugagggcagggacugugucuuuuguucaucacugcauaucuagugucuuucacagucuuuggcacauagugggugcuuaauuaguauuuguugaaugauugaaccaaaauagacauuugauugggcagggcugauguguuauauacuuuagacuuugggguuauuuuuuuagaacacguuagcucaguuccauuauucuagccaacuucuaaguuuuauuuuccucuuuaacaaacauguuaaaguaucuauuacaaggcauggguuauuguggucacugucucccauagugguaaagugagggugaguaacuugggccuccuggguucacccuuagucacauuauuucucaauaugcuggugaugcagcauauuguauguaaguuaucuaguagaaauacacugucuuaucuaauugcaacuguguuucuauagauuacucuuccuacuuuuuagcuuggaaugugguauucagaacuaucgaguauuugugauaauguccacaaaucaaaauguuuuuguuuuaaaaaauuacuuaaauucucuaauauuuaguguaaaagacacaucuuuucaucuguaacacuuuucucucuguguccugugaaaauucauuuuccuuuaauucuuccaauuuuucuacuuugauuguuuuuucagccaaauggaaguucagaaaaguagaauuuuuaccaaggaaaauuuaaugucagagucuagauauaauaucggcaugguauagauuauaaggucugacagcacaguagucucacguuugugacugagguggaaaaaaauacuguauauaaaagguucaguauguuuggacuauaauuguuaguaaaggaagugaauggauuuuuaucaauaauauauaugagcauaguggaauauuuuuuaaaucauaaaaugacuucuauaagcuuguaugggauuauauugucacauaaauaaaaauucaugaauucuuuggaauaaaaguccugccaaagaaaauagugaacugaaggauaagucagucaccuuuugccacaucuuuuuaauuuuuauuuuaaaaaauuaaaaaaaaagcauccuucccacucugagguuuugcuacaucuugagacaauccuagauaaucagauccucagccuucaaauaacuucuaauugucugaacuggagccuuuuucuuaucugccaagaaaauguauuaguggccacaugugguugcugagaggcugugcuucccaaagcugucugguuucuuugauugccauccagagagugaacugauaugcucagcuggggugaaugaacagccagaacacagccuugcuuuuuuuguguggggguguuagugcuaauaaaagauuaacgcuguuuuccucacagggaaucaauggauaauguuuugauagcccuugucucaccagugaaccauauggcccuuauuuucucauacaugugguugaaauguuagagcguaauguuagagaagaaucucugugguguacuggcucccguuccuugccuaggcauuaaaguguagguguuuuauuauauuggagaacuucccucauuuguuuuuaagauccuuuauggauccacagugagaagucggaagaucaaggggauaauaggauugacucucauccugugcugaguuuucucauauacauggcauucauuuauaaaaucucugguccaagaccuauaaaauaauguuacuuucaaauagugauuuccuguauguuauguugcauaaaacccuuaguuccugggggaagguuauaaagagaguucccaguagucugcagauugguuuuuuacaugaucauuuaaaguuguuacuuuuucuaaaaggugaguucugauucccguuauacauacacuaucaaaauuugguuaaauaccuccuugccugcuauugcuaagagagggaaagacuaaaaaaauuugagguuucuuaguguuguuugaaaaaaaaaauaauuucuuucaugguagcuaaaugccaagacuggaaaagcuuuaaggugaugcuuguggucagcacugccuuugacaagaugguuaaaugugguggucuugauaggauuugacaaccauuuuugauccauauauauaguucaucguggucucuuuuuaaacaguggaguaaugaagcuguuaaauauccuacucaauugagaaggaaaauggcuaccaugaacuacuuuauucaagugacacugcaauauaaaggcuuccagcaguuucaaaaaugcaucuacacaacacauugccaugagaaaugaacaaucugcccuucccccgggucucucuuaaauuaaguugauucagccacccuuuuccagucucuacauggaaacuugcuuugagguuuaaauucuguagcacaaaauaaagauacauauuaaugcuuaauaugaaaagcaacugcuuguguugacuacuagcaugucaaauauauuuuuaaaguacacugguacucugauuauaggauauacuagauauauaaaauuuaaggagguuuuuuugauggacuuuugaguaguuuucaguuuuuggccaauaugaauaaagcuauuaagaucuuuauauaauuauuuauguggacaauacaaaaauauaaguaucauacaaguguaaaaugauuuuuaaauuauacuguuaaaaaauucccaaucuuuuuuacuguuauaaaauuuuaugacacccaagaauauugagaauagaguucuaauauugguaggcaugcuuuuuguagaagaaucauauuauauguguuuaccucaaccuucaaagauacuaaauuuguaucuucaguauuucauauuguacauaauuucagucacuucuggcuaacuuagaauaucagaaaugguaaagcuuggcaucagaacaaguucaccuauauuauauuacuauuucaauuauguuucuaccuaaguuaaaagugagcuggauuuuaaaaucaaauuuucuuuuauugaaauuugcgaacaugaaccuuuuaaaucagcauuucuagaucuuugcuaaaauaagacaguacuauuuaauauggaaacaauaacugagauguaauccuaaauuuaauuuggaaaguuauaucaugauuuuaggagacugugaacauaaaaugugugaguggaaaauuaagauuucauauggcuuuuuucagcugguugauuaaguccuauauaguucauuguccuaaagaugaaauuuauauaagguuuuggaaggcaggauuuguauauuaaaagugcauguuuccaaggugguacaaacuguuuuuaacaaucuaucaucuuucauuuaccaagggaacuauguaaaaagaaaaggaaaauguuaaguagaaacaaaauguugagaugaugauaagcuacaaggaaagaaaaaagacuuuagaaagaauacuaaaaagaaacuagcuuuuuuuccucaacaaucugucugaauucauuuugcuuucauuauauaucuagcccggaggcaaaguauguugaguauuacaacaaagaggguguuauaaggaggacuuuuuuucaauaauaaaguauaacauauguguaaaccaugcaaccuuguaacaggaaacuuuauaauaagggaggacugugcuuagcuuuuccacaauuuuggaagaaugaauuuuauuagguguuagacaaagaaauuaucaacugacuuuuaugcuguaagguugaaagauuuguuaugaccauuucuagacuucagcagugguuuuaauguggguccugauauauuaggaacagugccuagcacuauuaauaugucuacuguugcuaguucucuaaaggaauaugauguuuaacuuuugccuuucaaugaaagauuauucaaaauucuguuauucugugguuuucucagcaguauuaggcuauucuugaauugaucaacacauaauauaauuugggaacccaaucaaugguucuuuucuuuuugaaagauggcgacaaauucuuuuuaaacuugggaaauuggcuccaucauucaucccuuauucuuucuuugcuucucuugcccaacuuccugaaaaccauauuguuuugaugucaauauuuagaauagauuaucuguuggggaaucaguuuguauuaauuauacuggaauaaauguaaguuugacaaaugauguagguuaguagguauugggccuaauggguuacucaguuaaugaagacacuaaaauuagggaccucuaauaugccugaaacauauuuccuguaaauuucccccaguuucaagauuaacuggcaauagcuauguuuuucuggcuuuuaaaggcuaauauaucaugguagaguuuuaggauuuauauagggcuuauuauggaauaguugagcucuuuguauuuaucgcacaguuauugaagcaagcuagaaguguagaagucaguccucaacuuuuuggcuuuucagcaaucuauuuuuuuuuuaauguuauacuuacucagucuccuuuccuccuccucucacuucaaaacuuaaaaaugauuauacaccacacacauuuacuggcaauuuuaaaugaaggugggauaauuuaaaaagacucuuuaaauaugguucaauucgcugcagggcugcuagaaaaauaaggaugaaguuuuuaggcaacgagaucuuagaaggagagggauguuagaaguauguuagcaagauacaguauauuguuauacauuuaaaaauaaaccauuuauuuuaagccuugcaagagcccagaaacauucaaaauaacuuuuaaccauguguaguuaauuugauaaaaauaaaaagucaaauaguacaaagcauaugaaggccucacucuccccauuauucucccuacucucuaauaugagucacugaugccuuuauuuuuucugaugguucacuccuuaucucuagauugugugaucacacccuauuuuuggauuuauccuauuuagauuuugauguaccacagugguagaaguuuugauuauugacacuuccuuuuucuuauccuccuuccaauuauaucacuguuuucauuucuguugcuggucaccugugcacguucaaacaguauacuuaauuucuauuucuuguucuaccaacuuucagcuccuugauucuacauuuuauaaaaugaagacauuggcuaucuuuaucauuacuguuauuucucucugauuuaagucucucaaccucuauccgcucuaccuuuauucuuacauuguccaaguugauaauguuuacaugcuggucuguaacuauaacuuaaaucuuccaugacuucucaugauucuaaaaguuaaacacauacuuuguuugaauuauguaaauauuacucauuguagaguacuaagaucacagaaguccaguguccuuuuaugaauccaauguccugugcuacucaaaggaaaaugaucuuaguggauuuuuaaaacacacauauuuauuuauauugccuuacaauuccugaagguuuuccuggcuuucacucauauuauugaaucugucaguuuuuuucuaguuccuggagaccuuccuguuaucuagagacaaggaaucccccccaacacccaauuuucuuccuuuuaaugaucucauuuuguucuggaguaauuuuguuuugcucuuuuguuuuucuugggcuuuucuuauagcagguuuuccucacauuucuggucaucaguuuuuauuugaggaugaaucaguagaaaaauugagcacugugaaaguggguuggauuuuugaacagcuggcuuagcuuuauuggcuaucaauuucuauuugacagccauacaauaaaggcugacuguaagcuguaugucccuggagacaggggccuggguuugucaacuggugggcuuuacuuuuacuuuaggacaguuaggggauaacuggcuguuuuauuggggacucaaauagcaguaguuguaugucuuuucuccugagguuguuuucuuacucuagagguuuuuuucacuccuauuuggggaccaugggcauaauguauucuggaccuggguggggaaggagguuuuggguugacuaucaggaugaagacuuuuucuucauguauuuucaggugucugccccauucccaugcucuucuaugccuggugucccccuaaucuggaguuccuuguuuaguucacccucuucagaauaugugcuuucuguuuccuauggaggaaggauccuggguaucuguuuauuuccauagacuuuuuauuuuuauuguuaauuuuuuuuucuuuccguuauuauuccaauuuuaguauaugugcugccaaagcgagcacaaauuccauagacuuuuaaacagcuccucuguuuucagauccuacgucaucccacuuucugugguaccuagugcuuuuacuucccgagacuuuucagaauucuguggggugaaucaguauauuucucucuaagcauucaaaguugaccucacucuacucuucgguaucauuuaccucuucuuguucacuuuccauuuucacagauuguggguaggcuuaccacaggucugauuucuuugaagaagcucauguuuguuucuuuuauccuuguuguuugggggcauuuuuuuuuuauuugagagaaggggacauagagucuuuaauucaccaccuuaaagcaggaagucgugucugcucuuuugauguaauguuucuagaaaauauuagagaaaaacuugucccagagucacuagucagguaaaagaauaugugauuggcuuucuccaaaggcucuuauuuucuguccugugugaaaaaggaaagggggucagaaugguugccaggucaugauuacagaagcucggcuguaagugauggaugaaaagcuugguugucugccuccauaguugagugaguuauuucacuucugggacccagugaauguucagacaguugaguaaucccacauuuggguaugugguaggcaucagggugaguaauauaugagaacuuggcauaauaauugggaauuauaaggagaguggcaauguucgauagggcucugucucaauuuccuacaauuucauuuucauugcugucaauaguauugguuuugcucagagaaugggggcauucuuaacuuuggcagaugcuaggauuauuaucauucuaguauuauuuuuggaagaagaggagauaaaaacugugcuugcccaugaacuucuucuauaugagcauuuuaaccaguguuuguuagagauguuaauaaucucaggcuccaauuuucuaucuccaguuaggaagccugguuuaucuugugacagaauaugagccauuuacuauuauacauguguguuaguccauucucacauugcuauaaagaacuacccaagauuggguaauuuauaaagaaaagagguuuaauuggcucaggguucugcaggguacaggaagcauggcuggguaggccucaggaaacuuacagucauaguugagggugaaggggaagcaggcacgucuuacaugguuggauaaggaggaugagagagaagggagaggugcuguacacacuuuuaaacaaccagaucucaugagaacucacucauuuucaugaaagcagcaagggggaggucugcccccaugauccaguuaccucccaccaggcaccuccuccaacauuggggauuacaauucaacaugagauuuguggugggggggaacacaaguccaaaccauaucaacauggcucuccuguuaucauccaaaacuuaacuuaccuggagaaagaaucagcaucugagauaaugucuauaaaguacucagucccaugcuugguuucccuuacccauugucaaccuccagcuuaguaacuccaguggaaaacaaggggcucccccaauaacucugaccaacaaggauuugccaagggcuccaaguggcccagcuugggucauaugcuaauucuggagcccaccacuagugucagaggaugguauacucugugggcccacaucuugguuaaguccucagcugcuugguaggugguagggguugguaagguaguuagucuuauuugaaucacacagaauuugggaauacaugcuggcugauaaaaacuacacguuugcuauagagagaagagacaaaacucuacaauagugguucucaaacuuuagugucuaccagaaucaccugggaggcuuauugaaacacagauugcugggccccauucucagaguuucugauucaguaggaguggcaugaggccccagaguuagcauuucuaacagguuuccaggugaugccaauacuacuggcguggggaaccacacuuugagaacccugcucucuagaacagugguucuuacauuuuaguguacagagacuuuucugggcuuacuaaaaguguuguuucugaggccucacuuccagaaauucagauuugagaaguuugggguacagcucaggaaugugcauuuuuaauguacccuagauaauucucauauaggagccacaggaguucagcagacuaugguaugauaaaugcugcucuguagguugcauguaacaaguauuagaaauuaaccauccuuauuuauuuauuuuuacgauauuggaacacuacuuuucuuuucuuuuuuuuucuugagacagagucuugcucugucacccaggcuggagugcagugccaugaucuuggcucacugcaaccuccgccucccgggcucaagcaauucuccugccucagccucccgaauagcugggauuacaggcgugugacaccacgcccgucuaauuuuuguauuuuuaguagagacgggguuucaccauauuggccaggcuggucucaaacuccugaccucagguaauccgcccgccucggccucccaaagugcugggauuacagucgugagccaccacgcccggccagaacgaacacuacuuuucuaauuuccacauguacguuugugucagucagcauccuagcaggaaauacaacauaucuuggaugauuaaaagauauuuuaggccgggcaugguggcucacgccuguaaucccagcacuuugggaggccaaaggcagguggaucaccugaggucaggaguucgagaccaguguggccaacauguugaaaccccgucucuacaaaaauacaaaaauuagccggugguggugguggcgaguaccuguaaucccagcuacuugggagguugagguaggagaaucacuugaaccugggaggcagagguugcagugagucgagauaacaccacugcacuccagccugggugacggagccagacuccaucucaaaaaaaaaaaaaaaguuauuuuagugaagggaucacugauagaagugugggcaggguuaagggaacaaauaaugaagcacacagauuaucagcaguggaagcuguuaucacuucuaaggugaagggacaggaggaggaaaugauauuauuuugagggcuuauuaagagagagggccauggagaaagguccuuccuccuacucuucauucagaugaaaaccucucacccccaaacagaugagacacgaaguccaaucaguuaccuuauugucaugggguaauauuucagccauauucccauuugaaaccaaaguugcauguagccaucacuacuacccucauacaagauagcaggaaaagagguguauugggagaaauaauugacuaguauaaaauauacuuagcuguaacagucuccaccauuguagcuagucaagaggcugacauugauaaucauaacuuccucucuccacuacucauuucauguuccucuuaguuuuuccaguacuuugguuggucacaauucuuuacuuuuauacccaaaaggauuuaagucuuuagugggccugucuuuacuggguuacuguaguuucccaucgauuuuaucagauaggaacauugugcuaagaggcagcccaaugaaucccuuggauuuuagacauagccuaccuguuuuuauugcaaagcagccaucuaguuuccucuuagaaauaaggaucaaucauucuuuaguacacuaaccuucuucucugcuuaucaccccuaugugguggagucucgaccagagaauucucugcuucaaauuuaguagaaccauggcuguauuccuugguggaagcuuucuuuuccugggaaccauauucuccaguguuuucacagugcuuguucauuaugagaaauccuuccauauaccucccucucuagaccuccuuuuuaaccaguauuucaguuuuguucuuucuaauuacuuaaucccaacccauuagcuauugcccaccuaucaguauaaaucuaaaucccaggucaucuuccauucccaguaaacugaccaccagauauauuguucaaauuuacaucuacuggaaaauuucuuuuuguaacuguuuuuuaaggauaccccuaagugggaaaccgauacuuuagcugacuucagguacaaggauaucaugcaaacccaucuguaaaccaggucuguguauuuuuuucuucuguucauugguuauggggaacuccucaugaggcaugaaagaggcagugaagcagcaaggguagauacuauaggaguuugagccacuagugcucauuaaauuuaugucuuauuuuccuguucauauauuugauuucuauuuaaucaaauagauuaaauugaucuucacauacccaauuucaugacucaguagaucaaguagcccauuuuuugauggacaucucuggucauguagucacugucuugauuugacaguuggaagucucaaucuuuuuuauuuuguaaguauuuaauuaaagcagauagcccacucagccaucuuuauaaugauuauuguuaucaaaaauuaaguccaguagucaccuaucucaaagcuuuguccuucacuggcacuccaucccacauugcagcagugaucauuuuaauaauugugauuucauugcauguccuauauuuuguuguuucauuuuuuuccccuggcagggaggucaucugcgcauucaucaaauaugugugagcaaaccaguccccaaaucucugcaaauccccaaguacuguaucaguuaaugacccagcaggaaauagauucauggcagaugauucaaaugaagggauuuuaaagcaagggguuacuuauagaagugugggaaugguuaagagaagaaacugucuuuauaguuaguaaaguaaguauaaacuaucuaauuuaagccauuguauuuugggauaucuuuguuauagcagcuuggccuuuucuguaauagacauaaaaauuuacauuauuaugacacuaguuguuacugauagcuaagacauuauuauauuuccuuucuuuuucucugagguuaaaaauaagacguaacuuuaucccuuuacccagguuugccuauuguuaauauuuuuaccuuauuugcuuuauguuuuuuccugucccuugcucucacuugcucugucuccuucucucccucucucucucauguguguacauuuuucccugaacagugugaaagaaaguauguauuucucaagaauagaaauauucuuauauaaccacaguacaguuaucaguuucccaaaauuacauugauauauaacauuuuuaucuacuguaucauccaaauucuaauuuugucaauuggucuaauaauauaauauaauaaugugcccuguagcacauuauuucccaucucaaugauuacauuuccauccuaacuauuacagaaucuaggcuagggauaggcauugcauuaaauuaucaugucuuuuagccucuuuuaauuuggaaaauuuccuccaauuuucuuugucuuuuaugacauugacauuuuugaagaauauagucucccauaccauuaaauuuuuuuucucauuuugucucuuacuucccugugauuaaaucaagauuauacauuguuguccaaaauccugucaagaauaggugauauugcauucuuccuauauuaucacauagaagcauccucauuaaugauuaauuuugaucuucugguuaagcuuguuaccugaauucuccacuguguaauuacuaauuacugguguuuuaugccuugcaacuaauaaggaaauguaaauauuuugcuuuucaucaacauucccccuugaauugauaacccauuagcaauucuugccugcaauaaucuuuacugugguaguugcaaaaugaugauuuccaaauuggcacuuccuucacauuugucaguugguucucaaucuucuacuguaagcaguagaucuuucuucuccccuauuuauuugucugcuuauuauguggauucaugaauuucaauuuuuuucuguuaguuuuaauucaauacugaaccuaauaauuuugaugcuuaaauugucccagauuuggccagugggagccucuuuaagcuggcuccuguguccuugugacaugucuucuuuuuuuuuuuuuuguuagcauuucuuuacuuucuagcauaguaagauguuccaggcuaaucugauaccuauccugcugcagccaucuauauaguauuagagaccaagauauagaugcuaggugugauccuguuacuaugguaucuuuacuuuuagccccuuucagggacagugcuagaaaauaugugcauguauauacauauauacauaucuguacauaaacauauacauauaugcacaugugcacauaaauguguacacuuacauauagauauaacuuuuuuuuuuugagauagagucuugugcugucacccaggcuggagugcaauggcgugaucucugcucacugaaaccucuaccuccuggguucaagcgauucuccugccucagccuccuggguagcugggauuauaggugugcgccaccaugccuggcuuauuuuuuguauuuuuaguagagaugggguuucaccauguuggccaggcuggucuugaacuccugaccucaggugauccacccgccuuggccucccaaagugcugggauuacaguugugagccaccaugcccagcccauagaaauaacuuaaaagucaugcauuccuaccauuauauccaacuucaguucauuccuacauaauucuuuuuugccauccccuauucaguauuuauauguuucuucuaagugaauaucuggcucucaacaucaagccacauauucauuugcucaugucuauaauacaucuaaaguagcugcagaauugauuuugaccauuucccuaugauaaacaaaccucugucucuguuuucuuuuucuagcaaauuccucuaaguauucguguucccagaggcugcuacuuccagugcugcacccuuucaaauuccuucucuguagccagagcuuugaacuuguagauccaacccauguugagaauuuuugcauuuauuguuucaccuuuuccuucuggggugguugggucugugccuuccauaaguccuuugcuuucuucuguucuuuuucacagaaucuuauaagccuuucuuuccucacuuucaauacccugaaguuugugguaguagcagugggcugaugguagaagugccauggaauuuguuucuuuuuucuucuacauauggugaaggcagcaaauguucuuucuccuaguaaugcagaaaguauggauucagugugguuuuauguuuuuucuaggaggguagggggaagugggugaccacuauuauuuucugaauucaggaaaauucuguuuuuuuuuuuaauuuuuaauuuuugugggcacauaguaggauauauauuuaugggguacaugagauauuuugauauaugcauacaaugcauaaucacaucaggguaaauggaguauccucaccucaagcauuuauccuuuguauuacaaacgauccaauuagacucuuuuaguuauuuaaaaauguacaauuaaauuauuacugacuauagucauccuauuaugcuaucaaauauuagaucuuauuuauucuuucuauuuuuuuguacauuuagccauuucuaccuccccaucccccaacuacccuucucagacuuugguaaucaucuuucuuuaucuccgugaguuuaauuguuuuaauuuuuagccuccacaaauaagugagaacaugugaaguuugucuuucugugacuggcuuauuucaccuaacauaaugaccuucaguuacauucauguuguugcaaaugacaggaucucauucuuuuuauggcugaauaguauuccauuguauauauguaaccacauuuucuuuauccauuugucuguugauggaagcuuagguugcuucuaaaucuuggcuauugugaacagugcugcaagaaacauaggagugcagauaucucuuugauauacugauuuucguucuuuuggguguguaacugggagugggauugcugggucauaugguagcucuauuuuugauuuuuuguggaacuuccucacuguucuucacagugauuguacuaauuauucccaucaauaguguuagaagguucccuuuucuccacuuucucagcagcauuugucacaguucaauguugguagguuguaugugucuaggaauuuauccauuucuucuagguuuuccaauuuauuggcauauaguugcucauaguaccuccuaaggauccuuuuaauuuaugcauugucuguuguaaagucuccuuuuuccucucugauuuuauuuauuuaggucuuuucucuuuuuuuauuacuuagucuggcuaaagguuugucaauuuuaucuuuuuaaaaaaccaacuuuuugugucauugauccuuucuacuguuuuguuaauuucaaauucauuuauaucugcucuaaucuuuauuauuucuuuucuucuacugauuuuugguuugguuugcucuugcuuuucucgcacuuuaagaugcaugauuagguuguuuguuugcaguuuuuauucuuuuuugauguaggcacuuauagcuauaaaauuuccuuuuaguacugcuuucacuguauuucauagguuucgguacauuauguuuccauuuucauuuguuucaagaacuuuuucaauuuccuucuuaauuucuucagugacacacugaucauucaggagcauauuguuuaauuuccauguauuuguauaguuuccaaaauucaucuuguuguuaauuuguuauuuuauuccauuaugguuagaggagaugcuugauauuauuucaaguuuuuugaauguuuaaagaaucauuuugugaccuaacauauggucuguccuugagaaugauccauaugcugaggagaagaauguauauucugcagccuuuggaugagauguuuuguaaaugucuccauuuggucuauagugcagauuaaauccaauauuucuuguugaguuccugucuaggagaucuguccaaugcugaaagugggguguugacauuucuagcuacuauuguguugaguucugucuuuuuagcucuagugauauguauuuuuuucuuuuuugagacagagucucgcacugucacccaggcuggaguucaguggcacagucuuggcucacugcaaccucgccucccggguucaagcgaauucuccugccucagcauccugaguggcugggauuacaggugugcgccaccaugccuggcuuauuuuuuguauuuuuaguagagacgugguuucaccauguugaucaggcuggucuugaacuccucugccucggucucccaaagugcugggauuacaggcaugagccaccgagcccagccagcucuagugauauuuguuuuauauaucugggugcuccaguguugaguguauagaucauuauacccuguugcuggauugacuccuguaucauuguaugaugaccuucuuugucucuuauuacaguuuuugucuugaauuaucuuuuguuuuauauaaguguagcuacucuggcucuucuuuugauuuccauuugcauggaaucucuuuuucuaucccuuugauuucauucuauguguaucuuuuuaggugaaguguguuucuuguaggcaacagaucaucgugucuuguuuuuucaugcauucagccacucuguguuuuaauuggagaguuuaguccauuuacauuuaauguuauuauugauauguaaggacuuacuccugccauuuuguuauuuuuuucugguuguuguguggucuucucuuccuuccugucuuccuuuuaaugaaggugacuuucuguggugguauguuuuaauuucuugcuuuuuuguguguguguaucucuuguauguuuuugauuugaaguuccugugaggcuugcaaagacugucuuauuacccauuauuuuaaauugaugacaguauaacccugauugcaugaacaaaaaacaaacaugcaaaagaaaacucuacacuuuaacuucauuccccugcuuuuuuuuguuuauuuuugauuguuauuaucccccugcuuuuuaacuuuuguuguuucucuuuaugucuuauuguacuaugucuugaaaauuuuuuguaauuauuauuuuugauugguucaucauuuagucuuucuacuuaauguaagaguaguuuacccaucaugacuaugguuuuguaauauuucuguguccuuacuauugccaauguguuuuguaccuucaggugauuuauucuuucucauuaacauccuuuucuuccagauugaagaacuucuuuagcauuucuuguaggacaguucugguguugaggaaaucucucaucuuuuguuucuccuucaugcuuaaaggauauuuuugccagacacacuauugaaggguaaggguuuuucuuuccuucaacacuuuaaauauuuuaugcuacucucuccuggccuguaaguuuccacugaaaagucuguugccacauguauuagagcuccacuguauauuauuuguuucuuuucuuuugcugcuuuuacgauuuuuucuguaucguugaccuucaggaguuugauuauuagaugccuugagaaagucuuaauuagguuaaaucagcuuaguguucuguaaccuucuuguacuugaauguugauauauuucucuagguuugggaaguucucuguuauuaucucuuugcauaacguuucuaccaccccucucuaccuccucaucaaggcaaauaccucuuagauuugccccuuugaggcuauuuuuuagaucuuguagacaugcuucauuuuauuauuuuguuuccuuugaccauguauuuucaaauaggcuaucuucaagcucacuaauucuuucuucuguuugaucaauucuacuauuaagagacucugaugcacucuuuaguauuucaguuguauuuuucaacuccagaauuucugcuugauucuuuuuaauuaugucaaucucuuuguuacauuuaucugaucggauucugaauuccuucucuguguuauguugaauuucuuugaauuuccucaacacaucuguuuugaauucucugucucuguuucucugggauugguccuggugccuuauuuaguuuguuuggugagaucuuguuuuccuggauggucuuaaugcuuguagauguuugucagugucugggcauugaagaguuagguauuuauuguagucuuugcagucugggcuuguuugugccuguccuugagaaggcuuucagguauucagagggacuucagcuccaagcacaauaucgcugugguuucugcaggcugguagagguacggccuugguagccuucgauaauaucuggaggaauucucuggaauacgaggcagagacucauauucuuuucccuuacuuucucucaauugaacguagucucucucucucugugcugagccaccuggaacuaggcauuuggugaugcaagcagucuuguggccaccaacacuggggacuguguugggucagcccugaagccaguguaguacugggugucacccaaggccugcuguaaccacuaccuggcuaccuccuauguucacucaaggcccuagaguucuccgaucagcaggugcugaugccagccagguuugugcccuucccuucaggauggcaagagcccccaggucccaggcagggacagagauuuuagaaauuugccugauguucaauucuacugcggcuaagcuggcacucaaaccacaagacaaaguccuuccugcucuucccccaucuuuccacagguagaggagccucuuccugugggcaccacuaccacuggcccacagaaguguucuggcaggccacugaccauguucacuuaaaguccaaggucucuucagacagcugugguaaaugcugccaggccugggacucacccuucagggcagugggcucccaucuggcccagggcagguccagaaauaguguccaagagccuaagccuggacuuggagaccccaggagccugcuuguugcucuaccucaguguggccaagcugguaccuaaggugcaaggcaaagucucuuuuacuuuucccucugcauuucucaaacagaaagaguguuucagcauagccaccacagcugggaaugugcugggucacaugugucauuagcaugucucagagcccagggcacacuguguacuaccuggguauugcugccgguuauucagggcucaggggcucuuuuaucagcauguaaugaauccugcuaagacuggaucuuuccuuucaaggcaguagguugccuuuugguccagggugugucuagaaaugucauuugggagcuagguccuggaaugggggccucaugacacugccuggugcccuauccugcaguggcuaaggugguauccaggaugcaagacaaaguucucuuuacuccucguucucuucuccuuaagcagaggauggagucacuuucauugcuguaagcugcacugucuaggguugggguaggggugacacagccacuccccuagccaccccggauugugucucccuagcucaagugccacucuaguccucuggcucugaacccagcuuagcacuaggaguugccuaggaauugcauaccuguguccuaaacugcuuuucauguguaccuaggauccgagagcacuuugguucaugauggcgaggccuguugagaaauucaaguuccuaccauugggaugggcgauuccccucuggcuacgucugguccaggugcucccuccuugcaugagugcuggcuuagcccaccauggcuuuacucucuguuauaucagggcagcacugaguucaauguaaaguccucaagucacugugcugucccuccaugaagugcacagacucuacacugggguaugagggaggggaggcaucugugauucaagacugugucuccgacccucuucagugacaugaaguuacuguaguuggucaucugauuuuugguuauacugugauaugaaguuaaaacuaguuaaacuucagugauauggaguuaaaacuacuacuuugcuugcucaucugauuuugugucaguccuuuuucaugggcagauagguguuaaaauuugguguuccugccaggaggaugaagccugccuguaggcuucuaaucugccaucuugcucugcccuccuaagacuuaauuuaaccaaauaaaugaaagaucuuuacaaugaaaacuauaaaacacugaugagaaaaauuaaagaggccacacacacaaaacagaaagauauuccaugcuuauagauggggauaacauugcuaaaauaucaauaccacucaaagcagucuauaaacuuaguucaaucccugucaaaauacugauauuauucuucguggagauagaaaaaacaaaauuuauauggaacuacaaaagacuccaaauagccaaagcaucccuaauaaaaagaacacagcugggccuggcgcaguggcucacgccuguaaucccagcacuuugggaggccaaggcgggcgaucacgaggucaggagaucgaggccauccuggcuaacauggugaaacccugucucuacuaaaaauacaaaaaauuagcugggcaugguggcggguaccuguagucccagcuacucgggaggcugaggcaggagaauggugugaacccgagaggcagagcuugcagugagcugagugcagugccacugcacuccagccugggcaacagagcgagacuccgucucagaaaagaaaagaacacagcuggaggcaucgcacuacuugacuucaaaauauaugacaaagcuauaguauacaaaucagcauaguacuggcauaaaaaacagacacauagaccaguggaacagaguauagaaacccagauauaaaucuguauguuuacugucaacucauuuuugacaaagaugccaagaauauacaaugaggaaacagucucuucaauaaaugcugcugggaaaauugaguaacaauaugcagaagaaugaaacuagacuccugucucuugcaauauaugauauucaaaucaaaauggauuaagaacuuaauuaagaccugaaaauagauuaagaccugaaacuaugaaacuacuaaaagaaaacacuggagaaacauuuugggagauuggucugggcagaaaugcacacacacacauagacacacacagacacacagagacacacacacacacaggaauauuauucagccauaaaaaugaaaucccggcauuugcagcuauuugaauggaacugggaguccuuguuuuaagugaaauaagccaagcacugaaggacaaauauuacauauucucccuuacaugcgggagcuaaaaaaguagaucucaugaugacagagaagcugaaagaggagaagcucuagaauaauuuuaugauuagauuaaacauguaaaaauaugucuaagauuuuuuguacuuagauuuuuacucugccacuuuucuugaauuuucuuuugucuuacaaauaucauguuuaggaaacuaaccuaaaagagaagucugaaugcugauuccauucagcaggggaaggguuguuauugccaucuguaguucauuguuacuaguuuccuuaugcuuggccauuugaggaucaaaggcuuuguuuaaugaccuugaacucugaucccuuacaaggcaaugcauauuucugacacuaggccacugggcuuucuguguucuuguuaaauauacaaugucauaauguacauacuauucuuuuggcuaguguaaugacauuucuacuucugcuuuuaauaaggcuaacucccuucuaaacacugucuuuaaaaauagaaugguucuuccauuaguagcagaaauucuuuacucuugguugacacacaauuuuuuuuguucccaaaccuaggccucaguccuauccuucaaaaaaacaagccgaacuuuguuuucuguuugccaaggaaagggauuagugugucugcacaaagaaaaguaauucuuuuccauacaaaaaaggauagguacuauauuccaaucaagguaacaaaccagugggcuaaaaaagaauugccuuuuaauugugaaaacauuuccugaucuuuuaaaaaaagaaaucuacgggaaguauaaaggcaaucagguaauaaacucauugaaaaucaguuauaguauuagcaaaaguuuacagugguuggcuuugucacauagucauaguuugugggagaaucuugaccuuauuugaugcuguaaauacuuguguuuucuuagccuauugauaugguaugaaggagucucuuggaugggccaaauugccuuucaaaaaauucauuguuuuguaaaauugggauuaccuuaaaagaaaaaguuaaccagccgggcgugguggcucaugcuuguaaucccaauacuuugggaggccgaggcggguggaucacgaggucaggaguuugagaccagccuggccaacauggugaaacccaucucuacuaaaaauacaaaaaaaaugagccggggugguggcgcacaccuguaaucccagcuacucaggaggcugaggcaggagaaugguuugaacccgggagguggagguugcagugagcugagauugcaccauugcacuccagccugggugacagagcgagacuccgucuccaaaaacaaaaaaaauuaaccaacuaaaaauacaaccuauagaagagcaaggaauauauuuggugaaauuugacacuuucuuuuuauugaaauuuauauuuuaaaauauauuuaaauguauuuaaauaaauauauauauugaaauuugauauaagaaaauuagaugaaauuuucucauauguugauguauuuaugguauuuuuugguuuugcuaaacagguuguguauuauuaaucauuugcuauagcauaauuuaagauuauuugcaguuucuaauuuuuauuaacacuaaaguuuuuuugacauucagcauuucugcucacaugagccauaauuauaucuacgaaguguuuugagcuuaaagcaacuuugaaaauggaagaaaugacuaacauuaaacauguuuagcuccucaaacacuaccugcugauuacuuaaauuuuauguggacuccauauaauguucauaauacaaauacauuucaauauuuugauacagaauaauguuuauaauucucagcaugcacauauauucuaaccaugcugagauaacacuagcguucaaacaacaguagccagucugauguuuaaaagaaacacuugcuagccgaaggacauuccucuugaggcauggacuggaaaccauguugaguaugcuaaguaauuccaucugaccugcagaaaaucacuauggguuacauuuucacuuugcacauaugucaucgaccaagccaacuggcuggaguaagcuuuuugaaauggacauuucuggcugagcuuuuggaagauugcauuuuuaaaaauaaagcauuaaaaaaaccauuauucauugguuguacauuaaaagcaaauggcgaaaggaaauaaacagaaguauaaaaaggucauaggaugaaaacauuaaauuguguauacaauuuuaauucuauuuguaguagguuuaaaaauaauuguacuuaauauagagccaaccucccuaaaaaagcaaaauauuuagaauuagacauuacagagaaggauauauugguacagauuaauaaagaaaagauuugacauuuuuccuuuuacaaguguuuaauuacaacuguauauagauuacauacuuacugagugaauauuuggaaaauugauguaaaucauuguacuuuuguccuuugaggaaauacauucugggcuggaaaaaaauuucaaauucagggaaaacuuucugaguuugaguccuugcuuuaccauuuacugacuuuguugguauaagguccauagucuuagccuuggauuucccugaaaauaugguuguauauuugccugacccugucauugucaguaaugaacuguuguuuaaaaguggcuuaagcuccugguaagaaagccauuuuuguaaauuuaggguauuauuuuuauagugugugguaacugaacuggccaagccagaacuuauuaaccacauguggcauugggagauaggcgaguauucagaaguaguuacagaagccuuuuaguuaguuaggauuuaccacgggcuucuucugugaaacucuuugcuaggugaguuacaagauaauacaugcuagugugcuagcccaaaggaaggaaagaaaccaauauaagaaaccaacaucaguuaaaugucaauuucugucacacauuguguuggugauugacacaucuuauguaaucaacuguuaucaguugaagguuuugagaggugacagcgugcuggcagcccuugcagcccucgcucgcucucggcaccuccucugccugggcucccacuuuggcggcacuugaggagcccuucagcccaccacugcacugugggagccccuuucugggcuggccaaggccagagcuggcucccucagcuugcagggagguguggagggagaggcgcgagcgggaacccgggcugcgggcggcgcuugcgggccagcuggaguuccgggugggugugggcuuggcgggccccgcacucggagcagccggccagcccugcuggcccugggcaaugaggggcuuagcacccaggccagcagcugcggaggguauacugggucccccagcagugccagaccacuggcgcugcgcucaauuucucaccgggccuuagcugccuucccguggggcagggcucgcgaccugcagcccgccaugccugagccucccacccccuccgugggcuccugugcggccgagcuuccccggugagcgccgccccgugcuccaccgcggccggucccaucgaccacccaagggcuggggagugcgggcacagggcgcgggacuggcaggcagcuccaccugcagccccagugcaggguccacugggugaagccagcugggcuccuaagucugguggggauguggagaaccuuuaugucuagcucggggauuguaaauacaccaaucggcacucuguaucuagcucaagguuuguaagcacaccagucagcacccugugucuagcucaggguuugugaaugcaccaauugacacucugugucuagcuacucugguggggccuuggagaaccuuuguguggacacuccguaucuagcuaaucugguggggacauggagaaccuuugugucuagcucagggauuauaaacgcaccaaucagcgcccugucaaaacagaccacuuggcucuaccaaucaauaggauguggguggggccagauaagagaauaaaaagcaggcugccugagucagcaguggcaacccgcugggguccccuuccacacuguggaaauuuuguucuuucgcucuuugcaauaaaucuugcuacugcucacucuuuggguccacacugccuuuaugagcuguaacacucaccgcgaaguucugcagcuucacuccugagcuagcgagaccaugaacccaccagaaggaagaaacuccgaacacaucugaacaucagaaggaacaaacuccggacacgccgccuuuaagaacuguaacacucaccgcgaggguccguggcuucauucuugaagucagugagaccaagaacccaccaauuccggacacaguuucacccauuucaugaguguuuaccaugugccaggcauuuuucuuagagucuuauaauugcaguuuauuuugcagaugaggaaacuauucacacuuauauugccucacaguugggaacaacucuucaggggaaaugaugagaagaguuugaagguuaaauaucauggcauaguuaaaaaaagggaggggcauauuuccauguugagggauggucagggcagaugcugcugauucuuuuugacuuugaccccuuguugcuaaaugugagaagcucucugagauugcgauguugagguuauuuccagucgacccgcaccugagauuugcuuugauguuugcuguguccuauuguggucagacugucuucaccauuguggugauugcuauguauauaaaacuacuuuguaccuaaugugugcauaaacauaaaggcuacauuuaagcaguuuugagcacgcuuauguuuaugaaaugugaagauaauucauuuucuggcauacaugcugugauuuuauuaguaaagaaaugaguucuaugugauacauuccuuuauacauauauuauuugccuauuguacauuguccaauucauguguuuacuuauuuacguuuauucuuauacagacuaguaccaaacaaauacuagugcccuuuuuaauucucacauuuacauggaguaauaauaacaaaaaugaaacacucugagcccaccuuuuaaauacaaguuuaaaauuucacuuggcuaaggauaaggagaaagaaaucauguuauaugguuuuaauuuauacuaagaaauuuguuuuacaacuacaaaauuaaagccauguaccuucucuaaaguguaagagaaaaaucuaaagcguuuguuagagguuuagccgugcuuuuuugcacaugcaguuucuccugccuagauugucuuuacagacugaugucuuaucaacugcggccaaagccuauucugaggcccagcucugcuggugucacuuucucugugaagcucugcuguguugguuguuucugcuuguuuauaccuagauaauuuguucauaccuuaccuuuaauuauugcauguguuauguaaugcuuuauuuuaguauuucuugacuucaacauuucuuucuugagaucagagaucauauuuuauucauguuuuuaaucuccaguacauaguccacucuguuccagucuguuccagacauagagcaaguagucaauaucuggaauaaaugaacgugcuaauuauauuuugauuuaaaaaaauugcguaugagacugaaaucaucaaguacugugaacuccauggaaaaaguauuuaaagauauuucaguucaguauuaaaauaucuaucuuugguuauuuuauucuaacaagaaaaaaaaauuagggaaaacugcuuucuacuaugggagguuauguccuugauuagaacaauucccuugcuuuuaaguuacucauuuuguugcuaggcagaaaugauaaaguguuguaauucuggaauaaaucuagaguacuucaggcaauucauguaacuaaagauaaagguuuuauauuguuccuauacuagagugaauuuuuaauuguuuguaaacuguuuaaaaaauuuucacaauccuacaagcccugccagaguugcuauucuucauugagguauguggcaaguuugaauuuggaaguguguuuguguuuacauuuuuaaaaaguauuucaugucaaaaauaugauaugaaauacuuaaaaaaucauauaugugauaugaaaugcuuaaaaaucauauauauauauacacacacacacacauauaugauaugaaauacuuuuggcuaaagaccaaauacaguauaagaacuuuaauccuaaaaggaaaauacuguuauauauacacacagugaaauaagggggucuuuguaaauuaaaggaagccaguguauaauuagcaauagcagauacaaugauguguuugaauauuuuuuggcuucuuguuuauuagcaugaacucuaugaaacuuuuaaauuucauguagugugugugugugucugccuaagaagucaaagucucaagcaugugacuguugauagaaaugauagauguuauaugcgguuauaccuuuuuagauuuuuucaucucuuauaacuaagauaucaaauugauuuuuugguugguuuaagagaaaaguuugaagaauagucccuaagcuagcagaaugcauggaaugggugacauuuuauuuauccugugagcaaaaggguaaggaucguuggcccugauuuccuguggcuuucaacagggaauucuaauaacauaggaaaugaaggaagaagaugcuucaucaccauuccuaccauuauugccugaauuugagccuucucuguuucucaugugcauuacugaaagagcauuccuacuggucuguaugccucauaucuuguuccaggucucccccgguuucuucuccuucuauucuccauuuuucugcuuuagaguaauauuuucaaaucacaaaucugaucuugucuuuguccugcuugaaauuuuuuguggcgccaggugcgguggcucuugcuuguaacuccagcacuuugggaggcugagguggguggaucacuuuaggccaggaguuugagaccagccugccaaaauugguuaaacccccgugucuacuaaaaauaaaaaaaaauauuagcagggcguaguggugcaugccuguggucccagcuacucgggaggcugagaugaaagaaucacuugagucugugaggcagagguugcagugagcugagaucacgccacuguacuccagccugggcaacagagcaagacccugucucaaaaaaaaaaaaaagaaauuaaaaauuccuaguggcucccaucacuuguaagaagaauaacaggguuuauauaagguucuggcccugcuaagcccccugaucugaucuuacuucaggucccaacuuaacacaauacauuaaaaaauuaauuuuuuaauuauauauacauuuauuuuauauuuuuuauggcagucaauauuucuaccccaaauuaauuuuuuaauugacaaauaaaacuuuuauauauuuauuguguauaacaggauguauugauauauguauacauugugguaugauuaauucaagcuaauuaacauaucuaucaucuuauauccuuaucacucuuuagugaugaguacauuuaaaauagacucuguuugcaauuuucaaguauaugguacacuacuauuaacucuugucaccaugcuguacaguauaucuucagaacuuauuccuucuaacuggaaccugaaaacaguaguugucuaacaacaacuuucucacccuucugccuaugcacaacacacuuuuccucauguuuuucauuuagccaacuccugcucauucaggauugaauucaugcuucacuuuuuggggagagggccuugaaaccaauuacaccuaccuuccucucacccccaagacuuaggaaugucuuuuaugugaaacuauaauacucuguauguucuucuaagcacuuacugugcucucuuacacuuuuaaaauuugucuuuuuuuuuuucacuagauuaugaguuacuugagaucaaagaagacuuccuuuauuucuucaucugugccugauagaacuuguguuuguugaaugaauggaauccuaaaagcucaaggggcuauuuaauauuuauuauauuugggucuauuuuacagauagcuuccgcuccaaggcuagugccacuuuguaguaauaauugcuaauuugauuuucuaaucucuuacuuuauaguugguaaauguuugcucuuaucaguuaacauagauugaaaguugacugaguauauuuaaaauuacuuuuuuccaucuucugugguauuuccuuaaaugggucucaguguguuuaaaugugguaaauauaauauuuacuuuuugagugggaauuuugugauuagucagauuuguauuuuuaaaauucugauaugaaauauuuauuauuuauaauacuacuaauaacuacauucauuggacauauuugaugaaugacuaugcuaaauuauuugugugugcuaucuuauuuaaucgccaaaacaauguugucaggucagugcaauuagccucauuuugcagauaaggauacugaugguuauagaaguuaaauuaguuacuuggguuuacacagcuacuaagucagagcugagauuuggaccugguggaucugacccuguagacugaauucuuaacuguucuauaucugucuguuguguuuauaugacaguaauugcaaauaauaauuugaaagcaguaacuucauuucaggcuuuuaaaagcauucuuacagcaaacauuucaguuaggcuuaacuugagaguacaguggcaaaauaauguguuaguaacaccaaauuuuucuggcuuaaaaaauauguuaauagauuaacaauagguucucccucuuuuuuccuucugucuucucccucaccuccccaccgaucuucucccuaacuuacuugucgaauagguuggauuguuuguccuguuaacgucccacagucuggauuuugcucauugcauccccacagugucuuguaaauguguuccucuguccacauuuacuguaaauuuguaguuagauguagaggacuggucagguucagguuugauuuuuuuggcaguacaacuuuacagcuaguguuucauucuuaugugaggaggcacaugcucccugguugucucucuuuuugaggcaacaguagccauugaugaucuaggcagugcuagagagcuacugauuuauuagggauuaaaaugguuauauuauaauuuuuauuauguaacggaaauacauuuaaaggaagaaaucucccuuuaucagcuaguagguuacccagagauauauucuuaggagaaaggcagaauaaaugcuuuguuguuucccuguuuucaaaauucaggguugguucucuagcauccuuugaagaugacaaauuaguaguuguuguuuucauauuauaauaaacuaauggauuuaaauaugugaugccuuucaauuuauugauauuauuguuauuauuuguuuauauuuauuuuuugagacaaggucacacucuuuugcgcaggcuugaauaccguggcauaaucacagcucacuguggccuugaccuccugggcugaagugauccucccgccucagccucccaaguaguugggaccacugguaccugcuaccaugccuaacuuuuugaaauauuuuuucauagagauggggucuugcuauguugcccaggcuggucuugaacuccuggccucaagcaguccuucuaccuuggccucccaaagugcugggauuauggacaugugccacugcacucaucugaaguuauuauuuuuguuaaugucaauauuguacaaucuuuagccaagggagcuuuucccaguugguucaucaacccuuuugacauagcuucaguagucuuuguuagcuuucuugcuucguauuaugagauguuccugccucaucuuuuauauuuccucucccagaacuggaaucagccacuucuuuaaggagcuugguucuuuuuuuuuuuuuuuuugugggaaauggcauuugaagaucacagugugggugcuggugguguucaguacuccugcugguuauugcuucugcacuguugugguggauagaguuaggaaauauacauacuuaguauuuaaagguaaacuauauuauggguucauauugauacucccaauuaugaugcagaccuacagacauuuuacuuauccucauugauuuuacauacauauauguacacaugugugugcauaugcacacauuuguauauauauuugcuggaagauguuuuuagauaagcaccuucagugguuuugucuuccaacauagccaaagguacagcacacucccuuuaguaauaaugccuugguggcaaugauucucauucuuaagggaaaaaagauauagagggggaaccuauagauucucacuggugagugauugucagugcaguuugaaaagugauccuuacucuuuccccuugauaauuugugacccagaagaggaaaauuucucaucucuauaguggagauuuuuuuuuuccaggagaauuuugucuauuaacauuggagaugauuuuuaauggcuuuuugaucauuagaugauaaucugcuuuagaguuuaaacaaauacacaggucuacuuuuguuacacauucuugugauuuuauaucugauaggucuuuuauugauaaguguuagauaagugcugcuggauuauagaaaacucuucuacuuucaauguuauauagaacaaacaaaaggauacaaaauauggcuagaauggcuagaauuaauacucaaaacaauuaaaaaauuaugauccagcaacuccacucuguguauauguccaaaagaaguaaaagcagggauuaggaaagauauuuauacauccuuguucauugcagcauuauucacaauagccaaaagguggaagcaacucaaguguucaauggauaaguggauaaacaaaauaugguguauauguacaauggaauauuauuugaccacaaaaagaauggaguacugauauaugccauaacauggaugaaccuuggagauauuauguuaagugaaauaagccagucacaaaaaagacaaauauuguaugauucuuuuuacauaagguucuuagaguagaguagucagauuuguagacccaaaauugaauggugguuuccaggggcuugggaaaggauaauggggaguaguauuugauagauacaaacuuuugcuuaggaaagaugaaaaaguuauggagaugaauggugguggauugcacaaugcacuuaugaauguaccuaaugccacagaacuguacauucuaaaaugguuaaaaugguauauuuuaccacaauuuuuaaaaaccacauagcaccaaaaaagagugaaugaguaaauuucaaaaagcugugucaagaaugauaauauauuauguaauuuguuuagggaccuuacagccaucaauuuuuuuuuuuuuugagacacaguuucacucuguugcccaggcuggaguucucagcucacugcaaccuccgccuuccagguucaagugauucucgugcuucagucuccugaguagcugggauuacaggcacacgccaccaugccuggcuaauuuuuguauuuuuaguagagaugggguuucaccauguuggccaggcuagucucaaacucuugaccucaagugauccccugccuugauccuccaaagugcugagauuacaggugugagccacugcacccggccuaaucuuuuuuaaaaaauuaaaaaaaaguuaauaguucuuugggaaugggugguuuuugguuacauagauaaguucuuuaguggcaauuucugggauuuuggugcaccugucagcugagcaguauacaguguacucaauauguggucuuucauccuucaccccauucccaaccuucccccuacccccaaaguccucuauaucauuccuaugcuuuugcauccucauaacuuagcucccacuuaugagugacaacauacgauauuugguuuucuauuucugaauuacuucacuuagaauaauggccuccagcuccauccaaguugcugcaaaagacauuauuuuguuccuuuuuauggcucaguaguacuccaugguguauauauaccauauuuucuuuaucuacuuguugguuaaugggcacuuaggcugauucuauaucuuugcaauugugaauugcauugcugauauaaacacacauguuuaugaccaugugugcacaugugucuuuuucauauaaugacuucuuuuccuuuggguagauauccaguaguggcauuacuggauugaaugguaguucuacuuuuaguucuuuaaagaauuuccauacuguuuuccauagugguuguacuaauuuacauucucaccagcaguguaaaaguguuucuuuuucaccacauccaugccaauaucuauuauuuuuuggcuuuuuaauuguggucauucuuguagaaauaaggugcuauaucucauugugguuuuaauuugcauuucccugauaaucagugauguugagcauuuuuucauguuuguugacuguuuguauauccuuuuuugagaauugucuauucaugucguuugcccuuaaauccuucaauauuuauuuaguugaagcaauuaaaaauaaaauaaauauuaauuugaaauaaaaauccuuaacagcuagauuauauuuucuuuuauucaaauucagaaaccuuuucauuuucuuucuuccagaagauuuagucacaaaaggaagaggaauaacuuucucuauacaguugaccauugaacaguguggggguuagggaugcugaccccuccuuuaagucaaauauccacguauaacuuuugacucccccgaaaauuaacuauuauuagccuacuguugccuuacugauaacauaaacaguugauuaacacauauuuucuauguuauuuguguuuuauaugguauucuuacaguaaagucagcuauaguaaaaaaguuauuaagaaaaucauaaggaagggaaaauauauuuacaguucauugagucuaaguggguuauuauacaggucuucaucuuugucaucuucacguugaauaggcuggggaggaggagaaagaggaggugaccccucuucagguaaccccaauuuugcugucucagggguggcagagguggaagaaacuccacguauaaggggacccacacaguucaaacaguuguuguucaagggucagcuguauuuuuauaucuccugacaugaaguuauaauuuguuuuugagauguacagagggaaaugaaaacagagaauuaaaauugaggaugaagacuuaggcuuuauuuauuuuaacuuucaaaaguaaauuuuauuauguauauuuaagguauacaacaugauuuaugaguuacauauagguauuaaaaagauuacuauagugaaacaaauuaacauauccaucaucucacuuaguuacccauuuuucuuucauuucuguggcaagagcagcuaaaaucuacucauuuagcauaaaucccaaauacaauauaauuuuauuaucuauagucuucauguuuuacauuaguucucuagaccuguuuauuguacauaucugcuacuuuuuauacucugacuucauauccuuguauacuucuaauuucuaauuguguauucugucuccccauuuucucccccugccaucugccccuggaaaccacuguuuuguucuauguauuggaguuuuguuuuguuuugcuuuuuuuacauucugcauauaagugagaacaugcaauguauuuuuuucugugucuggcuuauuuccuuuugcauaauauccuccauguugauccauguuguggcaaauggcaagaucccauucuuucuuagauaacaaauauuuauaguaauacaauaauaauauuccauuauaacuauauaccacaguuucuuuauccauuuguccacugaugcacacuuauguuguuuccauaucauggcuauugugaauaaugccgcaauaaacauggaagugcaaaugucuuugcaagauggugauuucauuucauuuggguauaugccccgaaaagggauuucugggucaugugaucauucuauuuuuaauuuuuuuggaaaccuccauccuauuuuccauaauggcuauaucaauuuacauuuccaccaacgguauacaagaguuccccuuucucuacaccacugccaacauuuguuguuuuuugccuuuuugauaauagccaucuaacgggugugaggaacuaucucauagugguuuugauuugcaguucccugaugauuaaugauguugagcaccuuaucauauacgucuuggccauuuguaugucuucuuuggagaaaugucuauuuaugucuuuugcccauuuaaaaaucagauuguuuugauacuauugaauuguauaaguucuuuauaaauuuuggauauucacuccuugugagauauaugguuuguaaauauuuuucccagccuguaggcuaccauuucguugauuguuuccuuugcuguauagaagcuuuuuaguuugacuguagucugauuuauuuauuuuugcuuuuguggccuucucuuuuggugugauuuccaagaaaucauugccaaggccaauguccaggagcuuucccacuguguucucuuagagaaguuuuauaguuccuggucuuauauuuaggucuuuuauccauuacauuuuuuaaaaaaaauuuucaauaacuuuagagguauaaguguuuuugcuuacauggaugaauuguauagcgaguagugaaguuuaggauuuuaguguacccuuuacccaaauagugcacauugcacccaacagguaguuuuucauccuucaccucccuuccgcccugccugcuucugagucugcaaugucuaguguaccacucuguacaccuuuguguucccguggguuaacucccacuuauaagugagaacuugugguauuugguuuucuguuccugaguuacuucacuaaggauaauggccuccauuuccaaugaaguugcugcaaaagacauuauuuuguucuuuaugacugaguaguauucuaugauguauauauagcacauuuucuuuauccacucauuaauugauagggacuuagguugauuccauaucuuuacaacugugaauugugcugcaauaaacauaugcaugcagguguguuuuuuauguaaugacuuauuuuccuucggguagauacccaggauagugggauugcugggucuuaugguauaucugcuuuuaguucuuugagagaucuucauauuguuuuccauagaagucguacuaauuuauauucccaccagcagaguacaaguguucccuuuucaccacaucugugccgauaucuauucuuuuauccauuuuggauugauuuuuguguauaguguaagaugaacccaauuuccuucuuuagcuugugggaauucuguuuuucugucacccuuuuuuuuugagauggggucucacuauguugcccagguuggccaugaacuccugaggucaugugauccuccuuccucagccuccugaguagcuaggacuacaggcaugugccacugugccuggcuccagcaacaguuguugaagagacuguucuuuauuuacuuauuguauccucuuggugcuguugguagacuguauuaauuuggguuuauuucuuagcucuuuauucuguuccucuggccuaugugucuuuuuuuuuuuuuuuuugccaggaccauauuguuuugauugcuauggcuuuguaauauaauuuuaagucagagaguguggugccuccaacuuuguuuuucauucucagaauuuuuuuuagcuauuugguuccauauaaacuuuuaugguuccauauaaacuuugggauuuuuuuccuauuucugugaagagugucauuuggauuuuggacccuuuauuuuuaaaacuauuuuaaagaaguagguaauuuagaugcuugggaaauccgaauuagaguauccuucaaaagaaauagacaggaaugacuuuuugaauuagaauucuuuguuuucaggguuugauuuauaauugaaacauaagaguuucuuucucuacaucaggguuuuacuacccuugacgcuguugacauuuuggucuagguaauucuuuguuguggaggauguccuauaugccauuaugggauaaauagaagcaucacuggccucuacccacuagaugccaguaguaccccucugcucccccauccagugugacaaccacugggggacaaaaucaccccuacugcucaacauuauaggaugaauauuaacaaaaauuaaggacugcauugcaaguauaacuuauacuccucuuuucuucucuuguuacaacuguuagaucugaauuagaauuuaauauaugucccuuuugaacaaaccaugagaagucauaaauuaauggauuaguucuuugguacuauuauacauuuuauuuugaggaagugacuauuauagcaauaccaaucuuucugauuuaguuaucauagucagauguuuuaauucuugcucuaaaguuauaucauuuuaaaaauuauacagguaaucuauuaauaauuuuaagaaaauuuggaaaaaugcagaaacuuauuaagaagaaaauuaaaaucaccuuuaauacuaaaguuuagauauaaauagaaauacauguacuuuuaagucaaguacuguugaaaaauguagugugguuuuggugaacacuuagagacuuuguagauuguaauuaaauccucccuuccuggguuaaaaugguaaacugugauuuuaaacaguucuucauuuuuuuuaagaaaauaaagaugcuagagcucaucauuauuuuuacuuccuuagguuugucugaauuguauaaauaauugugauaacauguacaaggauaucucugagauaaaaaggguuguuuaugaaugaauuauccauuugugagauuaauacuaacuuccucauauguguguaaaguaacuucuuacauaacacauuaaaccuuucaacuguucauguauaauauauggccuagguguaugugcuuguauauguguguguauauaucuauauguauguguaucuguuucuaauuuuauaaacaauaaaaucuagguuugaacagaagccauagucuuugcuauauaauugaaacaacauguguuuugguguaggcaaauuuaaggaaagucguaacucucaaacaauucaucuguuuagaaaaugguuucaggacuuuauauguuaaacccauaauucuauuacaauuguugaguuuuguaacaagaagcauuuguucuuugacuuaagccuuuagcagaguuuaacaauuagaaauuucucagaaugaugcaugcuaucuauugaagaaauaggggggguugagaaaugagccauuccuggaaagcugaaguaaucuucaagguuagaucugaaucuuggcacccauuguuuggguggcuauuggugaugcgaaaguguuaauuuauuuuuguuuuuauucucucuuuuuguuuuguuuuuguuuuuucucuuuuuguuugguuuuuauuuucucuuagaauguaccauugcaauuuugaaugauuucaaggaguuaauaaaaugucacaaggucacaaaaaguuuuuuuauaaacuacaaauaaucugucuaguaucauuuuaccuagaagagggaagcuuuucauuauuaacuuuuugcugaguuuauuuuuggaaucauuagagguuuauugacaaauagcugauuuuauuuugugugauacuuauuaaaggauaugaacuuucuauaaggaggaaggacauuguauuucauacacuauguuuucugucauaucaagcauuuuuuuucuuauaaaagcuacugguaucguauaacuggcaucccaaaauaagaagacaguaaucagcuguucagcuaucauagaugaagaguguauuugauuuaagaaggaaaaaucaaacaacugcugaugcuauaucuuuuuguuguguuaaagaugucuuuugauaaaggcuuuuaacuuugaaauuucuauuucuuuccaaaagcuaagaaaaacaaaccuuuuuuugacuauagguuauaugacugggacugugccaggugccagcacgugcuucuauuuacaguaguccccucauauccacaguuucacuuuccgugguuugaguuaccugaggucagcuguagcccagaaauauuaaauugaaaaauccagaaauaaacaauucguaaguuuuaaauugcucuucauucuggcugaugucugucccacccaggaugcaaaccaucuuuuugucccacauauccacccuguagacacuaaucuccuguuugucacuuaguagccuucucaaugaucacaucgacugugguggugaucacaguguuuguguucaauuaacccuaauuuuacugaauaauggccccaaagugcaagauuacuaugucuaauuuauaaauuaaucuuuaucauauguauguauguauaggaaaaaacaguguguguauaggguuugguacuaagguuucaggcauccacugggggucuuggaauguauucucuguggauaggggagacugcuauaauuuuuucccccagcuauugagguauaguugacaauuaaaaauuguauauuuuuaagguuuacaacuugaugauuugauauaugcaugcauuauaaaauauucaccacaaucaagcaauuaacguuccauuaccucauauaguuagcauuuuuuccuucccuuccuauuuuugugagaguauuuaagauuuacccucuuagcaacuauguacaauacaauauuuuuaaauauauucacauuguuuuacauuagaucuucagaagcuauucaucuugcauagcugaaacuuugucccccuugaaaucuauuuaucaucuaucauauauagauaucuaucuauauaucuauaucuuuuuaucuaucuccaucccuccaucuauccacacacacacacacacauacauuuauauacaugcacauauauguauauguguguauauaugaauauuugaauauauacagacacggguaaaaacaucugaacauuuuaagguuugaauggcauaauggcagucucaagggaauggagaaaaaguucuugggaaauacugauuuuuuucaacauucauuguuucaucauagaaauuuguuugaauggaagguaguaaaaguagugguuuuauaauauaaucauuuuuucuccuuuaauuuggcauugaugauauauuuugguuuugaauuuaauaugugacaaguauauuuuagcauuuuauuggaggaagugcuuacugacuuuuaaaugugaaaaugccauuaaguaagggauucuauugguuaucugaggacauggacccaaagaaagaauauguuuaaugauuuuuaggagugagaauuuugcauuugguagcauugaauaguuuaaguggcaucauuuauguuuacacaugaaaauauauauucuucuauuccccuuccucuuucuuuuuuuaugacaggauucagaucugaggucuuuugaaaguccaccugacauaggucaugaaggacuugccuuuuucuugagcaggagguggcaaucuuagcauauuuacuucuaauuaaaaccagaauccaauguuuuacuagggaauuuauuacuacuuuuaagcaaugagaauuuugaacuugggaguagaguuuucuuuuauaaaccuuauaguacauuugggccucagaauuaaaaaaagcuguugacugcccauugugcacuaaaaaggcuaaaagucaucauguuaguaguuuuguggcauucuuuuucauuauagugcuuguuuuauggguuuuauaaagaugcauuaaaauguagcagcuucuguuggaauaacaucaaauuaaguuugugccuuuacuggccacuuuuuuguccuugacaaaaucaacuggacuuuuaaagugauccacaugacugaagauggaaauauguaugcacuaaagauucaaagucacugagguaguggauacauauaccagaagugaaggggaaaaguagaguugauuccagacucuuaaucaccuuuaccagaaaugcuuguuuauuuucucccaaauuuuauauauuuuuaaaauuauguaaacaaucuuuuuacuuuucacuuugucugacaagaaacuggcuuagcauuuauuuauucuugacuuuagauauauagcucuuuuugaguaacgaaaaugaaaguaaugaaacuacuuuaagaaguauuuuuccuuauuacaccacuacuguauuguuuauaaauuagagaauacaaggucgggcauggugguucaugccuguaaucccagcacuuuggggggcugaggcaggugaucaccugagguugggaguucaagaccauccugaccaacauggagaaaccccaucucuacuaaaaauacaaaauuagcugggugugauggcacauaccugcaaucccagcuacucaggaggcugaggcaggagaauugcuugaacccaggaggcagaggcugcagugagccgagauuguaccauuuuacuccagccugggugacagagugauacuccaucucaaaaaaaaaaaaaaagaaaaaaaaauuagagaauacaguuaaaugaauacaaaacaauuacgacuguggauguuguuaaauuuuaugacuaauugugauugcuaauucagaauuuuauauauuuauuuauauacacauacauacuuuaaacaaaauggguuauacuguccauuauaagcuuuuccccuuacaauauacuaugccugucuuucuauggcaauauauauaaaucuaccucaucauuuaaaaaauacauaauuuauaaauauuuauacaacacauuauaauaugugcuaguaggauuguuauuguuuuuaauguauuuuaauugacaauuuuauauauuaaugggguacaauguaauauuuugaucuauguauacauuguagaaagauuaaaugaagcuaauuaacauauccuucaccuuaucaacuuauuuuuuuuguguggugagaacauuaaaaaucuguucuuuuagcaauuuugaaauauacauuacauuauuauuaacuguggucacugcgcaguacaauagaucauuaaaacuuacuccuccagucuaauugaaacuuuguacccuuuuaccucaucauuuuuaaugacguacaauuuguguuuuacacaugcauacacauuauaauuaauuuaaucagucaucuguugauguauaucuaaugcuuucaauaguuuuuauauuuauaaaucauugaacuuauuuguaauucuuuauauauuaaaaauauaaaaugaauacauuuuuauuaaaccaaaacugaaaaguuccuuuucauuucccuucugcagaugaaaucucacucuugugccaagguaaauaaaauagugagcaaccuugcaguuggauacaauguucaaugcguuuauaaacauauuugguucuguuuuauguuguuuuacauaaaugaggucacucuguauauuagcuuguaacuuccucauuucaguuacacggacaucuuuucauguccaaacacacagacuuuuguucuucuuugagcuauguacaauucuauauuuggauauuucauuauuuagucauugagauugcuucuaaaauuucaauuauggacaguguguuuuugcaguggcucacucugccuuaguauaugccuuuacaguaaagcccauggguguguauccucuugaucugucugugacauacauuuuagcauuuacauuuaauuucacuuaagaguagugguauguguugaucuugugguggaaaauagaggcaguuggcuaaauauucuagaaaguuugcagagagcuugaucaaauaagcucagaggaagagguuccucacuucaggauuaccacauucaucuaguaccuucuucaacaaccauuuaaauuaaccuucucacugaaagcccauuuggcuaauggaagauuuucacugacuuuucacucuaugaaaauaaauugauaaagauucaggaguuaucagcucuagguaugcuucucaguaauggaugcuuauucaaacuuuuacucuugugacaaucaagaucaguagaagucugguuuuuugaugguucagaugacaaauuucaguggauagaaauugugucaacugcuuucugaugaggugaaagccugcucuuucuguccucucuucucuuccucuccucccucauccucaagaauagagagccauuucauauacaguggacauuguuugcuccauuaaauaacaauagucuuuucagacugacugcuuauuaucuaagugcuuuuggaaagagggauauaaauccgccaauauuuaggucaccauuuuugcuaaaagucuucuaacacauuugccuucuugccaagguucaauauacauguuugaacaugugauuuuaaaaaaugugugcccaaacuuugaucaucaugucccauggcagagucagucauugguggggccugaacuucaggaauaguggggagugugauuccucaaaggucuuuuuuuuuuugagacggaguuucgcucuugcuguccaggcuggagugcaauggcgcgaucuuagcucacugcaaccuccaccuccuaguuucaagcaauucuccugccucagccuccugaguagcugggauuauaggcaugggccaccacgccuggcuaauuuuuguauuuuuuuuaguagagacaggguuucuccauguuggucaggcuggucucgaacucccaaccucagguuaucugcccgcuucagccuccaaaagugcugagauuacaggugugagacaacaugaccgacccuuguuuuuauuuuaacuuaaguaacaugcucauuguagaaaacuucauaugaaguuugcauuaagagggaaaaaguauuuucuauuuuugccacugagagcuuuaaccaaaugaguauuuuaggauuuuuuuuagccuuuuuacugugaauuuauaugcaguaaaaguggauucauauuguauuuauuaauuuaaaguccuuuucucacuuaaaaauauugugagcauuuccccaagucaauaauuauucuauugcaauauaaaucuaaauggucguaaagaauucugugguauaccccuauuaguggaauuguuucuaauauuuugcuuaaaaaauacugugguuauaaauuaccaguauuugaaucuccaugaguguucauuucugauauuucuuuagaaucaaaucccaggacuggauaauugggacaaaaagcuuuugacgcauacuuuaaauugucuuaugucacagagaugggcuuaauuuauguuuucauuagcuguguguaauaucugugccaauaccagguaguaucauuuuuugaaaguuuuuaaaaguuccuaaucuucaucaggcaaaagugacaucuucuuauauuugcauaauuuauaauaauaauaaaaaauauauuggggacuuacuuggugcuacuaccuacgacuacgcuaaggauuuaaacuaaacuuucucauuuaauccuuaaaacaacccuguaaaauaggugaucauucuccuuuuaggcaugagaaaauuuaagauuugcaagauuaagcaaucugcccaugaacacacagccuaugagugguggguuaucuuuuuaacuuuuuuuuuuugagacagagucuugcucugucaccaggcuggagugcaguggugcaaucucggcucacugcaaccucugauucccugguucaagcgauucuccugccucagucucccaaguagcugggauuacaggcacgugccaccaugccccaacuuugccuaaucauacagauguuuuaauuuuuuaugauaucaaauauuuuaaucuuuuguuauggcuucugaucuuuguauucucauuaagaccuuuccuauacuaacauucuaaaauauuuaaugucuuuucuuaaauuuauuuuuagauauggacuaggcaugguggcccacaucuauaaucccagugcuuugguugucugaggcagguggauugcuugaggccaggaauucaagaccagccugagcaauguagaccccaucucuaaaaaaauauaaaaaauuagccaggcaugguggugcugcacaccuguagucucagcugcuucagaggcugagguaggaggaucccaugaguccaggaguuugaggcugcagugauugugccaccguacuccagucugggugacagagcaagacccugucuuaaaaaaguauuuuuuaaagauuugguuuacaguagggcuccaguuuuccccccaaacauuuauccaguuguccaggcaccuuuuaugaauauucuuuucucauaugcuaaauucccauagucauuaauuuguuuuuagacuauuuauuuccuuugacuuauuugucuguaguuuaucuauaaugaaugccauaccauauaaaaauauuaauguacaguauguuuugcuguguaggagggcuaaucauucuucauuguucuuuuuuuuuuuuuuugagacaggaucuugcuaugucacccauaguggagugcagugccaugaucauggcucacuguaguuuugacguccugggcucaacugauccucgcaccuuagcuuccugaguagcugggacaacaggcaggcgccaccaugccuggcuaauuuuuuuauuuuguagagaugaggucuugcuguguuucccaggauggccuugaacuuggcucaagcaauucucccaccuugaccuccuaaaguucugggauuacaggcgugugccacugggcccacccauuguucuucaaaaaauuucuauguuauuuuugcuccuuuucacuucccccuugaacuuuaaaagauaguuuauugaguuccaugaaaaaaauuguuuuagaauauuauuuggcauugcauuaaaucuauaaauuauuguaaugcauaacuggcauguuugugauacaauuuuucccauccaggaacacaguauaucuuauuuauuuagauauucuuuuaugucuuucaguaaaaaaauuuuacguuuuaccuguauuaguuuuuugguugguuagaucuucucugucucuuuccuucccaccccacuugcucacuuccuucuuuucuuccauuuaugugccagcacccugguaggcacuauggauacaaaaucgaggucuguggcuucuuuaaguuuggggagggagauaaacauuaaguagauaaugauuaaguagauagcaauaggugucaaaucacaaccauuacgagggaaaagauaccauguuaauaaggguguaucuuagggguauauuacuuaauuugaccuuacuuaauguagccuuccugagcaagucaagaucucgaaguugaccuagcguuaguguguuaggaaccuaauugcuugguggcuauugugaaugaaaucuuuguuuuauuacuuuaaaacauuuuuuggaggggagggcaaggagaagacuagguaggcaaagcuauguugauaguuauuuuuccuacacaauauauaacauuccacucuacucuggcuuccauugauagaaagaaguuagguuucagucuuuuucuauuugcuuuugagacauucucugugcuucugcaguuucuuaucagguaucuaagggaugauuuauuuuuauuuaucccacuugggauuuauuggacuuaaaacuggauuagcauuggugacuuucaacaguucuggauaauucucagccauuauuucuuugaauguugcuuuuuccauauuuucucuauuauguaccugugaaaauccaguuagauauaaguuagacaaucuuaugcuauucuuuaugucucuuaacuucacauguauuuuccauucaucucuaguauuuugaugcaucuuggauuuuuuuagauuuauuuguuuugcuuucuaaaucacugcuauuuaguuacaaauucuuauuaaaacugcucuuagaguuuuguuaacuuuguucacucuuaauuauuauauuuuuuauuucucaaauuucuguucuuuuaaaaauuucgcuuggucauugauaaggucucuuaaucauuuuuaauaccugcuuuuauuuccuuaaacagaaaguguaauauuuuuauauuuucugucaauuucaguacacgaagucuuugcaguuuucaucucauucucuauuauuuuugcuguuucuuggucauguuaccuucaauuuuuuguguauuguaacuuugacuuugaggucauauucuuuugaacauuaucaaugggaaugauuggugucuuucuucaaagauuugaguaaucuuuugucagauguuuggugguacuuccaacccaguaucacuuuauacuaaaaucacagacugagguuucuugggucguccaauagaaugaauuuagucugcaaacccacauuaaaaucaguuugggguuuaugaauuccuaggauagauuuuuuuuuccuucaucugguuccagguuuugagauguguacuuuauuuugcuuucuccugggcuugagggggaaugcuauuuacaaguucuccuuacaguagagguagagcucuuuguggucuuugcuuuguacuggggagauaaagucaauaugaggaucuacuagauucuccacaaaaggugguccacaaguuuuuucuccuuuacuguaucucauuugagagcaggaaaacugaagcuuaugguugucugauuuaggaaaaugcccaacagcucuuuuuaccuuuaugggguucacacuuuuacuuaguuuuuagcuucuaaauuuuauuuacuuuuuuuuugcagcauauugauguacuuaaaaguacugcuuugaacaaacauuuuauacaguaauuuuagucugagaaucagggucuuauaugcuauucuccuccucuacuuguccccuacuuauuguuugauuuuauuuacauuugcaagcaauuaacaaagaauucagcaucaaguuuugucugcuaaagugaaauauuuaacauuuuauauuuaaauuagauguuacuuauaagcauauaaaaugcuaugguaaugauagaccauguuaaauuuggaaucagaaaggaauuuagaaauuaugucauuagguaccuacacuaugcauaacauucaguuggagaaacaguaggaagguuagaagacguaguguugaguucuggcccugcuacuuaccagcuguguguccuuuaauaaaucauuugaacuuucuugagccuuaggucucuccacaguaaaugaggacaauaauucuugacguucccaaguuauagaauaguuggaugugcuaauaauguauggaccacguuguaaauggcuauuacuguuaauucggaagucuuucauuugguucuguuaauuucauuggacuucuguuagaaaaggucaucaauguauucauagauugcuaccguuguuccucaaacccucuuaaaaccugucucaauucuuuagccuuccuuguuuaauuuccuccuuguaugacauuggagcucaguuaacuuuuagagcauagagcagaaaccaagaauuuugaaagcugauuuagaaauaucuauuggaauacacaaggaguguuacauaguuacacauguccuucacauucauaucugaugcagcugaauuccuguuuuaaggcauaaaauaaagccagucuuugauagagaauaguaaaagccuaugcaguauccaauuaauauugggaagauuuuuaaugggaucguacugccuacuugucagcagagggagccuuugucucacuuuuugauuccagaacucuuagaguagugagauuuuaacaagucagaauauuuauggaaaaugucuguuuccucaccuaggccugaauaggaaccaguuuuucuuuuguuccuggaagagaaaaacuuuuuguguuuguuuucugaguucuuuauaauaguuguucccaaguuccuuaaaaaugguuaaugcugaguuguaacagagguucucaauuacuauccuauguuaaaguuuuggauggucuuaagauaauggacgaaaaagagcuaauguaaguaaguuaaagcuaaaauuuauucaguuagaggacuacacuuagugaugacauuuuuuacuuccuacuuauuuguauuaguauugucuuuuaagagaauauuggugauuauaaucuauuucuuuaaaaaauuuccugacuggggccaggcggaguggcucacaccuguaaucucagcacuuugggaagcugaggcgggcagaucaccugaggucaggagguucaagaccaaccuggccaaccaacaugaugaaacccugucucuaauaaaaaauacaaaaauuagccagaaguggugccacauggcugcagucccagcuacucaggaggcugaggcaggagaauugccugaacccgggagguagagguugcagugagccgagauugugccacugcacuccagccugggugacagagugagacuccaucucaaaaaacaaacaaacaaauaaacaaacaaacauccugaugggcuuuucacaaggcugacaacccuacgauguucuccaguaguuucugaaauguuacaggugaaugaaauucaugagccugggaaucacuguuuuacugaguacuuuagcaaauaaaaauugacauuucugaauugaaccauuuccaacuuccuggcacauuuuuuccuaaccuuccucugggaucuuuucuauccuuugguauguaaagagugagacuuaauaacuaaauuaucugauauccaagguauaaauaaguaugggugcugggggaaguuggcuugauacuuuuuuuaaagcaugcuaaauuuugguuuaagauugccauacauuccuaccauguucuauguacuguaccagguaguuaauacagguucccuccuccccuccuuuagucuuucuagcaacccauugcgguauagagguuauaauaaggcuuauuuugcauuugaagauaccaacuggaugaaauuaaacaaaguacccaagucacauauuuaggaugugucugugaaagccagaauucaaaaccuuaucaucuuguguuucugaaucaaaaaucacugcccuuuccacuacuuauugguacuauaucuacauuugauacucuuuccauauuuguucaauuuguuguuuuaugauauaccauccugcuuuggaaacagggaacagucagggaguauccuaauuagugccccuuuuugguacuuugccugcugauaauaaucucuuguuuuguauugaaaagaaaaagacuuuguacccaggcucuaauaauuacuagagcuuuaaguuuaaucugaguaugcuuuugaagucagaguuuuaugaaauacuaagggaucuaaggaucauucugcuccuuugguguccacuuugggcuuccacaauuuauucuuugugguugaaugauuuuucuccuaauuuguauauuuuccuuguagaguucucagccaugcuuccuuuauuuccuauauuuuuuauauugucuuuccaguaggcuuuaucucuuuauuuuauuuuuuuaagagcagauuuaaccuuaaccuuuccccucucuucuuaacagaucuuaguguuucuaguguuaggcauacaaugaguacuuagucuuuugacuuaguucuaacucuguaauaccaagauggauacuaaacucuguaauaauuuugaaucacagucucuuaagugucacauaccaaaacuaauuauuucaggacuuucaccuuauauuauuuuuacuuugaugcuauucauucauucaguaaauacuuuugguucuaguggaugcgagggacuaucagggauggagaggcauggugaauaaaacauaauggcaguucuuauggaauugucaugugaauauggugauacuuucaaacauuuugguccucuugaugguaauugacauauugcuaaucuagaacuacaguuuaacauaguuucuugcuuuuaugaugguucaguuuaguuaaacagauauuuuuggagcacuaacauauaagagacugugcucaaugcuaugagcuagauaaugaaaagaaaauaaacaucuuuaaggacuuaagauauaaggacauuuagggcaggguuauuuuacuuggaguauuuggcugauggggcugggugagagggaguacuauguucauuuagcagacauacacugaggaguucuuuuggauaucuuguuuaugaauuuauacuuaauucuggagguacuggaguaucuuggaaguuuuugaguggguugauaacaugauugcauuuguauauuaagaugaauauuuugguauauuuguauguaugacuuuuacuaaacgugguauuuuaacuacuucccuuagaagaaaccaaggacauuuaagagaucaaacaauggcuaaauggcacauugaagucugugauaggaauggacaguucaggaaauuuaguguuguaacuaucccuaauucauuuugauuugccuuuuaaaaccauguaaguuuaaaucauguugaaacucagcugauaauuuccuggcuuuaguuguuuuuuuuuuuuuccacaacauuaauuaauuggucacagugaguucaguguaaacuaagguuuuuuucuuguuucuucuuuugagaugcuaaugauuuaagauuaagagaguugauaauauguaaaaagcaaauauuuagcuuuugaaguuaacgcuuuaugggacugauauuauugcaagugaggaauauuuauacaaaauaaaguauuuaauuuuuuuuguuuuuaaauauuuuugggaguauucucuggggucuuaucaugauuggcuauuaccuugaguaguuuaccuuaguuugaaacugguuauauuuuuaaaauuuaugccucaacguuauacucauucuuuaauaauuuuucuuuuggauacaggagaagaaaggaaugcuaaaguacacggguucuucuguaugauguugucugucuugucuuucuuagggagucauccuguaagaaaauaucaauauuggggugggggaagggagagagagaauacgaaugugaauauguguguguguuggggugagggugugcagacagagacagcucauuccccauucccagauucugacacacucacaauauucuucuuuagagaguucaauaguuagcauguuaaggaaauugcuauuuugaggaaaguuaacuuaaaauagucagaaaaucauuugaacagccaacaguucccacagaccuaaguuccgagagacuucucauauuuuuuaaagucuuaaaacccccccauuuuuggcaaaaaagaugaauuucugaguguauauguaugugugugugugugcaugcagucuuucucauguuaaauuuuauccauuuuucucugaaagaauuuuuucccuugauuuuuaaguuuuucaauuuuaaguuuggucuauaaggaauagaauaacccaguaauaucaauuacuuaacauuuagugaaugcuugcuagguacuaggcaguauguauuuuaauuauauuuaauccuuauugcaguaucauguaauauucucuucuuaccauuacuuuacaguugaggaaacugauagagcucccaggggucugggauaaggaugcagcaaacuuguccucaaguuguggcucugccaucaguucugaugaacaugucaucuucaucaccagugucucucugcacccagucccuccccucccaacaccuuccacccaccucuuuuuaaauccaugucucgaugcaugguguuccaucugcuuuugcuucucuaauugcuugggaaacucuuucucaaccugcaagacccaguguucugaagcuuuuaaucauccuuccauagccuuuuaaauuacuuuaauauaucucuguucuuacauuguuguacuauuuaauuaacucccauguucacccaacuuucugagaguagcgacugugucucuccuagcacauacuagguguacaaugaaugugcauggaauuuguugaaugaauaugaguuauggaaaauguuaucaaaacuuucaugaucguuccaucugacaaaauaauucacccaauauuuuguggaugcaagcaauaauauaauguuuagggccuucuuuuaaacucuaaaauugcauucauauugaaccuaucacauauaaugcuaauuuaaucaaugguuguaauuuucuuauauuauguuauuaaccuuguucacaguuuaggggaaaagauugugauaaauagcuugacagaacaccuaguaauggucuuugugaggcaauuaaaauuugcuauuaaaauuagacacauuaaaaugucaaaagacaaguucauaggagaaguuaauauguagacuuaaauuuuauuuucuuguaucuuaaagcaauuagucucaugaggcuauuuauuggaguaacacuugaauuauaguugagaauuuguguaacuuucccugguacaucauuuaaaauauuagcuauucagcucaacauaugcauucuauuuauucauuucuucuguuuacuucagguuuuaaaauguauuuauuuaugccuaagguuuuaaacuuagaaucuaauuggauauugcauuauuauuaggcacuaauuaucuuuagaauguucaaacaauaacagaauaugagggagagaguaauaagaaagaagcuagcuauucuuucaucuaauuaccaauuauuaguuacuaagcauagccaaauaguagcaugaucucaaaacuaugauaguaguuuuauuugcaugaugauaugagugaaaaguacaaaaaugauauuuaauggcaaauuuacaauccagcaaccucuagauauccaucugcuauuuguuuuuaaggcaguaucuguuggaauccuacucugaauauuuuuaugucuuuguucauagcaaacauguuguaucauuuuugagguagguuugcaauaaagauuaauguguuaguguuucagucuuucuguaacaauaacaaauuuuuuuuccgugcaugcguaaaaugaacaaaaugagcggaaguuccacagacuuuuggacucuucuguucuuaugcaucagucucuugauguuuccugucugccuuuuugacuaccuauacagcuguuuuuuguguguuuuucagacuuggagaaagaccaaauauuuuugacagcugcaugcugaacugcauauaugcuuggccauaggucacguuugcauuucuucacuuguauuuuuacucaauguguaaaagaaauaugagcauagagagauucaaaaaacauguagcaugcugaguaaugguaguuuucuuucauguuugcuacaccacuuacucugcuguauauauuccacaggaagagaaagacagagaaauggaggacauggcauucaggacugcccuccaugaggcccuuguugccauaauaaugaaggauggaacaugcucugggucaugcaugguagaaagaacuucugggcauggggacacacacacacacacacacacacacgcguacacuccuacacuucaugaauagauuguaauuuucaugaauagauuauaauuuaauagagaagacuguuaaauuuagcaguaugauuaacauuuaguugauuaccaguuuaugcaucauguuaaagcuuugacuauaugauauuuuaaugccagaaaaugagacauacuauugaauaaauguucaugacaugaagcugccauaauggaacuuuucugccucuaccccccauccccacaggcaugaauuuuuuuuuuugccuuugaaaaugaaaaauaauugauuuuuaaaauccucucaaauugaucuuggucaguucuuucucaauuuguuuccagaucuuacaaguaauauuucaaaucacaacaguuguuuuucucuuauugugcucaaaaugacuagaauaaaauccagauuuuaaauucuguugaaaucuccuaguuuuuuuccgauuuaaaaauuauuuuuuccuguaugguuuaagcauaauuuuugaggagucauuguuaagauauugucaucuuuucaauuugugcuuuuauguuucaugcucuguuggugaaacaugauccauugcacuguggaucaaguauaauugccucugcaucuuuuucuguguuccuuuucuguccaauaauuucccucuacuuuuaccuuugacugcuauucacucugccaaucuuuugcaguccagggugcaucguaucugucaugaaaucuuuccuggaaauuuuauuguaaugcaguucuuugauuuucugcaguguuuagucuguuuuacaccacuuagauuuuguauguuaaugcauauuauuuuaauaaauggauauaaauuuuccuucccaggguuucaguguguuauaauggagccagauggauuccuauuugaauauuuguugucacuuucuaauucuuugacauuagacaaauuguuuaaguucugcagguuucagucuucucguguauaaaaugggacuauugucucuuuuuuagaguuacuaaaaauuauaacuaauaaugcuguuuaaauguuuaacagaaggccagaaauguaacaggugcucaguaaauggcuguaguaguuaauauugcuguuguuccauauuucuuacagcuccugauauaauacugagcaugugguaaagacucuuugaguaugguucauggcaaggucauuuaaauagcuucugaaaucccauugcuuuugugaaggcuuccuguuggcucuguucugucagaaugacaaaacuuucauggcuuuuucuggacuguucuuucuauucccauuaucuguaaggggagccuuugguauguauucugaagugguuuccaaaacagugauuugaaggauuuauuuauuuauuuuugaguaauguuuuggaucaaucucuacauauuucuaaacaucaguagccaagauuguaauaaauaaagcauuuuucacauacuuuguaugcagagugaaacacauggaauaaaaucucagccaaucugagguacagaugaauaaauuauuuugccuagcuuacuucagcucaacagacauuuauuaauguaucuccuaugugccaggcauuuuauaguugcuggauuuacaaagaugaguaagauaugguuucugccuuugaguuaguccagggcaaaugagagacacaaaaacagaucauuucaauagaugacguguucuaagauggaggugggacaggggcucugugggaucucagauggugggugauugaagcggaaugagaagacuuauggaaagaugugagucuuagcuugugaugucucucagaggaaaaaugcgcugaucuacuugauucagggacagagaccugacucaaagugacuucaguaucuacaggaaugaauugccugcagaguucagaggaagauuuggcuccaggugaggcuugaugcacuggcucaaacagugucuaccauggcucucucuuaacugcuuuuggaaaagccaaauggccucugugauuccauaccguaugcuccucacgcauuacucaccagggaagaguaacuuuuccucuaguuccagcucaaauuagggaguucauuuuucucucauuggcuguaaauuaucccugaaccaaucacugugacuacugggguacuaauugguuuacauaagucagggccuugccucaagcuuagagugaggucagucucacccaaaccuuauggcugagcaugaggagaggggaauggauaacuagggggaagcuagcaaauguuugcuagaugagggggagaaaaguuaaaggaucuuuggaggaaagaaaauuguguaaacaaaagcaaggaagcaugcaucaucaugaugugugugggaaauagcaagcaguuaaacauuaauacaacauguaguauaagaguuagaaaauaauuauagaaauaauaauguguuuggguauuuuccacugcuaggucuaguuuccauacauuauuuuauuuaauucucacaaguuacugaaguaguuacuccaucuugcagauaaggaaacuugagucuaagcucacagcuaauaauugguggagcuggacucaaaccuagauuauuuggcuuuagaggcagccacuuggacuugaauauauuaaguguucuccucuauguugcuagaguuucaggaaauaggaccuguucuacuaugcuauauuaggcuguucucgcauugcuauaaagaaauacccaugacugguaauuuauaauuggcucacaguucugcaggcuguacaggaagcaugaugcuggcaucugcuuggcuucuggggaggccucaggaaacuuacaaucacgguggaaggcaaaggaggagcacacaugucacauagugagagcaggagcaagagagggaggggggaggugcuacacacuuuuaaacaacaagaugucgugauaaaucacucacuaucauaagaacaguaccaaggggauggugcuaagccauucaugaaggaccacccucgugauccaauuaccucccucccuccaggcuccaccuccaacauuggagauuacaauuugacaugagauuuggacagggacacagauccaaaccauaucauaugcuaacaggccagguuuucucuggggcucaagcuuucuucaggccuuacuuuuucauccuaucaugcuaagguagugguucugaaacuuuagcaugcaccguaguagucucuaggcuuguuaaaaccuagcauuucugggcucugugaccagaguuucucauaugguaggccuagauugguaucuuagaauuggcauuucugagaaguuccuaggugaugcaaauggugcuggucugggggccacauuuugaagaccacuucuuugaggucuuugggagacugaagauuugugguucgaugauaccacauauugaaaugaacacaaauuuuauugguacuucugcuugcaaguacacauguucugagcuuacagucuucaauaacacagauaucaagaguauuauuuugguuaccauaauaucuuccaccgcaggucaaggucauugcauaaauauuucauaucuuaauagaaaauauaucgacauuuguauuuacauacaaaauguauauauuuagacuuaauuuuuuuauauuuuuguugugaaaaaguauauagaaaaaguaaaaugaaaacccauauuucuaccacaucaaguuguaaauauauauguauuuauacacuuuuuuugaugaaccauuugaaagugaguuacacaucuugcaccacuuuaccauaaauacgucagcacacaucucccaaugagaauauucucuuacauuucacaacgccaugaucacuuaagaaaauuagcaauaauuccuuaauguuaucuaacaugcagucauauucaaauucccccaauugucccaauaucuuuccuauaccuguuauuuuugguaccaggguucaguuaagugaaacuaaauuuuaagagacagcaaugcuggauggaucuuuaggcucagauuagguucuguguuauuuaagaucuggguuugguugcuuuaacaaagacuagacuuaaugauggcuuaaauaagaaagauguuuggccgggcgcaguggcuuaaucccuguaauuccaggacuuugggaggcugaggugagcggaucaccugaggucagaaguucaugaccagccuggccaacauggugaaaccucaucuuuacuaaaaauacaaaaaucagccaggggugguggcgagcuuguaaucucaauuacucgggaggcugaggcaggagaauugcuugaacccgggaggaggagguugcagugagccaagaucgugccacugcacuccagccugggcgagggagcgagacuccaucucagaacaaaacaaaaagauguuuauuucugucguguuuaaccaucuggagauaaaggagucuagggcugauagagaggcucugcuguccacaauacgugacuuucaucucugaggccaagacaacugcuccagccuuaccaugaugcuacaaagaggggagggaaguguauaguugguccauguaagggcaugucugcaaguuguauguauaaccucugcuccuaucuuguugagaagaacauaauaauaugaugcgucuguaaauagaggacuguaaguggaagcuuuauuuuggauggccaugugucuagugauaauucaugauucuacuacuaaagaaagaauggcuguugggggcagcaguuagcaucucugccaaaaguucuuuuuugcaaaaaaagagcuauaccaaacuauauuaaauccacuuaacaaugauauuucucuuuuugagauauauagggcucauaauugcuccuaugcuaacugagcccagacagauguucuuuuuuggauuauuugauauguguuuuauagauguucucuuuuauuuuuguuagggcauuagcugucauuucucacagcugacagugucuucacccccuuucuaauuuaccacuuucuuuuuuucugggcuagggaagcagguaauaauaacccucuuaauaaugcuauaauuuauucugugucuuaugugugcuauaccauguuagggacuuugacaucuuuccucuaacuuuggaacucuuuuucagcauuauugagauaugauugauaaauaaaaauuauauaucuucaagguguguacaaugugauguucugauauacauauacauuguguaaugauuaccagaaucaagcuaauuaauauuaguauggaucacuucucauaauuaucuucuuuuuugugaugagaacaaagaucuauucucuuagcaaauuucaaguguccauuauuauucacuguaaucacugugcugugcauuaggucuccagaacuuacucauauuauaacugcaaguguauaucauuugaccaauauuuccuugcuuuccccaucccugaccccugguaagcacccugcuacucucuguuucuaugaauuugacuuuuaaaaaauauuacacguaugagugagaucauguaguguuugucuuuuguugucuggcuuauuucauuuagcaugauguucucuagguucauccauguuguuguaaaugguaggauuucuuucuuuuuuucuaacaugugaggugauaucucauugugguuuugauuuacauuucccugauaauuagcaauguugagcaccuuuucauauaccuguuggcgauuuguaugucuuauuuggaaaaaugucuauuuuaguccuuugcccauuuuugaauugguuuauuuguuuuuuguuauugaguugugugagcuucuuauaucuuuuagagacuaauugcuuaucagauauaugauuugcaaauauuuucucccauuauguguuuuuuuguugauuguuuucuuugcugugcagaaaauuuuuaguuugauguaguccuccccucuauuuuuuguuuuguugcuugugcuuuuuguguccuauccaaaaaaucauugccaauaccaaugccaugaagcuuuuuaccauauguuuaccuucuggaaguuuuacagcuucagaucuuugguuuaaaucuuuaaucuacuuugaguggauuuugguuguauaguguaagauaaggaucuuuuuuuuuuuuuuuugcauguggauauccaguuuucccagcaccacuuauugaagagacuguucuuucaccauuguguauucuuggcgccuuugcugaagauuagcugauaaccuuggagcucuuauacaaauauacucauuuuacaaaugagaaggcugaagcuacaggaauaucaguaacuuguuuauaaaaacgacaauucuuagaaccauaauuaaaauaagaauugaugcccuuagugggaccugggaauccuaccuuugaaaauuugcaugauuuuuauuacaaagaccuugcagcauuuauuuuaacuacuuagaggcauuuuuauacuuacucauuuuugcugauugcagacagguagguuugccagauagcuagaugagauucuuuuugucugauugugucucugugaauacauguguacagcaugcauauacauacaacaugcauauaaacucacaucuuuuuuggaaacuuuuaauagcauaguggauaaggauaacauuaaaaaaacaaagcuuaggcugggcgugguggcucacgccuguagucccagcacuuuggaaggccaaggugggcggaucaugaggucaagagaucgagaccauccuggccaacaugguugaaacccugucucuacuaaaaguacaaaaauuagcugggcgugguggugccuguagucccagcuacuugggaggcugaggugggagaaucacuugaacccaggagguggagguugcagugagcugagaucgugccacugcacuccagcguggcaacagagugagacucugucucaaauaaaaacaaacaaaaaaaacaaacaaaaaaaaccaaaacaacaaaaacaaagcuuaaaacaguaacuguaaagccuaccauacguuauaaaagaaucugaguauugagagaauacuuuucaaacagcauuaauauaaacaauuuuuaucucucuaaaagagauuccugaaugguucagauguauguuuagugaacauucauucacagacaauacuuauccuagaacaucuuucaggcuauuuaagguugauaaaucuauuguaucaguugagguggguuagaguauaaugcaguaauaagcacuccaaaacucaguuuguucucucucuuuuuuucuuuuuuuuuagccucuuuuggugauauguuuucuuuuuaaaaguugcuuagcuguaugauuguccuuagucagauacaagaagaguaucaucuauuucuaugcaauuugauuucuuuuugagcacucuuuaaaaucuaaguaugcuauuuaagauugucacugauauucaagguaauaaagaauaguuacuauaguacuuacuguauaugguguaugagcuagagaugacaagguacaagauuggccuuuuauuuauucccuuaaugaguagcuuaauuuuccucuaacauaauuuuucccuauguaauacauuauaggauacacuaaucacacuagcaggacaugaaagguuauagccacuagaucuuucucagauuagggauacuaauguaucuauguuuucuauguaucaguuuucuaugauaaacuguaucaguuuucuaugauaaacuguaucauagaaaucaucaucauuaccaucaucucaguaaauuuuaagaacugugaauauugugcuuaauacugguagacuaauaguagaagacaccucagaauuaguuuauaguugagggcaauuagggauugguauuuuucacuauuaguaauuuucacaccgaaugcugcuuaaugcuaugauuuauguaaaauuggugccuaagacauacauguuguagauagugauuaauaaaaauauuauauuuauaaaaagaauagauuaucuaauuuucucuaauucuucuuuaggucgagauuuaauuugcauccagucuauggaugggaugcugaugguauuugagcaggagagcuaugcuuuuggaagauuucucccuggcuuucuucugccugguccucuugccuacaguucccguacagauuccuuccuuacugucucuuccugccaacaaguggaaaguuauaaguaaguuuggauguuaagucuucagaaucaugauuuuuuggugcguuuguugcugacuaauuuuuguccacaaagagcuucaauaucacaaaugaaaaagagaucgguuucuuugaaaauaugugauuguggugacuuagacuauaucauuuacuauuguaaaauauuugaaaggcaauauagugcagugguuugggaggcagaccuggauuggaauccugauuuuaccacuccagauguuugaugguccuuauccuggcucuaaaggagguaauauagcucauuuugacaaguuuauuauaaggauuaaauguauguccaguuacuacccuguagaaaaugcucaauaauuauugugauuguuccuugauauaauaaauaauuaaauacgauguugagugaaaaaagccaaauugaagauuuagcuguggaauucuuuuauaagaaaaaagaauaugugugauauaggaaaaauacuggcaugaacuguuaauaugaaugucaauacuuuuuuagaagaacaauucauaguauaagugaaguaugaaaaugacccuaggcaaauaguuuauacuuauucgcuagaaauucuuauuggucuugguaaauuguguaugagagagacuguuuucuucuccaccagcuagauuuaaauaaaagucaagguuuugaguuuuuggagaguauguuuuuuauuggcagagagaauggggaaaagaguagaaauucaugcugggaaaagaaauagccuuggagguuuucagugccuuuaguaacuuuauuguguugucuuacugguggcaacauuuggaaguuuaaacaucuaagcaacacaucaucauggcuuuucaacauuauuuuuggccacaucauuauucccaagaugggaagaagauauaaauucaucaggcaacagauguaaauuuuugucuucauguuucaauguuguguauauaacaaguuaaugcagcuuucucaucauaaguagccauuugcuuuuuguaaaucauugucaaggcaucuaggguuaaaacucugaaaauaagugaauguuugugaguaagcagaauuuaaccgauuuaggaaguguaucaucauguaauauuccuucuguaauucuuauggcucuuauccaaaggagaugauugaaugguggcauugcuauugguaauaaauaaaauauuauauuuauuuggagagguugggaaaaauaucuguauaguuuacucaagccugccaaacuugagcaauauuaggacaucugcuuuuuagcuuuccacccagcucugugccucaccuccugccaaguagugcuaugcuagagccacaguacaaauauuuaaacacccaguuacuuacucuuugaaauaugugcauaggaauuaauuugauaauaacucugggagugauuggauagagaaguaauguguagauuuccuuaaugugugaguuuaaucuaacagaagcucacauuguuuuaacugugguaagucuccaacauaccaaucuauuaaauucaucuuugucuuagacuaaaaaauguacacguuaugcauuauguggcucauuuauaaugguaaaaaugcaugagauacgagauuauugugaaaugaugacaaucaagaagguuuacaacauuaagucguauguuguacuuauauaugcuuucaacuuuaauagauuauauuaaaugauaaucacugcugcauuuuuggauuuuggagaaagcaugaaaacuauguuuguucuuuugaggcuuuauuaaaucugucuauauucaguuaauauaauauaaucaauuaauagaauaggcuuuuaacacauaacucauuuucauuuuugauauugauaccuuuaguuucuuuaaacccugcuuaauuauguuuaaauaaaaaccagugaaggcuagggaucucaaacuucaguguacguaggagucaccuggacagccuguuauaaaaugcacuuuuacagaugcuaguccccaguccccuagauuucuuuuaauagguuaggggauaagacccagaaaucaucauuguaaauuuuuacuccagaucaaucuaauucaggggcacacuuugagcaccauuuuucuuuuugaaguaagagaauuguuugcccugagacauuuuuuuuuuuuuaauagagacggggucucacuauguugcccagacuugucuugagcucuugggcuuaagugaaccuucugccuuggcuucccaaagugcugggauuacuggcauuagccaccacuccuggucuguuugcccuuuacugaggguaaggguaagggcuuugguaccacuguucucugggccauguauguccaaacuuugaucaucuuuuauucucuuuucuuauccuuugccuugcagaauuauuuagucaguaaucccugcccuuaauacuuucucuuauucagccucuccuucccauucccauugguucaggccuauauuuuuucacuuggauuuccguuuuuuuuuuuuucucucuaaacuuugaagguuucuucucauaucuuuucuuuuaaaacaccuccuuaagccagaauaauuuuuauuucugacuaaaagaccuagacuuuuuucuuuuuuuuuuuuugagacugagucuugcucugucgcccaggcuggagugcaguggcgcgauuuuggcucacugcaaccucugccucccgcguucaagcaauuguccugccucagccucccaaguagcugggacuacaggcgcaugcugccacgcccagcuaauuacuuuuguauuuuaguagagacaggguuucauuguguugcccgggcugguugcgaacuccugagcucaggcagucugcccgccucagccucccaaagugcuaggauuacaugcaugagccaccacgcccggccuagauauuuuauuauugacauucagugcuuuuuauaauccagucccauuuuaccucuaugauguggacuuuuggacuuggaagugacuuuugaaguuaacugguucaacugucuuccuuuuuucaccuccuagauauauuacugccuaaaacacugauuuuuggcuaaugucauguauugccuucuuguacugacauuuuccagaguaucuugcauuaucagguucuugagagaagaaucuguguuaaacaucucuucacugacugaauaauucaguuuguuuauucagucauucauucagcaaauauuuuucaacaggcuugugugccauacacugugcaagguacuggaaauguagucaaauagacgugccucuuauccucaaauaguauucaaggaggcaggaagucagucagcuacuucaguccauuugucauacaggcuauagcagagcuuugcauaggaugcugaggaggccucgaggugggaccucuaagaguugaauguagggaggcucccuaaaagaguauaccugccauggguguuauuucucuccuucugucugcuauaccccuuccccagcaaccccucaauagcuccuaauacaucacuaaguaaauaaucagccuuaaauaaauauuuaaaaguguuucuguugaauuuaauugacuguuuuaaaaagaaguauucuucuccaaucuuuggcucugaccaaauggaaauauuuguagucuccauauauguuaaggguuuuucucucucuccuuuuuuuuuuuucccacauacugucuaucuccuaugucugaagugcuuuuccuucuuucucugcacguggaaauuaugucuagaagccucccugcuccccuucaguucuucccugaccuagauguaaccaacaucuccuuuuucucaauuuacauaguaguuuuucagugcuucccuuagguauuacuuaugcuuucacugauaguaaacauuuguuuuucuccuugacuaagcucagugcuccucgauggcaggaauucuguauccccugaagugcccagcacuguaccuuggugaaaguggguguucaaugagaacugauaaaagagugaaaaguguauaaagaaagcuucuguuuuguuacuggcaucuuucaaugaaaaggauucuccccggcauagucaagaauguuuuagcuauaguugaaaucaacauaauaaugcucugugucucgagcuuccauuucuaguaaaguucucuggguuacauaucaagguuccaaaacuuccugccacucacugaggugacaguucuguuuauuuugaaaauaaaugauuuuggaggguuuacuuuugugcucugugaugccucaaucuauauuuuaguuaccugcuacuguuuuuacaaagcaauuuggaagaguauuaaauuaugugguugaguuuguuauuggugcacuacaggaccugugaagcauuugugguuagugagucaaaaagcaccaccguuuagcugcacuugguguaguugcgauuagugccuuucuguucugagagacauguauggcacucuuucauaagaucuuguuacauuggcccugauuauucuuucagcaaucucgacaagggaacuuuuuuguguagcuuauguuacugaacacuugagugguaagaaaaaagauccaaauauuuuauuucagaauuuccaaaucugcuuggaauuguuugguuuuagaaauagauuuuuacauacuuuauuggucacaguuaagaggaauuaaggaagaaccauaaaauagaugcucuuguaaguuugucaucaucuaauuuuacugucaaguuuaaguaauaaaauacucuucugaguugucuuuuaggaagagaaaugguuuggauuuggaaaucaguagucaauuuuggcugugccucugccugcuguuuuaauguuaauaaggccgcuuuaggggcucacuuauuucuuagauaaaauaaugaccauaguuauauauauaagcuucaaacagcucaaagaguuuuggaccuuuguaacaaucucaugaauaucuauauuaucccuuggcagguugguuucuguaggaaaugaaccaccuauguaacuaauugccuaggguuagauccauagcaggacaagcuuugggaugauguucuagucaccagcgcauacuauuucuguugcuaugaauugggaauaggaaaacaauccuauuuggaguucagaaugugaggucuaauuauuuugcacuuuuagagacuuugggauuuugaaggucaaucucagaugguauagagagauuggcugcagcugaccgugggauuuuguagcauggucuuacaaggcugagaucuucucccucuuacuucaugcgccccaugacucauuccucccugucaugcaucucuccuaaacuccugucauggccuuucaugucucuuuuacugcugcaugccuuugcauuuguuauuugauuugccauaaugccuucuccuucuuuaccagcgugauagaauuuucacucauccuuuaaaaccuagcuuucucuuccugaaccuauaccaagagcauaucuuuucucccccaauuacuuguuacuauugguacuacgugcauaccuucuguuaauuagcacaggauacucugaguuauacuuagcugucuguauaugagucucuacaacuagugugggagcaccuuaugaguauagauuauguaguaguuuuuccauuguuaauguuuguauuggaucccuacuauauguuuauaaaaugaaugaaauuuauauauauuacguuuucauauuaauaagaucuauuuuuuauaagcuauuguuaaguuugucaucaccuucuaugucuuggaaaauuuaaaucauagucauucugcauucaacugaaguuacagguuuuuuauaagugaauuauucuugauugagauaggauguuuucagaguugguauaugacauuugaagaccauuguacauuucagugcuuguuuagauaugccacauugccuucauucaggucccugauuuuuacacucucagauaucugugucuuagaaaaugugaguuuugauucaauaggagggaaaggcaucugugagucuguaguugcuuuauguacaguaggauuauucuucuaaaaauaugccauuaauuaaugagaaauauagaaauuucaacuuuauuagauaaauuaaucauuucuagauugaauaauauuuauaaauuguuuuuaagaauaauuugagcuaaaugccacuauugaaauagaagcuguaaaauacuuauagaucauaaugucgauuacugagaacucacuaccuaccagcuacaaacuacuaugugauugaucucuaucucuauauaaaucugucucuuugucaacccaucaaucaauaauuguauaccuacuauauaccaaauaguaggcacuuuauaauuuauuguuuaauccuuuuaacaaugauuguguuagagauuauuaucucuguuuuauggauggggaagccagacacagagugauuauucaccaaaaauguacuuaccuaguuaagugguuaaacugggguuaaacugaguucuuuuugguuccauagauuauguauugauaauuucuacuccaucugacugcuuugcauauuuacauuuuuuucugucuauuugguguuuaggugcuagaucuuucuugagcauuguuacuugucacauaaaauucuaauggaagugcuuuaauaguugguagagcuguuuucccaacacugaauaauggacauaugguuauaauuucuuuaucaugacauuuuacacaguuuuaugucacaauaucacucaauaagaauucaaucuuaaauuuuagaguuuuuaaaaacuaggaaaaagugcuuuauaaaguuuauagauuauuguguacuuuuaaaguuuaaaauaauuuauaauuuuuaauuauaaacucauuuauaauuuuuuaaauuucuuucauacagguaccagguacuugcuuuugcaacagaugcagauaaaaggcaggagacugaacagcaaaaacuugguucuggaaaaagacuaguuguaaggccuuuuuuuaauauauaaaaauuucaauaaugcuauaucuaaucacauauguuugucaauaauaauucaugggaagaaaauguaaaaaaauaugucagccauucucuuuccuauauuaugguuauauuaaugaccuaagaauugaguugguuguuguugagcaauggaaacacaugccuggucauggucuuaauauaacagauuguagaguuguaccacuagaacuguggauauccagauggagucacuuuuaacaaauaaaaauagaaacauuaaaaaaaucucuccuuaauaggcaaaauuuuguagauuauauucuauuguuugaagugucuuuuuucucuagcugcuuuccagauuuucucuuaucacuuguuuggagcaaugggauuauaauguguacuuuucuuucucuuuuuuugagcuuaagauuuguuaagcuucuugcaucuaugaauauuuaguuugcauaaaauuuagaaauguuuuggccauuaauucuuuaaauauuuuguaacuaguaggcaugcgaccgaauauauaaguaaaagauaaaaauucacagcucacaaagauagaauuagcucaaagacaaaggugaaguuugauaauuugaaaaguaguuugaagaaaaauuguaaaugaugaauucuccauuuauuguaaauuggggaauagauggugauuaugaacucuuccuuaucuugagaacuuccauagacagcaaggcaaaaaauagaaggaacuaaaauuaugguggaaacagugaaauaaaucugaggauacacaagaaggaagcuaaauggagaaauaauguagaauuuagaauacuaacauaacaguauuggagaagacuaugcagaauuuucuguauuaggauacagaaguucaggagaugguagaacagaaggguaacuuggaaagagucaagaaucagaugaagauauauuuuuuuucauugguaguaaaaaguaaaagagcacaaugaauaaaaauaugauauaguuuugcacagaauuuagaagcaccauaguaauaauaguuaaagcacagauugaagucaaacaggucuugagagcuuuacuuuuuuuuugagcaaguuacagcaaguuuguuagccuuacuaaaucucaguuuccucauuugcaaagugauaauaucuauuuuaaaauguuguuauuaggcugggcgcgguggcucaugccuguaaucccagcacuuuggcaggcugaggcagguggaucacccgaguucaggaguucgagagcagccuggccaacauggagaaaccccaucuccacuaaaauacaaaauuagcugggcaugguggcccaugccuguaguucuagcuccuugggaggcugaggcaggagaaucgcuugaaccuggggggcagagauugcaguaagcugagaucgugccacuguacucuagccugggugacagagcaagacuccgucucaaaauaaaaaaaguuguuauaagauaaauuagguauuuauauauaaauauauguauuguauauaauaaauauauaaagcacauagcaaaaugucuggaugaacuuacugauaaugguaauuaaauuguccuuugaccuccucaauagugguguucuuccauuuguuucuuauagucugcacuucagccauauagggccucucauuguuccaaauauuccauggcucuucuucauucuaggcauaugguuuuucuucugucuggaauagccuuuccuuaucauuugcaguuuuuauugauuacuccaugucucacacugaggauguauucugaaggcaauugcaguugagugguuuuuccauucgauuagugaauagaguaagaaauagcaguaaaacuucauuuuguuacacgauagucacuuugcaggaaugugauaccauggagcaauaucaaaucuauugcagaagaaacagaacuuacccaauggagugauuuuaauaagauaguugugggaagucauuuaauagcuuccuguguuacucacagcuaccuuuuuauugauugauuucuauuuaagucuuuuguguucagaaaaauaauuuguaugauuuaaauucucuuagauucauugagauuugucuuauggccuagaauaugaucuaucuugguaaacguucagugugcaccugaaaagaauguguauuuuuuuuguuguuagaguguuucauacaugucaauuagauuauguuggaugauaguguuguucaacucuucuauauccuuauuaguuuuuuuacuaguuauuauuaguuauugagagagggguauugaaaucuuugacuguaauuguggauuuuuuuguaucuccuuggaaauaugucuaucuauaucuauauuuauuuauuuauuuauuuuugagacagagccuugcuguguugcccaggcuggaguguaguggcacaaucuuggcucacugcaaccuccgccucccggguucaagugauucuccugccucagccuccugaguagcugggacuauaggcauguaucacuauguccagcuaauuuuuuuguauuuuuaguacagaugggguuuugccguguugaccagacuggucucgaucucuugaccucgugauccgccugccuuggccucccaaagugcuaggauuacaggcaugagccaccacgccuggcauauaucuauauuuauuuauuuauuuuuugcuucagauauuuuggaauucuguuauuagguacauaaacauuuaagacuguucugucucaugaugaaccccuccccuuuacauuaugaaaugaccuuuauccuuuuguuugauaaucuucuuuuuucugagaccuacuuaaucuguugguaaaauacucaguuuucuuuugauuaguguuauucugauaccuuuuucuaucuuuccacuuugaaucuguuugucccuuuauacuucaagugcauaauuuauaagaagcauguaguugguugggauuugcuuuuuaaaaucagugugauauauacucugccauuuaauuuuguuuuauuuaucuauaugucugucuaguuuuuuugguuuccuuuuccucuuuuucugcuuuucuuuggauuuauccaguuuuuuuuuuaaauucuauuuuaucuuuguugguuuauuagcuauaacucuuuguuuuguuauuuuaguguuugcuuuaggguuuccaguuuuucucuuugacuuaacacagucuaccuucaggugauauauuaccuuauauauaauauaagaaguaugcuucuguuuccuaccuuccagucuuugugcuauuguccuguauuuuauuuuuacauaggcugugaaccccauauuacauuguaauuauuuuugcauaaauaaucaauuauauuuuaaugagauuuaaaugacaagaaaaauauguauuuacccauguagguaucauuucugcuguucuucuuuaauuuguauaauuccaucuuuccaucugguuucauuuuccuucaaacuaaaggaauuccuuucacauuucuuuuagugugggccugcuggugacgaauuuuucauuuuuuauguauauacuguucuugagguuaucccugggacacaguuaaguuacuuggaaacaguuugauuuuugggggccuuguucucaagacuuguuaagugggaccaggguagugcucauuuuagggcuacuuauucccuauuccucaggcaagauccuucuuaguacuguaccaauucacucagaauuaugagguuuugcagccuggcuggugggcacaggaaauaucuuauacccugugugaauguugggcacuguuaucucuaaucuuuuuugggugguucuuucccuggccuugugugguuuccuuacaauaauuugccaguaaguacucagcugaauauuugagggcacucucugcagaucuccagaguucugucuguaugcagcauuuauauguagcuauuuggugugcugucuuguuaacuccaacugcugugguuucuccagacucugaguauccaucuccacaauucacagagucugcugggcucugccuagguucuucuucccugcacuauggccuagaaacucuuucaaggcuggagcaaucaugccacucaccucguuuguuuucugucuuuaagggauugcugugcuuuguugucugguguccagugccuugcaaacuauuguuucauuuauuuuguccacuuugucguuguuuuaggugggaugcuaaaucauuuccuuauuacuccaucuuggcuggaaguggaagaauuuuuuuuuuauuauuguucuuagcaaauuucuguguuuuaugagacucauuaauucagaauguaguguauuucccuaaguggaggucacagaguggcauucaguaccugguaaauugaaaguauuuaguggcuggaucucagacuguggccucagaaacaugauuugccuguucacuuuggauaaaucaccucucagagugaggcacacaucagcccgagguacagacacugacguacaaagccaaaugcuagccuguuacaauauaaugagaaauauaacugucaugggacugauauucauguccuguccaguggagucauuuuauauagguaagcaauacuugagccaaauaguaaucaaauaauuucuuaguguugaauucuaguucagcuuaagauagucugaugcaccuaccuauguucacuaggcugucucccuucuacagauugaucuuauacauauacuggcaauauuugccuuucuggccagccccauuuggauuuuauaccuucuucaaauauuuuaauaucuaaaguagaugaauaccuaagaucaugucuugauggccaaaaauucaucuugucuuuaaugugacuuuucaugaucuuuucuuggauccauuguuuguugaucauagccuaacuuucacagcagcccuauuuccuguuuaugcagauuuuucucugugaaaccaucucauuauuacuuucauauacaauauaugccugucagggacccuggcuuggguccacagcucucccauuuugggccgauuaauggauugauugcagcucugcaucucucuugggugaagccccaggagacaagacccuuggcuccaaccacugcuaagguccauuccucugcugccucuaagcuggggagggaauauaaagcuugagaucuccccagagaggcagagugcagccugggagugccaagcugugauuuacagccagcacagaagugggagaagagcugcacuuucagagcauugauacggaacaugauggcaaccauugcagugagccaagauugcaccaccacauugcagccugggcaacagagugagacuccaaauggaaaaaaaaaaaaaaaaggccaggcgcaguggcucauaccuguaaucccagcacuuugggaggccgaggcaggcggaucacgaggucaggaaaucgagaccauccuggccaacauggugaaacccugucucuacuaaaaauacaaaaguuagcugggugugguggcgugugccuguagucccagcuacucaggagucugaggcaggagaaucgcuugaaccugggaggcggagguugcagugagcugagauagcuucacugcacuccagccuggcgacagagcaagacucugucucaaaaaaaaaaaaaaaggagagaaagagaaaauauagaggugccacauaagugagaaagagccuacuuacugaccaaugcacuugcuaacauaccccacuuugaaaccaaaggcaagaauuuagcuauaaauaaaaaccuugcagaaagcuucagcccucugaaaacauccagaaaagaagucuacugacuauacucaauuuacaccucacgaaaaggaauacucaugcacacagaugaaaaaaaaccagugcaagaacucuggcaacucaaaaggccacaguguuucccuuccucuaaaugaucgcacuaauucuacagcaaggauuguuaacugggcugagauggcuaaaaugacagaaauagaauucagaauauggacaggaaauaaagaccauugagauucaggagaaugucaaaauccaauccaagaaaucuaagaaucacaauacaaugauacaagagcugacagacgaaauagccaguauagaaagaacuuaacuggaccugauaaagcuguaaaacacacuacaagaauucguaauguaaucacaaguauuaauggcagaagagaccaagcuguggaaagaaucugagagcuugaagacuggcuuucugaaauaagacagucagacaaaaauaaagaaaaaagauaagaaaugaacaaaaccuccaagacauuuggcauuauguaaagagaccaacuuuaugacucauuggcaucccugaaagagauggggagaaagcaagcaaguuggaaaaccucucucaggauaucauucaugaaaaauuccccaaccucacuagagaggcugauauucaaauucgggaaaugcagagaaccccugcaagauacuauacaaaaagaucauccccaagacacauaaucaucagauucuauaaggucaaaaugaaagaaaaaauguuaaaggcagcuagagagaaaggucagguuaccuccaaagggagcuccaucaggcuaauagcggaccuuucggcagaaacccuacaagccagaagagauuggaggccuguauucaauauucauaaagaaaaaauauucaaccaagaaugucauauccagccaaacuaagcuucauaugugaaggagaaauaaggaucuuuucagacaagcaaaugagaagggaaauuguuacuaccagaccugccuuacuagagcuccugaaagaagcacuaaauauggaaaagaaagacuguuacuaaccaauacaaaaaacacuuaaauacuuaaauacauggaguaaugacacuauaaagcagccauacaaacaagucugcguaauaaccagcuaacaacaaugacaggaucaaauccacacguaucaauacuaaccuugaauguaaacaggcuaaaugacccauuuaaaacacacagaguggcaaacuggaucaaaaagcaagacacaauuguaugcugccuucaagagacccaucucacaugcuguacaccuguaggcucaaaauaaagagaugaagaaaacucugugaagcaaauggaaaaaagcaggagcugcaauccuaauuucaggcaaaacagacuuuaaaccaacaaagacuaaaaaagacaaauaagggcauuacauaauaguaaaggguucaauucaacaugaagaucuaacuauccuaaauauauaugcacccaacacaaaagcacccauauucauaaaacaauuucauagagaccuacuaagagauuuagacugccacacaauaauagugggagacuucaacaccccacugacccuaugagacagaucacugaggcagaaaauuaacaaagauauucaaggucugaacuuaauacuugaccaaauggaccuaauagacaucuacaaaacucuccaucccaaaacaacagaauauucauucuucucgucaccacauagcacauacucuaaaauaaacuacacaaucggauauaaaccaauccucagcaauucaaaaaugucaaaauauccaucaaagguagacuggauaaagaaaaugugguacauauacaccauggaauacuaugcagccauaaaaaagaaugagauuaugucauuugcagaaacauggauggagcuggaggccauuaucuuuagcaaacuaaugcaggaacagaaaaccaaauaucacauguucucacuuaaauaucacauguucuuacuuucacuugagguugaaaggugggaggagggagaggaucagaaaaaauaacuaucacauacuacgcuuaauaccugggugauaaaauaaucuauacgccaaaccucugugaaaugaauuuaccuguauaacaaaccuuccuauguaucccugaaccuaaaguaaaaguuagaaaaacugaaaacaguauaugccuuucugccaauguuuuucaaaauggugugucuuugcucuuuugcauuuuccugacuuagaaauauuguauggaagaugaauccugaaaagcucucauuuuacauucauucuuucauuacuuuaagaagcauuuauugaacauuaacuguaucccagcaauauggagauauccuggaguagcucuuauguauagaauauucugcuauacucucuaguggcuuggugacuacucuguauaugcauauugauauauuuuuaguugcccuauaaaaacacauguacaaucauaaugauaguuuuuauggauuauuaaauuugauuugcaaauuaagcacaauaucauuuucauggaaguuuuuuagggaagcagauaaguguuuuaguguucuugaauugcagaauaguuaauaucauuugguaagacauggaacaaaacuuugauuagagucuuguaaaauaccagaaaaauggucauagugauaaaaaaaagaauaaagaaaugaaagagauuagcccaucuuuauauuucugcuuuguuguaaagcaauuucuuaauuuauauugauaugaaaauaacugaaauuuucugagguuagcaacuaaauugauauugaguuuugcuuuguagguggauuggacucuaaauauuggagagcaagcccuugacauauguauugucucuuucaaucagucggcauccucuguuuuuguucuuggugagagaaacuuuuuuugccuuaaggauaauggacaaauucgauucaugaagaagcuugauuggagcccaaguuguuuucugccauauugcucagguguguagaaagauuuucuuuuaucucuuccauaugucaaggcuaugugauauacaccagaaaaagccacacucauacacauauuguaaacauauaugaaaacaguuuaauauugaauauguaauggaaauuuuaacuuucaaaguuugaauggaaguuugauauaaagcacacauuugguuuugucagucauuuuacuuuguacaaaaugacuuguaaaauuggccuccggcauacauuaauacuuuccauaauguggcuauucaagaugcuuucaagagaacaucagacucuuuuauaagcacaauaguaaugucuaauagaaugaauuaucuguagugaaugcguaguaaaucauuagcuuaaauguguuacauauuaaugaaauucaugcuuucuagaugaaaugcaaaaauguuggugauuaucuaguuauagcuuccaagacuguaaaaugauuccuuucuuuuuuauacugguaaaguuacaaaauaauguuuuauuauguaaaaucuuuauguauuaaaauccagguguuagaauuaguuugugcuaucaauuuccuaaaagagauauacuuuuccaaaugacuguuuucuuagugucucuuuucuguauuuucaacuuacaguuucugaaggaacaauaaauacuuugauuggaaaucauaauaacaugcugcauauuuaucaagaugugacacugaagugggccacccaacuuccccacauuccuguagcaguaagagugggcuguuugcaguaagugauuuaauuuaacacaguuuuuaaagaggauguuagucaagaaauuuucuagaaguucuaugaaauaaugacaagugauuuuauuaaaaaauuacaggugacauuguaguaugaaugucaauaauaaaaguaauuuaaaauauaacuuuuauuggaaaggaaggauaauuagugcuauuaaucauuuucauuuaauauuucuagcaagauauccuuaguaaauuaaagguaaaaacuggugaagacaucaagaaaaugguuuacuugauagauuauucuucagaauacaaaaauauuucuuuuagcauuugaugagucccuuuuagagaacauuuauugauagacugugacgauauuacacuguucauuauaauaaguucucaccuuguuucagacguuucauuaagucaagugaugcagaauuguuaaugaucauguguuuacacaguuuagauuuuaaguggggcuacuuuguauuuaaauugaaaaacagaauucauacuuuaacauuaaguuuacaaaauuuaucaaaaaugacagaaaugagccaucuaagugaguaauuuuucuaggucaucaguauaaaaacugagaugccgaugaacuuuuuagcaucuuagauuauguuuaggaauugaaaauaucagcaaacguauagaaauacaacuuuccauaaagcuucauagauucucagauguauucaguucuacuuauuuauaauauuuuauugagcauuuaaaggccauacggggcggggcacaguggcucacgccuguaaucccagcucuuugggaggccgaggugguuggaucaucugaggucaggaguucaagaccagccuggccaacauggugaaacccugucucuacuaaaauacaaaaaauuagccagguguggcggcgugugcauguagucccagcugcuugggaggcugaggcaggagaauugcuugaacccaggagguggagguugcagugagccgagaucacaccacugcacuccagccugggugacagagugagacugugucucaaaaaaaaaaaaaaaaaaaaaagccaucuguagaauucuucagugacaccuauaguuucucaucaggauggaguuguuuucuccuauuaagggcuugaguguaauauuauuguugaagcucaacgaaggguauucauauuugcaucaguguuuuaucuaaagccugaauuuuagaaaaauggaaacgguguuuugaaaacauugaauauuuuaaaaagaaguugcuuucuuauguuuuaugagaaaaaacauauaauucuaauugcuaugcacuuaacacaaguuauaguuauuuugugucugaaaaauaauuuaaaaguuuugagauuggcuuuugcaauguccaucacauggucuuuuuaaauuuaacagaauauucauacucaccagacauuuuguaucagauuuacuuagaaggauuuagaacaggaaaaacaucuugccagcagggcaacaucaaguauuucacuucuggaagaguaauucuugcaggagucuauauauccauccaaagcuguucucuuuggucucuuaagugacaguucauuugcaaaaagacagauccacacuggugaguaugggucucauuuugacuuauaaucuucauguccuucaggagccaauaucuugaaauacuuaaaaauuauugggguuuugguguguauuuugagcacaggagaaugauggguagaaagaccuuauugagaacauuuaguugaaauauauauauuuuuacacauacauuauauacaagggauguacccauuucaggagucaccauacugagaaaagugcaaagguauggcuucucagcagauauuuauuguuaauuuauaguuuuuggucuaggugcaacuuaugaguuaacagucaauaauaacugaaauauuaugaguaaaacaccaaauuuucauauagugugcaucaugaugcuuauguucaaaaguagccugucauuuuauuuucgguaccugugagugaaccuuccuauuucucauagcuuuugcaagaugacaguuauaaacaauuaaauccaaauauugccauuaguauuuuccacaauuaauauauaaaaauaaauucuaauuguugaacugaagauuuuucuuuucuuacauauaauuuaacacaaaguauaggauuagacuguguuugaaagaauuccauuguaauuucuauuagaguuuuuuucuucuucaguaaacuauaauuaaugcaugaaaaagaaaauaaagauuguaaaacacuagacucaauuaacauaaaguuuaggaagguuuucugcccucaccacaauuguaagcuguaugcuacaguuauuuaaauaccuuuuaucauagucacaucuuaaaucuuauuacuuaucuaaacugaggcaguaaauggacaauuucaaaaaugaucauaaguacagaacaccacaacuauauuuuaaucacuugcaaaaaaggccguggaccauggggagagcacucagcucuuagcucaugcugcgguuuagguuauuaaccacaaaagguaagggagcuuccaguuuugcucuuuggcugucagaucauuuacaggggggaaguuggaauaguagcugguguuacagauacccuacacaaugcaaagcuagugaacaccaauaucuagucauccggcaaaaaaagaaaaaagaaaaaaacagcauaaacuagcaagagcaucugcagccaacugcaggcuaaugccacaucuuuucucaaggcucuauccuggguaugugaaugaaaagcccugcuuuuguccugaucaacaacagccuuccugugaggaagauacuuccuugccacgugagcgcuggugggcuucucaccuuugcaagcaguccauagguguggugguucccaaaauguggcuuuugccauucaccaugcugcccucacucccucaccucaugggccacaagaggguggaagagccaggcagaucuaagcugaugucccagaaggggucuguggugguggagacuccauggcagacuuggcaggugauguccaacugcagcccaccugugaagaucuguucuaugauguaguugugguaguuggccuucuucccauugucaucaccuggggacagacuguggcucugggauuagugucuguaaaccacaaagacagcgaaugucuaagggaagaguauguuuacccugcagaggccugaggaagccagcgcugacacuuuacaaggccaugugaggaugcucaucauuucauuagagggucuugcuguuauuuaaugugacgagaaaucacagcacuuggauuuucaaugcuccuguuuuugucauucccuaagaagagccccauauuuuuuaucuugccaacaaagcacaucuaaugcccaauagcugaguagguaguugguucccuuuuuauaugagggacaauugaauaaauauuuuccugcagacagcugaaaauauugugggccagauacuguaaccccagacagguucuuucugccuguugcacaaacaaaaucaauucacuguauuucaguagagaaagaguuuaauugaugcaaggccagccacaccacacugaagagggacuuauuacugaaaucaaucucauugaaggcucauagguuagggguuuuucaaaaguucuuugggggaagaguuugggguggcuaggcaaugggugcuugcugcuaauuguuuggaaggugcaaucauaggggugugggaaaugauccuguugcaugcugaaucacuucugggagcaguugguggguccagguggaaccaucauggguuucagaaaugcaaaaaaccuguaaagaucucuuacaagaccacuguuagguucuacaauagugauguuaucugaaggaguauuggggaaguugcauaucuugugaccucuggaauaauggcuggcaauuguuuuugucuacaccuuagcaaaauucaggcuacucuauccuccuagccugguguucucucauuagcuuuacaaagacaguugaguuuuggggaagggcuauuuuuacuuaaacuauagacuaaaugucucccaaagcuagccuagccuaagccuaggaauaauuaagggagcuugaagguuagaggcuagagggauguagguuagaucaugucucccccacugccauaauuuucucacugugacaauuuuugcaaagccuguuucacuuucgcccuuugaguuucagcaugccucauucccgagguguaagcuaugauaugggaaaagggugaggacugcucuaacuucuuccuacugacagggggcauaguugugguauggguugccccuaggguaagaggaguggaacugcuuugcauguauucauaggugccugauugggcuuccaaggcuuauaugacaaagacguuaauauucucacccacaguuuuagcauagcacuuaagugaaccacagacuauaggauaaugaguagauuguuagaaauacagauucacuaaauaggaaauagcaaauuuaaauauaucaucccauauuuuuuuaauuuccuaguccugagacuagaugaguucagcugaacagcuguuucccauaucaggagguggcauugcagaugggcuaggccuuuguauuugaugaaggcaaacagauuuuuuaauaagaggcauuucagacagguuccaggacuauuucuucacuguaauuagaucucugcccuaugggucgacagugccucaccagcagguacagugccaaagaugacccucaguagaaauaagcaguuguaagagcucaccucuaggucuguuauacuggaggaggcugaugaaccaugggcagauauuugcaaggguggauccuggauaagcccccaaauuuguaacugucugacgaguucuuccugcucacuguacaaacaaaauuaauucaugacauugcagucgagagagcauuuaauugacgcacaucuagccauaccaugugggagagagaguuauuacucaaaucaauaucauaaucuguuagaauuuuaaagguaauuauuacuaacuuagcuauagcuuaucuguuuauuuauuuuuagagacagggucuugcucuauugcucaggcuggaaugcauuggcaugaucauagcuuacuucagccuugaacuucugccuccugucucaggagccuccugaguagcuacaacuauaggcauaugccuccuccugucucagccuccugaguagcuacaacuauaggcauaugccaccauuccuggcuaauuuuuucauauuuuuuagagaugaggacucaccauguugcccaggcuggucuugaacuuauggccucaagugauccucccaccuuggccuccccaagugcugggauuauggguaugagccacagugcucagcccacauauuuauauuaggaaguuauuugaaauugacaguacugaaauaauuuuucucuugcuuuuuauuaccuuuaggguuaaagcuuuuugauagaagcuuccuuggcugaauguguugauuuaugaaggaaguugcugcuuuuuaaauacguuucuuuucagugaauaagaaauguuggauuuagaucaaguugaugcaauuauacuuaauaacagcauuuugcucagagucuaagauguuuuuuuucuuuccacucccaccuacuuggcagcuuuaguccucucuaccuuguuuauuacauaccaguuccaauucugucuguguuuucuucuuccuuuucagauuaaaucucauucucaauuaaauuguuuuuuauuuaauuauuuucaauuuuuguaggucagacuaugggaaaaugaaaucaauacacagguuacagaaucagaagagcccagcaucuuacuucugcuguggucaguuucucaaguggcaaauaaagaucaucauuuaucaguaauguuacuuucucuggagauaucaaauaaauauaucuacaaguguggaaguccauuugaaugaaacuucacaaagaugagaaccauucuaaacuuugcuggcagcucacagcaagcuuuaaaaucuuauugcaguacuuauugcagcucauuuuuuaguuugagcaauuuggucuaguacuucaauguuuuucuuccuaggcuagguccacaauagucacuuauuuuaaauuuguuacuuaacaguuucuucuuuuuaaaaaauuuccuagcuuauuuaaauuuuuuuaaacauuuauuuuagauacagcagguacaagugcaaguuuguuacauggguauauugugugaugcugagguuugggguacagauucugucacccggguagucagcauaguacccaauaaguagguguuccacccacagccacucccucccuccccacucuuguagucgacagugucuguuguucccauguuuauguccaugugugcucaauaauacuuuguucuuuagcuuucauugaucuaauauuguugaccagaauguuucccccauaucuuuucuggauuuucauguuucuauuucgagacauagcucaagucacauaaauaagccuuuccugcuuaucauggucucccucuucucugaauuucuaucacauucauaauuauguugaugaacuacuauuugacuuuccuaacucuccgacuagauaauacauuccauuuuacuuuugcauaucacacugaauaaucagugagaaagaugaacauaugauauaugcuuccuaaauacuuaaaagucauugugguuuuuaugugucaggggaagagcuguggcucuaaagaccuuauaagaucucuuaguugaaaaaccuuuuuaaaauaugaaaaaacagacucauagagggaagaaggauuuuuucuugaaaccgaauuuauuagcaaaauauuuuuaguuccaaagugacauuuucuuuuuugguuuaaguuuugcuguuaauuugucguuuuuguuuuuuuuuuuuuuuuuuugcauuauagaaagagaaugugagccuauauacuuuuugcuauccuguauuuuaaggauuuucuuuuugaauucuuacauuccacagaaaauucauaaauauuucuggaauuuauguaagguauaaauucugauauuuagcaccucugcauuuuuauugauauuuucuuguauuuguuauaaugcaagaguagaauauuaguuuuucauuacuauauuuuucugucaguuuucuguugaauaagcuuuuugguuuagauauucuauguuagucagcuuauauuccugauagcuguuuuuuuuggugaguuaaaaaaauuugucacuauaaaaugaccucuuuuggguuccauuuaauuuuuuuuguuugcuuauuuuuucauuuguuugcuuugaguucacuuagauauuaguuauugguaugcuguggucuaugccuuuuuuuuuuuuuuuuuuuuuuuuugaggcagggucucacucuguuucccaggcuggagugcagugguguaaucauagcuuauugcagccuugaaugccucaguucaagcaauccucucacuucagccccacagguggcugggacugcaggcaugugucaccacacucaguuaauuaaaaauucuuuuuuuuauagauaggaucuuguuauauuguccaggcuggucuugaacuccuagccucaagccauucuccugccucaaccucucaaagugcugggauuacaggugugagccauugugucuggccaaugcuucaucuuucaauagguucauuuaauuuucccaggaaugauauaggguguuauuauauuccaugguaaaaauguauuguuauauuucaccuucagacuuuauugauguugcuuccuuauuuuuuuaauuuuaaaauuauuauuauuauuuuugugacagggucuugcuuuguugaccaggcuggagggcaguggugugaacauggcucacugcugccuugaucucuugggcgcaagcaauccucccaccucagccucacaaguagcugggacuauagguacaugccaucacaucuggcagauuaaaaaaaaauuuguagagauaggaucucccuauguugccagauuggucuugaacuccuagccccaagagauccucuuuccuuggccucccaaaaugcugggauuacagaugugagcuaccaugccuggccccuuauuuguuuuuaaaauagcuuuuagagaaaauaauaaccuuugugguuuuugcaaaaaguauagaacugcauuuuuaaaaacuauuauuuaaaaguacaaagaaaaauaaaauaccuuuuuauuaaaguuacaugagucuuaucaaauagaaugaacauuuguuggcacuuuuaaauaucaacccugauauuuuucucuacacacgugcaaauuuaggcauagaauaaaauuuacaaaacaggaccacaugaauuuuauuuuuaauuuuuuuuuaagauggagucucacucuguugcccagacuggagugcaguggcgugaucucagcucacugcaaccucugccuccuggguucaagcaauucucugccucagccuccugaguaugugggauuacaggugcccgccaccaugacuggcuaauuuuuuuguauuuuuaguagagacaggguuucaauaucuuggccaggcuggucuugaacuccugaccucgugagucacccgccucgccucccaaagugcugggauuauaggcgugagccaccguguguggccaugaauuuaaaauauaaauuuauuucauuauauccuaguggaaaaaagaaauagcugaaguggaaggaauauaugaauuuuuuauaaauguuuauucacaacauuauauuuuaguuucuaaaagacuucucuaaacaagaauagaaaaaaaugccuuuuugguugauaccauuagucuuuuaaagcugcauuucaaauuuugguagugucuauugacuuccuauugugaaacauaaggaaaauagcauacuuauauuuucuuccucucuucuugccaaauucugguauuauugguauauuauuauuuauuuugucaaaauuuaaaacacuuccauacauuuuuuguaaucacaauuucuauagugcuuucauccuguugauauaucuaaauggagucaaagcuuaccacuaguucuuuuacuauuccugaauuaucuugauucauuucuuggugaguugaguuuaaucauccuguaguuuuguggaaagccguguaaguguucuuaccuuaauaauuguauauugcuuuuauaccugaagauaacauccgcuucccucugaaauuuggacauuccauuugguuuugaaaguugcuguggaaaagccugaagguagcuuaauuuuuuuuaaaaagacaucuuauuggaugaauuacuuuuucugucuggaugcucgucugacuuauuucucaguccuuaagaauuaaaacauuacuccucaucaauuaauuauuuguauauauuuguucuuucuauuuugauuuuugugauuuuuuucaugucgcuuauccauguucuugaguugguuuuuaguguauuuauucucauuuaaaaaauuuauuuauucuaguuauugcuucuaguguggcuuucaaccccguaucuuuugaguucuccaaacaaugaaaaaaaggguuucuuuuauuucacugauacaagggguaacuauuucucugaauucuucuuuuguuucuuuaggaaguuuuugcuauggagauuuucugucuuuuauguucucaucucccucaugucuaccccuuuccuuuuuuugcaauuuccacacauacaucucuucuuauuuuacaguuacucauuuuuuaaauggugacagcaguuugcugaaggauuguguggggaguuuugagggagagugaugauuagcucagaucaccugaauauuuucaccuucucacucuguuuauuuucucuuuugcccuggggguccauuuuccuugguuuucaggguucaagaggcuagugagugucacagaagccccuaacggccccugucacagguccuuggugcuaagaaucaguggcugccgcuugucuuucugucuucauugguuaggaagcugauaaaagcacagguauagggccauaucuuuugcuuccauucugguucuucugaugucacuccuucuguaucccaugcauguccuuaaaucucauuccguuagucuaggaccugacucucucuuccgcuugaagucugcagaguuggugccagcucuuggcauccuaucauacugugguccagaauuuaagauauuugguaggcuucaaaguuuguugauugugacuguagucauuuccucauucaauuuccuuuuuuugggaggugguaguuauuguaguacuuucugcuguuuuugguaaguuuugcuguauuaucuuugauuagaauucaagucuuugucagucuuuauuguugcugaggagaaauccauggacaaccugauuuuuguuuuguuguagguaaucaguucuuuauguuugauugcuuguagaauguuuuucauuuuuucuguaaaugccacacuugccaccauauaucuguaugaugauauuuuccuugauauuauugggaauguagugaauuuaaucuguuuaaaccauuuguuuugcugcugaagaaagguuuccuauguuauaucuuugauuauuucuucaguuuuguuugauuuaaucuguccuucaggaaaacuaauaucuuuugguuggcuacuuauuuucuguucccaauaucugcucucuuuuuccucauaauuuucauuucuuugucauuuguuuucucuguuuucuguggaaguguguaaaauuuguguuccauaucaguuuugagaaaccacggcacugguuuuggucuuuucuaugucuacaguggaagauuuuuuuagucugcugagguacugucuuucucccagccacuucccuccuaccuccuguaucuuugcuacucuuaaccaguguaguauaugccaaguuacaauucccaugaggcacuaguaccaaguacaucuuacuuugaaacauguuuauaguguuuauuuuggggcuuuaucucugaguauauaauaugccauuauuaaucucuguucuuuacuuggacaauuuuauagaauuugcuaccuuuguuuagaagucaauagauaguguagaggggccacgggcagugguagagguuggaaagauucaagaggguaguuauaaaauauguugcuucaaucauaggucacuaacagaugucuguacaguuuucugguucauauagaacuuggaauucugaaucagauggggcagugaguuuauaaucagaaauguuagguagagugacagaacucuuggcuuucauggguuccuaucaaaagaggagagcuuugguuuagggccuaaugaaucugcuauugcauugugguauacuguaacuuaacaugaguuaugggggaugaaggaacagaauuaugucauaguucguauauuuuuucuuccucuuacuauugguaccucaguaaacauaauuuggacaaauuaugucaaucucauugaaggauuuuggggguaaaauuaguugcaugauuuuugauggucaucguuacaugcaugcauauauuuccauugugucagauaaaaggucuuuaugagaugaccccuagauauuauauugauggggcuuaaaauggagaagcacaagaauugugcuuauaauguccuuauagccauguggcuaaaccauuauugagguauggccugucauuugguacacuacuuucauaaacuguaguauggcuauuuugauaaguguuuuauucacauggaaaagaccuuguaggaaucauuaaauaaauuaaaaagccauaucuuuauuuuuauuugucagucaagguuauaauucucagaaaaauucuccuuaggaaaaguuagauaucuucugcuuggcucauguuuucaugaucauuuuauuuuuaauguaauaauguaaaacacagcauccuccauucuuauaaacaauaucauaguaauuacaguuccagauuguuugauuuuguuacauuccauaguaagucuauuuaauuugccuggcagagauuuuagaaacacuguauagccaaggauaaguaguugcaguuagaaugccaguuggguuuaugauuuucuguuuuauaaauuaaauguuucaaugguagaauucuacuuauuaccacauguuuccacugaaaaacuucuuuagaaguacugucaucaagacugugaacaucucuuaaaaaugaaacucucaaucuccaagaaaauaauuuauaccgguaggaaaaauccuuuuguguuuuggguuccucauucuguaucccauaauugauauaugggggauucaguugcaguaggguuguagccaaaaggaaaguguuugcuuuucacuaguuaugaaggguuugccuuucacuaagcacauaccuucuuggcccuuuggucccggagaucauuucuaucagguuagugacuuugccguucauuuuucuuagaaaacacaugugauuuaacauuuuuuucuccuuacuucagauaguggguccuccugauaacugaaauuugacucucugguuucaaagauagaaugaguuuauuuuuauggguuccugagaauucugggaaauagcucuauuucccagaggaaaaaguuuguguuuucuuaguuacuuacuguagaauauaaaagagaaaaagugauuuauuuguguguggggggcaguaacauaaaguuuauaugcggcuaagcucuuugcagaaguacuuugaacuuuagaacuuuggauggacuuaguccuuuauucuguuaacugguguauggccuguuuuuuagaacuagcuuuggagugcaaaaaucugaguuaucaccagaauaaaaaaagagaaauaucucuguaucucuguuucccagaggaaaaaguuuauauuuucuuaguugcuuacuguaauauaaaagggaaaugggaaaaagugauuuuuuuugauaacauaagauuuaugugcuacuaagcucuuuguagaagaacuuagaacuuugggcuucagaacuuuggguggacuuaguccuuuauucuauuaaguaguauaugaccuguauuucagaacuagcuuuggagcacaaaucagaguuaucaucagaauaaaaaaagaguguaaauauauaacucuuaugguauaggauguugggugacuuaaaauuagaaucaaaaggaaaugcaagaauuagcaauuuuuauugcuugcuaugcacuagcaucauuucaucauuagacucuuaauuucuacaaagagcuacauugguagcuuauucaaaacuuucuaagucuuuaacacaucagguuuaacauuuuaaaaaccuuaguaaauccccuacaucuuaagaaaaaagauuuaggagagugauggugcauguuuacauuucaagauaacgguauuaauugaaauuacuaaaaguuggguugaaaaguaaaauagaugaauagucauaucauuuaagucauuuuuggaauucuaacuugaaacuuguaagcaaauuaagucucaccugauaaaauaggucuuuaacucuagguuaucugaucaacagaaccugccaguuaacagauuguggggguucccagauauucuaaaauguggaacuguauucaaugguuuuccugccuuuaaauagagaaaauccacugacuuuuguucccuaaagugcaguuuacuauuuaaaauaaguguaaaauaaaagaauugcuaccugcuuuauuaaugugcuaaaaaaaggauagauacccauauaauguuuuguguguguaauauuuaagacuauacaagaaaacugaauuaauuuaagguuaaaauguuauuguuuugagagaggagaaaggaagaaaccagucaggcaggcaguuaggguggguccucacuuaaauuguuucauacuaaagaacagccugaaaaaucaagcuuugggcacagaugagggaacuugcacagcggggcuugccuaagacaugcccacagcugcacagguaagaaaggauaaacgggugacuuguccagacaugccugcaauggaaaauucugucuccugaaacaugugcaguaaggggaacaaagcaauauggauuaacucaagcuaaggacccacaugcgcacuaggaggaugggguggagcuaccagaaauucgugccuuaugccguuaugcaacccagcccuccuuugguuucuuauaaaaggcuuuacauucagcuguaaaaauggcaacucuuuuccaggcucccuguucaugguggagagcuuucuucuuuugcuuauuaaacuuuugcucuaaccucaaccuuuuuguguccacacuacuuaauucucuugguugugagacaaaaaacucugggugguaccucaaaaugagagacugcuacauuguggugcauuggcaagacuguaacaguuucaaucaaguagaagaugacaaaauguuauucugggaauucguuaacguugaauaauguaacaugaugaacuauguucuauuaauaauuagcacguauguucuagucuugaaacaacuuggcuagauaaaagcuuugcuuagugaagaaagacuuauuacccuuuuuccucuuguauuucaucaaaaaauuaccuuuuauguucaaauguuuuugagcaagaguauuuuuauauuuguugauaguuagcaugaaguauauauuaugaagauguuuuaugagcauacauuuauuggcuaaugaguaacauguuauuucccaauaacacuguucuaagaauuuauaugaugauaauagcaauuuguaucauuaugugccaggcaauauucugaauucuuuggacauauuaacauauuuaauucuaaaacaguuacuacuauuauuacuauuauuguuauccucauuuuauagaugauguaacugaggcauagagagaucaaauaacaugcacgagcucauaagaaaacauguaaacagcuaauuacagccuaagugaguugguguuacaauauagaaaagcagaauacgguagguccauucagaguauuuauccaccauauugcuagaagucccaacaauuuuugcuuuuacugaaaaacucugauacauuucccuucucuaagauaauugcuucccuuucagauuagugcgauucaauauucuaucuaacaagacguauguuauuuagaguuguuaggguaaacaccuggaaaaaccagaaaguggaagccuaaaacaaaaguuauuacuuuuggaguguggaacugagggguggaagggccuggaugaguuccuuaaauaucuuuuagaaagucucagacauucugaaaaucaacuugagucuuuggaaaacuaaugaugcagccaagccucuuucauuuaaaucuaaaauaguuuagaugcauuagauucaaacauaaauuauuuggaaugaauaaaaaaugaaagauaaauuauuaaguauuuuaaggacaguguuauguaaaaguguuuuuucuuuuuauuugagagaaaaguuauggcuugugaauuagaaauuacuaguauuucaguagucaaaauacaaugaaaaaaaugguaguguuugcauuucagaugcaacauuuuguauacuacuuuuuaucuuuaacuuguauuuauuuccauuucucucaucuucuuauuccaucuuguuaccuccaaauuuuaaauggguaguuacaauucauauuaauugaauauuuaaaaauuuucuuguaaauggguaguuacaauucauauuaauugaauauuuaaaaauuuucuuggggccaggugugguggcucacgccuguaaucccagcacuuugggaggccaaggugggcagaucacuaggucaagagaucaggaccauccuggccaacaugaugaaacccugucucuacuaaaaauacaaaaauuagcuaggcguagugcuacaggugugccuguagucccagcuacucaggaggcugaggcaggagaaucacuugaaccugggaggcagaggucgcagugagccgagagugcaccacugcacuccagccuggugacagagagagacucuaucucaaaaaaaaaaaaaaauuuuuuuagaaggaaauuacuuugaauuguaauaucuacaguucgcauuuaggauugaaugucgcaauaacuuaaagcauuuaggaauguaaaaauucugcuuuuugccuuuuauaaaacuuuacuaaugauggagcaagcaaauauaucuguuaagguccuauaguuagauaaagaccuccacuuuccaaaaccuuagcaacgugcaugccaugugaaugcagcauggggcuggugugugagugaucaagcagcugcaacacaguuuauauggagacaauauccagaguacuuaaaauuuaagucaaauauaugaaaaauuaaaacacaaucacauggggaauaauggagggaugcaguuaaaaaguuaucucacugcuuuuucaauaucugcaggcuuccagauaguaggaaauucuuuguucuucccuucaacccaucuguuguuccuuaguguaacgacaucacugcaacuacugcagccacuaaagcaucgacauuaaaaaaggcaaaauuuagaacuuuuuacagaguuuuauuaaacuacaaguuugcagaacgauuuggucuuuaaauuuuuaaaaaauuuuuuaguguguguagcauagugauaugauagaaguaaugcccaggcagacauacucuaagauuagaacagaauucucaguauuuguguugguauagaaauuuuuuuaugacuuagaauuaaacauagagauuucuuuauguaucauugaaaugaauuacuuuuuaaguaaggaguaugguuauaaauaggugguccauuaaaccuguguauuugcuuuauuccuuuuuguccagacuguuacaucuuugccagaaauggaaauguguauugcuguuuccuacucaaaaauuacuuuaaagaaaaaaguauuaguuauuuaugcuaauuucaguucaguaaauauaccauuuuuguaguuaaaaauuuaaaauaggguacaaagcaaaauaaaguucuccuuaaauaauaugaaauaucauaaaauaauuuuuauuuauuugugccugccucacagcagaccuuauaaauacuauuuguuucuguuuugauauuuuuaucagauagaauuuguguuuacuagcauagaauuuagauaguaaauucuuuacuuuuaaucaaugaaaucacaguucucauaguaauuuuggaucaguuauuuaucuuaacucuuuuuuauuucuuuauuccuuaguuagugucuaaaaucuguucucuuaagaaaaguuaaaguuuuguuaaaaucacaauaauuuuuguccagguuaccuuugccuauuuuuaaaugcuaaaauacuuaagcaauaguuagauguugccuuuaggaagauuauuguuaccuuccuuauguuauuucucccaaauacauaucuuucuuucagcuuguauauauuucaugaaaauucaugccuauuuugaauaauuuuuucaagauuaugucacauuugaguucaggaaauccaauugugaguagaaguauauguuacuuuacguuuagaauauuaaaauggauuaaugaaccuugaguuuugggaaaucucauucuuaaaccauuugaaccuccaagugaugcucagauaucacuagcccauagaagaccacagaaaauuucauuaacccauagaaacccagugaauucuacaaaguuugguguucuaaagauaagcuaacugaauagcaguguuaaauggaguuuauucaggaagccauguagcauggaaacaaggccuuugucuugcaauaugaauuuuaauaggucuuaauuccuuaaguagguuuuuucuauagcugggacuggaguccugugguguguagucuuuagggccgcuccacuuucaagucuuuggggagaacuaccuucuccagcugaaguuuucuccagggaauuggcuuauagaaagauguuuccucuuucauauagggaccacccuuauucaguuucuucaugcuuggcaaugaguugauuuucagugaauguugguugagugaaugaaugaaugaaugcaugaugaagagauuaaugaaagaaugaucugaaaacaagugacucacuuagaagaggguucaaagucauguuacuucacagccugaauaccuugccuguggaaaauuaaaagaacauuuaguuuggcuacuuaaaaauguuuuuuuuuuucccccugagacaaggccucccucuguugcucaggcuggagugcaguggugugcccauagcucacugcaaccucugccucccaggcucaagugauccucccaccucagccccccagguagcugggaccauaggugugugccaccacaccuggcuacuuuugaauuuuugguggagaugggguuucaccauguuggccaggcuggucuugaacuccugagcucaagcaaucugcccaccuuggccucccaaagugcugggauuacaggcaugacccaccgcacaccaucuauuuguggaacauuuauuucuuuguuuaggucaaacuuuuuacuguuuuuauuaugucaggugaauaucccaugaagagucuuagauccauauauaauuaaggugauaauugcaauuugaacuuauuguaugcauaaauaauauuugcuaugcugauaaguaugccuauacuguuacuuuaaauuauagaaaaaaguuggccgggcacaggggcucauacuugcucucccagcacuuugggaagccaaggcagguggaucacgagaucaggacuucgagaccagccugaccaagauggugaaacccugucucuacuaaaaauacaaaaauuagccaggcgcgguggcaggugccuguaaucccaggugcucgggagucugaggcaggagaaucgcuugaaccugggcggcagagguugcagucagcugagaucaugccacugcacuccagccugggcaacagagugagacuccgucucaaaaaaaaaaaaaaaauuguagaaaaaguuucaaaagaaauuauuagcguugaccucauuuuauaccaacagucaugaguucaaguguuuuuauguacaaaauuucucauaccacuuucaaaaaagcagauuugguuaucuucuaauggaccaugucaacauuucauuuauauauuuuaccaugaaaauauuuuauauuuuuauuaaacuugaauacaugcauauuaucauuuuccacauaaaauauguaauuaugugaaagugaaaauagaagggguuauagcaaagaaaaauugguaucagaauuauacaguauccugaugcucuuugggaagaacuucagaauuuuaaugaugauauagacaagcagaugacucacagacacggaaaaaaggaucuguaauuguuauaugagaggagauaaaucaacacaggucaaaguauguauggauuucuaccuaggaggcccugaacacauucauacuguauaaugcagacuuguauuguuucuauugaaauauuguuucuggaggucccaugaugucaucuaggaaaaaguaucaguacagaaaauuuauaauaaaaugaagugucuuucgggaaauauaagaccaagugcaguaugcuauuauuucuuuccauuuucccuuuucuguaugucuaaauaggauugugucucauuuagucaauauauagaaccuaucucuauagacuauuuauuagacucaguacucuaguuaaaucauagagauuccuauacuguuaauuacuacaauuauuaaugaguaauaugcuguauuucucccaaauaucuuuuuuuguucuucauuauauaccucuuuauuucaucacuuucuucugagagacuuaguucuuuuucuucgugaagagaucuacauaaaguguagguuuuagugugacuccuagaaauauuuuuauguuacuucauuucucaguggagcacaaguuauauuguucuaauguggggcaucuuaaagacuuuuucuccauuucucucagaagagccuaggaagaaccucuaaauugaaggcacagaaacacagcauugugaaucuuagucuaacauauacuuugaagccaguacaaauaauuuauuuuacauuauaugaugcuguuuaacuuugaucuagucaauuaaaacaauaagacuacuuauaaauauuuuuccauuuauaaauguuuacuucuguuagcagcagcaacccucccccccauaugccaaacacacacacacucacgcacacaauacuuccaucuaucuaucaucuaucuaucuaucuaucuaucuaucuaucuaucuaucuaucuaucuaucuaucuaucuaucucuuuguccauccauccauccauccauccauccauccauccauccauccacccauccauccgaguauguauguacauaucuuucuucccuggagugugaguggcuugccagagagggcaggcagaggcaucuuggcuggaggcuccaguuaauuuaagacagugggcauuauuaauaggcagcaucugcccucucccuuuugguaauguagugacccuuuuagcugcuggauacccaagcuuuaagaggcaaucuuuaaugugauaucuuagaguaauguucuuacuaaauaaaucacauuuagaagcuuuuaugcaaucauagucaugcuuguauauuaaaaagucuaaacaugauacacauuaaaagugaauuuauauucaugaagccaaauuugauuuucugguuaaugaugaauucaucuagaaauucaaaugguugcuuuuaguguucaucuauguaaacugacacaauaaaaauguaaguuaugcuaugauauucugugcuucauugcaagugguuuucuugauaauaaauuuauuuugccaaaugcuuuuucaaauagucucuucuuuccuaaguaaacuugcucuaguuggaaguaacuuaauagguuuacuguuacaaugagaccaguacaaucuuuuauuuaggcauuuuauuuaggagcuuuuucuucaguuaguacccauucaguuagaaugggcauauugaacauuuaaaauaugguucuagacuaaaggauauacagagacauuacauaauuuuacacauuuauacugcuaaggcaagcauacguauucuaccuauucauaauauuagagaaaaagagauacuaauugccauugauguuuaagaguaaaauucuuaaaccauaguggauaauuuccugauauuuuucuccugugucauuuucuuaaugguauuuauacacaauuuuugguacuuaauuuuaaauuugaaaugagaaauuacugaacagcacuuuaaaaauuaaacuucaaagacuacagauuauguaaaguuucaauuauuugaaaaacaauaaaguaagcaaaauuaagaaauaauuuuuuaagaaaccagauuuuuuugugaugcuuaaauuuugaacuucuuuuucacuccuaauucaucccauuuccccccaucuuuuaaaauuucugcagaauuuuuucuaccuugcauguaaguuaaaaaaaauagucuauuauuauuuuaguuuguggaauucaaaaaaacacaguuccagauaauauuggaauaaagcaacuuuccaauuuagaaaacacugacauugaaguaagauaugagaacuuaagauacgguuaagagagaacuuaagauaugguuucuugauaaaucaagaaaaauuuauauauugcaaugugauuuaauuacuauacugacaucuguuugauccagacuguuaacaaaauagucuagaaaauauuguaauuggaauuuuuggucaacagugaauuuuuuuaaguuacaaauugacaccacucuuuauuugcaaagaaaagauaauaaaauuuuuuauaccaaaaagagaaauuuuucacauaaaaauaaaagguggaauauauaaaaugggugaggauauccagaaccuuccauguaacaugaguaagaaaaaucccaacaauuaacaaacucauuuuucaauggccuauuaaucacagaauuaaacaaccauguaaaaauuaaaccuacuuauacguugaaauacauuuuaauucauccauaaauucaacacacuuuaaaauggguagaaaaagauuuuaacuagcuuaaaaaacccaaaauagauuacuuaaacugauguacuauugcuuaagaaguaucucuggaauucuccguuagagacuccugauaguuauuuucugaacauaucuuggaaucaguuaguacuuuuaaguuauaaaucuguggaaaauaucacauaccguauguguaaaacaauuagaauuuaauuuaugacauuugaucguauuuugauaaaauuuuauggacaguguaaacaaucuugauacccaauugcuuuaacaccauuauuuucuauucacaaguugcauuauuuggcaaugauaacuucauuuugaguuuguaguuuggaaguucuuuuaagucaaggaauaaucaccugcuuuauugagauuguuguaaccuaaaagagcaauauggaacuccuaguuaaaugagaccucugacccaaacuuggcaauucucucagcuagccagggaaaacacuugcaggguucauuacuuucuucugucaucuugagagauucuaccccauuuuucucuucuacugaccaaccuuugacuucccagacuuguguuucuuuccaacagaggcgaauaaacacucuugguaugugaagauuaaaggcccauggccccuguaggugcccugaagcaaauuuguucagaauuaauuuggcacuuccacuugugguuuguuuaggauaggaaaccagauagaauucaauauuguaucuugaaucuuaggacccaguacuuuuguuacaaacaacagaaaaagaaaagguuuaggugccaguaacauuuacucuucaaaggaaaguuuuugucuuucugugccugguuaucuucaaaaguugcagaguacaaaagaaaauuucaguggaaauauauuucuuucugauauagaaaagaccuuuaaaagagucauuguugacaugaaagggaaaacauucugauuuucugggaugcaagccuuagaaaacaagccggaguaaaagaacauguagaaaugaauaacauaugacuccaggagaugaccuguugugaauuauuucagaauuuaguggauaucucagaugguugauuuuucucuacauguuugcuccuaugaacuuaccuuccugagugggcaucagauuuguuuuagaggugaaaaucuauucaaugaauaccacuguucuaaauacauaaaacuguaaaccauugcuauggaacauaccaugugauauguacuuuaaagaacaaaauaaguuucuguaugacuaaagaauauaaggaagcauuucucuaagaaauuguaaucauugaucagucuuuagcggugggugacuugguuuauagauuuuagaaucuaaaacugguagauguguuuugccuauuauaguuugguaauucuggcaucauauaccuuaaucuggaaacaguagaagaaucaagaaacagagaagcaagaaggaauaaacucuuuuuuuaggcaccuacuugccaccuuuuuuguggagugggcaacaaaagauguaucucacaauauuaccaaugcaguggacuccuggaaguuuguugauuauauuuuauguaggaacagaaaaagccaaaagcaggcauuugauaauacuucugagauagguuggucaauaauacauucagaaucaugaaaggaugcuucucuuuaaaaauugagcauaggacagauuuaacuuuguuaaacacaaauaccaucaucuuauugaaaacuucuuggacaauuauaguaccuuauaaauaguuaucaaagacaguuuuucaguccucuaugguuuuaccguagugaaccuuucaaaauuucauuggguagaaauuuuauuacagccuuuucuuuuuuuuaggagagauaugcucaguucucuuauuuguugguaaaucuagacuuugaauuguuaauuugaggauaaauagaagagaaaggagagaugggagcuauagaagcaucuuaauucaguaaugucaugguucaggaauauuuucauuuuuuuucauuuuaauuuuuuuuuauuugccagguucaacauugacacauaggaauauuuuuuaaagcuguauuuuuaguguugggguauuauaaagguuaaagcagaagacuccgaccauggcugauuaacuuacucauuagcucugagaccuugggcaagcuauuuaaguucucugugccucagugccuccccgcuuuucuguaaaauggguuuaauaauaauaucugcuuugugggguuauuuuggggauuggauaaguuaacuuuuuauuagacugccuggcacaugacauuauguauguuguagccaacauuacuguuaguuuuggcacauuuaccaauaugcccacuuuuaacaauuauuuuacuuagagaagcuauaaauacaguuauugaauuaaaucccuuuaagaaugauaguuguuucugaaugauaucucucuugaaagacugggcccaagauagcaaagcuaggcaaagaguuagguauuuccuggugaauguuauguaaugggccacuuagaaacaucauuuagugcccaugugugcagaguucuguuuuagcuuccuuugcuugcuggauugcaacaaguucaaacaguucaaaucagagggagcugggaaaugguguuucuuagaggcauuugauucaggaaggcagcuaguuauggccuggaagaucaaggacuugaacuguaguccacauagaggcgaggcugaacuacugguaccuugaugcaguauaaaggaacaagucacgcuuuucuuuuuccaucuauugaaucaguaccauggccaaccugggagaaaauauuuuaguucaugguuaaaacagcagucagaagucuuuuauuguuguugauaacuguuuuucacuuagagaaauuuuggaagaugguuaucuguuuagugcugccaaauauauuguuauuaugcagacccugugggcagcagcugcaguuguuuuccaaaggacaugcaaccaaucuagcuaucaugcuucagcauugcuggcuguauuuggucuuuuuauucacaauugcaugcauacuaagacuuucagucauaauauuaaaaccgaaggauggguacuguauuuugaugaucugucuucucuuucaucuguucuuauuuuuagucuucaaauuacccuuauuuuugaacauuucugaucacaauuauauauucaauuucuauguaauauauucuuuuuuagggaguucagggaaguuguauaugaugugcugaaaugauuugcuuugacuugacccaauuauaauuuucuuuagcccugagccagcugaaauaagauugagcuaauuuaugccacuguuuuuccaguaauguugaaguagggcagaacuacuuauuaugauaauguucucuuccaaaauaauaguaauauuauuauaauuuaauaauaaucaauauuauuauaauuuaguaauauucacaauuuaguaauuuaauauuuacuaaauauuaaauuuauaauacuaguuuaauauuuacuaaauauuaaauuuauaauacuaguuuaauauuuauuaagccugugcuuugcaucaaucaggcacugggcuaagcccuuauuaauucacaccaaacaauaauuuuugaagcagguacuacuaguauuuuuuuauuuuacagaugagauaagagacgcuuagaaacguuagcaaacucuuacaaagccaguuuuggagcagggauccaauuuuaguuguuuuugacuuuaguguugggguucuuauucccuauucuguuuuuaccaccuuccaugcuauaaauuggcaagcagucuuggcagcaaauagauguucacucaaaugggguaauugagagaguagaaaugaacaaagagacacuagcaaggaauggugaagcaucuuggcacuaacaacaaugggaacuauuaccguuccuguaucugaaagggccagagaagggauuuguuauuggauccugcagagaguaguguagcuauaagagagggccaucugauaggagcuguugccuuagauugauggacacaaucaauccuggagacucagcagggagggaggugaggaaguuaauacucugaccccaccuuccucccucucuccagucucuugccaaugauuuucauuggccaaacucaacuggaagccagagggaaagggauccuuggaugcaguggucagcuucuggcauggagcagauuggaaacagaugggaaguuugcagggcaaacagaaaauauccaguucacagaugcuguacugagaaaauacuuucucaaugucaaagcaucggugagccaggauuuucuauuuuugucucuaauuauuugaaccauuucuuuuuaauuuuaauuuuaauuuugucuucuuaauuaugguaggggaaauguagaccaaggcucuuuccuugcaguugccaggguuauaauuuggauuuuggaaaaauuaacuuuggauaugacuuuccuuguuuuuuuuuuuuuucuucuguaaaaugggaauagcaauaucaauacuaucccuguucuguguggauauaagaaggauucaugaaauaguaaugaacucuggacacuuaauaacauuuagauauauucauauuuuaaccuuccuccuuaauguucuuccuucuaaaucuucaagcugcuaucugagauuauuuuuccuucugccuaaaaaaugcucuuuacuguuucuuuuuguaugggucuacuguuaaguaaaucugucaguuuuucuuugccugaaggcauuuaaaaaaaucuguuuauuuuuugaaggauauuuuugcuggguauagaauuuuagauuagcaguuauuuucuuucagcacuuugaagauaucaguccauugguccaucuggcuucuguagguauuauugagaaguuagcuauauuauuauaauuauuacuucuuugaagguaccugucccuuucuggcuacuauauuugcuuuuauuuuuguggguuuacaauauauauguguguauauauauacacacacauaaauggguuacaugagauauuuuaauacaggcauggaaugcauguuaaaaucaggauaaaugggauaucuacauuaggguaaaugggguauccaucaccucaagcauuuauccauuguguuacaaauaauauaagcauauucuuaauuauuuuuaaauauauaauuaaauuauuuuugaguaucaucuuccuuguaugccagaaaauauaagucuuagucauucuuucuauuuuuuuaaauaugguuaaccauccccauuuccucccaaccucugaauagcauucccagccucugguaaccauccuugugcucuccaugcguucaauuauuuuaauuuuuagcucccacaaauaagugagaacaugcaaacuuugucuuucugugccuggcuuauuucacuuaacauaauaaccugaaguuccauucauguuguugcaaauggcaggaucuccauuucuuuuuuauggcugaauaauaauaauauucuauuguguauagguaccacauuuucuuuauccguuuuucuguugauggacacuuaguuugcuuccaaacuuuggcuauugugaauagugcugcaguaaacaugagaguggagagaucucuucaaucuacugauuugcuuucuuuuguguauauaagagggagugggauugcuggaucuuaugguagcucuauuuuuaguuuuuugaggaaccuccaaacugcucuccauagugguuguacuaauuuacauuuccaccaacaauguaugaggguucccuuuucuccacagucucaucaacauuuguuaguuccugacuuuuagauaaaagucguuuuaucugaggucagauuauaucuuauuguaguuuuaauuugcauuucucugaugaucagugauguugagcaccuucucauaugcuuguuugccauuuguaugucuucuuuugagaaauuccuauucagaucuuuugcccguuuuuaguuguauuauuagauuuuuuuccuauggaguuguuagagcuccuuauauauucugguuuuaaucccuugucagaaggauaguuugaacauauuuucucccauucuguggguugucucuucacuugguugauuguuuccuucacuguacagaagcuuuuuaacuugaugugaucccauuugucuauuucuguuuucguugccuguguuugugggguauuacucaagaaaucuuugagcagucuaauauccuggagaguuuccccaguguuuucuuguagugguuucauaguuugauauauaagauuucagucuuuaaucccuuuuuauuugauuuuuguauauggugagagauaggggucuaguuucauuuuuugcauacggauaucuagguuucucagcauuauuuauugaagaaacuguccuuuccucaauuuauguucuugacaccuuugucaaaaauuaguucacuguagauguuuugauuuguuucuggguucucucuucuguuccauuggucuuugugucuguuuuuaugccaguaccauugcuguauuaguuaugguaccucuguaguauaauuugaagucagguaaugugauucuuucaguuuuguucuucuugcuuaggauagcuuuggcuauucugggucuuucgugguuccauauaaauuguacgauuauuuuuuuccauuucugugaagaaugucauugguauuuugguagugauaucauugaaugucuagauugcuuuggguaguauggacauuuuaacaauauugauucuuccaauccaugaacauggaacauuuuuccauuuucucuuaaauuucuugcaucaauguuuuauaguuuucauuguagagaucuuucacuucuuugauuauuuccuagguauuuaauuuucuucauagcuauuguaaaugggauaucuuucuugauucauuuuucagauuguucauuguuggcauauauaaaugcuacugauuuuuguauguugauuuuguauucugcaccuuuacuggauuugguaaucaguucuaaguuuuugcuggagucuucagguuuuucugaauauaagaucuuauugucugccaauaaggauaauuucacuuuguccuuuccaauuugaaugcccuuuauuuuuuucuguaguccaauugaucuagauaggacuuucaguacuauuuugaauaacaguggugaaaguggcauccuugccauguuccagaucuuagagaaaagucaauuuuucccuauucaguaugaaacuagcuaugggucugucauauauggcuuuuauuguguugaaguauguucuuucuguacccaguuuuuugaggauuuuugucaugagaggauguugaauuuucucaaaugcuuuuuuuaguaucaacugaaaugauccccuccccccgccccuucuuucuuuggucucccucuguugccgaggcuggacuguacugccgugaucucggcucgcugcaaccucccugccucgggcucccaugauucaccugccgagugucugggauugcaggcaugugccgccacgccugacugguuuuuguauuuuugguggagacgggguuucgccguguugaccgggcuggucuccagcuccugaccucgagugaucugccugccucggacucccgaggugcugggauugcagauggagucucgcucacucagugcucaauguggcccaggcuggagugcaguggcgugaucucggcucgcuacaagguccaccucccagccgccugccuuggccucccaaagugcuaagauuacagccucugccuggccgccacccugucuaggaagugaggagugucucugccuggccgcccauccucugggaugugaggagccccucugcccggccgccccgucugggaagugaggagcgccucugcccggccgccaccccaucuaggaagugaggagcgucucugccuggcugcccaucaucugggaugugaggagugccucugccuggccaccccgucugggaagugaggagcaccucugcccggccgccaccccgucuaggaagugaggagcguuucugccuggcugcccaucaucugggaugugaggagcgccucugcccggccaccccaucugggaugugaggagcgccuaugcccggccgccccuucugggaagugaggagcgccucugcccggccgccccgucugggaagugaggagcaccucugcccggccaccccgucugggaggugaggagcaccucugcccggccgccaccccaucugggaggugaggagugucugcccagccgccaccccgccuaggaauugaggagugccucugcccggccgcaaccccaucugggaaaugaggagcgccucugccuggccaccaccccgucugggaucugaggagcgucucuccucggcugcccugucugggaagugaggagcgccucugccuggcugcugugcaaucuuccaagugugaagugacagccuuucugcagguguacccaacagcuuggaagagacagcgaccaucgagaaugggccaugaugacgauggcgguuuugucgaaaagaaaagggggaaauguggggaaaacagagaucagauuguuacugugucuguguagaaagaaguagacauaggagacuccauuuuguucuauacuaaggaaaauucuucugccuugggaugcuguuaaucuauaaccuuacccccaaccccgugcucucugaaacaugugcugugucagcucaggguuaaauggauuaagggcggugcaagaugugcuuuguuaaacagaugcuugaaggcagcaugcucguuaagagucaucaccacucccuaaucucaaguacccagggacacaaacacuguggaaggccgcagggaacucugccuaggaaaaccagagaccuuuguucauguguuuaucugcugaccuucuuuccacuauuauccuaugacccugccacaucccccucuccgagaaacacccaagaaugaucaauaaauauuaaaaaaaaaaaaaaaagaaaugaucauauggguuuuguccuucauucuguugauuagauguaucauauugaucauuuugcuuauguugaaccaugcuugcaucccuaggauaaaucccacuugguccuaaugaaucaucuuuuuaauguguuuuugaauucaguuugcuaguauuuuguugagaauauuugugucaauauucaucagggauacuagccuuuaguuuuauuuauuuauuuuuuugauguaccuuuguugguuuggguaucagauuaauacuggacuuguagaaagaguuaggaaguauuccuuccuccucuauuuuucagaauaguuugagugggauuguuauuacuuccuuaaauauuugguagaaucagcaguaaagucaucgugucccaggcauuucuuuacuagaaaacuuuuuauuacagcuuucaucucguuacucgauauugauauguuuagguuuuggauuuccucaugguucaaucuugauagguuguaugcgucuaggaauucauucauuucuucuagauuuucuauuuauuggcauauguugcucauaguaccucuaauuauccuuuuaauuuauguaucauugguuguaaugucucccuuuuuauaucuuauuuuauuuauuugggucuucugucuuuuuuucuuacgcuggcugaggguuugccaauuuuguuuaccuuuucaaaaaaaccagcuuuucauuuggcuaaucuuuuguauuguguucuucauuuuaguguuauuuauuuuugcugugauguuuauuauuuccuuucuuguaaugauuuuggguuugguuugcucuugcuuuuguaguucuuuaaaaugcguugugagguuugagguuuuucuacuuuuuugauguaggcacuuauauuuuuguuuuugcuuuguauuuguuuuugcuauaucucauagauuuugguauguuguguuuucauuaucauuuguuucaagaacuuuucaguuuccuucuuaauuucuucauugacccacucuucauucaggagcauauuguuuaguuuccauguguuuguauacuuuacaaaauuucucuuuuuguugauuucuaguuuuauuccauguggucagagaagaugcuugauauuauuucaauuuuuugaauguuuuaagacuuguuuugugacuuaacauauagauguuaagucacaaaucuauaaugaaggccaucaugcuacugaagguuuuuuccuuccaugugcgaaauucauuuuaugugaagucucucauagucaguccuguuacucaggacaagaacauguagaaaacggaaaauaugaaacuuuaugauuuaaaauaugagucuuuuacaaucaauaaauuguuuuggaauaaaaaugaugaauggcuuuucuuuugauaauaaucugaaaaaguguuuguauuaaauccgguaagccagauauuugaguuagugaauugauauuguaugauggaaaguaucugaagcauuuugguuucuugaaagguuauguugugaaaaauuuguuuuguaagaguagacguacaaaaagcauaugcuauuguuauuaccuagaauccaauaaaagauagcuuuuugaaaauuauuaccacauguguguaggaguugcuuuugcaguuagguuauuuuagauaccagaauaauuuguuucauauuuuaagcauagaaaugccccuucaaauuuaguaucccugugacucuagcaugauauauguuagaaauagcacagaauaaaauaucuuggcaaauaauugaaguaacacauucuauaagcaaucucuugaaugaaauaaggauauuugcaggaacauuguauguacgcgguaucugugaggaaucuucucagcuauuaaaugcaagacuuuugucuuaaaccucaaaauuuuaaaaagcaagaacacaaagcaauuugaaucacaauucacugguaaaugcaauauagcauucuuuucaauuuucaauuuguaaccuauauuugccuuuaaaguaucacuuaguuguguauauacaguaacaaaaauaagauuuucuuuccuacuuguggucugaguuuauuggauauuaaauguuggcaacauucugaagucauuugaacccaaagggacuuuucagccuguuguaauagugguagcagaaguaauuaguaaucauaaagaaggccaauucuuguuucucauuuugaagagcauguguuuguuguggucuguuauuauugaugguuuaucauaaaccaucuagaauuucaaaaaaguuucuuauuagcagugacauguguuuacaaaauuggcuuguccaguuuagaaguauaaucuuugccuuaacuauugcauuuuuuuuuuuuguaaacacucaucccuuaguaugugugggagauugguuacaggaauuccugcagauccaaaaccuaugaauacuaaagucucuuauauaaaguggcauaguguuugcuuauaaccuauguacaucuuccuguauuauuuaaugucaucucuagauuauuuauaaaauugaauacaaugugaaugcuauguaaauaguuguuauacuguauuuuuuagggcauaaugacaagaaaaaagucuuugcguguucagugcagaugcagccaucuuuuuuuuuuuuuuaguauuuuugauccaugguugguugaauucauggaugcagaaccuaugaauauagagggcugaugguauuuguuacuaauuaauuccucggcuguaggaccugguagucauuuauugaaauguugucacuuuauacucuccaaaagugcaguucuaacacaaaccaauugcuagguauuguuagcacaucuccaaaguggccuaagucgaaaaccaggugggagugaagugacacgugcucauugguguguauguguauaguggggcugggauugggauuucauugugcaaaugaauagaugucaucuucugacugguaaaaggcagguaagcagcauguuguuaguuugauauucucagaggcucaggcagcuagcugaauguaugccucaugaagacaucauuaguaggaagcauagcaauaaagggucugcagcaucugcugagaaauguggaaucauguuaggaaggacuggauuuggaggacacagcucauuccagaccccgcuucucucuuuagagaacaaaauaaggccagaauuaagggauagacugcccaaagggugugaaagcaaauuuagaaaaaaguugauuuaucaagauuagccuaacuuuucauguaggagugaaguagaugagaaauuagaaauuacagaguuucugaaauucauugcuuuuacuggaguguacuaacauguuaucauugcuaaggugucuguucagaagaucugguuauucacuaacggucugauguuuggcagcuuguguuuguagagguauaggagagcacuauccaucacaguucuguaccuaggauuuguauuucccuacugaacuuuguaccauaaugauucuccaucucagucaguugacagcuuacuuaaaugauuguggcaguuuucaagagaugaauagaucucuccuuggaauuuugaaaaugcaaacccacaucaguacuuuaugaacaguguuuuaaaaauagacuuuguacuuauuguuccucaauccugacguagcuucuauggggcaaaugagaagacuccaccucucacuuauggccucuuaggagccaccaacuauacacauaugaaagaaaaugaagcauuuuuaaagcaacguaaaaacaaauauuauaucaauugguauagauuguauuuuuaaguaccaguugcuuuuuggcacaaggaaagaauauggacuuuggaaucagagugagcuugguucauuuauuaguuaugaaauuuugagccaaucugucacuucucugagccugaguuuucucaucugcaaaauguaggugacaguaaugagggcuuagaucuaugguucucagucuugaugacauuagaaucacuggaguagggggucuuuaaauaaaacugaugccuggauugcaggaggauuacauagaaguaguuaaaagaagauucuuaggugauucuaauaugcaauaggauugagaaucacuagccuagacuaagguaguggugaaugaacccaagguuuccaacacuucaaauuauaacacguuugagugaaggauggacccaagauuuccaagacuucaaauuauaacacguuugacuggugaaugaacccaagauuuccaagacuuugaauuauaacacauuugagcuagaaguaguuuaacugcuucauuuuagaaaugaggaaacucaagaagcaaguacauaaauugauuuggugacuuuuuauauaggggcaugaagcagaaaaagaauuauuguuauucuuuggaacagaggugauggguuaauuauagugauauuauaagaaauaagaagguaggaaaagggaccagguuuuugagaaagaaaagcuugguuuccagccuguugaauguauggugaccgagguacauagauggaaauaaauguauaugaaagucccuuuuaaacugaaaauacucauacucauguaaguuaauauaauucaaguggaaauacuuagaaggauccggccaugugguauuggagguuacagacuagggguuaggcuggcaccugucagugcagaauuaguagcuaauauagcauugaauucucagggaguuaguggagcaugggaagaagaaaggucugaguagaauauuuagggauucucauaauuaggaggcaggaugaagagaucuuaaaagaaacuagagaagguagagaagcaagagaguuaaguccaguggcaucggagccaaaaaaggggcacauaucacaacaaauaucugugugucugcaagaccuguacuuuccagugucugcuggguaucaccuuaguguugaguagcugucucaaaauccaagcuugcuugccuugccuccucaaucaccccacaaaauucagcccuccuccuacaguguguuuaaucuugauagauggcuucauacccagcuuucccaggcuaacacuuaggaaucaucuuugauuucuuucugucauuguuuuucuacauuuaaucgucauguaguauuauuuuuucuaucuuugucuuguuuuuucuguucauugucauuacacuauuucuacuaauuccaaagccuacuauauagauuuuuaaaaaaaacacacuuguuggaaauguuauaauuucuucuauguuggaagugaaaccauggucauuauguguauaacaauucacucauucugggcaagagccaaaacacauccagaugggccauggauaggaugacaauauaauauucauccaaauugggauauuucugagaguaaaaggggauucuguuaauaauuuuaccaggauaacaggcauuaaaagggacugccuugugcaaccaggauauauggcuauacuagcucccugguucccaacugggagcaguucccuaccccaggggacauuuggcaaugccuggggacauuuuugaaugucauaaccggagcaggaaguguuguuuguuuuuuguauuuacugguagaggccuggaaugcugcuaaacauccugugauacaugagacaguccccacaagaaagacuuauuuggcuuuuugcauuuaauuaauucagcaagugcuuauuuaacccccuucucuaugccagccacugugcuagauucuggggauauauucaugagcaaagcagucauggucacugaauucauggaacuuguagugggagagaccaagauuaaauauauaauugcucaaauaaacauaucauuccaacagugagaaguacugugaaggaauaguagcuggcacuuugggagcauauaacaggggaccuggccuagaaugugaagugagggaaaguuuuucugacauauugaaauccaauggcuaagcagaccugaaccagacaaagauccuuucuaagaagaggugaggaagaguguaccaggugccaaaggggcauggaagaugaccacuucagauaaguggaagagggccagagugguagagggacuuaggguaggggaugggagguaggugaugagaggaggcugcugaggugauccaggggucuguucaaaggguuuugauuucuaaacaggaaaccauuggagguuucugaucaagggaaugaucagauuugcauuuuauagaaggcugcauuucugaaauauuaucuaauugugucacuaccuuuuuuacuaucuugcuuuaaagagacugagugcucacagcauuugagaucuguccuagcuagacccauuugcauuugugacuuaucucucacucuguauauucuucucauauacccaccuugcuuacuguuagaaagcugccuugcuuuuucuccucaaaaaugucuacauauuccgaggcaggcagaucacuugaggucaggaguucgagaccagccuggccaacaugagaaaaccccgucucuacugaaaauacaaagauuagccgggugugguggcaugugccuguaaucccagcuacuugggagguugagacaggauaaucgcuugaaccugagaggcggagguugcagugagccaagaucgcaccacugcacuccagccugggcaacagagugagacuccaucucaaaaaaaaaaaagugucuauauauuaaccuuccaguggcauaaaagcaauggcuauuuuuuuucugacugacauuccucugugcaauagaauguuaaucuaaauuguaagaaaccugcuuucccccauauggcauauuaaaagcaauuuuaauuuugaaagaaaaauaguucauccaagaaacauuugcauuuuguaauacaagguuucuugccaaugcuuuagccacacugcacuugcaaugacauacaauuguguacccuuaaaccucuguuccugcugcuccuccaccagaaauaccuuuuuucuguccaccauuuuuuugauuacauucuacuuguuuuucaaauccuccaugaaaccuuucuugguuucacaagauuaacauuuuauaauguucuuuucuguguuaugacugaauuuugugcauccaugauauuauuuagcacauagcgucuuguguuagcuagagcgggauauaggcaucugucuuccuuagugacuggaaaugaauauacuucuguaaccuuuaugacaugaugacauguaauaguguugcauuaaaaauauuguuuuuaacacagcaucguguagcugcgcagugaaugcuuauugaaugagggaaugggaggggugugauuaauauuuucaaaugccgcauagauauugaggaggacugagaaaauauauugauuuccuccacuggagucuuuccauagcuucucauugguagugggguaaggccuacaacaucuugccagacauucaaaggccuuaugcaccuuucauuuuuaucauaauuuuuccauuucaagccucuuggggagaaauagacuucucuggcugguaggaacacauguauuuuaauauuaugcuugugcuguuccacuuuuucagaaugaccucccuagccuuaacaccuuuacaaauuauacuuguucuucuggguucaauuugacucuuaauuuaucugcuuaauuuuccuucauagcaccugucaucuuugaauguacuacauuuauuucuuuuguucauuauuuuucucaccccucuaaaauuugaaugaacuuuuucaggacagagauuuuuggguuguuucuucauuuauagucuaauucugagaacuaugcuugaaacaucauugguauucaauauguauuuuuuaaaugagugguucuggccuuaguaaaauacuuuucuauaaaugugcuguacucuguggugugugugugugugugugugugugugugcgcgcacaggcacguauuuguauuugugugcuuuguggauaacacuuuguugaaaugcccuacuucuucccuuauugaauucuugcuuaggucauuucuucuaggaagcauucuuuucccucacugucugauuuuuuuggucuucuccuuuguuuauuuaucuuauauaucucuauauuacucucuuuacuuuuaaguuccuugaggggaaugaccaguguaacuugcccaucuuuagccucuagcguggugccugaacauuguaggugcuaaauaaauauuuuuucauuaaugaaagaaguugcgucaaauauuuauaaacauauuuugcuucuggaguacgaaauaggcacgucugaaaguuacaucauuuucuuuuuuucugguuagcaauuguuuagucugugaacauaauuagauuuaacagucuuguguugacuuucuaguaagucuaauaagaguuaguuucaaaagaacaggguaaccucugaguucuugauacacaaacauuucuuuacuacaaaagguauuuuguucagucucccuucuauaaccucuguaauuuuugcaguuuucggugacaacuucuuuuugugcagaauucuugcugcuuugauaucuuugaaggcuggccuuggcuccuccauuuuacuuguccuuuucuugggcauuuuaauuaccaugucccucucauuaaguaauccagcucuugauuauugaggcuaauggugaauagcaauaacaacugaaagccauuuacauaaaccucaaauugcaccuuaaaaauuauuuaaaaaugucuacucuugagaagucagcauggcauagagagcaaaacauaccucaguauaaaucaggaaacugagguucuagguuugauucuuccuggcuccuggguuuuuguguucagaaugagcuguguauguggaaauguauuauuacgaagcuuuuccugaaagaugguuauguaagaaaggaccaacaagacaugauuauuuuuaaaaauagcaaaaguagcuccccagcacauauuugcuaaacauaugcagguaauuugcuaaaugcuugacuuauuuccaggaagggguuaauacaguggaaaauucuggccuagaaucaugucuucuuuuauguguuagguaaggacuucaauaucuaauuuuaauuuccuuucuuuuuuuuuuuuucuuacagauuuucuuuauggaagcauuuguugccucgaucuuccacuuuagaaaaaugaaguuucuccuuuucuuugggagaggauauaucugaauacuugccuucuuggcauuuauacauucaaagcucagugcuagauuagagcuauuauuugcauagucuuuugguauugcccacuuuuggcauuaccauauuauuugacaauuagaaggaauagggaaggaauauuacaugacuguaaaagaguugguuauauuuuauguugacuucaaggguuccauuugaacuauuaugggcaauuaaagaguuuuacauuucuuuguuaguugauugguaucuggaguguuguaguguguuuguauuugcuuauaaauaaguauuauagauaaagauaaacuucauaaagaguggauauuuuggggaaaauuucauguggauaaugucauccugucuggcauugacauacacaaauucaaucucacauagucuuugccuugagagagcguacagucuauucaaaguugacacacaugcacaaaaaugcaauaacauuuuauagaugcuauuauagaaaaacuauuuuguggggauagugagguuauaaagguaggagugauguauuuuaucugaagauaguaagacuggcuuugggagagagaauuuuuaaaagaggaguggguauuugcuagguugauugugccaauuagcuuugcuguguaacaaaccaucacaaauguaguagcuuacaacaaugauuuauuuaggucaugauucuauggguuaauuuugggcuggacuuaguuggaugauuuuucugcucuuggcugguguauugguuuccuagggcugcuguaacaaauuacaacgaaguuggugacuuaaaacaacagaaauuuauucucucacgguucuggaggacagacuccaaaaucaaggugucaacagggcugguuuccucugaaggcugucagggagaaucuguuccaugccucucucuuagucuuugcuagcugcuggcaacccuugguguuccuuggcuaguagacucaucauugcagucucuuccucugucuucacaaggcucucuccccuguguuucucugucuuuuccuuuucugucucuuacaaggauacacaucauuggauuuacagcuugucuuaauucggaaugaucucaucauucucuuacccaaagcaagccacaaagucaguccagauucaaggagcggaggaauaaaaugauuccuccguaauuucccuugaugaaacgagcuguaaagucucauuacaaggacagcgaauaccuagaggagaccauuuuggucauauuugcagucuaccacacugauaaagagaaauggggaggaugaaggggaggguuaaauagggguggaagagaacauuuguagcauaauauagaguuaaaauguuaggcaguccuaggucaugucaggguagauuuuauguaucaucuuucuagguguguugguggugucauuuuauguggauauauauguguauacauguauuaauuuuauuugugauuuuuuuaaaccaucaguuuuuuuauuauggaaaaguucaaaugcauacaaaguaaauaguauaauaaacuccugugcacacagcacuaagcuuaaacaauuaucaaccuucuggugugcuugcuuuuucuauacuuccaucuacucuuauuuuuuauggcuuuuuguaagguaaaauuuacauacauugaaagauacaaaccuuaacuaugcacuuuugacaaaugguuguaucugucucauccacacgucucucaaguuauagaacauuuccaucaccuagaaaguuuccuugugugcuuucucuguuaauaauccccucuugccugcacccagguaacugcuguucauauucucuuuuucacaauagguuuaaguugccuauucuaaaacuuuauguaagugggaucauacaguagguauguuuuaauauuugucuuauuuuguucaacguacuauuuuuuaacauucaucuguguuguugcauguaacaguggcaauuuauuuuucuauugcugaguaguguuccauucaaugaauauaccauaauuaaaaaaucucuucuguguaaaucuuuuuguggauuuauguuuucauuuaucuuggcuaaaugaugaggagaagauuugcugaguuaaaggguuguuauauauuuauucuuuaagaaacugccaaaacuuuuugcaaaguaguuagacuauuuuacauuccuacuagugauaugacaguucugguugcucaacauccucuccaacauuuaguacuaucagucuuuuuaauuuagauauucuaauguguguauggugcuagcuacuugugauuuuaauuagcauuucccugauaacuaaugaugagcauuuuuuucguggcuuauuggccauuuuuauacuucgcucugugaaauguauauucaugucuuuugcccaguuaaauuuuuuuuugguuguuauaguaguucuuuauauagaaggacgcaaguccuuugaugaaaauuuguuuagugaauauuuucucccaguccuuggcauggcuauucauuuuuucacagugacuuuugaugagcagaaguuuugaaacuugaagaggucuaguuuaucauuuuuccuuuaagguuuuugcuuucugcauccuaagaaaucuuuaucuauuacaggucaucaggauauugucuuauauuuucuuuagagagcuuuauaaguuuagcucuuuuuuaggucugugauccaucucaaauuaauuuuuguguauaaugugaggcuuauuuuuuuccaaauggauauccaauugcuccaacacuauuuauugaaaagacuuuccuuuccucuuugaauuacuuuggcaucuuuguugaaaaccaauugagcauaugagcauggguuuguuucuggagucuuuauucuguuccauugaucuguuuagucucaugccaauaccacauugucuugauuacuguauguagauuuauaguguaucuugaguucacucgugaaaccccuccauaucuauuccucuuuuuucaagguuguuuugcuauuuuggguuuuuuugcauuuuuguagaaaguguagaaaucaacuuguuacuuaaaaaaaaaagcuggcugggauuuucaucuggauuauguugcaucuguagaucacuggugagaaucaacaucuuuuuuuuuaacaauauuaagucuuuaaggguguaucuuuuuaaagcauauuucuguucaaauaaaguagaggcaacaccuuuucguccauaaggcuauugggggauuaaaugagauaaugugguuucacccccuaaagauguuugaguuugucuccucucucuucccauccaucuugccugggcuaccaucuuuucuuuccuggauuuacuguguuaacucuauccaaaguggucucuucacauugaaaucagaagagaucuuugucaaagaugaaucugaucaugucacuccuguacuuaaaacccuugcaugggccaggcgcaguggcucacgccuguaagcucagcacuuugggaggacaaagagggcauaucacaugaagcuaggaacuuaagaccaguuuggccaaccuggcgaaaccccgucuaauaaaaacacaaaaauuagcuggggauggugguguguccaucuguaauuccagcuacuugcgaggcuuaggcaugagaauugcuugaacccaggaggcagaaguugcagugagucgagaucacaccacugcacuccagccugggcaacagagcaagacugucucaaacaaaacaauacaaaacagaacaaaacaaaacucugucucaaacaaaacaaaacaagauaacaaaagcaaaacccccuugcauaacuucccauugcuugaagauaaaauucaccaccuuuaauggagucuaaagagccugaauaauuuaaccuuuugugauuccuuggcccaaucuugacuuaauugcccucugaauuuucuuugcucuugccacucuuggcuucuuuauuucacuggauguuucauguauuugcuucuuuuggagucuuuacauauauugguccuucuugaaagaagcuuuuacaacauuuguccucuuauagcucugcuccuccuuucccaagucucucuucuuuguauuuuggcuuaaaugucacuuuuucagacagugaggucucuuguaaccauugucccuacccuucaaucccauauucucacugccugguucaaguuccuuugagaucucuauuuauguaucuauaucuagucuggcuacuuuacuuuuuaaauaaaaauuauuauuuuuuaaaaaauauuuuaauuuccauagguuuuuggggaacggcgguauuugguuacaugaguaaguucuuuaguggugauuugugagauuuuggagcaccuauaaucugagcaguauacacugaacccaauuuguagucuuuuaucccucaccccccuuccucuccuucccuuccccaguccccaaaguccauuguaucauucuuaugccuuugcauccucauagcuuagcucccacuuaagagugacaacauaugauguuugguuuuccauuccugaguuacuucacuuagaauaauagucucgagagcugggcacaguggcucacuccuguaaucucagcacuuugggaggccagugugggcggaucacgaggucaggaguuugagaccagccuggccaacaugaugaaaccccgucucuacuaaaaauacaaaaguuagcuggguaugguggugggcaccuguaaucccagcuacuugggaggcugaggcaggagaaucgcuugaaccugagaggcagagguugcagugagccaagaucgcgccacugcccuccagccugggugacagagcaagacucuaugucaaaaaaaaaaaaaaagaauaauagucucuaguuccauccagguugcugcaaaugccauuaauucauuccuuuuuauggcugaguaguauuccauuguauauauguaccacaguuucuuuauccacucauugauugaugggcauuugggcugguuccauauuuuuguaauugcaaauugugcugcuauaaacaugcauguguaagcaucuuuuucauaaacugacuucuuuuccucuggguagauaccuaguagugggauugcuggaucaaaugguaguucuacuuuaaguucuuuaaggaaucucugcacugguuuccacagugguuguacuaguuuacauucccaccagcaguauagaaguguucccuuuucaccccguauaugccaacaucuauuuuuuuuuauuaugaccauuuuuuugcaggaguaaggugguauuacauugugguuuugauuugcauuuccuugaucauuagugauguugaauauuuuuucaugaccaagaacccaaaagcaaaugcaacaaaaacaaagauagauuggugagacuuaauuaaacuaaagagcuucugcaccgcaaaaggaacagucagcagaguaaacagacaacccacagagugggagaaaaucuucacaauccauguaucugacaaaggacuaauauccagaauuuacaaggaacucaaacaaauuagcaagaaaaaaaccaaacuauccuaucaaaaagugggccaagggcacgaauagacaguucucaaaagaagauauacaaauggccacaaacauauaaaaaaguauuuuuaauuuuugugggcacacuguagcauuauauuuuuaugggguacaggagauguuuugauacaggcauacaaugcuuaauaaucacaucaaggcaauggggguuucuucacuucaaguacuuaucccuucuuuguauuacaaacaguucaguuauacucuuuagcuaaauauacaaaaaauuauuguugacuuuagucacccuguugugcuagcaaauacuagaucuuauucauucuuccuaucuauauuuuuguacccauuauccauccuucucccacuacccuucccagccucugguaaucauuguucuacucuuuaucuucaugaauucaaucguuuuaauuuuuagcacccacaaauaagcaagaacaugcaaacuuugucuuucugugccuggcuuauuucacuuaauauaaugaccugcaguuccauccuuguuguugcaaaugacaggaucucauucuuuuuauggcugaauaguauuccauuguguauguauaacaacauuugcuuuauccauucgucuguugauggacacuuagguugcuuccaaaucuuggcuauugugaauagugcugcaauaaacaugagacuggauaucucuccaaucuacugauuuccuuucuuuugaguauauaacagggagugggauugcuagaucauaugguagcucuauuuuuaguuuuuugaggaacuuugaaacugcucuucauagugguuguacuaauuuucauuucuaacaacaauguaugaguguucccuuuucuccauauuuuccucagcauuuguuauugcgugacuuuuagauaaaagccauuuuaacugaggugggauuauaucucguuguaguccugaagaguuuccucaauguuuuuuuuuguaguaguuucauaguuugagauaaaagauuucagucuuuaauccauuuugauuugauuuuuguacauggggagaggggucuaguuucauucuuguacauauagauauccaguauucccagacccacuuauugaagagacuguccuuuccccaauauauguucuugacagccuuaucaaaaauuauuucacuguaaauacauucaucuacagugauguuucuggguucucucuucuguuccauuggucuuugugucuguuuuuaugccaguaccaugcuguuuuggucaccauagcucuguaguuuaauuugaagucggguaaugugauccuuccaguuuuguuuuucuugcucaggauagcuuuggcuauacugggucuuuugugcuuccauauaaaucacuggauuuuuuuuuguauuuaucugaagaaugucaguaguauuuugauagggauugaguguauagauugcuuuggguaguauggacauuuuaacaauauugauucuucuaauucaugaacauggaauaucuuuccguuuuuuucuguccucuucaauuuguuucaaaaguguuuuauaguuuucauuguagagaccuuuuauuuccuugguuaauuccuagguauuuaauuuucuuuguagcuuuuguaaaugggauuacuuucuuggugucuuuuucagauuguucacuauugguauauagaaaugcuacugauuuuuguauguugauuuuguaucuugcaaauuuacggaauuuguuuuuuaguuuuuuugguggagucuuuaguucuuuccaaauguaguaucauauugucugcaaacaagggcaauuuaccuucuucucuuccaauuuuggaugaacuuuauuucuuugucuuguugaauugguagguaggacuuuuaguacuauggugaauaacaguggugaaagugggcauccuugucauguuccagaucuuagaggaaaggcuuucgguuuuucccauucaguaugauauuagcuaugggucugucuuacauggcuuuuguuguguugagguauauuccuucuauacccaguuuuuugaggguuuuuuuuuaucaugaaaggauguugaauuuuaucaaauacuuuuuucagcaucaaucgaaaugaucauaugguuuuuguccuucauuguguugauuugauguaucacaaugauugauuugcauauguugaacuauaccagcauccuagggauauaucccacuugguccuaaugaaugaucuuuuuaauguguuuugaaguugcuuuacuaguauuuuguugagggucuuugcaucaauguucaucaguuuuauuggccuguaauuuucuguuuuugauguguuuuugcuuuauuuuggugucaggauaauacugguuuuguagaaugaguuggaaaguauucccucccucucuguuuuuuuguaauaauuuaaguagaauugguguuaguuuuuaaaaaaauauuugguauaauucagcagugaaaucacugggucucaggcuuuuuuuuuuuuuuuuuuuuuuugacugggaaacuuuuuauuauggcaucaaucucauuacuuguuuuuggucuguuuagguuuuggauuuccucaugguucaaucuugguauauuuguaugugucuaggaauuuauccauuucuucuagguuuaccaauuuauuggcauauaguugcucauaguagccacuaaugauccuuugaauuuuugcaauaucaguuguacugucucccuuuuaaucucugauuuuacuuauuugggccuucugucuuuuuuucuuagucuggcgaaagguuuguucauuuuguuuaucaucucaaaaaauaaccuuuucuuucauugauuuuuguauuguuuucuuuauuucaaugucauuuauuucuucugugauguuuauuauuuuucucuuuuaguaaucuuggguuugauuugcuuuugcuuuucagauucuuuaagaugcaucauuagguuguuuauuugaaguuuuucuacuuuuuaacuguagaugcuuauagcaguaaaguucccuucuaguacugcuuuugcuguaucccauagguuuuggaauauuacauuuccauuaucguuuauuucaagaaaauuuucaauuuccuuuuaacuucuucauugauccacuguucauuaaggagcauauuguuuaauuuccauguguuuacauaguuuccaaaauuccucuuguuauugauuucuaguuuuauuccauuuuggucagagaauauucuugauguuguuucaguuuuuuuugaauguuuuaggacuuguuuuguggccuaacauuuugucuguuuuugagaaugauccaugugcugaagaaaauguguauucugcagccguuagaugaaauauuccacaaauaucuguuacuucuauuugguuuguaaugcugguuaauccgauguuucuuuguuuauuuugugucugaaagaucuguucaauauugaaagugaugugcugaagucuauagcuauuauuuuacaggguucuaccuuugucuuuugcucuaguaauaauuugcuucauuuauuuggaugcuacaguauugggugcauauauauuuacaauuuuuauaucuucugguugaauugaguuuuuuuuaaaucauuauauaaugacuuccuucgucucuuuuuauaguuuuugucaugaaaucuauuuugucugauauaaguauagcuacucuuugucuucuuuaguuuccacuggcauggaauauauuuuaucauucuuuuauuguuagucuauuugugucuuuauaugugaaguguguuucuuguaggcagcugaucauugggucuuuuuuuaaaaaaauucauuaagccacuguaugucuuuugauuguacaguuuaguacuuuuauguucaguuuucauuauuaauaauuaaggacuuacuccugccauuuuguucugugguuucuggucuucucuuccuucuuuucuucauuccugucuuccuuuuuuuuuuuuuuuuuuuuuugagacagggucuugcucugucacccaggcuggagugcaguggcaugaucucagcucacugcaaccucugccucacggguucaagcaauucuccugcgucagccucucgagcagcugagauuacaggcaggugccaccacaccuggcuaauuuuuguauuuuuaguagagacggaguuucaccauguuggccaggcuaaucuugaacucuugaccucaaguaauccaccugccuugggaucccaaaguguugggauuacaggcaugagccaccacgcuuggaccccugucuuccuuuuagugaaaguuaucuuucucuggugguacauuuuaauuucuuacucuuuauuuuuugugucccuguuguauguguuuugauuugaguuuaccaugaggcuugcaaauaugaucuuacaacccauuauuuuaaacugaugaacacuuaacacugauuucauaaacaagcaaacaaaucaaagaaacaaagagaagacuaauaaaaacucuacaguuaacuuugucccucugcuuuuuaacuuuuauuguuucucuuuauaucuuauuguacuauguauuaaaaaguuguuguagcucuuauuuuugauucaguucaucuuuuagucuucuuacucaagauaguuuacacaccacaguuacaguguuguacuauucuauguuuuucuguguccuugcuauuacaguaaguuuuguaccuucagaugauuucuuauugcuaguuaacauccauuuuuuuuuuuuuuuuccagauugaagaacucccuuuagcauuucuuguagggcaggucuaguguugaugaaaucuaucagcuuuuguuugucugggauaaucuuuauuucuccuucacguuugauggauacuuuugcuggauauacuauucuaggaaaaagucuuuuuuuucuuucagugcuuuaaauauaucaugcuacucucuccuggcuuguaaaguucccauugagaaguuuucugccagacauacuggagcuccauuguagggcauuuguuucuuuucucuuccugcuuuuaggauccuuucuuuauccuugccuuuuggaguuugauuauuaaugaucuugcaguagucuuauuugugucaaauuggcuugcuguucuguaaccuccuuguacuugaauauugauaucuuucucuagguuugugaaguucuguuauuaucucuuugaauaaacuuucuaccucuaucuuugucucuaccugcucuuuaaggcuaaugccuuuuagauuuaccuuuuugaggcuauuuucuagaucuuguagguaugcuuuauuguuuuuaaauuauuuuuucuuuugucuccucugacuguauauuuucaaauagccugucuucaagcuuacuaauucuucuacuugauuaguucuguuggugaggcacucugaugcauucuucauuaugucaguugcauuuuucaauuccagaauuucugcuugauucuuuuaaauuauuucaaugucuuuguuaaauuuaucugauaggauucucaaugucuucucuguguuaucuugaauuucuuuguguuuccucaaaacagcuauuuugauuucucugaaaggucacauaucucugucucucugggauuagauccuugugccuuauuuaguuuguuugguaaggucauguuuuccuggauagccugggugcuuguggauauucaucagugucugggcauugaaggguuagguauuuauuguagccuuugcaaucuggguuuguuuguaccuguccuuuuuucugaaggcuuuccagguauucagggggacuuggguguuacaaucuagauuuugggucacugcagccauaucugcauuagggggcaccugaagcccaguaacacuguggcucuuacagugguaucaccuugguggacuugguugagauccagaauaauucucuggauuacuagggagagacucuugcuuucuucccuuaccuuuuccccaacaaaaagagucucucucucucucugcuguguuuccuggagcugggggaguagugacacaaggacucccauggccaccaccaaugggaguaugcuggguaagagcugaauccagaauguacugggucucauccaaggccucucauaaccacugccuggcuaccacuuacguguggucaagucccuagggcucuacaaucaucaagugguaaagcuagccaggcuuguguccuucccuuuugggccaugaauuuccuguggccccaggcggguccagagaugcucucugggagccagggucuggaaucagaaacuuaggaaucuaccuggugcucuguuuuaguacagugagcugguacucaagccacaagacaauguccuuccuacucuuuucccuccccuccccucccccuccccucuucucccuugaaucucucccuauuacuaccaccucuaggcuugcagugaguacuaucuggcuaccgcugauguucacucaagccccaggcucuucagucagcuugugaugaaugcugccaggcuugagcaguggguuccccucucagggcagguccuaaaaugcuugcuguccgagagccaaggauuagaauuggggaccugaagagcuugcuuggugcucuacuccacugcagcccagcugguaccuaagcuguaagacaaaguccccuuuacucuucucucuccuuuucugaagcaaaaugagucucccccauggccuuugcaguugggaaugugcugaccggaagccagcacuucucugaauuccacucaaggccaaugacgaguacugccuggcuaccacuguugacuauucagggcccaagggcucuuuaaucaguagguaaugaaacuugccuugaguggaucuuucacuuaaaggcaguggguucccuucuggcccaggguauguuuagaaaugucaucuaggagcuagggcuuggaauggguacccgaggucucugcucagugccuuauucuacuguggaugagcuggcauccaaguuacaagacaaaguacucuuuacucuccucucuccucucuucaagcagaaggaaggggucuuuuccagagcugugcacuacuuugcugggcguucggggaaagguggugcaagcacucccuuggcugcccaaucuggugucuuauuaagucuuuugcccuccauguccacuggcacugagcccagugaagcacuaggacuugcccaggaauugugguucuuguggccuagacuuucaaauuuauuugggaccacagaacacuuuaccugcaguggcaagguuuccuggaacucaguuuccuaccacuuggauggacaauuucauuuuuuauucuggcagaauagaaaaugaaaaugagguggaggaacauauuauguagggccuugaagacucuuguaaggauuugagcuuuuguuaugagugccagaggagccaccggaggauuauaagguaacaugaauauuuuuacugcuuuguuggaaaguuacuauagaggcacauguauagaaguggagaggcugguuaauagcaguuaucaagggcagauuaaaggguguuuguuaggcuugguguggugguucacaccuauauucccagugcuuugggagguugaagcaggaggaucaccugaggccaggaauucaugaccagaccugcaacauagcaagacccuauaucuaacaacaacaaaaaaauuagcuugguauguuggcaugcaucuauagucccagcuacuucggaagcugaggcaggucacuugagcccuggaguuugaguuacagugagccauuaucauaccacugcacuccagccugagugacagagugagagucugucucuaaagaagaaacacuaaaaaacaaauauuuguuucaugcaugcaguaguguacuuggugagaagugguuggauucuggacauauuuaaaaaguaaggcuggcaauauuugcugauggaauuuaugugguugcaagaaaaagaaaagggagggggagucaaggauggcucuaagguucuuucuggaugagcagcuuaaagaauggaguuaccaauagcagaaauaugaaagaugcaggaggguagcuuugaguuggagagguggggccaaaaucaggaacucauggguagccauguugagcuuuagaugucuauuggccuucuaaguguagcugucaaguagggggcuggauguacaugucuggcuggagauauagaggugggagcuggcgugaagaaaguauuuaaagucauuaagacugaaugaggucaccaaggcuggaauccuuugccuuuauuuuguccauuguuuuucaucuguggggaucuacuuguaggucaagauccaccuucugcauccucugcccugugaagccuugcucugcucucucaugcaggcccauugcacucucuucuuacugugcucuaucuacuacauuggauugcaauugcuuuuauuuaaaguaaguuugaaguccucccaauuagaccaaagauuuuuauacagcaagccucaugucuucuuugccuuuauagcuucuguuguauagcagaugcucaauaaaaaugucugaaaugauuaaugguggauugauuaaaauauguucaagugcccacguccaguacuuuuggacugaggaagagcugugugaacugaguguggcugacugcacuugaagggaaaugccuuucaaucauaugcuccuuacugagguagaauaaaauuuggggugcaauaaauacuauuuaggguuuuaagauuuccuugguaucuauauauaguaguaaaaaccagacuuugacaaugugauaaccuacaauguuccuauuuugcauaaaaugaagccaaacaagagaacauuagguccaaugcauguucuuuuuauuuguuuuuaaaacuaguauucuuuuguuuuaguguauuaggaaaugaaagaaaccauuuauuuucuaucuauugagcuauauuucaaauaauuucauguuacacauuuuauagauuggcuuuguuggaaaaauaaaacuaguuaaauguuuuuaaucccacaaauauuuaauuuuuaagucacugauugaaauuuggucacugggaauggaaaauagaacuuuuuuuuucuuaaaaaaggauaagguuuuccuucuuuuauuuauuuauuuauuuauuuauuuauuuauuuguuuauuuagaaacggaguuucgcucuugugucccaggcuggagugcaguggcgcgaucucagcucacugcaaccuccgccucccggauucaagugauuguccugccucagccuccugccuaucugggauuacaggugcacaucaccacucccagcaaauuuuuguauuuuuaguagagaugggguuucaccauguugggcagacuggucucgaacuccuggccucaggugauccacccaccuuggccucccaaagugcugggauuacaggugugagccaccgugccuggcccuaaucuuauuuuguaacuauaagacaaaaugaaaauaauucaucauuucacuaguuagggauagucacauccuauuaacauuuagguauuuuuccuaauucauguuuuauacauauauauuuauaaacagaauaaaauguacaugcaguauuauguuuuacuuuuacauuuauuauuuuuucugauaacagauauuugauaagauaugauuuuuaaugguuucuagacauucuauuauagauacaccacaauuaaaaaauauucccccccuaucauuuggguuguuucuaaauuuuuaaaauaaccaugaaaguagauuacugcauaaaagacaauaguauuuuuaugguuuuugauauauuuuucuaaaauguucucuaaaaggauuauaacaaauuuacauugguaucaaaaguauaugagaguaugucuccguguaccuucucuaacagcuggacacauuauuaaauacaaucuuuuugcuaguuugagguguuaaucaaauauaccuuuuuaaaaaguuuuaaaauguacauuuuuugauuuugaaaauuuuuccauuuauuuauugacuguauuauuuuuaugugugaauugucuguagauggccuuuauuuaaccuuuuucuguuggguauaguaucauuuucauugauuuauaagaguucuuuacauauuagauuuaacauauaaaauuguguuuuuuuuuuggagacagagucucgcucugucgccugggcuggagugcaguggcaugaucucggcucacugcaaccuccgccucuccaguucaaguaauucuccugccucagccucccaaguagcugggacuacagaugcaugccaccacacccggcuaaauuuuuuguauuuuaguagagaugggguuuuaccguguugcccaggcugaccucaaacuccugagcucaggcaaucugcccaccucagccucccaaaaugcuaggauuacaggcauaagccaccgcgccuggucuauaaaauuguuuuuauaggucaaaaccaguugaauaucaggaacuucacaugguuuaacuuaaaauguuguauuuuauauugguugccaauguuuucugaguuuguccuuuguucuuauuaugucauauucuuaagccuauaacaaguuuaaaauuuuaauguaguuuaauuuagagaucccuuccuuuguagcuuccucuguugcguucuuauagcaaaaguuuucuuaccaucucaaagggagauaaauauuuuuguaguuucauauuuuuaaauugaacuuuaaaaauccaucuggaauuuuguuuuaauguguuguuaaggcaggaaucuguuuacugagugauagaaucauuauuuacagauuccugagcaaaauucuguuguuuaauuucaugccccauugcugaaauuacaaaauuaccaaacguccuaggaauguaauaucuuugacccugauucuucauaaaguacauuauucuagugacuuagcucagucgaugcacuucacagaccgauaauaauucagagaccuugauuuugucaauguuaaugaugcuuuuaagacagaagcaauaggguacacgguauuggauuuaauugaugguucuguucagcauaacauucugucauucauagaaccuuacuuauuaacccacaugaacaauauuguuaaaauuuucauuagaugcaaaaauccucaacaaaauacuagcuaaccgaaucuaacagcacaucaaaaagacaguacauuaugaucaaguggguuucauuccagggaugcagggaugauuuaacauauauaagucaacaaaugugauauaucacauaaacagaauuaaaaacgaaaaucauaugauuauuucaauagacacagaaaaagcauuuuauaaaauccagcauggcuuuaugauaaaaacucucaauaaaauaggcauagaaggggcuuaccucaaaguaauaaaagccguauaugacaaacccacagccagcaucaugcugaauggggaaaaguugaaaucauuucccuugagaauugggauaagacaaggauguccacuuccaccacuuuuauucaacauaguacuggaaguccuagccagagcaaucagacaaaagaaagaaauaauccaaauuagaaaagaggaagucaaauugucacuauuugcugauaguaugauuguaugccuagaaaacccuaaagacucauccaaaaagcucuuagaucaaauucaguaaagucucaggauacaaaaucaauguacguagaucaguagcacugcuauacacuaacaacaacaaaacugacaaucaaaugaagaacucagucccuuuuacaacugccaaaaaaaaaaaaaaaccacacacacacacaacuccccccaaaaaaccaccaccaacaaaaaaucuuaggaauauacuuaaccaaugaggugaaagagcucuauaaggaaaacugcaaaacacugcuggaagaaaccauagaugacacaaacaaauggaaacaaaucccaagcucaaggaugggaagaaucaauauugugaaaaugaccauaaugcccaaagcaaucuauagauucaaugcaauucccaucaaaauaccgucaucauucuucgcagaacuagaaaaaacaauccugaaauucuuauggaaccaaaaaagagcucgcauagccaaagcaauacuaagcaaaaagaacaaaucuagaggcaucacauuacccaacuucaaauuauacuacaaggcuguaguuacccaaacagcaugguagugguauaaaaacgggcacauagaccaauggaacaggauagagaacccagaaauaaagccagacuucgagcgaacugaucuuugacaaagcauacaaaaacauaaauucaguaaaagacacccuauucaauaaauggagcugggaaaacuggcaagccacauguagaagaauaaaacuagauucuuaucucccaccuuauacaaaaaucaacucaagaugaaucaaagacuuaaaucuaaaaccugaagucauaaccaaaagccaccuguaccccaaaaacuauugaauuaaaaacaauuaaaaacaagaggccagguguggggcucacgccuguaaucccagcacuuugggaggcugaggcagguggaucacgaggucaggaguucgagaccagccuggccaaaauggcaaaaccccgucuguacuaaaaauauaaaaauuagcugggugugguggcaggcgccuguaaucccagcuacucaggaggcugaggcaggagaaucgcuugaacccgggaggcagagguugcagugagcugagaucacgccacugcauuccagccugggcaacagagcaaggcuccaugucaaaacaacaacaacaacaacaacaacaacaacaaaaacaaaaaagaaaaacaagauugaaggcuuuaaugucccuaaacaaauuacauacuauauuaucauucuugauacagcuuuuugaaauuuauucauucacccuuguuuuggugcuauguguuuuuuuaaauugugguaaaauacacauaacauaaaauuuaccauuuuaagcauuuuaaaauguacaguucuguggcauuagguacauucauacugcugugcaaucaucaccacuauccaucuccagaacuuuuucaucuuuacaagacuguaucucucaacccccucccccagccccuggaaaccaccauucaacuuugggucucuacaaaucugacuacucuaggaaucucaucuaaaaagaauaguuuuuagaguacacgugguuuuugcuuacauggauaaguucuuuaguggugauuucugugauuuuggugcaccugucaucgagaaguauauacuguacccaauauauagccuuuugucccucaccccucucccaaccauccccuccugccaguccccaaaguccaugucaucauucuuaugcuuuugcaucuucauagcuuagcucucacuuauaagugagaacauaccauauuugguugucuaaguuacuucacuuagaauaauggccuccugcucuauccaaguugcugcaaaauacauuguuucauuccuuuuuauggcugaguuguguuccaugguguguauacacauuuucuuuauccacucauugguugaugggcacuuagguugguuucauaucuuugcaaaugacaugaauagacaauucucaaaagaagauuuuuuuuucuucagccaacaaacauauaaaaaagugcucgacaucacuaaucaucagggaaugcuacucagccauaaaaauaaacaaacuaagcuauaaugucuuuuuuuuuuugagaccgagucuugcuguguugcccaggcuggagugcaguggucucggcucacugcaaccucugucuccuggguuuaaguuauucuccugccucagucuccugaguagcugggauuguaggugccugccacccacaccuggcuaauuuuuguauuuuuaguggagaugggauuucaccacauuggccaggcugguuuugaacuucugaccucaagcgauccaccugccucggcuuuccaaaaugcugagauuacaggcgugagccaccauccccagccuauaaugucuuuugcaauugauuuuuuaaaaaguaaauugcuuaaguucuauaauuaccuuagcugucaagacauucuggugaaauuuguucuuuuggugagggaagacccuggcuacucucuuuaccacuugaacacgugaaauaccaguaaaaaguguuuuuagagagucugaagaaauauauguauucucuauuauccaaacucuuccuauuugaacucagaaacuuaauagguucagauaauuuuuuagauaaauggcuuguaucuaaauuguugccauuugcuaucuaaauugauggaauaaaacugauuuaguaauaaaccuuucaacucaaagaccaacucaauuuagauaaggaggaauacuuguauuggguaaugcuagcuuuucuguaugauggacuguucaaaggaugaagaugaaauggaaaugccuguuugaauucaaagaacugaugaaucucacauucucugagaagccccccccagaggucugcgcuuuagcacccuagaguugccugaggacucauuggguucguagggcuuaguggggcuagcuagaaugcggaacagacuacagucacaacucagagggaagggaagauuugcucucuugaaaugggcuugucagagcugaaaguugggauuuccauggccacuagauggcuucaguuaccugcaaagaaagguucaaacccaaagguacucugggguugcuuuucauacuuuaagaagaucauuccauuuuuggacuauuuguuuucugagggguagauggcagaagcaauugauaaaacuuaaaguuuuugaggauuaucuagucuuaccuucucauuuuacauauaaagaauauuuaggaaagcuuucccaaguugacugagcucuacaggagcagcaucagagccagacucaagucuccugcguccuagucuaguucuuuagcuguugaaccagugacaacaaucuauuuuuuauuccucucaaguaauaugacaggguugcaugucacugacuaugccugaguccuggagaugauguguauuggaauguuguguuuaaggcagguggugaaguggaugcuggugaccaucuuaugggcagaacugagcaaugguaguaucuacucccaacccaguugagcuuuuagauuaaugaaaugacuaccugccaugauccacuguuggggaguuuuaaacauuuuuguucauucuaaauaauccuagacucuuacaugccuuaucuguuauauacuuuauguccuuuucucuucuucagaugaauagcaacauuuaaacaucuucuuuucucucacaauuuuucuauuuuuguuuacuuuuagagacaaggucuugcuauguugcccaagcuggauucaaacuccugggcuuaagugauucuuugccucuucaaguagcugggaguacaggcuugugcuacugugcccaauuuauuauuuuugauuaauaucuaaccuuuagaaccaaguagaaaauacuuuaaaaaaaaaucaaaaguuucuguagaaaaccuaacaaacaaaagugagucaaacaaauccauuauguaucaacucaaaauggcuuaucacgauguugaauuuuuuuguuuuuauggcaaacuuagggaggaagcaaauacaguauucaucucagcuacuuuuuaugacauguucacaaaaacaacuuuaaaaaaauugugugcuaaaauuauccuuaauuuauauauuauggcuaguuucuagaguaaaacagaccucagggagccuaagagagaaggaagagugaaagaauggggaauaaaaaagauaaugaggaugagaagagugauagagaaagagcuaguaaaugggacaauuggcugcuucuagcuaaaagugaagagaaagagagaacaaaccagagggccacuugaauaggagagcgugugaaggaagcugugaugggaggaccugggaaagagggcaaacaugaauccuaaggguagagagggaaaaggaugaggaaagaccgggggcacuuuuuuuuucgcaagaccuccgauggcuucccacaucaacuucguugguuuucuguccccuggguuguccugucuucacuccugugccuccuuccuggucuucagccagccagcagccccgcuccaucucuugguccauuguaccuccaaaguguuguucacaugcuuauuacggaaaugccaaguaguagcuggaaggaggauuaaaaacaguacuuaaaaugcucuuagagcaggauuugcuuuguaguuagguccccaaaagugguagcuauuauaauaauuaagcuuuuuucccggccuuaguggaccuuaacauugggaauacuucuguaaauacaaaucguguuugaaacauuugaauugagucuuugaaguaaaacuuuagaaauagauauauaguuauuuucuuaaugguguguugaugcugaauugaguaaaaauguaguuggucaagacuaacucuacugaaauuuaaaauuaugucucauuuucucuuccuuauuguagugauuuaaagggagugauagucacucugagugaugauggucacuugcaguguucauaccuggggacagauccuucucuguuccaagcuccaaacguucaaucucgagaacuaaacuaugaugaacuugauguagaaaugaaagaacuucagaaaaucaucaaagauguuaacaaaucacaagguaucucauuugcagcuuuuuauuauuuuaguauucauuaugaaauucauauuaucuuguagauagauauuauuuuguguauuuguuaauuuucuccucuaggcuuaauuaaaaucauauuuguaaaaacaguauugcucuuuagcacacaaggucuuuaugucuacuuuguauguuauggcuucugaaaacguauuuuauuuaagaaagugcuuuuguuguuaauguuucauggacagcacuaucuaguuuuuuucuuuacaugcuaagaaaggaagaaguacuucuuuggguggugguuuuaggccuugagaagagcauuaaaauuuagaguggucauuuauuaacuucuuauacuccugaaacaacuuuaguucuucuuuuaaaagaaaccaaagcacaugagcuaccauuuugcuacuaaaaauguagucauuugcagcuuagugacauaauuuauguuuguaguuaauuaaccauccaaaugguguguagcuugcgguaugcugauuucuaaugacucagaggcugaugauauuuucaguucccgaguuuugaauaacucaauauuaucuuacuuugggacucaaaaggguauaauuuuuuuuuguaaauuaaaaggagaaacaaaacaccaauccugcaguuugaguuggacaugugaaaagcauuacuucaaguucccuuuucagggucagguaaaaguauuuuuuuaaugugaaaaaauauggacuauuuucacauaaaagaaauguuaaaacaaguaggaauaauaaaagaagcagagcaucaaaagccaaccaaaacaacagagccaaucuuaauccugauccaaucauuuuacuagauuuauguacuuuugagucuauguuaccaacauuguauuccucugguccugaggaauugagauaauauauuuuuaaaauacaaauauuaaaauaaaguuauuaugcuuugguuucacacauucuuuuagaaaguuuugaaaguaaaccagugaaguucaggucuuucaaguaccuccaauuacuuaaaaaucuauuuguugucagcgcugccaugucaaauagagagugguuaaaaugggaugugucauaucgcaguauauaauuuuuuguuucaauuuuuguuacuagcauuuuugggaauaauagaauuauaagucuuguuuugucauuuaaaaauauaauuggggaaggguggcauaggcaugaaacaugaaauuuccagaguucauuaaauaauauggcuuucauuucaaauuuuguccugagauuuugcccuuuccauaguaauguuccaauaauauuuugauuaacauuaauugaauaugaaauuucucagaaaaucccuuacagcuaaaaguuauuucuuggugguuauagugaugaccuugggugagaaaguuuaggcuguuuuacuugucauuaccuugauccuucaguaugucuuaaaauaaccgcuaauuaagauagggauacacccacagacuuagguguaaagugcaugauuuacauaaccucaauuuuuaauuaauguuugaaguuccuugccccuucuaugccaccaucauuuaguuuuauuucugggaaagaaacaaagggaaacuuuuuaaacugagagguauuuaaaacauuuuauuucuagauauggaaaaaaauuuaguaacuuguacccuuauaaaaccaugguauguuuguuuauuaaaauaccuguaauuaauaaaagcacaaaauuguuuuauuacaguuuuagcuucucuuuauuaugagaaguuaaaaugcugaacuuuuugaugaccccauuauucauuuuaaugucacuuauuuuaguuugggggcuuuaacuuacaaaaaauguucauagccuuguggguuauguucaguacuuaaagcuuuuaaaaguguuuucaaaggaagaguugcagcaaaauuuaaagccaguuuaaagaguacauuuuguuguacacaugguguauauuaucuaccguaauaaaaguguuuuugaagcugauuuuauguguguaaguuauaagaggaauguauguuguaagcaugaaaucauaguaauaauuucuguauggcucauggauucugaagcuuuucauacucaacucauuaaugugaauccugccuaguauuuuuguuaccaguagucaacaacaucuacucguaggaacuuucgaagacagaauuuuauuuaugauuuagauaguugaucauguugucuaccuggcaugaguaugaaggacugggugcaacauugagauaggugcccauacagcugugucuucagaaagggacagagagcaguaagacguggggauauaaaugaaagucugcacuccauuugaaauguccaggauaacuaagcugaugauaacacugaguaguagaaucauuuguauuuugugacauuguucauuuaggauucugucuggcuacaugucacaagauacccaaauaagauagagguuucuuucuuucucuugcaaaagaaaccuagugaugggcaguccaggguuggcuuggcaguuccacagucaucagagacucuugauuccuucuaucucggagucauauauugguccugcauggcuuuuggaacuccugcccucgcaucugcugcugagucagcccccuuaaggagcuuucuuggaagccacacccugaauggcuccuacuuaaaucucaccagccacuccaagcugcaaaacuggcuggggaauuacaugacuuagcugaguauuuuguugcuuagaauaaaguugggcuuuaaguaaagaagaauugaagaaugguuauugggaugggcaaugaacagccauuuguacucucauuaaguuauggaaauucccauuccaaaucgugcaguuuggugggaaugccugauagcaguuguaggcaguuccuuuuuuugugagauagcugauucauauuuucagucagccauccucagaguguggggaauguuuccucucagggucacagggugaucucagcaauucuagguguuaugugcagauaugauuuccagggaagaaucaucaggcuauuucuccugagucucuccucuuauuagggaggaauagcuuucccagaaacaugugccagcucucuccacucccaacuucccuuaccuuccaucugccaggauuaagucccauguucauggcuaaaacaacaaauggucaguggaaggaaaucaugaugauuggauuugaccguggagccuggaaggggugacuuucucugagaugaaggugaauagcuccacaaaauuaggguuccaauacacagagggaggagggaagaauggauguuaaguagguagccaauaguuugauauguauauauauuauauauaugaauauauauaauuuaaaaauguuuuuuguuuaagaucuuuguugauacuaugaauaaauaucucauuaugcaacauaaacauguuuaaaauuaugaaaauaacauguguaugguaaaaauaauucaguacuaaaaggauaaauaaugaaaggugaaucuuuguucaacccaagauccuaguuucacuccuuaaaggcaauccuuaucaagagcuuuuguguauuugucuagaaaauauucauguuuauguaauuguuuugacacaaauaugugcauauuagacacauuguacuacaucuugcuuuuuaaaaguuaauagauauauuuuggaguuuuuaaaauaucaguauguaaagauggacagcacccuuauuuaugacuuugggacauugcauaguacagauauaccaugauuuauuuaauaauuagccuauuaauagauauauagauauuuagguuguuuucauuucugaaaaaauaacuacuaacauuagagaccuccuugggcaugguuauggguauuggauacauucuugggaguagaauuaagucacaggauauguacauuuuacauuuugcuaguucuagccaacuuaccuucacaagggcuguacuaauuugggcuuccacuaguaguuacagagagggcauugagauuccuaaugcuggucagucaauggcucacaucuuagcaaauaucugcagaaaaagacaauauuuuuuaccauauuauagagggaaagaauuagcaucaagcuucuaauacuguaaugcauuaguuuuuucaacuugugaguauguuuaugggguuuuuuuuauaugugguauagacaaaccuuuaaagaaaaacuauauauagaaaguuuuacuuuaugauuaaauaauuuuucuuuuuuuaaaucacagguguuuggcccaugacugagagagaagaugacuugaacguuucugucgugguuucuccuaacuuugauucaguuucuguagguguacuugcagauuuuaaagggguuuauaagagugguaaacucugaugaauuaggaccaaaaugcauugguuuaaaguuugguccuccaaguagacacuucagggaggauaacaaauuguaggccuuguuauuuucuagauaaaaacauuaguagccccuuagugccaguaaggagcuccuugggcaggauuucuguuuuaaaaagaagugggguuguaggggaagagagagcaguaggagggcuucuugcccuaguucuaauccuacuuaaaaaaauuuuuuuucaaacuuucuuaguaccauagcauugacguaauacuaauguagcugaauaauacugacccuaccagauuuuuguuggagauucaguuagauaagguuugugaguggccuagcucaaaguuugaugauuucuagucuuuaauacauuaugguggugguggugguaggguagcuuaagaguauauaguugguccaauacuuaauuuuuccccuguuucuaucugugugacacaaggcaagguacuuaauuuucuuagucucaauuuucucauccacaaaaugggaauaauaauagaaucuacuuuguugaauguuaugauaauuguuaugauugucauuaucaucaaauuacauuuuacuucuuucuacauuauaauaaucaacaucaucauaaucauuaugauuaucacaaccaucuauguccaugaguugucuuguucacugcuguauccuuagugcuugccaaauaaugggugcucaauauauauuugcucuaugaauaagugaauuaauacaacugagaaauagaaaggaugaaaggaggacuauucuugauuauauuacuucaucuccucacuuaaguuuucuauaagcacuuguuaggaugugauugauuauaucucacugacugcaguuuaucuguguagaaacagaugaucaccaacagaaauugguguagaaauugaucuguguagaaaucuguguagaaauugaucaccaacagaugaucaauuuagggaagugguugaauucacucauuuuacaauauuuggaguucauaucauauaauucugcuugggaagugucuucauuauuuagguaucagaacauacuuuaaaacguauaucaugagugucaaaagauuaauuuuaguauaaacagccaauccaauuugugauaaaaaucacauuaacauuacuauauuauaguaaauuggguacacaaaaaaguaggacuauauaugaaagaaacauucacccagcugagucacauaguagaggcacuguuuuaaauauuggccauucagcacacaccauuuuucauucuaccugaaggguguagucuaaguggaacauuucugcuuaguuagcugacaaauguacacauauuuucuugcuguggaaaugacuuuuuuuuccuuugggcaacuuauauaaguuuuucuagguucucuucaacauaggcuauuuggaaugaggaauucccuuucuguuuuuuaggaacuuuuagucuuuguaggaaaauuccuuauguaguagcacuguguuauaauguauauuucccuauugguaacccugaaugcuauuuccucuuaaguaggugucucuuuccagcuucauuuucccuguguuacuauuuuuucuuucuuaagagauuucuugagaguaucauauucaucucauuggaaaacauuagcccuacaauuuauguggcuuuggugccaugacgucuucuuauagccauuucuuucuugcuauaguuuuauguucccaaaggacugcuguccuugaaguaucuagguguuuagucauggauugauaugagcaggaaacaggagauguugguuucucuucuagaucuguggauagcuaaauguaaaauauuuccuggauuuuagguauuagagcacaaagccuggauuaauauuuuacuuugaaucauuauuaugaaagcacacaucucaaaaaaguaauauaauuuauauuagaauggagucuuucuuagaggagauaagcauugcuaucccaucuuccuuacugagaagcaagaucauaguuuaaauaugguuuccuguggagccauaaguagaauaugaaucucuuaacuuugaauucugcugaugcucauuacaucauagaauccccauugcuuagaaguggcuuaguuuuucuuaguuaaaaauacuucaaguaaaaaaacgcaauggaucauauucauugguuggauagagacauaauuuuaauugguccccagaauucauaacgguauuauuagaaaauaugucaccccuuagucuuauucuaucauagagcauuuuccccuaccaauguaucacucuaaaaaauaaguuauaagugauaagggaaguguuuuauguauuauauuauacuauguauucuuuaagaggaaggagcagguaacacgaggugacgcucaaagaaugccuauugaauuaguuuaugauaugcacugguuaaaaaaaaguuucccuucccuuccuuccauuccccuccccuccccgccccuuuauuuuugagacagagucucgcucuuucacccaggcuggagugaaguggcgugaucugggcucacugcaaccuccgccucccggguucaagcaauucuccugucucagccuccggaguagcugggauuacaggugccugccaccaugcccagcuaauuuuuguauuuuuaguagagacgggguuucaucauguuggccaggcuggucucgaacuccugaccucaggugauccaccugcuucggccucccaaagugcuaggauuacaggcaugagccaccgcacauggccuacuuuuauuuuauggguguaaggccacucaaucuuuauaucauuagcugcaugucuuagauacauguuguuaaucagaauaacacauaccuuacacagggugaaaauacagggaccugaaagaauggcauaauauuuuucugggacauacagggaggucuucuucuaugcaauauaaauaacaaguuaauagaauuaauacuuucaauauuuaaguaaaucugggaauggagugguuugauaaaauaugugaccuuuucuuuccuuuuuaggggaugaguuuuuuuuuuuuuuuuuuuuuuuuugaggcagagucucugucgcccaggcuggagugcaguggcgugaucucggcucacugcaagcuccgccucccggguucaugccauucuccugccucagccucccgaguagcugggacuacaggcgcccgccaccgggcccggcuaauuuuuuguauuuuuaguagagacgggguuucacgguggucucgaucuccugaccucauaauccacccaccucggccucccaaagugcugggauuacaggcgugagccaccgugcccggcccaggggaugaguuuuuaaauauuagcuuaugacuuucuggacgaaggcaucaaaaaagccagauugucucuuuuagucugucauuagaguaauaaaucuuuuauaguuuccuauuuugauaguaggaaauauacauugcacucauuguguucacucacugcuguguaauauugacaucauucuuucuugccuucucaauucuguguuuacagcaagcgaccgauguugaggugggaacugaccuugucccuucugucacggugaagguauuguaccagauuuuagacuguaaugugcaaacaauaugauuuauuucauuacaucugucacuguugagaacuuguaaguagcuuacagaaauguaaaauaaacacuuggcauuuguagauuuuuccccagccuugaguagugaauagaaaaccuuuacuguuacuugcaaauauaaaacugguaauugcauuuauagcaauauguauauaauauaaauaacuauuaugaaguacuguuaccauuauuuaaauguguagcaugauccaggcuuuuuucuuuggaaauaaaguuaacauuuuaaaucugcuaaaggaauugugucaucaccauucauaauagaacaaucaaguagcaucauacauaguauacugugaauugauauuggagaagcacggggaugguaauaucuuucuucuaccuaugauuaugugguguuugaaaagaauuuccagccaucucucugccuuaacuuuaaguggauguauuuacagcaagaaaauauugaaugaagaugccacaaaguuagaaugguaacaaauugauagucuggaaaauagaauauuaaggaugugguuuugguuaagauuuuuaguccugucauuguagaauuuuagaacuagaacuuaaauguagaaccuucuuaaagcauuuagauuaaaauaugguaaucagucagcacauuauuaagcugaaaauauuuaucaugcccagaccuuggaagcaagggaagguuguggauuuuggcaauucacuuagucaaaacuuggauggggcuuuauauuuucuuagauuauggguugcucuccuuggaggagcuugacagggcaccaagcuuuaccaauuguguucgcuuacacuggaaccagcggguggcccaaauguggagaucuuuggucgaacuugaagggagcugaaucuuacaacaguuuccuaagcuaaguuuuuuggauucuugccacuggaaacaaggguggucuuuccccaaccuccuuucccccaguccaaucaaaggcucuaucucauuaauacuuccgaaucuggaaaggcauuaguggcaagaaaucaaacacuuaagaaaaagaaauaacugucgaguuccaggaaugauuuguacuuuuguauagggacaccucuuuuaaaucuaucuacugauaacguucagacacauacauguaauaauuuaggagugcacuguuaauugcaauaagagaucuugugccuuaacuagauaacauugcucaugcuaauuguacccccagccaaccaggaauuagcaccguaaguaaacauaccuuucccucccaugcaguucuuaagcuuucauguguaguagccaccuuaaaaugauggcaugacacuacuggaaaauucuccuucuguucguggaacuuacuauauuugagaauaccuaagucacaacugucuuucucauugccauuauaaaagcaugagaaagaaugcaacaggcaaggggugcagaaaauuggugggacucacacagcagacacaaugucuuccugauccugucugacaguuucuauacaaauuucuacuauaaaucucuccuuaugaccuuuuauaacaacagcagccaagauauacaaccaugcaaguuuccaucauaauaaauccuguuaauugagaaaauuuuuccauccguuccaagugaaugaagauguggcuaccuugaguaugugugcaugaugcgugaccaucuauuccaggcaacuaggcgagugguuguucauaccuggccucugguguuguauuuauauaucuaggauaaaaauuugguauuauauuuccuaaggguuauauuucauaagaggcagaaaauagcauggaaaauucuuguaucaauguuuuauauuuucuccuuaauauucuauaauuauuuuccuguuaaaauauaagacuugugaucuagccaagucuuuaacucuuuuuuggcucaaacacaacuauucuuuguuacuguuguuauuuucauuaccuaucuccuugauuuguauuuugaaagggccuagcccauuguugggguucaauaaauaugugcaugagagcuaucaugauugugcaacuaaaccaaaugcaaacccuucuuguuacaauguaaaauucugugauuauugucuaaguagacaucguugugccaggaaaagccagacugcucuuuuucaaauggcuuauuacuacuuaaaggaauuuucauuuuuacuuaaaacugaguucucauaagacuuuccuggucacuauuuucaacucucuacuuggauugauggcuuugcacagguuauuuaccuucucugaaccucuauuuuuuaaacuguaaaauagggauacuuuuucaucugcaaaguuauuuugagucuuaaccacaguugguuaaaggcaugggcucaggauucuggcagauagcaguuaaauugugguucugccacuugcaaucaaaguggccuugggcaaauuacuuagcaucucugagccacagucuuuuguaaaaugguuuaugaugguaccugucaaacauuuuuguaaagaguaaauuaaauaauggcacguaaauaauuuguuagcaugguuccaugaauauagaaaauugcuaauauuuuuuaucauuaauauuauucauuuuauuuaaaaauauauguacagacuaguauuauauuauuauaauaguagaauauuuaaauugugucuuguuuguuuaauggacuagcuaguugaaagaaaguuguuuguagcacuugcauggugucuuccugccauaauaaccaucaggguuuuacuaaaaagguauuauguuuacaauggccagacaucauugaggaaguuuaguuuguggcaugaugauucccuguguauucccaggauuuacaaaguaaaaauugaggauucauuguucaugguguuuaucauauuuaauugcaucgauaguugucuuaaaaauuuuccuuugcaagucaaaauuuuuauguuuuuaacuuauuuuuaaguugugcagaauacucacaucacuuaaaauuaauacauuuacugaaucuaauuauguguucauaauguuugugggccacuuguauauucuuguauauauaaaaauauuauauauauuuaaucaagaaagagguaauacaugcuuuuuauugaaaagaaacuucaaaacuacuuuucuuaacaauaagaaugguccuugaauuauguuaauguauguaucugucucauauaacaaagucuaauaacuagacugaacugccguauagaaaagguaccauauagaauggugguuuauuuuauuuaauuuuuuuucucaugacauacgagucaccaugauagaacauuuuaaaauagcuuuacuuagauauaauuuagauacuauauuauucacuuaguuaaaguuacaauccgaugacuuuuaguauaguguauuuacagaauuuugcaacuaucaccacaauuuaauuuuagaacauuuuaucccaccuaaaagaaaugccauacccauuagcugccauuccccaucucucucaucccuaagcaacuccuaaucuacuuuauuucucuauagauugccuauucuauacauuucauauaaauggaucauacaauaugugguucuuuguggcuagauuuuuucacuuagcaucauguuuucaagguucacccauguuguggcauguaaaugaaauaaugcacauaaauuuguuagcaugguuccauggauauagaaaauugcuaaugguuuuuaucauuaauguuauucauaauguauuucauuucuuuuauugcugaacaauauuucauuguaugaauaugucacauuuuguuuauucauucaucaugaugggaauuuggauuauuucugcuuuuuggcuauuagcauauuguugcugugaacauuuguguauaagauuuuggguggaccuauguuuucguuucucuugguauagaauugugaaguuauauguuaaauuuauguuuaaccuuugaagaaacugccaaacuuuucuuagaguagcuguaccaauuuacauuuucacuggcaauauaugaggguucuaguuucuccacaucauugcuaacacauguuauugucuguccuuucgauuauagccauuuuauuggguacguaguaguaucucauugugguuuuuaguuuguaucuccuucauaacuaaggauauugagcaucuuugcauguacauauugccaaucuuuauucuuuugaguaaagucuguuuagcuuuugugcacaguuucuacuugauagaauauuuuaaucuauuacuuacuguauuauguuuugugacuacucauuuuuuccucagguaauauuuucuaauuauuugcuaguuauguuuaaguaguuacgauagucuaucaguuugaauaaaauguaauuuucuauugauaacaauuucuguuuccuuaggucacacugcagaacagagugauauugcaaaaagccaaauuaucagucuacgugcaaccaccauuagaauugacuugugaucaguucaccuuugaauuuaugaguaaguuuuuuguuuuggcugaaagucuaccauggugugaauuuuuuaaaaauacuaguuuguucauuuaauggcuauuauuucaugucugaauggugagauugggaucgucccaaaaucaaugauuguguuguuuugcuuauauuuucccucuuagcaucagcaugaacguucaaucaaugauuguugggucaaauuaaucuuuuacgauuacagauuucuaggugcuuuucugaacuuguuggaccuauaauuguuuuugauuuauuuauuuauuuuugagacagggucucauucucauuggcccagacuggagugcaguggcaccaucauggcucacugcagcuucgacuuccugggcucaagugauccucccaccucagccuccugaguagcugggacuacaggaaaacaccaccugacuaauuuuuuguauuuuuaguagagacgggguuucgccauguuauccaggcuggucuugaacuccugggcucaagcaauuugccuaucucggccucccagaguacuaagauuacaagcgugagccaccacuccuggccuguuuuuagauacuaaaauuuagaaggcuuucuuuauugguguuucuuuagugaucuauuuauugaaucgguaauguuugaagaauuaauauggacuuuggaguuuggccugaguuugaauccagcucuaacacucacuugauguguaaccuuaggcaaaaacuacauuaguaaucacuuggagccucauuuauuuuaaucugcaaaaaggggguaaugauauuuguuuuacaagguuguuuugaggauuugauuaaaaaguaaaucuauaaaagauauccauaauaaugcuuaaaauaguagacaugucauuaauggcaacucuuaguaagguuucuuuguauagaaucucuuacucccaaccauuuauauccaaauugucauuaguccuguuaagauaaucugaacuaccuuucaagucuuuuuucuuuuuuuaguuuacuauagcuuuucugcuaaggcuucuaucucuuauucacgaagucaagaacauaucuuucuuuuuuugccuccacauaaccaacccauagcugagugccugccguuaguaggaauucaacaaaucuuugcagaaugaaugaauaaacgauugagugaaguaaccucauaggugauacccagccauugaacuuuugcuugcauuucugauuuuguauaacacuuccaauuugucuuucuaaaauacauucuaaauaauuuauuuuuuccauuuauuauggcucucuaauacagguugggggccagauauguuaacauagaugagcacgcacaaucuguuaaguggcuacuguguaacacuccucauccauuuucuccuucagucuauguucuacccaugauaaauugcuauuuuccucccaaauucucuugcccuuuuguguaccguuuucucuguucaugcugucuguuccucgaaguaaagaacagcagugguguagaaugccaguuucuuuguaccuuguucuggaguuaauuccuaguagcuguguuaccuuaggcaagcuucuuuuuuuguuuuuguuucuguuuuugagacagagucucacucuguugccuggacuggagugcaguggagcaaucucgguucacugcaaacuccaccuuccaggugucaccacgcccagcuaauuuuuuuguauuuuuaguaaagaugugguuuucucauguuggcuaggcuggucuugaacuucuggccucacgugauccgcccaccuaggccucccaaaguguugggauuacaggcgugagccacugugcccggucuuaggcaagcuucuuaaucucucuguauuucaguuuucucaucauaauaaaugaggacaauaauaguaucaaccucacagguuuguugugaagauuuaaagaguuacuucauguaagugcuuaugacaguaccuggcauguggugagugcuuauuaaauuuuaacuguuguuaauaacaguugccccaaauuauguaauuuauauuauuuuuacauugcuuauagcaccagauuugacuagaacaguaagcuuuucuguuuaucugaaaagaaguuauacaccaucagaauuggaaggaaaugcuguuguuucuuauuccagaccaacagguaaacauacaggcuuaaucauuacuuuaaguuguuggaguuaugaguaaaaugcuuaugcauuuaagaugagaaaacauacugugaaauaucauuaaaugagaaaauguuauuuucuacuguuaaguaaaaucauguuuucauuacuuuuauguguuaugaguaguucgugauaaggcuauuuagcugauuuccauauguaauguuugguucccucuuuucaguuaauagcaaaucugauacauuuuuauuccuaauagaagaauguuaucuagucagacuucauuuauuugaaccaaaggcuaguauugaugcaggauuuuugcuccuuaguucagccauaucugcguucuuauuucaugaccaggaagaauuaggcaugcggacacagugagugaggaggguggaauuuuuaaagcggguuuccaccucacaaauugaauaccagggcucccacaccugagcugaugaggccaggcuccuccccugcguaaggcacuuauuccuuguggccccaccccauuuccccagugcgcucgcgggcauguccaggcaagccauagguaguauuugaaaaggcagcauucgauuggcuaaaagacauuauucagaaagaaucaauugggaaagggcaggcacacagggacagaaguucuucuggguucuggguuucauccaggaccagcaguacggucuuucagcccucaggcuguuuuaagccugaagguaagauuucaccugggaccuuuccguauuugcuuaggcguuugucugccuccuaccucuaucaguaugaauuaguagaaaauaauauuauggauuacuccaacauuagggcaguaaucagaguuuuagacacuguuuuagugacuaaauaaaacucuuuagcaucuuauguguuaaaauacuuaagaacagaucuuuuaaaacuuagucugcauuuuucaaccauuuuuggccauuaugcuuuucugcaauuugaaagacagaauuuagaagauuacuaaucauugguauugguugaaagugaauuagaaauuaacauugagagagucugcagaaugccaagagaagcaaaaagagacguuaucaauaguauuauuuacuuaaauuauuauaaaaaagaggaacuggauugacuuuaaaggggaaaguuaaaagaaaauaaauucaaaaaguaacuggaaauauuaauauuauguauuuuccccuuuauugagucuuuuuugcuguuuggcuagaucauauaucuuuacuuguuuuuuucccacauuuacaguggaauaacacauucucauagacuucugagaauggaaauauaaauaaauguauuguuggguuucauuuauuuguguuauacucucaauuguggauugacuuguguuuggagagucauuuaagucaucugugagaaucuugaaauuuuaauuuguauuuuaagcagauaugugucaaauuuguguuguaacuuuaccacagauaauuuguugccuucuuuucccccuacccauuuuugcauugccugugauggacagaucgaaauccugaugguaaguguaaagauaauuuagaaaaaaaugaauuucagaacugaaauuugaugaauugaauugguauuauaccaugaaugaacucuuuuuauggacugcucuuuuaacuagaagaaguucuuuaggaugauacagugccuugauucugcuauggagagcauaguagauguuuccacagagacuugucauuauuaguuguuucggagucaugagaaagaaugaaauuaggaguaaaaauagaaugucuuuuuugaaaaauauuaaagguguuauugacaacuuauuacugcaagucauugguuauuuagcugcaugcucuguuauuuuaccuaaaagaaagaaagaguuuaaaaaaaguguuugucacugaauucuaaguuguguuuuucuacauccuccaagagauucaccucucugugauaagaaugguguguguguucgcucugugggcauauuccuugucuuguuuagaauuuguaggggaauguuaucaaacaucugacucccucuaacuugcuugggucaguguuguuacucacuuuguuuuccccaaaucuuuuguuugacucugcuaugauucugaucacaauaugaacuuaauuaaguuuguuccuuagguucuccuuuuagguuuugagcuuuuugagggcaggggucaagcacucaucuuugaauugcauacuaacagaguacauagcaggcacuacaaguaucucugauuauuuuucccucuuagauauagacuuaaugugguaguuuaucuuuauaaguuauuuuaagauacauuuuagauagcaauauuaauuaguaauaauuaaauaaauauaaugaaaugacuuaaagauuguggcaauauuuacuaaugccguuugggugaugccaacaaucugaguugcauagcacaugucaucuugauaucuggaaguuauauauauauuuauaugagaaguguuuuaauagaaguaaacgauuagcuuaauaacacaaaguauacuugucaaauuagaauuugggucauuaaaaaauaaccugauauuaauaaugaauauuuacauuuuaauuagcuagauugccuguaauuuuuaagauuuuggaccaaauuuuguaaaauaucauguuauuauuuaaaugauuaguuuuaaguuuaaaaaaaucaguuaagguuauuguucaaagaaauuuauuccuucuuacuguaaauucagcccaaacuaugaggaaaaaacccacaauuuauagaaaugguaguguuucaauacaaagugaaagcugguuuuaauaaucucuuugauauauuuuaaaauuauaauuaagcuuuagggaguggaguugaaauauucagcggcaccuaguaggcaagaaaauaauauguugccacuuagaucuuacuuacacacaaggcuucauauuucaaagacugauccauuuuauugucuugaucuguucgggcugcaaugcagauaagcaguucugcuuuuauauguggaaaaagagaggcaaacgagguuuuauguugucccauaaggguuagucuccauuauuucugcauuaaaguuacauggcgugagcaguguaaaacaugaaugcagaugaagcacaguacguagccagacauaacaggaaggaaucaaggaaguucuggcuaccagacauugcuacugcuuugggguuccuuguuuucaauaugaaauuacucuagcaggccccuggaaagaguucuaaaggcauuauauagauguauaauauauagguaugguuauuuuauucauauauacuuauuuuuuuucuauguucuuuuuuccuuuauuucuuuaaagcacauuuuggcuuccaauuugacagugauacugggcuuuuggggugugccagauguaauuagaagucucuuccuggaaguaaaauguucuguuagagguaguuuugaugagaauauucucucugaguguuaaauaauuuugugauuaauugcaccauaguaguuacgacuauccauuuccucuaguagguuaggaagggaaauguuugaaggagaggugauuauaucugguaaaaagaacuacagaacagucagugugauaaaugacuaggccaauauuggaguaaaauaaaugacaaaaguuucuuuucucucagcguaacacuuagagaauucaguaagccagauauggagacuacuuugccaacuauagagagaaaauacugcugaugguaggcaaaguuaggaccaauuagucucuuucaacuaaguugaaagcuguucugcuagcaacugugaaaagucuuuaaauacauguaauucuuuuccuucucuauuacaaacacauacacccacacaugccucuaugagucuuuggcuucagguucuuagacauaauuacagccugaagaguaauugguagccaaauuuacacuucagguuuccuaagaagguguaaaucccaguagaaaugugccucugaugaaccucaugucuaaaaacuagagauuguauuguaaaauccuuggauuuuaauuugauaguguuauaaaauagugacauucuaauuuuucuuuuaagggaugguuucuguagacugguuuuuuuaaaggauuucauaacuuuuucucccuaaugguaaaacuuuucaagcugccaucauuuaaaaaauagccauaaucauuuuauuaaguaugagugucaucauuuuucaaaguaauguuuuccaaauguccuaugaaacaggcuuauaauuccugcagagaaaagauauucuggaggggcucuacaaaucuuagcaacugcaaaccauugcccuagugugugauauugucauuaacugaccuaacugaacuguaaauugaguuacaauguauuuuccuucuuggguuuauuagugcuugcaauccauuuguuucgauuucugaaaacauauacacuaccaguuucuuuagcucuggguucguggagauguaggguaauaaucuucaaauauauaggcucagucacuuauaggcaguguuguugauuauauuuaauuuuuuuuaacugugaauucagucaguaccugguccaaguaaaguaguggcuacaguuuuagcaguauaguuuuggaggaacauucacagccaaauucugguuugaguaauuagcucagaauuugguugaaaguguauagaagauaguuucuuuuugugccuguacagaauugucagaaaaggaagcauuuguuuuuguuguacuagucauuaaaaaugaagaagauggaaacaaguuuaaguuuccuuguucuuuccagacuguaucuauuaauugauacaaucugaaauuuucucuacaguuuacuuauuguagaggaaacauacucaguggguguauuuccauaauuugaggauauauagaguauauggaaauuuccuugaaguuggagaaaguagugcuuuguaauuguuuuguggugauauugacagucgugcuuugugcaguaucuuagaucauguuaccauaauauuuugagucaaaacaucucaucauuguaaaguacaaauacacaugccucuaaaaaccucacagaaugucaugaaauaauacccugggacuuuucuuaagagacaccaguuguaauucgcaucuaggauuccaggagaagugaauuuaacaucuguugguuaugagcaaaaaaugagcuacguaaaacuugauggauaauagauuauauugaagagaaugacaaauaugcuccacaugcucugaaaaaguauuuaauugaccucauauaucaauaugcuugccauuguugaugauuucucacuauccuagugaauaaguaguacuggaaaguguacucccagcuuggauguggaguaagacauacaauuccaauugacuuuagcaaaauauauugcuaauuccagggauccugcuuugggaucaugucuccaaacuaacugcuucugcuuuugcuauuuuuaagcagcucccugacuccucuauaaagaaauaaaggaauuaauguguggauucaucaaguagaguuagaacauuuugaguguucaguuuuucuacagcacuauggcacggcauaggcuucuauauauuaucuuucaucuuaaccagucaaaaacagaguucuagaaaaaaggagagaaaacuaggauuuuaguauugcuuuucuagauuuauaaguagagagccuaauuugcuuugguuucaauuucauuuucuguaaaaauauugaaaaugauuuugaaaagcuuuauacaaauucuaauaugaaacucuucauugucguauauucagcuaccuauuucaguaugcauguaugaguauuaaaaucauuuaacaauugaaugacugucuaaaugucuaaaaugucacuuaaagugauauguaaaguuaaauggcuugagaaaaguauaauucauauaaagguaauauucuacauauuaauguguaaaaugaacauggacuucaauagaacuucagaagagcaaaucuugcuuucauguucauaaucugaaucuucaucaaguaaaaaaagcuaaagauuuaaaauguuuuugaguagagaaauuuuuagauaugguaauauacagucuuaaagauaugauagaaacuucauauucuuugcucauguuugcugauagucuuggauuagggcuagagcucugaaggucuuaaagacuuaguucaguaauugaauguaagugacuauaauguuuuauauaguauccaaaugugaugauuuuaaaaauaugauacuauuaaagacagaucucaugucuaugcuucuuuuaaaauuuuauuuuugccuuguaccuuuugaaaauaguaaugaaauaugaaucaugauaauaauuuacaguuauuucagcuuuguuaagcaaaauaggcaggcaacaagcaaaccaagauauauugcugcucaaacuauuaguaguacaauuuuuuuuugccaaauuauuugucaagucuaugaaucuacauaucucucuuuuauuuuaggcauuccgcgaguuauccaauguaaauuuagacuuccccuaaaguuaauuugccuaccaggucagccuucaaaaacugcaagccacaaaauuacuauugauaccaacaaaucuccagucagucuucuuagucucuucccagguaagacuguugaaauaacaugccugcagcaucaaaaaugcuaagaauuuagaauggaauccuucaucagcagauaaugaugggguaauuaucagauaauuguuaaguaagaguauaaaaaugccucaaggauuuuucccuccuuugccuguucaaaggugaauagcuuauaucaacaagguaauaagguauuccuuuuaaguuugauuaaaauuaucauaauaauuauuuugcuaugguauucagaaauaaaaaucaaguguuucucuuuagacugaauuuuuuuggcuuggaauguaaauauuuauuauucaucuuuaugguagguuuuuggauauaucugucuucuaaguguauaaauauuuauuauuuucauuguaggcuuuuguauguguaccuuuuaaaguauauucuuaugucucugaaaaguaaucuuauaaguagaugcucuuuguacuguuuuauucugcugucuacagcagcuagagggugugcauccugugcuucugguuguuuagaaggguuucauauuuaaugcuucaauaucacagugaacauuugggguaauuugugaugguaugacuuggagagaagugucaguuuuucuuucugaguggcuuagaaacuaaagaagcuuuuuuggaucaaacauccuuaguaaccaagguuuuuagugugucaugucauuaauuuucuugauggugggguagaauugaagaauaaaaucuuggaauuaaaucaacccuuuuaaauccuucauuaaaaaucagcacuguuggcuaggagaugcaucuucaccuuugcauuaguggauaagauuuaggauacaaacaauacuucucacaagguuuagaaauuuaugguaagucaacuuuuguguuauuaacuacuuaaagugcuuaaaauuuauuuuuuauuaauuugcaguauuucaaaaauuuuauuuauauauaacucugaaaaaucuccaagauuaaauauuuuacuacaauuauucuauucuuaagugugaauugaguuuggagauauauauguauauauuguuagcaaaauauuuuuuaccuuuuggguucuuucucccaucucuucuuuuaccuccuuauuuuuuagucaguuuucuuguaacaaacuuggauuaugaaaaaaacagacucacuaccuuuuguaacaucuuguauaaacuuauuaguuucuugggucuccuauacuaccuuaggaacauaguuggaaauuauauguugaacaccaaauuuauugguggcuuugaaaaacguuuaaacaccugacuucugaggaaggguugaucuuuacuguagauaaaugcaacccaauuagaauugaauaaaaacacaugccuuugagcagaaagguaaaguccauaagauacgaauuguauaguguguacuaaagaaagcuuagaugacuuauccauuuuccuccugauuuugggcucaauuguuuugaugucauuaugcucaucagcauauauuugcuucuuacucacuuuaggaaugggacacaaugacaaauuuuuaaaaauuucuucugggauccaauauauaugauauagagugguuuuuaaaaaauuccuggauuuguauuaauguuaaacaugcuggauggaaucaugugcuuguuuaaaauaaguaucacuucacucugauaaaaguaagacuuagauaaaguugccauugcaaaucuucugugucuguuuuuuuuaacugaaagaagcaaaauuaaugagcuuuauagagaagaaauaaaacaacuuuuacucuacaugucuucccauuuguuuauuccaguucucuuucugugaacaaauauagguauauuuaaaauagcuuuaauuuuucuuauuacaaaagaaaugugaaauuuagaaaauguggauaaccaaaaggaaaaaagugaauguuacuaguaauucuacuauccagcaauaccuuuuucuguuucauuacauuuuucuaaucuuuaaauaaauauuuuuucuaagcauuuauccccaaaaagaauuucacuugucauucuguuuugagacaucuuuuuacaccauuagauauuuuugauauaugauuuuaaugauuacauaguauucucucauaaauccauacuauaaaaucauuugaccagcauuauacuuuuagauauuuacguuguuuuuaguuuauuaauauuguaaauauaccugugaugaacacuguuguaacaauacuucuucaaauuuauuauaguuuauuugaugaauauuuaaaaguggaauugcugggugagacagagaaucagaauguuuuuaaaacuucugaaauauagugugaaauugacuuccuuaaggaauaccaguuaacccuaacaacaauguuugaauaaaggcguccaguaccccaaaccuugccaauagagaaucuuauaagaaaaaccuuuuaauaugcuuaauaauuauauagaaaacauuuauuuacauauauaaauagcuaucuggggugcuucuggcaccccagaaaagugaauuaagcaauaaauaccuuuuuuuuuuuuuugagacagggucucauucugucacugagguuggagugcgguggcacaaucauggcuuacugcagccucuacuuccugggcucaagcaauccucccaccuuagccucuagaguagcugagacuacaggcauauaccaccaugccuagcuaauuaaaaaaaaauuauuuuguagagauagggucccacuguguugcccaggcugguuuugaacuccuaggcucaaguggucuucccaucuugggcuccuaaaauguuggaauuacaggugugagcuacugugccuggccaagacauuucuuuaucucauauaaagaggaauccagaagugggcaguggaagcuguggcaguaguuuaugacuguuaugaaauaccuagcauuuuuucuuuuuuuguaaucuaccaucuuuaguguguugacuuguuccacgacaauaagauauuugcuucagcuucaggcaucauaucuuacuacaagguaggagguagggggaagaaauagcuauauaguaaugaugauaacuuuuaucagaaaaggauuuuuucacaagauucccuaggaaauuucugcuuagguuucaauagccauaauuuuugucacauggcuuccuuuagcaguacaagaggcugaaaacuaaaugggcuagagaaaaggggguugggaacauguguuaaauuaccugaccaucaauguaugucacaauaccaguaguuuuauacaaaaauuuuacuuaaauguaauaacagauaaaaugucauuugauaauagucuuuuauguugcucaaguauguuucuacauuugcuugucaauacauuuauauuuuaauaguuacauaauauuccauuguuuggaggugucauguacauacagauuuuuuguacuucucuauuucucuuaggagaaauucuuuggagacaaaugcuugaguuaauggguaugcauauuugaaaacuuuauucaaauaccagcugccuuuuugaaaaauuguaucacguuauacucccagcaucaagguucaugcgcaugauagcagcuggauucauuaaaucuuuuaaaauuuuugauauuauuagguaaaaaaugacauuucauuuuuaacuugaauuuccaauauguuuaauuuuucuuaacuacuugcauuucuucuuuuaauuccuucuuuuaagguuuauauuuuuagguaguaaaauuucuuaauuacuuucuucguaguuucagguuuucauguuaugccugcaaugaucucuauucuaagauuauaaaauacuuacuuauuuuuucugguacauuuuuauacacuuuuguucucaaacacagcuucagugcauauuuuugugcuuuuaaaaaagcuuaaauugaaguaugacuuuuguaccauaaaucacacauuugaagcguauaauuuugaaaaguuugauuucuguauuuaucugugcaaccaucucaacgguuaaguugcugaacauauccaucacugccaaaaguuuccuuuugucuauuaguaauuccuuauccugcaucccaagcaaccacugaucugcuuucuguuacuagagauuaauuugcauuuucuagaauuuuauaaaauggaacuauauaguauauguucuuuuucauuugucuucuuuugcuccuuuauuugauaugugauuugcaaauaauuucucccagccugugauauguauuuugauugucuuaacagaaucuuuggaaaagcagaaguucuuaaucuucauaaacccccccguuuaucaauuucuuaaugguucauaaauuuacuguuacaucuaagagauauuuccuaauccaagguugcaaaguuucucucucuuuuuuuuugauagaaguuuucuaguuuuaaacuuuacauuuaagucucuuccccauuuugugcugauauuuaugugugaugugagggauggaugaaauucauguuuuugcaucugggugucuaauuguuacagcacuauuuuucagacuauccuuuuccacugaauugccuuuucaacuuuguugaaaaucaucugaccacauuuauguggguguauuucugcuuucuuaauuuuguuccauugauauuuuugucuauugcuauauaccaauaacauuguguuuugaugacuguauauuuauaauaagucuugaagucagguaguauaauuucuccaacuuuauucuucucaauuuuguuuuggauauuuuagguccuuugcauuuucauaugaaucuuagaaucaucuuguaaauuaaauaaaacuggcuguugggauuuugauugggauugugauuguauugauuccauauaucaauuuggagagaaccaauaucuuaacaauauugaacaugguauaauuuucucucuguauucuaguuuuuuuaagaugaaaaugcagaccaucguucauuuauuuagggucuauuuuguuucucucugugaggguugguaguuuuucauguacagguuuuacagaucuuuugucagauauaucccuauuucauauauuuuuaugcuauuguguuuuauuucaauuucagauuguucuuugcuaauacauagaaauacaauuuauuuuauuuucuuuugauauggagucucacucuguugucuaggcuggagugcagugguacaaucucgucucacugcacccuucgccucccagguucaagcaauucuccugucucagccucccaaguaguugggacuacaggcacacgccaccaugccuggcuaauuuuuguauuuuuaguagagauggaguuucaccauauuggucaggguggucucgaacuccugaccucaggugauccaccugucuuggccuccccgagugcugggauuacaggcgugagccaccccacuuggcuuacaauugauuuucuuauaucaaucuuguaucaugcaacauuguuaaaccacuugugggcucuauuagcauuuuuguagauuuaaucagucagauuuucuacauagaugaucauguuacaugcaaaucaaaacaguuuuacuucuuccauuccaacuggauuguuuguuuuugcuugcuuuuugccuuggcuagaaccucugggauaauguugaauagaaauggugagaacagacauugucuuucaccauuaaguauguuuuagcuauaaguauuuuuuagauuuuuuuuuuuuuuuuaaccagguugaggaaguucccuucuauuccuaggucgcugagacuguaaucaggaauggauauuggauuuuuucaagacuacuucuacaucagcugagacauucuuaucguuuucuucuuuauuugauuaaauaugguggauuacauugauuaauuuuuaauguuagcccaaccgugcauucuugagauaaauuauagauggucaugauauauuaucuuuucacuauauuuuuauuuuuuuuuuuauuuuuuauuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuucacuauauuuuuagauuuaauuugccaaacuguauuuuagaauuuuuguaucuauguucaugagagaaauugauuuguaauuuaguuuuuuucuacaguuaugugaauaauuuuuacuccauccccccacauuuuauguuuugaugucaugaguuucuuauaucuggauauuuauacuucucuccagauuuggaagguuuucucuuauuguuuugcuugauucuguucccuaaaucuugcagccuuucuucuuuccuuucauuuuuuuccuccucucacuguauuuucuaauaaucugacuuugaguucacagauucuuucuucugcuuaaucaguucuauuuuugauguucuuccuuauauuuucccccuucccccuccucuccccuccccuucccccuccucuccacuccccuucccccucccauccuuuccccccucccccuccgcccuuuucucccauccuguccuccucccccuccucucaccuccccuccucucucagggucuugcucugucauccaggcuggagugcaguggcaugaucauggcccacugcagccuugacauccugggcucaagcaauccuccgaccucagccucccaaguagcugggacuacaggugcaugccaucacaccuggcuaauuuucuuauuuuuuguagagacaagguuucacuuuguuacccaggcugaucucgaacugcugagcucaaaugaugugccugccucggccucccagagugcuagacuuacugcgcccagcuguuuucauuucauucauuguauuuuuucagcuccaaaacuuguuauucuucuggguuuuguuucucuuuuuuuuucuuuuuucuuuuuuuuccugguuuguugagcuuccugaaaacaauuauuuugaauucuuuguuaaccuguagauguccauuucuuuggggucagcuacugggaaaucauuguguucuuuugguagggauaugucuucuuuguuuuucguguuucuuguugccauacuuugaugccggcacauuugguggaucagucuccuuuuuccaacuucgugugcugauuuugguacgaaagaccuucuucuaugggaaggucaagggugcuggcaguaugagauguagagguucuggcccuggcaagggcauagcaauguaaacuguuugcagcucucuuagcugugguugguguugguuaagauugcugguauccucaguugccaacucugugaguguucucagcaauagugagggcuauugggaucuuuaauggcaguggaugcuaggguacucccaaucucuuuuucucccaccagggaaaucauggccaaggggaucccucuuggcacucuaucuggcuugugggccaguuuccagugccugaugagugguaccuauggagaugccauggagccaaguccugaagcauggguauguguaaagggacuuugguucugggcuuugggugguaauggcaccagugccuggggcacaggaacccccacugcuguguuggugaugguaugugaggcauuaguguuuaugaaacagccggggagcccgagaugggagcauggaugugugcaguuacucuggcucuggguuacaggaugggaccuuguccucuauggcaggugauguaaugacugaaccauaggaauacgcagagagaccuuagcuguaggaccucgggugugagcuggcucacucuggugguagcucugguaucugagacauggaugggcauagugcagccacagagccagugucugaaguaugcacauucaugaagugacugugaccuggggguuaggggaaugugcaagguuuggagagguggugguuuugguucuggggugguacaacagcagcuacuucuugagcaagggaauauggagccaugccuuccucucugggguucccugguggaaauggcuauugguuaccucaguggcaaaagaugcuggugucuucugugaagcaggcugcugggaaccauggaaguucccacuccacggcugucaccaauaggcuguugccuuuauucuuugucacuagccaucuguaggcaucuuagguaugccgauauaaccagccauuuguuccguuuugcugcagcuucuuacaugggcccuugagcucccacagggcuauuaugguguuugaauagcugucuuucucucucucuaauuuuuuugcuggggaugaagacuaguguccccuacuuuaccaucuuggugacauccuuuacccccgugaugauguuuaauguuucuuuuuuuuuuucuuuucuuucuuuuuuuuuuuuuuuuuuugagauggagucucacucuguugcccaggcuggagugcaguggcacgaucucggcucccugcagccuccaccuccuggguucaagcgauucuccugccucagccuccuggguagcugggacuacaggcgcaugccaccacacccggcuaauauuuuguauuuuuaguagagaugggguuucacuguguuagccaggauggucucgaucuccuuaccucaugaucugcccaccucggccucccaaagugcugggauuacagucaugagccaccacgccuggccuaauauuucuuuucucugucacuuugucuguaaauugguaaguuggaucuacagcuagcagagucaagauugacuauucuggccggaguucuucauggaugguaguauagacuuucagcaaacagagggcacauaauauuuguuugucuuuuuuugugugugaugguaacagccauugauauccaaugcugagauccauuaguucacuacaggcugaaaaauagauauuuuguuucuuucacacuuucuucauuuuuuagcuggauuauuucuacagagagaaccuuuccuuuaguaguuguuauauggugcaguuugaguaggguuuucaggauaaaugcuugguucuuucccuuuauuacuaauuuuuaaaauauuuuaaauaaauagagcuuaaaauaaauaguauugauucucuaggaucauccaauagugaccauuuguuuuuauuuuguuuuuaagucucuguaugaacucaugccuuuaaacauauuugauguguuuuacuccauugcaauuauuauuuucuuugauacucuaauauuuuuaucucuggccaguaguagucucuuuaagcuggcuuucaaguuguuuucauaaaacccuacuggcucgguaauagcuuccuugcuaucuggcaugaaaagauauucuaaguucaucuugcacguguucugucucauauguggaaucaaccauuagaauaaaugaaauuaaaugacuccagaguuuuaguguaaggcagaaauuucauuaauuggaagcuacuauggaaaucaaggugaauauauuauagcucacacauggaguuuauacaugacuagugacauaaaaaacacgcaucauucaacuaagguuccuauuucaaauguguucauuuugccuucugguuacauaaggugauuucucucuuuucuuuguagguuuugccagucagucagaugaugaucaggugaauguaauggguuuucacuucuuaggaggugcucgaauuacuguucuugcuuccaaaacuucucguaaguaaaaccauguuaucauugcuuuuuaaauuuuuuucuaaggauaccacaucacagaggauacucacaucaauaauuccugcaaagggugauguucauuuagauuucaguaacuaaaagccaugauauuaaguagauaggaugugaaaguuaugaagugaggauuguguuuuauuagagaacacugauguugcccaagauuaccuuaccaugaucuaaauuucaccaaaaaucagauauguaacugauauauucacuuuaucagaguguauguaauuuuugucuuggagcuaagaagagucuaagagaggaauuuaaagaaaugaaaaauauuuuugagguagguauauggugaacuagauuugggaacuccuagaacuuggaauuuuuuuguuugcauauauucuuguuuauucauuuuggacauuggcaaagaugacagugaaaguggauagcuuuugcugaguguaauuucaguaggcagaaagguguaguaacuauauagucaaguuugaauuuaaauaugcuuuauugauuugguugcuuuauguaugcgagaauaauagucgaaacuagucaauguaaaacuagcucuugacauauguaguauacugaagcuacugagcuuacugaguuauacacaccuucaugggaauaaaguaagauauuaagaaaggaaguauuuaacgaaucuguauugagagaaaaaaguacacacacacacacacacacacacacacacacacacacacccauacccccuugaaauagucuggcucaggacauuccaauuaaaaaaaaaacucuaguuuuucuggugagcuuucacuuucuacccaugcauuugcaguuguaguugguuauugcuuuucuaauaauaagaguacaauaaggccaucuguuuuugaaaaagaaaaguauuagcaggaggaacagacaucccauuuagaaacuguaacaauguuuuuauggcuaaaaucauaauaguuucuggaauaugucaauuggugacugguaaaauagacucagauacuauugaagacucaauaauaggucacagaaauaacaacucugagaagaaagaggagauucuuuauuuucaugauuuuucugauuggucaugauugcaguauucuuuacauuggcaucauuuuuuaaaaaacaaaucauuuuauuuugauaagaagacuuaacaugagaucuauccacuuaaaauuucaaauguauaguucaauauugcuaacuguaaguacauagcaccauuuugcuuugauuagcuuuaaucuccaguuggaugguagaaccauuuuggugcauuucucuuaguuuaacaguuauccuugguuaaacuaaaaaaguuaugccaacauuucuuugggaaauuguacacauuuguuugacugcaguugauggugccauauaaugaaucugcaaaugagaccauuaaaaaaggcaaaaauuuuugcaaaugaauauauuuauauccuaauguauuuuauuuauaacuuuuaauauaaaguaacaaguagaacccugauguugcccacgauuaccuuacugcuaucuaaauuuuaccaaaaaucaauuauauaucugauuuauucucuuugucugaauguauggcaauucccugacuuagcauaguguagguacacaaaaucaaauaauggaauaggacaggaccuuuuaaacaaggagccaaauaaacuguguaaauugaaaccugaauaauagucauuacaauucuaugaugguuuuuggcuacagugacacacagaauccuaccuaggagaugccuauggugauggagagagauagguauaaggagaguguacuuuucugagauugaggcagauguuggugcuccuacugcuuuaucagaguauucauuccuaagaaaggaaugaaguaauuuguacccaaucuguguuugacauuuuucauuuuuugaaagguaccuaguauuaauuguaguccagcaaucugcuuuacagaaaaauccuacaaaugaaagaaccuaguauuucuuccauaguaaacagucaaaugauucauaagucacauagaauuguccuugacucuuggauaguauuuucuguggguuccguguauucaucucuuuuuaaaaccugcuugguaaucaaccaagccuucauguaugcuguauggcgauuuuaguuccuuuuucugauucaguauagaccagucaaagcaaacaagagaaaaguaagguguagcucauugucucagacaccaaaccaaauucccuggggaacugaguaggauuauauuuuuagaaagcagaauaguagcuggguguagcagcuuaccccuuuaaucccaacacuuugggaggccaaggugggaggaucgcuuaagccuagcaguucaagaccagccugggcaacauagugagaccuagucccuauuuaaaaaaaaaaaaagaaaagaaaaauuagccaguugugguggcacaugaauguagucccagcuauucuggaagcugaggugggaggaucacuuaagcccaggagguugaggcugcagugagcugagauugcacuacugcacuccaaccugcgcaacagagugagacccugucucaaaaaaaaaaguagugcuuaaauuugggaaaaauaugcuagcaacauuucugaaaacuguuaucacaguccuaaauuaaaaauaacgggaaaguucuacuuuugugagaucaaauguuuuuauaauuaauauugcaaaauauuucugcguggaugucuauaauuucgagugauucaguauaaugggauuucagaaaaauaugcuauuauguaaauacguguauauucuuacgcugcuuuccuaagguccagauccacauagugacuuauuaccauauacaacaaacacugcuagcucucucuccccagucucuccugccccuuucuguuucuguacuuuucuuggucuugccucucucugguucuguuuuuaucuuuugucucuauuuguacauugccuuguucuacuugcuucuuaaagaauuuagaagaguuuaaaaguauccaaaauaugaaaagagaaaauaaguauuucaagaaaucagaaagagaaaaucagagcaggaaacuaauaaagguagaaauaagauuaauacucagaaauacauacuguaugaucaaaaaggugcuagucaccuaaaauaauaagaaaucauuuuguuuccauuuucagaguguucaaaauauuaaaccuuuuguugaggagaugcacacccuuuacugaugcugagucaaagaugaaauuucgcuuaugaauauucaaaaagacaguuccuuuaauaauaucucuauaguuuauauaauuauaaagauuaugcuuaaguaauuaugagaaacaaauuucacagaacuuuagaaaauaaugauaaaacuccauuuauuaaauauaauucucccugagcccaaaucaguguggucuaagcugcagccugauccaaggauaaauuuugaguaucuaguuuugcaaguuuucaguaucuaguguuuucaauaaggauugagcaaccaauuucaguaacucagaauugagauguaggaugaaggagguguguauuuuguuuuuaaaugagcaauauuagaacauguuugaacauuaauuuaaaugauugaguucagugggagagguugaugaucaggaaagagaaguggaucauaaguccgugaagaagagagaggggaugggaugcagaagcuugcgggaggguuugaggaauaggccuuuguaacuucucuguaacaggagggaucguauguacaccuagggagacuuuguagauuuguuaguggagagauaaaggagcuuugauaauguauaaaucugaaaaaaaauagugagaaaauaagaaagcaaacucaugagggaaauaggcauuguggaauuuccaucuagaguuugagauccuacauuuugaauugaaaccagccauccuuuuuaggugauuuucccuggaagugauuuguuuaucagcaucuaagcaacuaaaaacagggcucagauuuuaaaacagaauuacagauaaaauguuuuuaaugagacugauuaucauaauggacuaccaaaucugagaugguaaggaaaucggugacgauuagagaaaacugauacauggugaaaaauuaauggguucaccugaucaaaauucuugaaaguuugaggaaguaaaguaguaggaguuauagagcaagugaacuagguuaaaaaauaaaagggaaaaaaaagguaguggucagagaauggaucagauauugagaacaagaguucagagagauugcagauucugauaauggcaagcucaucacugggggacuggauugcuaaaguggagagaagaccaauggggacaaagauuucaagaaaaugagguaucacaguuguggauauugaaaaggccuguuuguauugagguacauuccuuguguaccuaauuuauugaguuuuuuuaaaaucaugaaaggauguugaauuugucaaaugcuuuuucugcaucuauugaaaugaucauaugguuuuugcccuucauucuguuaauaugauguaucaugcuuauugauuugcuuauguuaaaccauccuugcaucccuggaaucaaucccacuugaucauggugaaugaucuuuuuaaugugcuguguugaauuugguuugcuaguauuuuguugaggauuuuugcaucuuuguucaucagggauacuggccuguaguuuucuucuuuuguuauguccuuaucugauuuuguuaucaggauaauguuggccucauagauugaaauuugaaaguauuccauucucuuugauauuuuggaauaguuugaguagaauuguuauuaguucuucuuuaaauguuugauggaauucagcagugaagcccucaaguccugggcuuuucuuugguaggagacuuuguauaacugauucaaucuucuuacucguuauugcucuguucagauuuucuauuucuuccuaguucaaucuugguagguuuauguauccaggaauuuaucauuucuuguaaguuauccaguuuguuggcauauaguuguucauaacaguuuaaugauuccuuguauuucuguaguaucagauguaauuucuacuuuuucuuuuauuugagucuuccuucuuuuuuuuuaguccaaagguuuguucaauuuucuuuaucuuuucaaaaaaccagcucuuuguuuuguugaucuuuuguauuguuuugaugcuuagcacaaugaaugagaaaguacacgcacacucucucuuucucucucccucucagacaaagcauuguggaauuuuagagcacugaggagcguauucuuaaagauuagaaagaaaaaaaacaaguuacucaagauaugaaucaagauggcauuuagcuuuucaucaaaauaauucgaugauagaagacaacgcagaaguuuucuccaagauuggagggaguuuucaacuuagaaugcugugucuugcuaaguugauaaucugcaaagaaugcugaauagacacauacucucagugucacaaagugacacugacaaauugcaaauacaggucaagcaucccaaaucugauaauucaaaauccaaagugcucaaaaaguuuggaaguuuggagcauuuuggauuuuggauuuuuggauuuggaaugccaaacugcuuaaguauauaauacaaauauccccaaaucugaaaaaaucugaaauccagaacacuuccgguccugagcauuuuggauaaaguauaccuaauguguagcaaauugguauagccuuagguagguguuugaaaaauggaaaagguaacuaauacaucggauguuucaauauccugaaagauuuuuaacaugcuaggaagagugauugaauugaauaaggucaaguuuaaaaauccuuuuuuugguccauuuugauuauuuugcuuucagguauaauagaaggauuguagucacauaugugaaaaaugguugggccuugaaauaggauuucuuuugcaucuuccaaaagaaaucauaugucaucuugaacuguguuauacaaaguaccuggagaaaaaggaagugggaguauuauuuuacuucaucuugguagacaauacauuuauucccuuuucauucagcagacauguuagguauaaacacuguuguggcucuuguggagcuccuacacuaaugggagagacaaacagguaaagagaaccaauaauagaaugcuugaugugcuuauagaagcauguuuuuuagugcuguuauaucccaaaggauugaaacucgauagaaauuuuguuuguagagggucuugaggaaggaguaggagacuaucaaguggaggucauucuaggaagaggggaaaguauauccugaugcuugauaaagcaugagguuucaaaggauuagugaauuuucuugugugcugaaaguucaugugguaagggcucugugacaguccuuuaaugaggucaggaaacuuagggacaaguauaauaaccaaaucuaaggucaacugaugcccaccucaugccccgagaauaguuuaacuuauacagugauucagcaauauauuacuguuaauauuuauuuuaaaauuucuuagcaauauuaucaagugacaaugagaauauuauauaaaucuagcuuggaaaaagccuguugaaaaguaagcguugagaaacaauccuuaguugcuaauauugaagagguuguauauuuaaaauguuaaaccuaccaaaaggccgggcgugguggcucacgccuguaaucccaggacuuugggaggucgagguggguggaucaccuaaggucgggaguuagagaccagccugaccaacauggagaaaccucaucucuacuaaaaauacaaaauuagcugggcauggugauaccugccuauaaucccaccuacuugggagguugaagcaggagaaucgcuugaaccugccagacggagguugcagugagccgaggucaugccauugcacuccagccugggcgacaagagugaaacuccgucucaaaaaaaaaaaaaaaaaaaaaaccuauugaaauaguuuauguuauuuccucaacauuuugguuuaaaaagcauucaucugcuuuucugucucucauuucaaaauuuccaaauagcaugaauuguauaguucacuguuuaugauacgaauacaagcauuauacugaugaacuugagaagauguucugacacacauaaagacugaugugaugcauuuuuuuaccuuccuuaauuaaauauauucuuuucuccauuuguaauagaguguuauggaaauugucuaggcuuugaucaucuaaauuuauuuuaucuggaaacugaagugguuauuuccacugagcuacuauugcaagauacaaaagaaaagagauaaacaaauugaguguucauuuugacagcuauuuugauuacuaauauuucaagggcacguuuuaaaauacagguucuuuuauguuauauuauaaauagaaaaauucauuucucccuccaugaaauauaaacucuggaaagucuccagggauaguauuaaccaucuuggaguacuaacacugagaaaauguuuaguaaucaaaauaauacuuuauaaaucuuggacucauugauucuuuggauuuuugguaaucuaaaaaaagcaaaaaauguuguuguguuuauaaauuccaagacuaauugcaaauuucuuucuuucuuucuuucuuuuuuuuuuuuuuuugagacagagucuuacucugucacccaggcuggagugcagucacaaucuuggcuuagugcacccucugccucccaguucaacugauucucuugccucagccuccugaguagcugggacuuacaggugugcaccaccacacccagcuaauuauuuuguauauuaguaaagaugggauuucacgcccaggcuggucuugaacuccugagcucaggcaaucugccuuccuuagcuucccaaagugcugggauuacaggugugagccacugugcccauccuaaugguaaauuuuuuauuccagaaaaauuguuuuuuauuuuucuucuguauauguugaugaaaaauuaagaaagaaacagaaacuaaaaauuuaaaguuacugaaaauaucacaccuuuuuaaauguuuauuaugaguuuuacauuaaaaaaacuuuuagguucagggguacaugugcagguuuguuauauaaguaaacuuguguaaugaggguuugcuguacagauuacuuuucucacccagguacuaaguguaguaccugaaaauuauuuuuuccugauuuucuccuuccucccacccuccacucugagguaggccccagugucucuuguuucucugcuuguauccauguguucucauuauuuagcuccuacuuauaagugagaauaugcaguauuuuuuuuuguuguuguuauuguuccugcauuaguuugcuaggaauauuggccaccagcuucauccauguuucugcaaaggacaugaucguguucuuuauuauugcugcacaguauucuaugauguaucccuaccacauuuccauuaucuagucuauugucaauggacauuuagguugauucuuugucuuugcuauugugaauagugcuacaaugagcauaugagugcauguaucuuuaugguagaacgauuuauauuccuuuugguauauacccaguaaugggacugcuggcuugaauggcaguuauguuuuaguuuuuugaggaauugccacacugcuuuccacaaggguugaacuuaauuuacacccccaccagcaguguauaagcauucuuucuucucugcaaucuugcuagccucuguuauuuuuugacuuauuuuuaauauuaacauuucugacuggugugacaugguaucucauuuuggcuuugacuugaauuucucuaaugaucagugauauugaguauuauuucaugugcuuguuggccauauguaugucuucuuuugaaaagugucuguucguauccuuugcucacuuuuuaaugggguugcuuuuuuuuucugguaaauuuguguaaguuccuuauagauucuggauauuagaccuuuuuccagugcauaguuuacaaauauuuucucuuauuuuguaggucaucuguauacucuguugauaguuucuuuugcugugcagacgcucuuuaguuuaauuagaucccauuugucauacuugcuuuuguugcaauugcuuuuggugucuuugucaugaaaucuuuaccaauuccuaugcccagaaugauauuuucuagguugucuuccaggguuuuuauagaucuggguuuuacauuuaagucuuuaacccaucuugaguugauuuuuguaugugguguaaggaagagguccaguuucaaucuuuugcauauugcuagccaguuauuccagcaccauuugcguguuuuugucagcuuuguugaagauuagaugguugaagguguucagcauuauuucugggcucucucuucuguucuguuggucgauuugucugguuuuguaccaguaucaugcuguuuuguuuacuguagcccuguaguauagucugaaguagggcaaugugaugcuuccaauuuuguucauuuugccuaggcuuaccuuggcuauuuguuauauuuuuuuuguuucauguggauuuuaaaauaauuuuuucuagcucuugaagacugucauugguaguuuaauuggaauaguauagaaucuguaaacugcuuuggguaguauggccauuucgaugauauugauucuuccuguucaugagcacagaauguuuuuuccauuuguuugugucaucucugauuuaucugaguaguguuuuuguagauucuuauuguagagaucuuucaccucccuuguuaauuauauuucuagauauuuuauucuuuuugugguaauuaugaaugggauuguguuccugauucggcucuuggcuuuauguacaaaaucauuaggaaugugagguguagacucaaauugauaguuuagaucccagcucuagcuuaaaauucuucugaaugacuuuggaaaaauuaaauaaccauuaaaaaauuuauuaaauggcccuaaaauaguacuguaguauuauauaugaaucaaaugaaauaaccccuaaaaagcacauaauaauuuccugaugcauuguaagugcuagguaaauuuuggcugcuuguauuauuuucauccuuauuaccauuaguacuauccacugacgucaccuucucaauguggccuuucccgaccauagcaucucaagaaaggccacccauuugucuuuaucacagcaccuuuguuucugcaucacaguauuuucauaggucuguuucauauguuauucacuuguuuauuuucugcccuucucacuagaaugaggacuaggaucauguauguguuguucacuauuaucucccuagcacuuaucacucagcaauauuuuuugaauaaaugaauagaugcaguguuaccuugagucuuauuuaaacuauaaacaagaauuaucuucuauuaccucucuuuuauaaagagaauuucgucccuuugauuugucucuuuccuuugaaccuacugcaugugauguuucucuguuacuuuaucuuuagagagggaagucuuugcccaauauggggggauugagaugggccuuucggagagcucauaggccccuguugagguaauccaaauuuuuauaaaaggagaagagaaaagcuuagacuuauucacauuucauuuugucagagauuuuuuuguuugucaggacaguaaaaggaaggagcuccauaggcagcugaggcagacacuugacuucgcuggaggaagaguuuggggcacugcugccuuucuugguuagcccacagcaucccccauuuucuuucauacaacacacaugcccaguguaagcuaugagugaagacucagccuagcaguuucacugagguauuggaguagguccuaauuggguuugucuuuccucaucaagaacucagcucuggccagcugagcuugggcaugcuauugguguucugcugagaaucauguccauguuuuuuccccagugauaaauucugaucaauuuucacaguaacuuauggcggauaggcuugccuggacguaccugaacaugcuuuguuuccagauguuuuugcaauaccuacaugggugauuuaacagaagcugguauaaugucuuguuauagugcaacauaaaaacugcuuacugcacuucagacguacuacguuccucgucuguguuuuauaaacacauuucugccucagugccuuugucccuacaguucuuuuggcuugcaaugcucuuuccauagauuuccccauggcuugcuccuuuacuucauucagguaccuugaauuauauaugugucuuuuuacuucuggggccagaugauacaguucuuuaaacgugugauaauaauccuaguuguuuauguuuaucuuuuuuaagauuguaauacauuuucacugaaaauuuauaguugaauggaauaaauuccucucuacagcucuauuuuauuucauauauaaagaauuuuauucuuuguauauauuuaggcuaaccccaaguuuuuucuaucugcauguggaagcuuauucagaauccuucuagaaacugaaugaauugaauuuucuuugaaaaauuagcacugugaaauuucuguaaaaauuuacagcuauauuugaaaugacaguaaaucguaugcuaaagaaaacauauuuuauuaaagauaguuguuuuguaucugcuaugugaaaguuacuugauuagcugggugcuguguagguccaaagaaauuuaugauaucucugcccuuuauuuuauaauaaauuggggaaaguaaugaaaacaauaaugacaauaaguaacauuuauugagugcuuaauaugucaagcauuguuuuaaguguuuuauuuaaagguacauauacgugaaaggaaaugagcauauuaaagcagaaauuucagaaucugggaguuguaaaggaucguguucaaccuuacgaaccugguggaagcucucuaaugcuuuuggcagguauuccugcaggaucuccauaggaauucacaagaagggcucugagcuccugaaggagaagcugcacaaagcucacaaggagcugcagcugaagggcgaagacugugagcagcuguuccuagugcaggagcagcugcacgggagcuggaggagcugaugacuagccuguuugaggaagcccacaagauggugugggaagccagcauacagcaggcagugucagaaaagcagcugaaugcggaggcauggggaaagauagacaugcugcaggcagaggugacagcuugaagacacuggucaucauguccacaccagccucucccaacuacaagcuccaccugcaccugcugagccccacuaagggugggcccugcaaggcccacugccaaccuaagagcaccagcagugcccucuccuuggccuugugccccacugugagacaugcccucaccuuggacaaggagguggaugugacacuauuggcagaguuccaagccuggaaggaauuaccuaccuuggacaagaccuguuccuugcugcaaaggguguagugggaggauauggaccccugccuggacuucacagugcagaaucucuugccacagguguaggccucuaugggggacaccacacucacuaucaagccuguggcucugcagaagcugccuauagugaggguaacuguggucaauuguggcagugccaauauaugugucuugagcaauuuggcccauaccugccaccaccaccacaucuggcuuugugacuuugcgagccacuaccacaucucacugucuucucaggccaggaucacugcagugugcaacuuuuucaucuauaucugcuacauccacaaggccuggugcgacaggauuugaagccaguguucugggagaucacaaagcugugaaaagagauacagcuggccaaacucagcucccccuagaagccuaggguguuaccugggccuagaugugggcugccuaggauggacagacacacauaaaaauaaggauccugguacaagaucugagacaggucuguaccucaugaaaugaucuuucuuucacaccgaguucugcaacucacagguggacuuucaagaaaauaccaaagaccaggggguucagagccugaaaaacacuuuuaauggcaguuuuuccugaggcagccaugagcaucuaucauuguuaauauaguucuuaucauguauugugcccuuugcaucucucuagcuguugucuaauucuucuguuaugugauaggccuuccuauacuugaaaaugguaguguaucuucuugcggggagguccuggcaccccuguggcaaggucagcccuaaugauugguccugaaucagugauggcagaagagugauggcagaagcaguauucagucuucugcuaucaggcucucuuuccaagucuccugggagcuccuugagggcagaagcucuucuucccuuauuccugauuuuauccccagugucuugcacugaguuacguaaaugaaugaaaguaaauaaauacaaucuagaguuaauauguuggaucucaagcuuaguguggauaagacuagauuuaaaagguucuuauacgguacuuuaucaucauuauucucccaucuaccucucuaccccugccccgccacaacuguacuaucucuaaaacauuaaaacuucagugucauuuauuuacaaaaguaaauauuugguggcauuuauuuuaaaaaguauuaucuuugauuaaggaaaacaccuaaucagcauuaugggcagaacucagcauccagaauaagacuggggugaagggagggguggugaagcuucaaggagaaugggguaugacuucagcagcaaagaccaguguguuugcauggauugugacaggcauacccaguauauuuuauucuuuaucauugugaaagggaaugacuagggaugagaggagauauacuauugaauucuggauggagaugacaaauugaaguccuaauaaccaauccgaagaaguaauugcauuuauaaaauuuaccacaguuaccauggggaacauaaagaaauauuuuauauguccauguaucaugcuacucuagcuagaucuuagauucccuaagcaagaagacugaguucaucuuuguacucccagugugucucuuuaugacaucugcauaauagauggucaauaaguguugaauuaaauggaauagaggacuuaguccuagaucucaaaaaaguguauaauuccugacccaguguggcagcucaugucuguagucccagcacuuugggaggccgagguggguggaucacgaggucaggaguuugagaccagccugaccaacauggugaaaccccaucucuacuaaaaauacaaaaauuggcugugugucauugcagguaccuauaaucccaguuguuugggaggcugaggcaugagaaucacuuggaccagggaggcugagguuacagugaacugagaucaugccacugcacuccagccugggugacagagugagacccugucucaaaaaaaaaaaaaaaaaaguguauaaauuccuuuaaagggagcaaauguaauaaucuuggaaguuauauaagaaugcaugguuuuacguaguuaagugccuagugaacuguagacauaguaagucucuauauaaauucaggaagacacaauguuaugaggcaguuaagauuaauaucuaguguuccagugccugcucucuuacuaacuggcuaguaacacuauuucucucauagggcuguuaggguuuaaaugagaaagugaauguaaagugcuuaaaauguggcuggugcagauugagcucccauggauaucagagaaaucaagauuugaguagaugagauuaaagccagguccugaugaagaaguacgauuuaggcagaaggauaugaacuauuaauucuagcacuggcauuuaauugcuuuugaucuuuggcaagucugugaaacucucugugcuuuauuuuccuuuguauaaaaaaggggcuauuguaaucacaguucuugguacacaguuuaugcccaacaaauaauagcuguucuuaucauagguguuauuaccaccucucuuaccaucauugucaccauuguugucaucauuuucaggguagagaauagcuagaaauuggucaucuuggaguaguggagcugaggucucagggaauaaagggaaacaagauuuauauuuagaaaagggucugacugcaaaaucucucuucaaauuaaauaacuauuagaaaaauagaaagcuuugaucaugauuacagugaauuaugcugauugcaguauccaggguauugaauuuuauauagaaucaauuuuacuucaguauuuugaaaugauacuaaugauaacaaauuguauucuugcaauggcucuuuucuuuuuaaguacaggccuuuuuaaaggacccaaauuuggguguuuuuauuguacugaagccuauuauaagauauauaacaaaaaggaccaugcuuuacacuuugccacugugaccaccuaccuuuggaauuagauuugaaaguguuaagugguugaugcagggagcaaugaaacagugaaaguauuuuuauaaagccaguguaaucauaucuuuguuacaaaaaugaaaucuuugaacuuuuaaagucaggauuagugauaguucauguagcuuuaucuaguaauucuguguuacuaagcauuuuuccuuaauuuuuuucucucagaacgauaucgcauucagagugaacaauuugaagaucuuuggcucauaaccaaugagcuuauucuucgccuucaagaauauuuugaaaaacagggagucaaagauuuugcauguucuuuuucgggaucuauaccccuucaagaauauuuugaguugauugaucaucauuuugagguauguaugaucauaacccacaucaucuauaauccuuaaauauaugaaagagaaauagaugcuauagaaggauucuguaugcaugccauuaggcuaugugcuucuaguuguuuuucuuauguggaugguggauuucgugaauccauuccugcccacuugcccaguuugugaucaauuacagacauuuacagaauggcugccuggagcuaaccaugucgucuggcccuggaacagagcugauuuaauucucccacauggagacuuagcccuugaccccaauaacccaguguuaaaacuauuugagcuuaucggaggccauuuggcuaacuaauucuagcaggccauaaaugaggugugauuauaaaguaaagugauuuuucuuuuucuuuuuuaacaagcauaccagaacuucugcaucugaaugaggguuaacacuuaaaauauuccccaguaucuggcacagugggugcuuacuaaaugcugaaugauuacauauaugaauaaauguguucuaacaguaacuuuguugcucugaauauuuugcauuucuucuuuggaagugccuucagagccuauguuagauucucuugaguauuucaauggugacaugucuucaucuuuugaagauugauuugaugauugggacuagccaaauauuuguuuugugaguggauuugacagugacagucauaguuuuuuuaaaagucccauguauuccagucaucaggcuccacuuacauagucuauaaacacucuacagacaauacaagaggggaauuuugagagaauuuugaacauuauccaaguaagcauugguucuugggacuacauuucaguuuaggagugugugugcaugugucugugugugugugugugugagagagagagagagagagagagagaauuaccagucauauaauuuuucagccaaccauugaacauucuaagagcauugacuuucagcuaugaagacuucuuuaauguagugugaacauaaaaagaaaauuucagguguauacaaucgaauuaugaauaauuaugucauaauuccucaucuaugaugaggaucugugaugacaauauuuucuaggaacgcaugccuuuggucaaauuguagcaccaaaauugacacagucuguaagaguauguuuagguaucguauggaaugagaaucuuugcaauuccuugggauauauuuuaagaaauucuugcuucgcuguuggaaacuuaaguguagugauuugugaaaggguccauggaaagacuauaccaauuauauauuuguaauauuugaaauagagaauacuagauacuauugacuaauaaguuugacauauaauuuucccuuuauacuuucuggcuaguaaguaacuccuuggagcuucuacaucaggggagugucuuuucugaggagggacuuagagaauauggugaaugacaggcacuuucauuuguuacacacauaaauuaaggggggcguuguuaugcuuccuuuguucucuaucuccuuucucugcuuucagccauuaguaagauuuuaaacuuugaauacaguuggguuuuggaauccaagugugccuuggaguguaaauuucaugaaggcagaaauuuuugucuguauuauucauugcuuuaauuucuagugccuggaccaggguuuggcucugagaucaacagauauuuguuaagcauugaaauucugacaugugaaaacauuucaaucacugcugcuuuguuacacauucaaaggaaugauaaccugguugauagucugaguauugagaacaucuuuuuaauuuuuuaguguaucaagaauuuaggaaauaaauuauuacagcaguaaauuauacaauuaaaagaaugaauuauugauaauuagguuaauguccuuuuaaaaacuuuauuuuaaaauauuuuuauuacaggaaauaaauuauagcaguaaauuauacaauuagaagaaugaauuauugauaauuagguuaauguucuuuuaaaaacuuuauuuaaaaauauuuuuauuacuuaauuuuugguauuuuuuugcucaagggaauauucuuugauuuaauuagcuacugagugcuucuaaagagaacacuuggacacaggaaggggaacaucacacaccggggccuguugugggguggggggagcggagagggauagcauuaggagauauaccuaacguaaaugacaaguuaaugggugcagcgcaccgacauggcacauguauacauauguaacaaaccugcacguugugcacauguacccuagaaauuaaaguauaauaaaaaaauaaaaaaauaaaaagaagaaaaugucucucaaaacugaaggguaaauaaagacaaaauacaugaauacacuuuaaaaaaguuaaaauuucaaguuacuuuuauuucauauguaauuguagaaugcaugcacugaaaggguaaggaauuugguuuguuacuagaaauguagacuacgauauguuugacuucugagcauuuugaauaugauguuuauuucagcuaguuuauuacuguuuuguaaaguugaguuagugauucacaugaccuaaucuuaugaagugucccuuuuacccugugacuuugacuagcuugcuuucauuuauuuauuuauuuauuuauuuauuuauuuauuuauuuauuuauuuauuuugagacggggucucgcucugucgcccaggcuggggugcaguggcacgaucucggcucacugcaagcuuggccuccuggguucacgccauucuccugccucagccuccugaguagcugggacuacaggugcccaccaccacgcccagcuaauuuuuuguauuuuuuuuuaguagagacgggguuucacuguguuagccaggauggucucgaucuccugaccucgugauccgcccgccucggccucccaaaguucugggauuacaggcgugagccaccgugcccggccgcuuucuuuuaacaauauuaauuuaaaugagauggguuacagugaagagagucauuuaggauucuaauuccccagccacucaaucucuucuuuggaggcaguguuugguguccaguuucuuguauaucuuucuagaaauauccuaugcagucacaacuauguuaauauauagguuucuuuuuuuuaaauaaaaaauaaugguagcacauuauacauacuauuuuguauuguuuugcuuuguuucauuuaucauauuugcacagcauugcauaucagcacauaguagucuugcagaauagucuuccuuauuuaaccaguuccccuauugaugggaauuuugauuauuaauaaugucuuacuaugauaacaauagaucaaacaauuuuguaauggguauccugauauauacauuacuuuuggcaagcauaucucuaggauacauuucuagaagugggauuguuaggucaaaggcguauguuuaagagguauuuguauuaacuuuuauguaaaacuuugcccauuuuucuauuggauuguugcugauuuccuacugauuucuguuagguuguggucuuuuucucauugauuuguagaugcuuucuagauaugggcaugacuuugucucuguaguuauugcuguuauuuuuugcaguuugcuauuuguccuauuuucuuuauaauuuuuuaaaaucauguggaauuaaauguuuuuguuuuuuuuaguuaguaauuuaucagggguguguuuguguguuuguuuguggguguggcuuuuagcuuuugacuuacacuaauaaaggccuuuccuauaccaagaucauuuuaaaaauucugauuuuucuggugcuuuuauugugucuaaacuuuuaaucucugcauugauuuugcuguaaagaaugagaaaagauuucuauuuuuucccauguaaccaauuauugaaaaacacuuauuaaaugaucuguuuuuccuccagugauacugguuaacuuuuacaauuuuccauuugaucuguuccacuguauuaucugugaauuagugauucauguaccaaauaccacauuguuuuaauucccuuaacucuauaaugcauuuaaauuucuucauuacucuuuuacuuuuauuaucauuguguguauuuuuucuuuaaagauguuuuuuguguccauuuaaucucaauuuaagaaauuauucauugcagcuacggauaaauggugaaaaauuagaagaacucuuaucugagagagcuguacaauuucgggccauucaacgccggcuacuagcaagauucaaagauaaaacuccugccccucuucaacaccuggacaccuuguuagauggaaccuacaagcaggucaguauaauaucaguaacaguuuucuauuacuggcuauacuuuuuuuugucacccuagagucauguaccagaauauccaagauaagguacucauuuccagugcuuuaaggaacagugaacagugcacaagcuuuagagucagaaaaaccuagguucaaagucaaacucugcugcuuucuaauugugugaccuuggguaaauuacaugagcgcccucaguuuccacauauuaccucccggaguuguugugaggauuuuuaaucuuuuauguaaagcaacaagaacaaugccaggcacguaauaugugcuugauaaauaguagcuauuaugauuaguauuaugagacaauucuuggugcauuccauaauuauuaccauaauucuccaauugucuuaccaagcaacuggcucauacuucuaguauuaugucaguugauauuuugagauggaauucuuaagcaucauaguucaaaaaguucuaguucaaaauauauuuuuucuucuugaucaccuuccauccauaguuuaucauuugcauggcuaggugaucuggcugucacucuuaaggcacugucucuccaaaaacuauucaaaacaucucucacuuaaaaauuauuuuuuaaauuuuaaaauaauuuuaaaaaaucaugagaaggcuucuaccaguucuguuauaaugucuuugaaugguuauaaugaagacuuugaaugacuauauuguguauuccuauauuucuucacaauguuacucuccuguuucaaagucaguguugcugguaugaauagucuguugauuuuuugaauugaguuuuuuaauugagauaauucuauauuucugugcaguuguaacaaauaaugcagagagaucucaugucuccuuuaacugcuuucuuccaaugguaacauuuugcaaaacuaugguauaauaucauaagcaguauauugauauuaauaaaauccacaggucuuauucugacuuacuuguacucauuuaugugggugcguguauuaaguuguauacaauuuuaucaccuguguagauucagcauccgccaccacauucuagacgcuucaccacaggacuccuucaugugguccuuuaucacaacauuucugcccuucuccccugccccacuccauucuguugauuuugaaaggacaaaucagauuuuuguuuucagaauuaauuuuccuaggggacagaaaaauagcuuacuauguuuuugcucauaauacauuuguuucuuaaaauuuucuugguuaggcugggcaugguggcucacgccuguaaucccagcacuuugggaggccuaggcgggcggaucacgaggucaggagaucaagaccauccugguuaauacagugaaacccugucucuacuaaaaauucaaacaauuagccgggcaugguggcaggcacccauaaucccagcuacucgggaggcugaggcaggggaaucgguugaacccgggagguggagguugcagugagccgagaucgcgccauugcacuccagccugggugacagagcaagacuccaucuaaaaaaaaaaaaaaaaaaaaaaaaaaaauucaugguuauuugaaaauuagcagcaauuuaaaggacagucuauaguagcaguggaauauuggaaagaacacugggcuuggaauucaaacaccgcaguguuguugcuuauuagauguaugguuuuuggcaauucccuuacccucccagaacuucuguuuuguuccauaaaaugagaugacuacucuuuuguuacaaagauuauauuccauaauguauggaauuuacaaaauuuguuccacaaauauagacugccaauuucgugugugugugcugggguaauuauaugauucuucagucaguaggcaccaaugcccugucuguuccacaccucuuuuccucuuuaguacucuuuuuguuuuguuuuguuuucuauuuccuuccuucuuuuccuuuuccuuuuucccauuucuuuguucacuuuucuuucucauucuggggucuaccgucaucccugccugccauacuugaggcugaagguauggucaaccuuguauuuaaugaugcuguaucuuuuuguagacacaaugguggaagggcauuuaaaggaacuugaagaggaugcuugauuuaaugcuuuccagauuuucuauauaguaagacuucgucuuuuauacauuuaaagugcagagguuuuuauuuuuuucugcuuagccucaagguugagguuuuccaugauuuguaauauuacagacaagacgaucaaaaccauggcuuuucacuugaauguauauuguuaagucccauuccuuuuagauuaaugaaaagaaugaauaaacauuugaaggaaaaauaugaguacuauaaggauuuugacuuaauuuuuauguaccuugccauucaauuuuauuauauguauauauuuguaauaaaugagggugagguguugauuguucaauaaguuucaugagcauaauaaagucuauuuuaauuccguuuagucaguuuuuuaaugacauacuuaacacaugaauauaauuucccaaagaaaauuauaacauuauacguaaugcuaaauuucccaucuugguuccuuaucaucugcucagaaauguaaucauucuuacuguuuuuguuucuuuccacaccucuuuuuuuggcacauagaaaugaaauauuguuucaccaggcuaaagaaaaacuccauaaagaguaucauaugauauguauuaaucuagcucucuuuuuucuuuuucuucuaaaguauguacuggaacucuuugcauauuagugcauagauguacuucucuauuuguaaugguuacauaauaguuuaugauauggacagucuguaguauggacaaucacaguuuauuaaaggacaaaucuuaauaauaguuuuaauguugagucuaacauugagaaauccuuuuucgacaacucuccugggaucgaacaagcauaccaccuaccuuauuaucacauaccuucuguucaguguuuuucuuaucuuuaugcuuugccuagguagggagcaugauuuacuugauggauuagucaagcucaugaaauaacaagccaugcuagaguccauuccugucccuguggcauaacuccacugcaugacuuuacuagauuuuuaaagucuuuucccaacguaccgcuuuaaaauuagaucugcuaccuguuuagcguuuuuuuuccuccugugaugggaucuuuuaauuuuucagcaaaauguucucuaugagacacacauacacacaugcacacauacaccagcauacccauacauacacacuaccuuacagguauguuguaccagauuguagcucaaccaauaguguaugaaaaugccugcuuuccuagguauuauuacuuauuuucaucuuuacaauuuuuaacugaaacaguaauuugauuguuguuuuacuucuuaccucuuuuguugcuuaccagagaugcugcauauuuuucacauguuaauuggccauuuguauuucuuuuuuaugacuugcguauguacacauuuuguuuaauauucuaucauguucaucuuugucuuaccauuuuguguauauugagggauaaucuuuggucauacuuucaucaugcaugaaaauacuugguaccuauuuauguauguaaucucucauacauaaaaaaguuuuaccaauuuaucauuugccuguuauuuuuuauuuguaauguauuuuugacacaugagguuuaaaaaaacguuuguguaguaaaaucuguccaucuuuuucguuuagguuucucugccuaggaaauccuuccuuauguaugccaagaguauaugaauaucaauuuauaaauuauucuaacacuucuaugcuaugauucuuuaaauguacuuuuuucacuccaucuggaauuuauugugcaauuuagugagaaucuaaucucccugcucccuggugagcuuagugucucagccccugcuuaucgcauauuccauucuucuacugagcuaaaauauuaccugaaucauuuaacaauuuuacuguauaguaaaccaucccaaaccuuaguggcuuaaaacaacaauaauucauuauuuauuguucaugagucucuggauuagcuugguaguucuguugaucugggucaugcuuggcugaucuugauugggcucacucaugugucucuggucagcugguggcucagcucgggacuggauagcuaggauguauuuacucauguauuuggcagauggcuugcaguuagcugaaauaauugggccacuugucucucauggcccagcaggcuaggcugggcuuguucacauggugacuauaugucccaaugcacaagcacuuuucaagcaucuguuugugucauguuucuaguguuccauuggcuuuggucaauucagaucaaagagguggggauauagacuuugccucuuuguugaaggaguggagaauuguguacuuuuuuauaaucuauccuccuucuuucaacauauauuaaauuagcaaacuauuuuaaacgaacaguucuuuuugaaacuuuucuaacccuucaauuuaguuuuucuauacuuagagaugucuuuucuucuauacuuuugacauuuaaacuuaaauuuuuguugucauuaaaaucuuauucacucauaagcaguuguagucuauggacucugaagauaauuuaucugaaaauuaauuagguuugucaagaguuguuuaaagcaaacagagcaggcuggguauggugacucacgccuguaauccuggcacuuugggaggcuaaggcagaaagaucccuugagcccaggaguuugagaucccuaugagcaacauaaagagacccugucucuacauaaaauuugaaaauuagcugauagagguggugcucaccuguggccucagcuacucaggaggcugaggugggaggauugcuuuagcccgggagguugaggcugcaaugagccaugauugugccuuuguauucuagccugggcaacagugugagacccugucucaaaacaaacaaacaaacaaacaaacaaaaaauaaauaaauaaaaaauaaugcaaacagagcaucaguguuguuuuuaggcgaauaaaacugucugaauauuugcccauguucuuaguuauggucaguucuuugaaggauggaaucuauuauccaguuuuuuaaauaggucuucaccuuagcuuuguccaguacuggcuucaugggcaugucaccugcacagucacacagagcccuguuuuugguuuaaugcucuauaguagccauacuggauuucuuaauacuuuuagaacaaaggguccuguauuuuuauuuugcucugggcaccucaaauaacguagcugguccuggcccuguuaggauaauaacaacuuucugaugaguagaacaagacaccugggaguucagaugcagagcaaaguucaaauagagaacagccuuauuaccccuacccccaaaucacauguaggccuuuccaaagaugaagaaaacaggaugcaauggacaucagugguagcucuucuggauagcucaagugcaucuuuuugggacaaacauauugguuaaucggcaaugaggcaaccauccacgaaggguuaucucauuuaggaccaucauccugcaguuagcccucucuuggccuauuguggguggcagccucuuauuauauuucuaacaggugggucacuggcuucaaggugcaucauuaauaguuuugaguuuuggugcaaaagccaaccacuucccucccuauuuucaaaugcagguuauuuccuguauccuguauaggaacccucaaagccacauccccaucuuauuuuugcuagcaugccuugccuacauagugucuacuacugcaucauacuccacuaggaacauacaacaagcacccuuauggaggccaaccuaagguugaagcaaggagaggggaccugggauuaucaaucugggaaaagcagagcaugauucuuacaggggaaggauuuggccucuagugaauaaauauuuuucaguuguccaccacaguuucaguaauuauguuguauuuaugcagccauaaaaaagaacaagauuauguccuuuccagggacauggauggagcuggaggccauuaucccuagcaaacuaacacaggaacagaaaaccaaauacuagauauucucacuuaaaagugggagcuaacuggugggaacacaugaagacauagaggggaacaacacacacuggggccuacuggaggguggaggguaggaggaggggaggaucaggaaaaguaacuacuggguacuaggcccaguauguggguggugaaauaaucuguacaauaaacccccaugacacaaguuuaccuauguaacaaaccugcacauguaccccugaacuuaaaauacaaguuaaaacuaauaaaauuuugggaaaaauaucauucuuuuugaaagaauuuucaucuuuacuucuagcuuuggagguauaauguugaaagaauguaaccauguugagaaugucuucuuuucaguaguuagaaaccuaaauuuccucauuuguaaaauuggaauacugccuucucaaucaacugaauguauuuuuggaggaccuaagaaauaaaguaggagaaaagaaaggaaauucuuauuuguugggugucugcugaguuugaaguaaauuuuauuuauuacuucauuuaauacuuagaaucaucaugugaggguggcauuauuguuuauagaggaagaaccugagacucugaguagaguuaagaaacuugcucaguguuacacagauauuaagcauuguauuccaaaguccaggcuuuagaauaucaaguggcaauuuuacuuuaaucauugucaggugggacauagacagccuagauuuucuuuagcaaaauuauggucaggguaaagaaaaaggaaaugugugcgaacuguuuguacauguucaugcuacguauauguauauucaugaucaucuaauagucauuguauacacaccuauuagacagguaacaaaaucuuuuggagaguucccucaauucugaaauuauaucugaaacaaguaucagaggacuuuuuuugggugugugacuuuguugauuucacuuauaccuaaguuuagcuucuuugccuucaaaugcuaaugcugauuggcagaaaagcuuugccaaauaaauucucuauuuuauuauaacauuuucacauaaauuuguuagucaaagcaagacugauugguugaguaaauugaaauggaagaaauuagacuuacccuaugacuuggcuuauguuuugaugcuauuacaugugcugagguuuuucuccucacuucaacacuaacccucuguuguagcagagggaaaauguuuacugaucuaaaaguuggugucagaugacauaugugugauguaaugacuaguagucauuaauguucuagagaggcagauggcugacuuuucucuucuacaaaagaggcuguauuaggcauaauuuuaaauagagauccugugguuuggaguuugcuauuuguuacuuuuucuguacuuuaaacuuccuuccacucuguuuauuuguaugguauugauauauaaaaaucauuuuaagucacgcagaagccuaagagcuuuuugguccauggguuuuuaaaugagcaugauuuuggcugauaacacagaggaauauauaaugaaaccauucagaggcccacuuuccucauugucauggacaaguaaaaauaacaugcugagagacuaagaaggagcuuucauggauguggugauguugcugggcuuguuuuucauauaaccacuuaagagcuaaaaggaaauucuuucucagaaggugauagaguaaauaggugagaaaggaggaggaagcagaaauuugcaaucguauguuuguggaugaacaggggugguaaguaaaaacaaaacaaaacaaaacaaaaaaacugagaugucaguaaaaaaaauggaauuuguacauuuuuacccuauaauuuuacucuugaauauuuaggcaaggaaauaguucacaaagaaaaaaauacauucaucaagguauucauuuauauuauuaauuaucuuugcaggaaauuguaaccagcuuucuaguuggaaagugauuagguuuaucauaguacuacuauuugaagugauauuucauaucauuauuguguuucauuauuuucaaaaccggaaugauauaaaacauuuuauauaacugaaaaaagcagauuaugaaauaguauauaauaaguuacaaauaaugaaauagaugugucuauaauagauacauuugcaaaaaauugaaaaugguguauguuuauuuuagaugacuuuacauuuuuaugcaauuuuuaaaaauauuauaauuuguugaaugcauggauaggaagaaucaguauugugcacauggccauauugcccaagguaauuuauagauuaacgcuauucccauuaaacuaccauugacauucuucacagaauuagaaaaacuauuuuaaaauucguauggaaccaaaaaagagccugaauagccaagacaauuguaagcaaagagaacaaagcuggaggcaucaccccaccugacuucaaacuauccugcaagacuacaguaaccaaaacagcaugguacugguacaagaacacacacaaagaccaauguaacagaauagagaacucagaaauaagaccgcacaccuacaaccaucugaucuuugacaaaccugacaaaaacaaucagugggaaagaauucccuauuuaauaaauggugcugggagagcuagcuagccauaugcaaaaauugaaacuggaccucuuccuuacaccaaauaccaaaacuaacucaagauagaucaagacuaucaucagagugaacagacaaccuacagaaugggagaaaauauuugcagucucuccaucugacaaaggucuaauaucuagagucuacaaggaacuuaaacaaauuuacaagaaaaaaaaucccauuaaaaagugggcaaaggacaugaacagacacuuuucaaaagaagacauacacguggccagaaaauauuugaaaaagcucggcaucacugaucauuagagaaauguaaaucaaaacuacaaugagauaccaucucacacaccagucagaauggguauaauuaaagcaucaaaaaacaacagauacugaugagguugaagagaaaaaggaacacuuuuauacguuggugggaguguaauuuaguucagccuuguggaagacaguguggugauuucucaaagaccuagaggcagaaauaccauuugaccgagcaaucccauuacugaguauauacccaaaagaauauaaaucuucaauuauaaaaauacauguaugcauauguucauugcagcacaguucacaauagcaaaaacauggaaucaacccaaaugcccaucaaugauagaguagauaaagaaaaugugguacauaugcaccauggaauacuaugcagcuguaaaaaggaacgagaucaugcccuuugcaggaucauggguggagcuggaagccauuauucucagcaaacuaaugcagaaacagaaaaccaaacacugcauguucucacuuauaagugggagcugaaugaugagaacacauggacacauugugaggggaaacuacacacacuggggccugugggaguggggucaggggagggagagcaucaggaggaauagcuaaugggugcugggauuaauaucuaggugauggauugaucugugcaacaaaccacuguggcacauguuuaccuguguaacaaaccugcacauccugcacauguacccuugaacuuaaaauaauaguugaagaaaaaaaaauaaaaauuaaaaaaauugaugagcacaaaaauagcuuuuucaaagcaaugugaaugcauuaauauacugaaucguacacuugaaaaugaggagcugacaauucucuaugccugguacggcacuaucuaauagauagccacauauagcuaauucacacuugaaaugugaauuuuauguuauguguguuuuaccagauauauuaccacagauaacaacuuuuugaaaacuggguuguagucauggaacuccuguucuucauugguauuucugagggagccguuuucucuuuccugucuauacccuaugaacuuguuucucuggucucagaauguuuagaguuuugaauuauuccauauaugaguuaguuuauuccuguucacugaaaagagagcaguuagauaacugaaugguaugcuugagugaauguaaagguggauguucucuuacucugucugacccuugcuaguuucucagccaaacaagagcaauauacaaagcucuuucaaaauuuuguaaauuuuucuuuauucgggucagaguaaucuccaaagaguguuuguuauaaguaugucccugauguauucacuaucuguguguggguauagagucuagccaaacugucugacagaaauuuguucaagucacaaaugugagccacauguauuauuuuuaauuuccuagaagauuaaaagaguaaagugaaacaaguuaaaguaauuuuaaccauguauuuuauuuaauuaauuaauuuauuuuuugagacagagucucgccccaucacccaggcuagaguacgguggcauuaucuugguucacugcugggacuacaggcacgcgccaccaaaccuggcuaaucuuuguaucuuuaguagagacaggcuuucaccauguuggccaggcaggucacaaacucaugugacccauccgccuuggccucccaaaaugcugagauuacaggcgugagccacugugcucagcccaacaauguguuuuauuuaacucuauauauucaauauaucauuucaacauguaguaaaauuaaaauuauuaaugagguauuuuauauuucauaguaugucuucaaaaaucugguuuauuuuauaugugcagcacauuucaagugugaauuagcuauauguggcuaucuauuagauagugccguaccaggcauagagaauugucaguuccucauuuuauauuguuucuugugaugucuuuuuucuuuauuuuuuuuucuuuccauuagucuuuuuaaauucuuauucaugaauagacuaucacugagccaaugauuuucacucacuggaugugaauagcaggcaguugugaagcacucuuaggugguuagagaaucaccagaaacauuagcucguaaaaacuauacauucaaauauuguuuaaaacaaugucaucaaauuuuaugucaacagacuugaguccuagucccaguucuuucuggugcuuugacuuugggcauaucacgucaucucucugagcuucaccuucuucacuuuaaucuguggacccuguagauagaacuugucuguguagcaucuugcauggugcuuauuuuccaguaaaauucucaauaaauguuuauuguaccugcauaauuguuaugaaaagggacuuagaaucuuaaauuuucaucaauucggaauuucagaaaucaauggggacuuagggaucaucuagugccagcuccuaaacuggggugagguuguugcccagucagcauuuguuagguauacuguaaugacaaugauguaaguuauagggcuuugugcaacugaauuaguuucagaaaagauauguaagugcaaaguauuauaacauuggaguuaugguucccuggauuuagguauguaaugcuaauugacauuaauggggguuguacauacuucaaggggagaacagaccuauuaucguaugaaaacauucuccuuuuaauaaccaucugguaugcuuuacuucccuggggcguguucacuuuuuauaaauugaaugcaugcuucuuuaucuucauguucuucaaucagcauuugaguuuucugcuugcuaguguuagcuugaacaacuggcuguauuguaaauuuaauauuaggauuuuaucuugguaaguuuaucagauucagaaauuugaucacuuuucugaaauaaacuauucugagucagaaguaaucaguguguccccucuucugcuaaaauuuuguucuguuuguuguuugaucuuuaaaaaaaaaauaguccuuugagauauacucagaaacaagauguuucuaauauuacaauaaaacuauuaaugggcucauuauguggaaaugaaaaucuuaucuuuuugugucagugaugacagaaaaauacauaaguggccuccaauuaucuguaauuguaugaggauuucuuucauuucuguuaucuaucuuccuguuuaaucccaucuggcacaauuauucuuuuuguauuaguuuuuuguaaaggaguucugaacaguuugaauugugaauuagcgauuauuacaacccuuauaacccucacaauccucccguccaccuuccuucccuuaccgucauuuucucucucucuuuaaguagaggaaaacaaagccaguuuccuugagagauuauuuugugaucuuucucagcaaaagaaaaagauguacuguuuuuauaagcauaucuaugaacagcugagcaguuauaucaaccccgauauguuucucuguauauuaauacacagagagcuaauagugcucagaguguugcuugaaaguaccaaauauaacuaaggauaaauuaaggugcuguacuuccuaaaaaguuacuuuuaugaggcccagcuguauagccuggaacaaucuagcaguaggaaaagugauuuaauguaauuaaaauaaauguacuuugaacauuugaccuuaaguggauuuaaauauauuugucacacuaccugagaaucauugauagaaugucaugcaguaagaucaauaccuauccaacuuuaccaugcucccagaugggccaccuguauuuuuguuuuuaacuuccuuuuuauaugauuuccauaucucuuauagcaggauauuaaauuucagagaauuaggcccucagccaaauauugauuuccccacuuuacuccaccccaucucaucuaggacuggcuucuagcccaucacuuaauauucuuuuucaguugauucccaguuagaaugauaagccagaagccauauucuuggagauguuuuuccuguggaagugauagauuuucaugggaccauuucccuccaucuuuuuucccacuuuugugauucaagguaaaaguauuugagaggaucugccuguugacaaaaagaaucaaacuguagaauauuugaagagauuuauucugagccaagugugagcgaccaguggccuggggcacagucucaggagguccuaagaacaugugccuaaggugguugggcuacagcuuggaauuauacaauuuaaggagacauagacaucaaccaauacauguaagauguugguuuggucuggaaaggugggacaacuugaagggguggggggcagggcuuccaggucauaggugaauucaaggauuuucuaauuggcaauugguugaaagaguuaaauugcugucuaaagaccuagaaucaauagaaggaauaucuggguuaagacaagagauccuggagaccaagguucccuugaugcagauuaaaccuucaggcagcaggcuucagagaacagacugcaaauguuuaucagauucccaguugauucugucuagaaaaaaggccuggaaagggaaggggauucuacagaauguagauuuuuuucccccacaagagacagcuuugcagggcuauuucaagauuugacaaagaaacauauuugggguaaaauauuuugauuuccuuccuuauauaauaucaugugauguuaugccagagucagguuggaaaguaagucauguuauauagaguuaaauaaaaccucucugaugauacuuuaugguuuguagagugugucuccucacgcccuugcuaaauccaggccauggucccaaggaagcccacagguccugguccuuauggucaaaugugucaacaaauugccucauuagaugagguuaauuuuaugaauguaauuaucugugguuuuuauuuguuuguauuugucuuauuccaagaccuucaaggggaucccuguugccuauuagauuacauugaaauuucucacucugacauucaaaaauucugaagaguugcacccaauuucuucuaaucucaucuccuauuucugcagaaacuacaugcuggucaagcuacccuauccucugaaaaagaacgcagcuuuauugauauauaauuugcauaccaaaauucaugcguuguaguguaccauuuaaggauuuuuaguaaauuuguagaguugugcaccacuaccacaauccaauuuuaaacaucaccauucccccaaaagcccccuuguguccaguuacaccuaauccucacucccacuccaacuacaagaaacuacuaaucuacuuucugucuucauagguuggucuuuucuggauauuucauauaaauggaaucauacaauauguagucuuuagcaucuuuuaccuaauaucauguuuuugagguucaucuaucaguuuuccucagugguugcuccuuuuuauuuuauuuccucaacuuuuaucuuagaaucaggcaguaccugugcaggcuuguuacaaagguauauugcaugaugcugagguuuggaguaugaaugaaccugucacccagguagugagcauaguacccgagagguaguuuuucaacucuuaccucucuuccuuccuccccacucuuauaucgcuccagugucuguuguuccuaacuuuauguccauauguacccaauguuuaguuccuacuuauaagugagaacaugcaauauuugguuuucuguuugugugaguuaaguauaauggcuuccagcuacauccauguugcugcaaagauaugauuucauucuuuguuuaugacugcauaguauuccaugguguuuauauaccauaauuccuuuaaaauuuuuuaaaaaaauaauuucaacuuuuauuuuagauucagggaguagaugugcagauuuguuacauggguauauugagugaugcugagguuugggguauggauccugucacccagguagugaacaugguacccaguagguaguuuuucaacucacaccucccucucuccccacucuaauacucccaguaccacauuuucuuuuuuuuuuuuugaguuuuacuuuauuuuuuuuuauuuuauuauuauuauacuuuaaguuuuaggguacaugugcacaaugugcagguuaguuacauauguauacaugugccaugcuggugugcugcacccauuaacucgucauuuagcauuaguuaugucuccuaaugcuaucccuccccccuccccccaccccacaacagucgccagagugugauauuccccuuccuguguccauguguucucauuguucaauucccaucuaugagugagaacaugugguguuugguuuuuuguccuugcgauaguuuacugagaaugaugauuuccaauuucauccaugucccuacaaaggacaugaacucaucauuuuuuauggcugcguaguauuccaugguguauaugugccacauuuucuuaauccagucuaucauuguuggacauuuggguuaguuccaagucuuugcuauugugacuagugccgcaauagacauacgugugcaugugucuuuauagcagcaugauuuauaguccuuuggguauauacccaguaaugggauggcugggucaaaugguauuucuaguucuagaucccugaggaaucgccacaccgacuuccacagugguugaacuaguuuacagucccaccaacaguguaaaaguguuccuauuucuccacauccucuccagcaccuguuguuuccugacuuuuuaaugauugccauucuaacuggugugagaugguaucucauugugguuuuguuugagcuuucuacauauggcuagccaguuuucccagcaccauuuauuaaauagggaauccuuuccccauugcuuguuuuucucagguuugucaaagaucagaugguuguagauaugcggcguuauuucugagggcucuguucuguuccauugaucuauaucucuguuuugguaccaguaccaugcuguuuugguuacuguagccuuguaguauaguuugaagucagguagcaugaugccuccagcuuuguucuuuuggcuuaggauugacuuggcgaugugggcuccuuuuugguuccauaugaacuuugaaguaguuuuuuccaauucugugaagaaagucauugguagcuugauggggauggcauugaaucuauaaauuaccuugggcaguauggccauuuucacgguauugauucuuccuacccaugagcauggaauguucuuccauuuguuuguauccucuuuuauuucauugagcagugguuuguaguccuccuugaagagguccuucacaucccuuguaaguuggauuccuaaguauuuuauucucuuugaagcaauugugaaugugaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacagucaugucgucugcaaacagggacaauuugacuuccucuuuuccuaauugaauacccuuuauuucauucuccugccuaauugcccuggccagaacuuccaacacuauguugaauaggaguagugagagagggcaucccugucuugugccaguuuucaaagggaaugcuuccaguuuuugcccauucaguaugauauuggcuguggguuugucauagauagcucuuauuauuuugagauaugucccaucaauaccgaacuuauugagaguuuuuagcaugaaguguuguugaauuuugucaaaggccuuuucugcaucuauugagauaaucauguguuuuuugucuuugguucuguuuguaugcuggacuacauuuauugauuugcguauauugaaccagccuugcaucccagggaugaagcccacuugaucaugguggauaagcuuuuugaugugcugcuguauucgguuugccaguauuuuauugagguuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucuggucguggacucuuuuugguugguaagcuauugauuauugccacaauuucagagccuguuauuggucuauucagagauucaacuucuuccucguuuaguguugggaggaugugugugucaaggaauuuauccauuucuucuagauuuucuaguuuauuugcguagagguguuuguaguauucucugaugguaguuuguauuucugugggaucgguggugguaucccuuuuaucauuuuuuauugcaucuauuugauucuucucucuuuucuucuuuauuagucuugcuagcggucuaucaauuuuguugaucuuuucaaaaaaccagcuccuggauucauuaauuuuuugaaggguuuuuugugucucuauuuccuucaguucugcucugauuuuaguuauuucuugccuucugcuagcuuuugaauguguuugcuauugcuuuucuaguucuuuuaauugugauauuagggugucaauuuuggaucuuuccugcuuucucuugugggcauuuagugcuauaaauuucccucuacacacugcuuugaaugcgucccagagauucugguauguugugucuuuguucucguugguuucaaagaacuuuauuucugccuucauuucguuauguacccaguagucauucaggagcagguuguucaguuuccauguaguugagugguuuugagugaguuucuuaauccugaguucuaguuugauugcacuguggucugagagacaguuuguuauaauuucuguucuuuuacauuugcuggggagagcuuuacuuccaaguauguggucaauuuuggaacaggugugguguggugcugaagaaaauauauauucuguugauuugggguggagaguucuguagaugucuauuaggucugcuuggugcagagcugaggucuuuauccaauuugcuagucugugucuuuuaauuggagcauuuaguccauuuacauuuaaaguuaauaguguuaugugugaauuugauccugucauuaugauguuagcugguuauuuugcucguuaguugaugcaguuucuuccuagucucgauggucuuuacauuuuggcaugauuuugcagcggcuaguaccgguugugccuuuccauguuuagugcuuccuucaggagcucuuuuagggcaggccugguggugacaaaaucucucagcauuuguuugucuguaaaguauuuuauuucuccuucacuuaugaagcuuaguuuggcuggauaugaaauucuggguugacaguucuuuucuuuaagaauguugaauauuggcccccacucucuucuggcuuguagaguuuccgccaagagauccgcuguuagucugaugggcuucccuuuguggguaacccgaccuuucucucugacugcccuuaacauuuuuuccuucguuucaacuuuggugaaucugacaauuaugugucuuggaguugcucuucucgaggagugucuuuguggaauucucuguauuuccugaaucugaauguuggccugccuugcuagauuggggaaguucuccuggauaauauccugcagauguuuuccaaguugguuccauucuccccaucacuuucagauacaccaaucagacguagauuuggucuuuucacauagucccauauuucuuggaggcuuugcucauuucuuuuuauucuuuuuucucuaaacuucccuucucgcuucauuucguucauuucaucuuccaucacugauacccuuucuuccuguugauugcauuggcuccugaggcuucugcauucuucacuuaguucucaagccuuggcuuucagcuccaucagcuccuuuaagcacuucucuguauugguuauucuaguuauacauucgucuaaauuuuuuucaaaguuuucaacuucuuugccuuugguuugaauuuccuccuguagcucggaguaguuugaucgucugaagccuucuucucucaacucgucaaagucauucuccauccagcuuuguuccguugcuggugaggaacugcauuccuuuggaggaggagaggcgcucugcuuuuuagaguuuccaguuuuucugcucuguuuuuuccccaucuuugugguuuuaucuacuuuuggucuuugaugauggugauguacagauggguuuuucguguggauguccuuucuguuuguuuguuuuccuucuaacagacaggacccucagcugcaggucuguuggaguuugcuagagguccacuccagacccuguuugccuggguaucagcagcggugucugcagaaccacggauuuuugugauccgccaaugcugcugucugacuguuccucuggaaguuuugucucagaggaguacccggccaugugaggugucagucugccccuacugggcugugccucccaguuaggcugcucgugggucaggggucagggacccacuagaggaggcagucugcccuuucucagaucuccagcugcaugcugggagaaccacugcucuccucaaagcugucagacagggacauuuaagucugcagagguuacugcugucuuuuuguuugucugugcccugcccccagagguggagccuacagaggcaggcaggccuccuggagcuguggugggcuccacccaguucgagcuuccuggcugcuuuguuuaccuaagggagccugggcaauggcgggcgccccucccccagccucgcugccaccuugcaguuugaucucagacugcugugcuagcaaucagcgagacuccauggguguaggacccucugagccaggugcgggauauaaucuccuggugcgccguuuccuaagcccgucggaaaagugcaguauuagggugggaguggccugauuuuccaggugccgucugucaccccuuuccuugaccaggaaagggaacucccugaccccuugcacuucccgagugaggcaaugccucacccugcuuucgcuggugcacggugugcugcacccacucuccugcgcccacuaucuggcacucccuagugagaugaacccaguaccucagauggaaaugcagaaaucaccugucuucugcgucgcucacgcugggagcuguagacuggagcuguuccuauucggccaucuuggcuccucccacauuuucuuuauguaguucacuguugauggguaccugaguugauuccaugucuuuccuauugugaauaauguggugaugaacauaugggugcaugucuuuuugguagaacaauuuauuuuccuuugggucuguacucuguaaugggauuguuggguugaaugauaguucaacucucaguucucugagaaaucuccauacugcuccccacaguggaugaacuaauuuacauuuccccaguaguggaaguguucccuuuucucugcagucucacaaguaucuguuauuuuuugacuuuuuaacaaaagccauucugaccagugugagaugguaucucauugugguuuucauuugcauuuaucugaugauuagugaugaugaacauuuauucauauguuuguuggcuaauuauaugucuucuuuugagaacugucuguucauguccauugcccauuuuuuaaugagguuguuuuuugcuuguugauucguuuacauuccuuuaucucauucuuuagguuguauguuucuucuguugauaauuucuauugccgugcagauggucuuuaguuuaauugggucccacuugcccauuuuuguuuuuguugcaauuguguuugaggacuuaggcauaaauucguugccacagcugauauugagaaguguauuuccuaucuuuucuucuaggauuuuuauaguuugagaucuuacauuuuaagucuuugauccaucuugaguuaauuuuauuacaugaugauagguagggauccaguuucauucuucuccauauggauagccagcuaucccagcaccauucauugaauagggagucucuuccccaugcuuauuuuuguuaauguguuaaagauugaugguuauaggugugcagcucuauuucuggguucuguauuaucuucuauuggucuaugugucuguuuuuguaccaguacccugcuguuuugguuacuguagccuuguaguauaguuugaacuuggguaauguguugccuccagguugcccuauuuuauuuuuccuaccagcaguguaugaggauucuguuucuuuacauccuuacaucacuuauuguugucuguuuauuuuuuaaaaauuauagucauucuaguagguguguagugguagcucauugugguuuuauuuugcauuuuccuaacgauguugaacuuuuaaaaauauguuuauuagacuauuauuuuuugaucaaauuuaccauauacauuucugccaccgugcauuugcugauguuauuuuugcuacauguauuucccuuuuuuucccucaucuuccuuuauggaagcuuccuauagauacccucuugucuuucaagcuuuuccuauuucaccaugccuuuuccaguuaucugugaucucuucugccuuuaaaccuuaggagugcuaugauuaaaccucuguugugaaauuuacuuauauuauucugucuuauguuaugguuucuuggguacuuccaucuuuucuccuggugagccuggacaacuggggccauuucuuugcuugcccaccagugcacagaacaguaacauaauugaaauaauucaugacuguuugacaaagaccucagagaaaaauguguguuaaagaagagauggcuuauucuucaauuuauuuucauguucccuguucucuuuagggcguggaauccaguacugaucaucucaaauguuuucuucucugcacccaugagucccuugcuuuauaucuuacuuuucuuuaggaagcuuagccucaucagaacacugucucuuuuccuguuguugcuugaaauucauaccucccuacucauuugccuaaaaucuuaguuucaucuuggucagucaccucucccauuucucccagguagucagcaggcuaaguagugacucagcccccucucugucacucucccaggagacaaccuuauauucugucuugucagaaagauugagacucucagcuaugucucccucauugucucaccaacccuucuagaaacuugucuacaucuauucccaacuuuccugcuguccuucuugucucaaaggaucagguacguuauuucucuuuaagaucaacccuucccuugaucccuuugaccuucugcuagcuucuggaauacugauuuauauaaaagccaguuugucuggcuguuauauuuuugaucugucccuugcucuuuugcuuucuuauagccuaaaaacauguugagguuuaucccaacauagaccugccuccuacaacuuuucuuuguguuucucuucuagaugcaaccuuuuucuccuuuucacacacgucucguaagauccauaguacuuuuauuuuuuugcuuucucaccucuuauuucauguauccgucuaauauauauauauauauaaucuuggccacagaccacagaagaacuuaaaauguugguguuuuuuuuuuuuuuuuuuuugcuuuauauaucuccaauauagugcagacccuguauaugcauacgggaauaauuauaugcagaaaugcagccuucuuuuagccggaaaggaugccuggaacauguggauaagcuuggauauuugucuaauguuaauuggaauguugguuuucaguugcagaugccaaaucuucauaaaaguaauuggauuuagcuuccuauuuagcaaacuacuucaaaucccugaaguaucccacauccgaaacuaauuuuucuugauuguaucaaguucagucaugaguagaacaaggguugacauaguuuuuuaauauuaaaauauuucuugacaagguuucaacacucuugcuuguccacaaaccuauuguuaaacacacucaauacagaugcaaucuuuguguuuuguggagcuauuuuaaaaacuuugcaagacugucuucuugaaguaaaccacauuuauuccuuuuuccuauacauguaaauuuaaacuuagauuuugaucagauuucaagaaacaacgcaaaaauuguguauuuuuauugcuuuuuauauaaacuuauauauguacuuaauuaaacuucuauugauucauccuaggaaauacauuuuaugguaguuuugagucuuaaaaguguuauucagucuacaaauguucaauguaauauguaagaauauuuggggauacuagggaaaaaaccucuuagaaugaauauuauuugaucauuaaaauuuagggauuaagagauucaauuuaaaggauugugcuaucaaauauuuaucaagcagcuacucuguguaggggucuuuaugauuagaggagguauauaaagauguuuauaauaugguguauagccucaaggagcacgauguuuuauacagauaauaauuauaagcauggacaaauguuacuccuuaugguagucauuuaccauugaggaugauuauuuaaauaucugaaaaaauaaaauggugcuuaagugaaauaugagcagaugcaucauacuuuuuuuuuaaacuaaaauguauuaugugaaaaucauuuugguugaaaucacuagugacuaauaggaacuguauagcucaacaauagauuauucuaauguauuuuuguaauagaacccauuuuguuagaaaaaaauucauagccaugcuucuaugucauuuuuucuuccaagacgucaaacuauuuagcagguaaauacugcacaauuuaguugaauuggauuuucagucuguuuuuaguucaucuccagaguaggacuaacugccagaccuaacguucacuccugugccacagugcuuaacauagagccuggugugaugcauucuaggugcucaguacacauuuguugagcucucugguccugucccaagggcaacuggcauuucuucagugaguuucugaagguaugccuucuguuucugccaguaauuucccugggaccaggaaauuauuuugcuaaugagauaugcacuuuacaacuugcaugccuaugcuuaucauuccuauuccuggaguucagcagucauugcagcugcuguggaaaguacuccuuugcuuugacuguguuuuaacuaucaaguuguuuugggacucccaguuuugucacuauggaauuuuuaagauccuuuuuugcuuaaaaagcaauugucaucuuggaagaagaauaggucucaucaucuuucugguguuaaguugcaaaccuuugaaaguuuacgcuuauaucauuugagguaaauuacuugcuauaucccaauuagguauacaguucuuuuuaaagcauguuuuucaugagccugaaucauaggacuagaagugacauuauaaaguacuucaucuuuucaaauuuugcuuucuagcuugauaccauucuuccuugaguuagccuuuuauucuuaaaauaaaaaaugauuuuauguaaaauuuugaaagcuguugacuacaauguuugauauaguuuaguagggaauguuauggaacaauuggauacucacgaccuagaaaaagagucauuuuuuacuaugaguuaauuuuucuggacuccucuuaguuaacacuggguaaugaguuagaugguaguucugauagccuucaaucaagaacugacucagagaaaauacaguuucaauaguaaagguggagaagcaggcauuccuacaacucucaguaucuaaaaauccuugcagucucacuccuacugucagcuguuuuaacuaucaguuuuauuuagguggagaaaccacugggaccaugaaugauaauuuaauuaacauuccuuuauuaagacaggcugaguuuaauuuuuucuuuugacuauucuuuuuaaauaaagauuauuuucuuaagauagguuucuacaaugguaauuacaaagucaaagaauaggaguauuuuaaggccuuaauauaaauuagcugauuauuacuaauuuuaugaguugaugcggcauagaaaaugugcaggcgauucuuuaaguauucccucacacugucuucauuaguaaguacaucaauaucacuguuuucagagcaucuuaugggguuugccaacagaaugugccuuccuucauggucuugucuuacaagaccaccuagcacagcuggagagagccaacaguugcguguaaaaaaaaaacagaauguggauaugaggagcuaaagacagggacuggcuauuggccccuuguuuauagugaauuaaagccagaccaggccgggcgcaguggcucacgccuguaaucccagcauuuugggaggccgaggcaggcagaucaccugaggucaggaguuugagaccagccugaccaacauggaaaaaccccauuucuacuaaaaauacaaaaaaauuagccgggcaugguggugcaugccuguaaucccagcuacucaggaggcugaggcaggagaaucucuugaaccugggagucagagguugcggugagcugauaaugcgccauugcacuccagccuggacaauaaaagcaaaacucccucucaaaacaaaacaaaacaaaacaaaaaacgaaaacaaacaaaaaaccaaaaaccaaacugaagaagaacccagcuucccagaggagacugagaaggaggcagccagcacaugagugcuccuguaguguuaucuuguuuugggauuuagaucaguuaguaguaauuucccuucaggccuacacauaucuucauuuuucuaaaagaaaaaagagagaaaaggggaaaugaucaaaagggggcuaaacaaugauugacuuuugauuagauuaaaugaguuuaaauucuacuuuacaaagaaaauuuuuacaaaggccccuuucagaauaaucagaaauacuuucacauuauguacuuuuaaacaaagcuuuuuaaaauaauuacauuaaauauuaucauuguagaaaauuuauaaaauucagauaaaaauaaacacaaaaaugaaaauggaaaagcacccauaguucccugugaacauucuccugucucuuuguguguauacaugcaugcauuauuuuaaaaauugggaucaucauauaaaaaucuguuggaauccuauuuauuccucuuaauuucaucucaagaugaguuuucaugucauuauaaauauuauaauaccaaugcuauauaguguagccauguaaaaaucaauuuaaucaguuuccuaguauugaauaauuugauuguuuugaccacuuuauuacuaugaacaaugcugcagugaacacuucuggagguaaagcuugaaacauucaugacuauuuucuuagaauaaauuuuuagauguggagauguugggccagguucuguguauauuuguaaguguuccuaauacaaauguucacuucagagagaugauaucaguuuaccgucgacuauuuggaaaaauuauaauaacuaggguagugguuuucacauuuuuuuaaaaauugaaaucacaacuucaaauugaagccuaauaccuaaaacaacaacaauaaaaaccugaguuauuuggaucgaaauaccuuccuacccuuuaucuugaugguuguagaggcucuacugaauuccugggguuccuuaagucccauuuuggaaaaaccaaugaccuucauggugggcuucuugggguaggaggaaaggaugcaaagucuauggcaaauuaaagaagggagauggacuuagagucacaaucugaaguaaaaguaugucagugugucuuguaaaauguuccaguauaaaguacuguggguaagaccccaaguuagggagaaagcuaauagaaauacaaacugagaacuauaguuuuccccauauuccuugaguuuggaaagcauguauaagagaagaugccucuaagagaccuggagacaaacuagaugaaaauacuuaaaaacuuggucuuggauugagagcucugcacuucagucuccauaaccaacauuagggccugaaagaagaaguagcucaucccagauaucaacaaagauagggaccaaagccuaaccacacuauaaauucacaguaaaacaguaagacaccauuucaucuauaaaacuggcaaauauguuuuuuaauaauucccaguguugacagagauaucaagaaguggacuuuccaguuuagaaggggcuuugaggcugcuaaguucaaccuccugcuuguuguauccuugaucuguagucuucuuagcuuuacuuaaacacucccaagaaagcguagugcucucucccucuuuugccuuuaggaacagcauaggaauaagccagcuucaucuucuugaucagacauuauaauuggcucaccuagugguuuuuaaaacauuuuuuuaauuaagaaaaaaaauuuuuugagauagggucucauucugccacccaggcuggaguauagugaugcaaucuuggcucgcugcagccucgaccucccugggcuuaggauccugccaccucagccuccugaguugcuggaacaacaggugcaucccaccacaucugguuaacuuuuguaguuuuuguagaguugggguuuugccguguugcccaggcuggucucaaauuccugggcucaagcaaucugccuaccucagccuaucaaaguucugggauuauaggugugagccaccauggcuggcuucacauaguguuucuaucaaaacauuuauuauuugccaaaauuaaaaucuagaagacuuuuaaaaauuucucuugaaaaaucaguagcccuggccauacgggaccugcauuuccucauggugagaacaggcugcccccuucacauggguccugccuucuucugcuugacagccuucaccacugguauugucuccugacacagccugagguucugcuaucuuguaucaucaaguugguguugcuuuuuguaguuuuuguaaaacuauaaaaagaaagagaaauuguucuuuuacccacauuuguaaaaauuagaaaaaugaacggcaggcugagagguuuuguauauuuuaggguucaggacacuauaaugaccaguacagaucccaagggggcucuauugcauggagacgauaguuacuaauuuauucauucauuuaugcaacaaauguuaugugagugccuguugugugccagaccacuaagcugugaugcacagugauggccaccaugccuggccauugaagccucaacagugcaugugacagccgugguccccaauauuaaggagucuauaaucuaugggguuuuccacguuauuccaaauccauagcuuaugagcaucucacagguguaaguggccauucgaagucacauggaggcaguggaggaggcagccaguugucuccuuuuagugagcaaaaaaugacucugaagcuccauuguucccuuuucuuuuauguggauagaaaagcacagggacauuugcuccuugaugcuccuagguuucuuucuaugaaaaucuuucauuuaucuacacuugcucaauagauauuuauuagggaccauaggugagacagucagaaaaguauacaaaauguaauugaaaugguuucucuccucaaguaguuuccagucuaguuaggaagaugagauaugcaccccaauagcuacaauagacacuacguuuuaacaauaguuguuagauuuugggucuggucuacaaaguuguuuuaaacuuuuauugugaauauuaucuuaggcccuuaucaaucuauuuuucuaguuuuuuauuugaaauguguucugauucaguucuauuuuaguacaucaugggcuaagggucuuuguggauggguuugugaaauaaacacaguuuauagcauugucucacuggggaaauuccuucugugggcuugaauacucuacuaauagacauacuuuuggaauguuauaauucauuuaaguuggauacuuccucuuuuuagaauuucauauuccuagauuuggggcauugcaacugaccuuagucauauagcccaaccuucuacuggguauaaaaacucugucauucaaugcaaucuaagauuacauuggcaaauaauuuucaucuccuaugaugauuuugaacaauuuguagugacuaccgaaaaugcugaguuaagaaggauucuuagguuuauccaggcucuaagacaaagguugccauaacuguuuaguggagucuguuaagaucaugggaauuaagaauguuuuaguauaugccuaacuauaagaaaggagauuuucuagcuaaucagagugaguuuucaugucagcuuuugguuaacagaagucuuaguaccauuuucucuaucaaauggccagucuuccauucagccaaguucauugggaaccucaccaaaagauuaaagaacagaaaauaaaucagguaaugaggagagauagaaacaacaaagguuucuacugacuugcuacguucacuuuuugaguuugggcacucuucuuuuuuaccaaggguuaagccuggugauugagacuauauucuggugcagugugcagccacuagguccuagguucuuugaggacagggaccauauccaucuuguucacucuaccaagcacagugccuugcguacagcaugccuaguauaggguaggugucucuaaguuuauagaaugaauuacuacagcccuuggcaucuugggaggaaauuuaaaaugagcucucagugcucucaagcagcauuguauugguuucucugguuguguaauuagguuuuugauuacaaauguguguuaauggacagauccauguguucauuuguugcugguugugguugugauacuuccguugagauuugcaguguguuccggacauacagugugacauuucugugguaaggcuucuggucagcggaagauugaugauguauuuuaaccccugaugacuaggaaaccucucucccuugggagacugaguguguggccaguguuuggcagggugacuucuugcaguggaauucugaagcucagacucguguucuauuucuuuuuugccaaccuuuggggcuaggucaugaagggucuuuucacaguggaaaccauuuucgcucaauuaguuggaugaaaacaaaggcugccccaugcccugugguuauugcuuuacaagcuagaggcucagauugaauugcaggcucccuaggucgcuggagacaggaaugcugugguggcuucacccccauggagagggcuggguuugaaagcaucuuguagccaccuugcugguugacuuaauagggaagaagguaacccugcaggagaagccuuucccagucuagcguaguguugagaagacauucugggaauaugcuaacaaaacuccuuaaaaguuuuuugauccauuuccuuuuuuaaaaaagaaacaacacacaaaacaugccaaucagauggcagaacccagagucuuucaugucacaauguguccauuuacuacagcauuuaguagaucaauaauaccuuuagcuugaaguaguuaacaagcauaccuuucaguguuacuuuuauuuucugcucccuguagcacuuagcaaaaucccauuaugcaauuggguaguauuaaauguuaaaaaguuaauuuguucugcauuccauuaaaauugcuuuuuuuuuucaugugaauugguccuuacaucuuguuuaaaaccuauaauuuaagcucaaacuguaguaaggucuugaguaaccuuuugcccuugcuaccuuaauuauucuucaucacacacauuauuucaggauugugacaauggguuaacuauuugcuaguuaaugaaaauaucugucacuuaagaaauauauggacuugaaguuuuaauuaaaauuguauaucaauaaugaaauaaaauguaccuuuuuugaugaaaauauauuuuaaaauauugcuuucuuucuuuuugaaauaaccauuccuugguuaaggccaaaugauugauuaagcuguugauggaaauggggagcuuguuuccauuuuaaaguauuaaaacauuugcuuuuuaaauguaaugguuuucuaauuacauucauugucaccuuauauaaauaugcuuagagauugucuuauaauaauaaaaugucguggaaccagauccuaauggugguguggcaaaaaugccucauauuucuugauuccaaauauauuagauaacuuuuuuuguauuuuucaaacuuauagugaauaaauaauaaguaggaaaugaaauuuccugaaacuaagcuaaauaucuuaagagcauuuggugcuuuguuuggccuguuuuuauuugauaaucuguauacuucauuaaaaaucaucagguucagagagauuacugauaauugcaaacuuaauucuuagcaguagagacugucuggcauacaaagcccuuaaaauuaccuugaauuuuuuuuagccuagagaguuuacaucuuuaugucacaucaaagagaaaaaagaaaacaaaaaauuggugguggugggggcagaugguggaagaaagauaugaacagauccugagaauaauggaguuuuuaauuugaagaaguuuuggaaauuagguucaguuaccucauuucacaggagaauaaaaagaagccucaaauauucaaugaccugcccaaaguucugcguuauuaauaacugagaugggacaagaaccaggguuucugagacaauuuguugguuuugaaagagauuuuggggucagacaaaucugguuuucaacccugacuaccuuuguaagcucuggcagauuauugaagugcucugaaccucauuuuuaucuucuguaaaauggggaugauauuccauugugugauuucaugagauaauggauuugaagacugagcuucgguucugacccuuccaaauggcuuaucagugcuggcucccuucccuuugcuaggucagugucuucucuacaacacaguguuguguauuguagcaagucacuuaugccaaacaagacccugacuauuuuggcaaugaggucuggguuugcugccugaccagcaccagacacggggacacuaguaugcaccuggcuuaugaugauacuguuacgagguuugggcaggaauccaugcugaagccaugcagcaggugcuuugguucuguggccucgggacuccugcauuucccuacucuuguuugauagcauagccgagaaauccacagagacagagaugaugcugaggagcccacugcuuuuuuuucuuggaaaagaaauguuccauggaaacuuuuccugugaacccucuuugagagauuuaugcagauuauaaagucaaaagaagcggucauuccagacuuuucuuuccaggcagacaggccaaaacauaauuuuagcagguauuaguaaaaauugagaaguauuuuguguaugcugggauucuugccaggcucuguguuugcaacucccaagacauugcuaaggugaaaguuuuucuucacuacccuuggaagauuguugaaacaagccggccacuauucuuuuccauugcauccguaucaucgaggccucucuagacacuguuuuguggcaucuugggccaacacaaauugauuugcuuuucagcgaaagaacuucaugcagaauguugacugcagguguguuuuggaggaggcaguaaaggaguagaaauggaaggauugaucauuagauaaagcagguuuaagucauuuggcuauuuaaacuguagaacugccugcuuuaauuuggugaggauuuuuaauuuuuuuuuuuuuuacuguaaacaaaugauucuacaaacugugaguccaaguagguacguccaaggaauuuacagcgacuuuuacaugauugaagauagaacuuugaauuuguuuagaagaaaaaagaucuagucgugagggagugcaaaacauacaccauuuaaaaauacucccugucauacaucauaaucaacuauugcauguguagccauuuauuaauaugugagcaugaugauacuugguguguauguuuguaaacuauauccauuuuguuaguugaaaauauucuuaauuauucauagaaauguauaaaccuccaugagaacguuuuaaccagauguagcaaagaccuaggcauacuuuauugaucauuuuguacagaacauuagggaauguuccagcagagugcagcaaaagcuaguuauugcaaaacauacucuugucuuuucuuagucagucuggaauguugagauauagagggauuuaagauuuuaaaaaugauggaaacaaacaguagagaucuuggaacaauguucuaugugcacuccugcuccccauccucugagaaggccucaaacaagaaaagcauucucuaauuuacuaaguaacacugaucuuucuuaaagaaaggacaugguugguaccuccagauaacacuugaaaauuagcaugguguauuuuacuugcuuuucuuuucaauauaacuuuuuaaaaaaguacacaaguacuaaauaucagaauucuuugucagaaaauacagaaaagggaagggaauaaaaauaaacaauacccuaauugcaccacccagaaaaucauaguuuaaauuuaguauauagccuuccagauuuaugaauguguuggauuauguauaaauauaaauaagaaauagaaauauuuuuaaauugggucauaagguacauacuguuuggaaagugcuuuuucuuguaaauauaaauuguauguacgguuauagcugcuauagcuuuucguaaauauaguuaacucugguugcuaguuucaguuauguuuguaugguaugcuccugucuuuuaaaaaaugugugacauauuacuucacaguaacauguaaguaauucauuuuacuuugugaauaaauauuauucugaugcagaccacuguauauuugauguguaccacaaagaauaaauauuuaccauagcagaauuagcugauuuuucuuacuguuggugauuuacuuuaagaagcuucucuuucuaacuucuagcccauuuuuagagagaaagugauauuuuuuagugguuugugauuacauagugaugauacuuuaauuguguugguguuuuuaagaauauuggcuaaguaguaaaauaguugcccaacuuuuccugcuuucuagcuaccacaauucaauuacuuuugauuguccugcuuuaaauuccuacuuuauaauaauuaugucuucuguuuauaaugugauaauuuaagaauagaagcacaaaagauuauauuuggcucucaacaaugagaagacagcuaauuaccagagaaacagagcuaucagauuuuuaaagaaaaguauaauuaauaaaugcgaauguucaguuuauuuuuuauuuuuauuuuuuaaaaauaaagacagggucuugcuguguuucccaggcuggucucaaacucuuggccucaagcaauccucucgccuuuuccuccuaaagugcugggauuacaggcaugagccauccgugccuggccuuaguuuauauaugagcacaucuguuugaauuaugucuggcacaugaaugucccugaaggaauacuggcuggaagagaacuuggggugacuaggucaaugacccuucuaucagaacugaaugccgcuuuccaaacaggccaggacagugaucaugagugccagggaucggaacacuuugcugauuuaggagguagaaagucagccaaauuggaagcuguagccauguuaaagauacuacagaagcuaccugcugaggggcugagacauuaacaggccuggcuacgugauaagauugaccacaaaagcacaagugcggacccgauuccauagcagagaacaucugccucugcugcuggggucaggagcagccuggagccugugggaauacagcaggggaggcauguaucaccuugcuguaaccacugguucuucaagcacaaaaucaaaaagauagaauuuuaaaaugaaaauguauaccuuggggguguguguguguguguguguuucuagcuauaaggggaugagaaaaacaaagguuuuugagucagggcccacgggugugcacacugugcuucugguagcagggucuaggauuaagagggccuuucauaugaugugugaagaauauauaaauguagaaagcaaaaaaaaaaaaguauuuaaaaaucuugcauuguuucagcaacacaauucagagucaguaaacuucagaaauuauaggugccccaggaaauaaauuaaaggccugggaucauuacuuuacaagaaugagcauaccaggacauuucgagaccaaauuuaguuucuguuccuucuucaaagacaaaacuugaagucuucuuucaguauguuaauuuaaaccucucuaaaaaccuuguaauugggguaagcagccaccaggggguagccaugauuugguuaaaauuacaagucugacuaguaaagcuuuuucccaggugggaaagugaaaggaccacuuugauuccuuuuugaagugaagcaaauaaaaugaaaagaaaguucaguaaauuuuacuaaacuuucaauuaauuucuugauugguuuaaaggacacuuuuugaguuuucagcuacucaguggcauuuuuuugcuccggccaccagcaauacagucugucucaaacuugacauuaacuaaugaugaacuuugcuuuucucaucaccuuguagcuggaaaaacacacacauacacuauguguauuguauauuuaaaaaaauucuaucuuuuugauuucaugcuugaagaacaagugguuccagcaaggugauuauggaagaauauaggaaaacuuggcuuaucauuuccagagaauagagagaagauuacuuucuauucuuauaaaaggagagaacucuuccuuuuccaaagaacaguuuucugcugccagcuagaugcugcuugaaauguauacauuugacacuuuaguaguucugaaauuugcuuuggguucagucuggaggggaacauuaaaaaauacagauuccugagcuccacccuuagacucaccaaauuucaaacgagaagagauguuuuuuuuaaaagguucccuggugauucugaggcaggguccaggaaaaugccuggcagccuucucucuuguaaugugugagaacuacacuaguaagagaauaucucaaaaugaacuuuuaaaaaaguuccuguuaccagaaacagguauuuaaaaauaucuaaaaaaagcacauguaauaagacuuuaagcagaggguuuaacagaauuuuguaggaaauuuuaauaugcagaccauaguguaaugaaauuucuuauuuggggguuucuucuuuuauacugauggccguauaauuauaagauuuuuuuuaauggaaauggaaauguacuuccuuguuuagcugcuauuuaagaaggaucuagaauauggaguaacugaaguuccuguuauaacuuaagagauuugaucacucagaguaacagaugugcaaguagauacucaccaucauguuaugguaaaaaaauuuaaaaaguuuaugauuuuuuggauauaaauuaauauuuuaaaaauguuuauugaccucuucuuccccuaaaguaugaaauaaaggggaagugaucacauucuauuuuacagacaagaaacugagcagugaggaggaaaaccacuuaucuaaggacauucuaaucuacaguaaacacauagaagaguauuggguuauuuugauuccugugccauuuuguuaucuaccauucuacauaaauggagaaguucuccucccuucccaacccuaugucuaaacuuacagucuaguuauagaucccauuguuagucuuucuacuuagaccccacuuuauccaguggagcucaauuauuauuauuaauuuuuaucauuacuuauuuuaaaguaugaugauaauacaaacaggcacacuuuaaaaaaauuuuuuauuuuaauuuuaaguuccaggguacauaugcaggaugugcacguuuguuacauagguaaacgugugccacggugguuugcugcacuuaucagcccaucaccuagguauuaagcccagcaugcauuagcuguauuuccuaaugcucucccucccccacagcccccuccagaggccccaguguguguuguuccccucccuguguccauguguucucauaaacaggcacauuuuugagagacagucuagucaggugauggaugcugugucgaaauggacagcagcuugcgugucuggucuuuccuccuuaaaaggcucagaaacuaaaggcgcuguuaugagaggaguuggaagaaguggggaauuaagagacuucuuuugggaccuaguuaagcagagaugcuauugucuuacuuuugaaauaccaagugggccuugcuguauuuuauuuuaguguugagcuucagauaccuaagccagugucuuuugcugcucacuuaugagauccagcuugaccuuacaguggcaaucauguuaaaagagaacaaacuaaaguaagcacaaacagaaacuuagaauuaguucuaaacaaauguggaucuaauuuuuuacauuaaaauaaaaccaaaaggaaggcugacuuuagguaacauuuaucaaauuuagacuaaaauaaaccaagaaguuuauaagguccaguuuguggaguaaaauauuggcaugaagagaacggaaacauugcauguaggaaaauguacgggaguagaauuagagaaggaaaaaucacuagucaugacccgauguuacuacagccacaccagcuuacuuauaauaggaauucaguguguuacaacaaagaggguucuguaaaugcaccaugauaaaaauggcaaauacuuauaauagcugcuauuuuuugagcacuuacugagugccagcuauugcuaagcacuuuaccuacauuaucucaauuauuuuaaaggguucuguuguacagagggacucuguaauguuuugccuucaauaacuuaaugcuuuuaaagagcauuucuuuauguaaacacuuccccguggauuugggauucuaggaaauaaaugggaaaauauuagcuaaccuuguacaagagagaaugaugguguugggcauaugcuauaaacucuccccagauuucccaaacugugauccaaggaauauucuucugggagauauuaauagauguucuguaaaaaauggguuuugaagcacugcauucuguguccuucugcuggggauucacuaagccacauucgguuguuaaaggaucugagaaguucugcuuuaaaaaaaaaaacggaguuuuuuaaaaaacuauguuuacuauuuccuuaauuuaacuacagaacaccuugagaggagcggucagggagagaggauuggagaacauuccaugagugccuaguugguauugggagacaauucugcugggugucuuuuguuucugugcaucuugugagcggagggacuagucagugccuuuguucuguacuauauucuguacuauauuuucaaaaaggauauuuuauagagaauacccuuagacaacagagguaguaucucccugcagagcagaggguagguuguuuacuaucuaguacaacaaacacaauuaauccuuccagaacaagguuuaagcaugauuacugaccauuauaaaagauuuggguucccuaagcucaggguucuucuccuguaacacaaccccuccgcaugugcagaugucaccuucuuggcccuuuucacauuaccugugggaaucugggcucagggaacuggcacaaaugcugauguucuggguacucuuguugcuuuaaguaguaaaaucuuuugcuucugaccuagcagucuugaaucuuuugcaagcauccgugaaaccauggcagauaaacuuguuaauuugcaauuacaguaaaaucuuagaccuuucacaauuccugaaggguuggguggaguagggugagagauaagaauagaguggcuggggcaaaacugugaagaauggagaaaacacaggacugcaaaguuaagcaucuuccaaacagucuggacuauugacuuuccuggcaauguugcuccuuugagccaauuaaucucaguuccuauagauuuccuuuuagguuuuauugacuagauaucaauuauguuuugcuacuguucuuuucugugcuugauuuuuccagguguagaauuuguuuauauaaugaaauaccaaauggugcuggauuauuaguuuuacaguucuuguacauuuagggaaagaaagacuaggcaauuuacucugcuuggcaguuuacacggguuuucugauguaaucauucauauuauucaggauuuugguauuuuauucugaaauuuacaugugaagaaauuugaugcucuucgaggugguucuuauaauauucauugcuaucauuuauggagugcuuacuaaacaccagcuacuguguagcuaagcguaggauauuuucuuauuuaauccucauaaugacccuaacuaguuacuauuauuauccuuauuuuaugcaugaggaaacugauaaccagagaggaagugaucacccccaggccagguaauuagagcugugauuuaaauacacguauguauguaugacuucaauauccaguuuucucuguuccccuccaccgucugccaaauuaaaguuuuauggcauuauuuggcuugagcugagggugaccauguaguuauaauccaaacuagacauuuuggagaggaaaggggaacaauauuaauaauugcaccagaacaacagguauaguccagacugucauagaaaaacaggguguguguucauucuacugugcaaaugaaauacccaaguaaauaguaggauagauuuuagucacauuugugcaauugauuuuugacaggugugguucuaggauauuaucucccauugagucaauaugccgaauucaaauaguuuuaaauauuuuauugugcuuuuaaaaguauuuuauugccaagguagacccacccuuauugacaguuccaauauagauaaaauggauuacugcacauccuuuucucacaccucaguguuuuauggguuuccagaacuuagugcaguccaaaguaaagggaguauuuaugacauuuuaaaaagcaaaacaggagauaauuauucuuuucucucuuccuccacccccucaaacugaagaacaugauugacuuggcuuuauaggguacacauuccucaucuaaaugaaacccagcugaggauggaaaauugcaacacuaucuuguccuccugaugucaacugacaaaggauaagauacuuaaacuuugcuuuccuugacauccuuuucagugagaguucuaacaaagagagaauaauaauuaauauacagaucuauaauaacuaugauaguuuucuugugguuuauacauaauuguuuaauuagccucuacaggcuacuaugguaguuuugcauugauuuuuuguuguugugcuacuuguuagaaauuuuuugacauugguguuaggcuagcuuuguaaauacauuuugugcauuuuuccauauugaaauauuuuugaagaguauauucuaugaaaugauucuguggucaaaugauauaucuuuuggagauuaacaauacacuuauaagcauguuaaagacuagguaaaguccuagagugcuagaaauagcuugcucacuuuguuuaguccagcauuucccaaacuuagacacugagugcuuuuuuuaguggagcauguauuaacuuucuguggaagcacacuuuggaacacauuggcauauguguagcaguuuucuuuuucaaaaaaggccaccucuauuuguugcuauaucuccuuuuauuuuauaauuuuguguugccacucucuccccuuuuuugcguagcuuuugccuugaaauaaaaaaaaaaaaaauucagccagaaguguuaguuaucaguuacucuaauucauuguacucugaaucuccuuuugccugccuaccaugauuugcuuugcuccuuuuucaaacuuuuuacuuuaauguuuacaucauuuauuuuuauucuuuaagaacacugaaagcauuuaaggcuaugaauuuguguuugaguauggcuuugccaacauaccacauuuaaguguggugauguugcaguauggcuuggugaaaauagcauugguuuaggaaacagcuagaucuuuacuaggauccugccauggauuccauaaucuugagccucaguuucugcauuauaaaaugggguuaauaauacuuacuuuucagaauugaaaaaaauaaauuuauuuauuuauuuuuuucuguagaguucauagcacaguaccuaaaagguagaugguugacuaaugaaugccuuuauuaauuuuauguuuuuauagauacucuguaauuucaauauugauuuaguuuugucgcagugguuucauaguagcuguuuaggagaauaacuuuacuugccaaauagcaaaauuaaaaaaccuauaguuuuguuaacuguuugaauuucauuuuuuucugagaccagcuucucuaugggaagggagaguugccuuuaggaaguucuaagccugcauuagcuuguggcccaugaggaaagggucuuuuccccaugaagucaggucgauuuaaaaaaauuggucuaugggucuuacugguaccagggagagugcuacuaggauggguccaaccuggacuacaugcucaggcugguggccauauaagguuaguucuguuaccaauaagcagacuaacacagauguguagcaauuaaaaagcagcagugaaaaaagcuagauauggucucccuacaaccaauuaacugaaauucguguauucacucacuuacucaaaagauguugagagucugcucugucaaguaguauuuaggcacuuuggauuuuucagucaacaaaaagaagaucccagacuucauaggacuuagguucuacuaaacauuuuucuuauuuauuuguuaauaauuauguuuguucucacuagauauaaauuccauggacucagcagcuuuuuucuuguucucuacuguaucccuagcaucuagaaaauaguugguauguuauaguaucucaguaaguguuuguuguauagaggaaacuuggguacucuucugggagaauacaaagucuuguuuuacuuuguggccuagucacuuauguggagggaacucuaguuccuuguuuaucgaaagcaguggauaaaaguccaaauucuagaauuuauccuucauguuuuuccuuaucucugcuucuuuccucuaucaaucucauguggauuuaaaauaugauaaaaucugggacaauguuuuucuuacccaccaguggccaauggacaguggaaauugaauaaacauuuaauaaaugaguguuucgaucauaagaaauagggcaugucugccucucccuuguuggcuguuugcacacuugggauuugcagucuucaaugaauaugaaaagaguuggccguagguguuugugagggagaagagaaagauuugacaaugguacuggccuggcaugguggcucacgccuauaaucucagcauuuugggaggcugaggcggguggaucgcuugaacucaggaguuucagacuaaccugggcagcauggugaaacccugucucugugagaaaaaaaaaaaaaaaacuuagacaggcauggugcugugugccuguaauaccagcuacuugggaggcugaggugguaggauaacuugagccugggaggcagagguugcguugagccaagaucaugccacugcacauuccaaccagccugggaguguggaauaagaguaagacccugucucaaaaaaaaaaaaaaaaugguacugguuaccuaagaaagcuguucuuguccaauaaagaagugacuaauagcauucuggguuuggguugauguagauuuuugacuaggggaaggcaguggauuuugguggaacucuuuuuugaacuuccagccuucucugcuaaauguggcuauccuagucagaguccgcugugaucugaauguuugugcccuucccaccaaccccaaauucauauauugaaacuuaaugaccgauguaaugguauuagaagguggagccuuagggaggugauuagaucaugaggguggugcuaucacaaauaggaucagugccuccauaaggaggccccagagguugccuugccccuuuuaccaugugggaacacagcuagaaggugccaucuauggacuagaaauagggcugucaucagacauugaauuguuagcacuuugaucuuggaauuuccagccacccguacugugagaaauagauuucuguuguuuauaagucacagauuuaugugauauuuuguuuuugauguuuugcuauagcagcccaaauggacuaagacagaaagagagccauauguuuaauggaaauuacuccugauguguggucgacauaauacaccaugaauguucauacuuugcacugcuuuguaacugggcaucuuuuuauaauauaugcuuuugagggaaugaacauugaaauaggagaaaagagcaaaucaagcaccacuugauaguuaccaugucaauugaaaagucccuuauauuuguccuuuuaaugagcagcaaugaaagaguauuuuauaauaucccuaagaaacucauucuaguuuguuaaacauuuuugccaggauuuuuuuucuuucuuucuuucuuuuuuuuuuuuugagacagagucucacucugucgcacaggcuggagugcaguggugcgaucucgucucacugcaauggugcgaucucgucucacugcaagcuucgccucccagguucacgccguucucuugccucagccucccgaguagcugggacuacaggugcccgccaccaugcccggcuaauuuuuuuuuuuuuuuaguagagacgggguuucaccguguuagccaggauagucucgaucuccugaccucgugauccgcccaccucggccucccaaagugcugggauuacaggcaugagccaccgcgcccagcugauuuuuuuucuuaaauuacucucaaaacucuuuauuuugcaguguaauuacauuauaaugugauuauauacaucuucuguuucuuuuaugacaaaccuaaaggguuccauagaaaacuagcuaauaucauccaauuuaagguguucuuuuuggccauuagguuaaaguauuaaaucauuaagacaacuuuaucucuuuguuguuuuagaagaaauaauuuagcagauaaaaaaugcaccuagaaaagaaaaguugucuauguuguuauucgaaauggaagauaauuugaaauccaaacuauaucgcuuuuauuaggccuauagaagaguuauuuacaaauauuucuaggcaaguuuuuaugauaagcaugcuuuuccuuuuuuuuuucaagguauuuucccucauuuguaucauauuuggaacguuaugcccuaaaagguuccccuacaugauuuuagaguuaagaauccuuuuaccugcuaguuucuucucucccucauucucuccuggggcacugaucuagucuauaauucagacccucaguugaaaaggaacugacauauaugugacuaagagaggguuuauguauuccuugaggcaugguccaucaaucaccuagccacuuuaccuaaaggcugaaaacugugaaucauuuccuccaguaccacaugcuaggaggcacuugauuuaggaauauggguaaugugggcuauaauuaacucuuuuauauauuuuauuucuguucuuuaacauauggcauauaauuuuauacuaauugcagagauaggcaauuaaaauuuugcauuugcugguaucacaagucuuucguuaauggguauacauaguuacaugaaaacacauguauauuaaucaauaauuuaccuucaaucacagucaucuguauaaugccuuuccuccaauacaucauugguagaggacaauuuggcaaugagaaagcaacaauuguuacugauuuugcauuguuuuggcagaguugcaauaauuuucccauaccgugauccagcagagauaucagauagauuucuagacuguacuugcauuugaaaguucuuccucuguuuuuauucugaguauuuuuuuccaucagcuuauaacaucauaauauugauuagugcaaguaauguauuauucaugccauucugguuucauuccauuagugccaucggcauuaguauucagucugagagacacaauuaugucaagaacccucuggaucagcuagucuuguuuugcauuuguuucacauucauagaagagacuucuuuguagaguagaucuuuuuuauuuuguuggugccaacuggaaugaaauaagagauuaauaugaggcugauguaaauauaaccuuauauauuuuuauuuuacagauaaucauuauguaaaauuugaaaaauuuggaauguguaaaacuuagaacuguauaaguagggaaauaaauucaucuguauuuucaucauccuauugacaaguugauuuuacuuucuagucuuauuucuuaaauaauaaaguucauguuguauaugcaguuuugaauacugauuuuuagcauuauaugaugcauauuuugccguauaacauuuuuaaaaguugauuuuuggugaacauauaauuguuuauauuauuguaucauuuucaaccauucuuaauuuucaaauauuuuuucauaguuuuuuuaucaauaaugauggauaucuucauuuauaaaucuuugaccauaucucugguuauuuccauaggauagauuucuggaagugaaauuaugggccaagaauauuagccuuuaaaaaacucuugauacauauugccaaacaacuuucuaaaaacacugaauucuaauuuccuguuugcuaaaaaaaaaaaaaaacuccguuuuagcuuauguugcuguaaagucauuuuuuuuauuuaauguguaucugucuuuuuaguaauauauucauuaaaauagacaaguuaggacaucauuagauugcuaaacaaccaaagcaacucaauagauagccuucuagugcuaaaagccaccugacauuuuggugggcuaucuuuucuuaguguguaauuuuugaugauuuauauugcuagauccuguagcuaaauauuugaacggaaauaugguguaggggucugagcauucagacagauaacaacaguucuguaagucugcuguggaaaaaugagagcugcuaucugcuacuucaucaguaauaacugagaucucauuguguuucaccuguguuuuuagccauucauagaaccauuuagugacuuaauuuuguauuuacaauuauuucaaaauuaguacaaagucuagguaaucuaaucaaaacaaguuauguuugaaauaacauacugcugcucauaugcuuauuugcaucuugaagaauggagucuaaaauguacaaugauggucaugacaugauauuauaugaauuuaauguaauauugcggcuuugaccucaugaaauaugcagaaagugcuaaguucaaagaaaauguuuaaauuaaaguauugugacuccauuacuucauuuuagccuucuaucauaaggcauuuuaugcaauacuaggaaaucucaucuccuuuauaaagacuacauaaaaugaauaaugauuucuguuccucugcccaauuugccugaaauacaauuguauugaauuauaaacuaacccuaaaauuuagguauaauaaauaccgcauguugagaaggucaguugauugguggucuuuuuaguugaacacuucucuguagguucugcauuggucgaugucuuacugaugguaaaagggaggaaaaaggaagcauagggauuaucagaauacuuggagucaucaaaaauucuauguauaaaauuuacuggcuauaugaccuuuuaaaauguuuacuggcuauaugaacuuuguuaauaucaaggauuuguuaaaucuuugauacuuugugaguacaauuucuugucuguuaaugaggaaugacauuaccucaaagauugaauugaauaaugaguaaaauaucccuuuuguagauguuccuuaauaaaaguguguuaauuucuuauccuuguauguaaaauauguggaagguuaaggcuagaccaaggacucuauuaaguaugcagcacucagaaaaguaaugccuucaaaaauguuuuugucuucuccuugcaauauagaugcaucaauagauacugaauuaaauaccaagcauaguauguggguuggcaauauccuguguuugcaacuguuggaaccaguuugccccauuugcaggaaucacaauaaugaagauaauauucacaaaauagcagugcauauuuuauggagauauauuuuccguaaaggccauucaguugguuccaggaggguuuguuguguucucuugugacacugaguuuuuggucccuugugcuucagauaugugaaaacuuuuguguucauuauuaucagugcugaauauuagccacuccucacagugaagcaagaguacucugaagaauuaccaguggauuccuugggcuagagguaucaccaaguguuuacuugggggagguggcuuuggucuucccaugaccuuuagcagccuuccccaauucuuugagauagagaauuaacguauuuguagucuuuuuuguaaagugccgugcaagugcaacuuuaagacaggucagcucgcuaacuuccaaguagguugcuguacuaaagcuggagccaacacaguuugggcugcccuacuuaagcaggaguuguugguuugccauuaccuacuguguuucugcuacuuaaggacucccugaauccuagagaugugggagcccuguagcaaaacauacaccauugcuauugcuggugaugugaacuuagaucauguuuuugcauugugaaauaaguguguuguaguguacuugaugaaagaugcucaucgguuaaaaucuuuacuuuguuauuauuaaugauuaauguaauagccccuugaucacugccccaacuuugaaucaucugucuucuaacuucaggugaucauuccucagaaaguuaguuuccuaaggauuauauaauugauacuuguaauuacauuauuuauaaucucaaacucauauuagaaauaaugaauaaaaacauuuuguuuuucaaguucaaaccaaagguucugaauuuguugaaauuauuuaaaaugaauuuauuuguuaagacucaccuccauugguaacucccuuugaagucaagcuguucucucugccaucaacuuuuuagauccaccuugaccauggcauugauaacgcuguguugcaauuacuugacuacacaucuguuuuguuaacaaagcugugagcugauuaacggaaggggacgugucuucuucacugauaucccuaaauguuaguaaguguucucauuguuaauagaugccagauaaauguuuuccagauuaucuugaauuuacuuaagcauggaauacuguauaaaacacauaaguuauaaagcauuagccaucugagauaauuucuguguaacuugacuuguaacugugacauaguuuauuuaacaugaacuuugguggugagauuuguacaugagugaggaaauuuaauauaugauuuaaaauaucagggauugaauaaaggaaaaagaaaccaucuacagcuuuuaagugucaauuggaccagucuuuuggaaucuaucuguccaucacaagcuugucucugcuuuagccccaucucagacauuuaauccuugucuagaaggguaauuagaaaccaucuaauuuagguuauuucuauugagguaaauugaguuaagauaacugaaacuugccuuggcauuuaaccucuuuggagucagagcauggcucacccuuugugaaaggccacgcagcugaccucucugcucccacaccagucuucuuuccaaacagcgaccugagagugaucaucaaauagagccaagugcuauaucagguuaacuccaggguauuuuuaauggauauauagagaagcaucagaguguuaucugucagacacauuuccaauucugaggggaaaauucuuuugaauuucacauaaauucuuuaccuggaaauacagauugauuuauauugaagauuacuacuacacaagaagucauagcuucuuagauaacuguguauauguccagcauaucuuuaagaacaguuuuugggcagugccucaugccuguaaucccagcacuuugggaugccgaggugggcggaucaccugaggucaggaguuugagaccagccuggccaacauggugaaacuccgucucuacuaaaaauaaaaaaaaauuagccggacacuguguugcauaccuguaaucccagcuacucaagaggccgaggcaggagaauugcuugaacccgggaggcagagguugcacugagccaagauccugccacugcacuccagccugggcaacagagugagacuccguugcaaaaacaaaacaaauaaaaaccccacagcuuuuguacagcuguuuugaacagcuuuugcaacuuuuucaacauuuuugcuggacaugguguuaaguuuugaaauauagaaaugaaaaacacauaggcucucuuucguaauucuaacucacugucaacaaaaugcagaaaagcauauuguaacaccuggugauaagggccauaaugaacauauugugguguuuuuauuuaaaauaccacagaacuaaaccaauuggcuaucuauauauaaaaaaugcaauuggauccuuaccucauaccauaaacaaaaauaaaucucaaguaaauuaaaugccuaaaugggaaacauauaccuuuuaaaagaaaagggagaagcuuauauuuuuaaccucaggguagggaaggacuuccuaagcaaguuauaaaaagcacagccaaccuuuaaaaucaaagauugauaaauuugacuaaauugaaauauaacuuuuguauaacaaaggaaaccagguacaaaauuaagauaagauauuuuuaauucauucuaccaggaaaggaguauguaaagaauccgacauaauuaagaauaacggguccaguagaaaaauuaggcaauggauauguguagaaaauucugaaggagaaaauguaagcugccaaaagacauugaaagaugcuuaaccuugguaguaaucagagaaguagaaauuaaaacccauagggaaaauccauuucauacauaucaaacugaagaaaaagggaaauuucugauaggaugaaguguuggcaaauacauggagcaaugacaaauucccauacacuacuuguaggagcacaauuagauacaguauuuggagagcaguuaaaugaaagaacuugggcuauauacaugcuaauauuuaacgcagucucaaaaacacaaugcugagaaagaaagaacacaggauauucauuucacaaagcuggcgaauguucucauaugcugcuauucucuucuuccauuggaacaguuaguucagcaaguuaucaugacuaaagcugaugaaggagucucuuacaaccuuaguuuaucauaauugguagguacccacaggauuuuuaucacuuuaccagugcuuugguagguaagucaccaagagugaacacagaguguucaagcuuugggcugauuuacaaacagccaaaaaugccuguauucuuggucaagcuuuauggacccuucagcccuaaagccuggggccagcucaggucugagugacaugcuaggccgggcccuaguuuuuuucccugggccagcugggaaggacuaucucaccuuuucuuacugcugcucacauggcccugcuauuccuauauuugcucucuccuuuuggaaucaguuuauuucuugcaagaauuaucucaugggguauugugauuuuuuagugauuaugugagcucuuacuacuuuuugcauguaucaaauggauuucucugaguuuuaaagaauuccauuuuacuauauuaauuugggagaaaugcuauugucuuucugaugugacccaugauuucauagauuucuacauuucucuucucagcuuucauuauuucagacugaagcauuccugucuccauaagccugcgcccacauccacuuuuuccacuuuuucucuuuuuuaucaccuuuuuuuuuuuuuugggauggagccuugcuuuguugccaggcuggagugcaguggcgcagucuuggcuaacugcaaccuccgucucccagguucaagcgauucuccugccucagcuucccaaguagcugggauuacaggugugugccaccacgcccagcuaauuuuuguauuuuuaguagagacaggguuucaccauguugaccaggauggucucgaucuccugaccucgugguccaccugcuucggccucccaaaguguugggauuacaggcgugagccacugcgcccggccuuuuaucaauuguuaaaggaaaaccuuucucucuagaggaagaaaagauaaaucugucuuuucugauaccuaggguagggcacaaggacuugacugugagguaggcaaggcaagugagucaaccuuaguguuuggguuuugcgugagaugcuugucuagagcaguacacuguauaccaggagaaauuugauaugaaauaagguaauguuuccuugcagugugaugcaaaaaggcuuagacguuagggcuggcgguuuuccagcuuugugaucauggaaaagacacuuaugaaaacucuugaucuuggaaaagacucauaaaaauucuaagccauaguuccauccauugaagguuggaaauaauaaagcuuaucucauagaguuguguaauuuaacuuauuugaaggugcauuguaaguuauaacguaccauacaaauuugagauauuaguguuaucaauauuuuucuaaaugaugccuaacauucuuuuggucucuuuugcccucaucaguacaugguauauguucuuaguucagcacagaguaacagucaucccuauuuucuuacuggcuuuuguuuucuaaagaaaggguaguuuuaaauauucauaaaugcaugacagcugggggcauuccuuuuaacagauaaaauuuauuaaauaugcaauggugcuugguggggaugcuacuguguagcacauggaaggucaugggccacagcuuacaauuuugaggggcugcacucagguuuauugaggcagugcuuaaagguuugaggucaagaaagggaagcugccagaauuuugaauuucauuccuaaacaagucauuuauuaagaaccuaaaaacguacugaaucacagcacauuaaguuaguugauguuggacauagggaauuuuugaauauggaaaaauuucagaguccaucaguauaccauugcacgagguagcccaagcucauaugaagcauaagaucuagugcaugguguaugccauuuagcagugauauaauuuauaauuuaauaaaugggcaugaucaacagcaauagaaguuagaagaaugguugcuuuuggggagggagaggcauuaacuagaaaaagaaaugugagaacuuugaagggugauagaaauauuccauauuuuuagugggguauugguuauacagguagauauauuugucagaauucauugaacugagaacuuaaaaucugugcauuuuccgaacacuucaacagaaauaauaaaauaagaaaaauguuuaaauggaaaaaauuacuaagcaugaaagcaauaaucgaguggauauagauuguuauauaacaaguagaauaucuaauugugagagaaagcagaguaaaagaaucaucaacauaggcuggaguggagucaauccaggaaugcucccuauuuguguguaugagcuggguuuuggggaaaggaugagcuguagauggccaaaaaaaaaaaauaaaauaaaaggguggggagaaaggucuuucaaucuuucaaaucuuggaaaccauauccccaagggcucagacagagcaggaugcaaacugaggcgagacgcuagauugauuugcaaaaaauauuuaauauucauuuuuuauguucauuguuuuaauucaucuauucauaaaaugaaaaucacaauaauaccuuguggaaacuuaauucaucauuuaaugauauuuuggauuauuacuacauaaauuaugucuauuucuuuagaauguucuuucugagaucuugagcauucugguuaauaacacaugaagcuugaaaacccacauuugcacuuauauuuauaauaucucuauuaaaucaggaaguuaauguuugcaugguuguuaacccauuuaauugcaacuaauguaugcuuucaugacuuuuguuuuaucucauuaccuuuuugauuugauuucuuuccuaagaauccauuaugaggacuuggacucuuguggagcucagaaaguuuaggauguguuaaaggaauuccuuuuauagguuaucucaaagauugcccaucaauuacagcaauguuuucaaccaucccuggcauauacuuuuuuuuuuuuuuuucccgagacagagucuuacuuugucacccaggccagagugcaauggcaugauccuggcucacugcagccuccaccuccuggguucaagccguucuuuugccucagccuccccaguagcugggacuacaggcacccgccaccaugccuggcuaauuuuuguauuuuuaguagagacaggguuucaccauguugggcaggcuggucucaaacuccugaccuuaggugauccgcucacguuggccucccaaagugcugggauuauaggugugagccaccgugccugacugcuggcguaugcuucuaagaaauuuccacuuucagucaguuugacaguugaauccaugaacacuuggucuaaacgcccuugauacuaauuaucauauuauguuugccaaagaccaggaaagagauuuagauaacaauauuuugcauaauucaggcuguaaaauaaaucauagagaaugagcagugugguuugugguguguaaguuguuuguagaauacagauaugaacuuuuaaaaauaaauguucucaagaaaguaucaguggcauguauuugaaguacuuuggaaacauuucaucaaauuauuacguuuguaguggaauugaggggugaacauuaauaauguuagaaaguguuuuuuaaaauaguaagcuaaaguuuuacaauugauuaaaauggaagcaagugcauucugaucugacaaauuauuacuuucuucugauugagaaagaaaagcuaauuagcaccucacaaaucaacagugaugaugggaagcuccacuauaaaugugccaaguauaaggauuauuguuccucaaagaagguguaugcauuaagcauaaugugaucaccuuuuuuuuggucucauuagcuugguguuuaucagauuucuuuaguuaacccaggucugcuuauaguuauaagcagccauuaccugcauugguccuuguccaauuuucacacuguguaaauauagacagaaagaaaaaaacacuccuuagaaauagcuuugaaaacugaggaagucuauuggaaacauaaagcauauuuggcaucuuauaugucauguaugaaaaguuaauggacuugguuuuuaugacuggcuuauggaaucggucucauuauuguacugucacaccuuguauauggcuaaauggguagaucauguacucauuucugugaaaaauuaugacuacuuuguaguagaacuggcaccauuaccaagaauuuaugaauuggagauugauuuugguaaaaauggaacuuguuuuaagccaaauaucuuaaaacccaaacccuucaauccuaacuguucaugagaaugacuugauuuuuguuugauagaaagauggaaauggaaaaggagacuugcuugucauuaugucugcuuguucauaaagagaaaucuggaaaaguuaauuccuucauauucugagacguagcuaguggaggacuaauuuugucacugggauucucuuaaauccagauaugcugucuuucaugcccuucacucccaccgggaaaccccuauauuuuucuucccuauggacuccaugcuuuaaaaauugucucucaaggacaauauaucaauuguacaugcuuuuauuaauacugcauagaacugcauguaaaauuguuugaucagugugaaauaauugcuacaaagagacuugacauuuugcuuuacuuuggaaucccuauuacacauaagcgugcaguuuuuguaauaaaaaagaugaaaauaacuuguugaucuucuauuguaccuguaagaaguucaucuuggcauucucuuguagucuuagcaagcauggauuuguaaucacgccaaaauggguuacauaugacaccagaccccuucugugugaccaugaauuauaacuuuuaaaaaauuacuuuacuugagacaaguuuaaggcaauaaagugaaugccugagaaaagaagucaucagugggaguuuaugaguuaccgaaacagggagcucaaacugugcucaccacaguagaauaguuuuaaaaaucagugaagguguuugaauugaugagcuguuugaauugguccucugaccucugaaaugaccuuucccauuaccuccucagguuugaaggauaauugcucuccucuucuuucccccugaggcaacccuagccagaauuucaacuuugccuuuugaagggugauaccuguggugcagcauauugggucaggauaugaccuugcacaucuguauuucacuagacccucagaauagagaugcccaccacuguugcugucuuagaugggggcuuagagaagugcuuccccaaauccaaaucauucugcaucuugauaccucaaggaucauucucuauucuuaaacuguuucuuuauugucaguuuugaagaacgguaacucuauuagggagauaaaaaugaaaaaaguuauuuggaaguagucacuaaauaugauuaguuauuuuacaugauauagauuauuuuaaauuuuucuguuuuccaaugugguuaacuacuguauuaagcacuucuggagcugccauaaugaacagcuuaaucaguucauauaaauuuguuguguacugcuaaggacuuuaauuggaaauauaauaaaucuuuuaaguaaggacuagucauuauagaaagcugauuugcaauaguuaaauguucacauuauacuaaaaugagauauaaacacucuuuuguagcauguuauuacaacacacagaugucuuggcuccaaagaacguguacuaaaugagugcugcuuggauuuaugccagggucaaggcuuagugaucuuaaguaagagcccagaacaucgcaugaugggaggucaacuaacugcuuuuuauucuaggagcucuagcucaugcuuuggagucugucgcugguggagaggacaugcccaguauaaucuauucucccugcucacaacugaagacaaagccuuaucaauauaugcagaccuuaaaauacaguugaaaauuuugcgaaagcucuuauuuuagggcaaguaguggcugguuuaguugcuuccaaaauggcuggauuguccauaauuuucagcugucuagggaaguugggagggcagagugcaucuuuccccgcauuuagaaaaauaguacauguauguugaggggaagugaguggagaaaggagaggaagaagaagaggaacaaggcuguacaauaaguuacaucccuaggucacauuuuaaauuuugauggaaccggucucucuuggagaaucuguguaaggaccuacauccuguaggaggaagcagagccuggguuuucaggccuuuaagcauugacuaacugcugaaugcaaaugcuagcggagauugaacugugcuaauauuccuauuagaacuguuauuauuuuagcuaaugcucugauuacagaauugcauaaguuuugagugcucugcucauaaucccuuuucccucauaagcccuguuauuuucauagcaauuuugcaaaacaugaaguuuugcaggaacacauguauugcauuuaugucagaaaugccaguacaucaugguaaauaucuacuuaguaaacuacuuguauguugaugcauaaaguuaaauuuuauaauaagaccucagugaccagauugagaaauugagguauaaaaaguuuguguuguccuccauuaguuggaauguucucuguuuauuaaacugcuuaucacauuguugaaacuauuuuaauccaucuaaaugauauugauaugguuuggcugugucuccgcccaaaucucaucuugaauuguaauccccauaauccccauguguugagggagggaccuggugggaggugauuggaucaugggggcaguucccccaugcuguucucgugauaguaaguucucaugaaaucuggugguuuuauaagcaucuggcauuucuccuacuugcacuucuuuuuuuccugccaccaugugaagaagguuuugcuucccuuucaccuuccaccaugauuuuaaguuuccuagggcuuccccagccauguggaacuguaagucaguuauaccuuucuuuauaaauuacccugucucaaguaguaucauuagagcagugugaaaacggacuaauacagauauuaauagauuuuugaagcagaaaauguauaauuguauuaucauucuuucaaguaauauauuaagaacaaaaacuccaagcuuaaauuuauuugauuugagagugagagaucuaaaauaugguuccuuaagauuaaaauagcaacagcaacaacaaaacucuuucaucauggaaucauagucacaacacuuuacaggugaguaaaggaggccuuaaaaauucagucuuugagagcaaagagaauaauuuacuagagccaaaaguuccugugcuucuaugucuaauauuaagguacaauucuuaguccauaguauugccauuugguuaauaucuugauaguaaauauuaaguuaacauuuaauuauuaagcaauauuauuaauuaaaccaaauguuaaaucuguuuuuuuugaaaaagcuugaaauucccuuacaauguaagaugucauaacuucauuauaucaagucuaaaagcaggcaaacaugagguaucaauuucacaccugccuauugccaugaucaaacaaccuaucuaaaagagaaugaggccuucauuuaagguuuauuuaaaguuggaagcuugguauuugccccagaaaagguagaaagugauuaaaugagaaagcagcuuaauucuugccauuuucauugucuuaucugcaguucuuucauucaucaaagaugagacaacauuuuucauggucagccuauucacuaacaugcuauggagugaguagugagcaauauuagcgaaagaaauuggguuguuugcuuuuccauuuccuuugucugaagcacaccaauccccaauucgauucugauguugagcacuucagagggcuuccggcuggcaucuggacaaagccugaauauguggagaacagauucagucugaguugacugcuaggcucauuucacccuagauuggcuaaagguggcaaguucugccaccaagagaagguuuaauaguuuagauaggugggaaagaaacuaaugaauuuauaugauaaucaaagaaguauguuacauuauugaaggaucaggccuuagaagcauccauccaaaggccaugcaaguauuuuuaggauuguguuucuuacacauuaucauggaggaagaaauaggaaaacaaaguuuguuaaagaugugcaagaagaaacaaaccagaauauaccacuuuuuccugauugguaguguucucccuucacuucuaggccagauggccccagauugauaucacaacaagaggcuugagauccacaauuaauuacggaagcugcggggaagcaaucauagugggcaccucucaaagaaauagaugucagaggaagacaguuugguuagaccuaggauuucagaggacaaacucauuacacugagcauuugcaguacuuaauacauuaaguaauaacaaauaaucagccuuuuuaggagucauggcuucaguggacuuugaauaggcuuugaauauuguccugacauuaaaaaauuugcauauagaaguuuuagaucugauuuaaugcuuguuagguuagucauccaacuguuuccaaaaagacuuuuuaaaauacguaucugcuacuagaaauauuuaguguugauuuagagaaguuuacuaucaggguguuaaauauuuauuugaugccugcggaaugauuagguuaaugaucugagaaggcugcuaugggucguguaucuguuacagaauuccugugauuuuaaaaucacacaaaugcugacuuuugauggcuuuugcccuugguauauagcagguuauuuuuggaaaguuccaaacaauuaaagaauuagagcugauuucaaugaauaaggaaagauggauauauguuguucagguucuguggguugccuacauguuaucuaauuucauuacuagcaggacuccacuuuuguuugagaaguagggaggcuaguggagaggggauugggugagcaaaaguuuuacugauaccuaguuuguaaaaaaacaaaacaaaaacacccaaucuauuuucuaggcucuuuuucagcuuagaguggauguguuccgcaguucuggccaguaaguuggaaguugaaggcuuccugccuucuuugauguucugccacucugauucuuggccgcuaguuuuccggacucugcuuguccugauagcugcagcguugccuugguuuccugugugggaaaccaaggacuuuuucugauuucagcucuguucagaccucuagaaauugccccaguucaggccucucucccucccuuguuuccuagccuuucugauguauauucuauugggcuuggguugguuuuccagaucgugucuuuuccugucugugauguagucugagugcauucccuuugccuuggcaguuuuccacuucaagggcucucauuuacuauucugaaggcggcaugggguaggacuccagaacaaagucagacagaccuggauuugaaucuuauuauacuuaaucucccuguuccucaguuucuugaacuguaaaagaggaugauaguauagcucaggacuuugaugugagaauuaaaugagguaaagcuugugaagcaauuggcccaauaccuguaauguaagcauucaguaccauugaaaugauauguuaaugaugauuaugcuaaaccaacaacaagcauugaauaggauuguuuuuuccuuucuaaagaauaggaaucugagacaguuuauucauaaaguaucagaacuggugccaaaucugcaaaucuaaauguucccugagcaguaaccauguuggucucauucacugcugucucccuaguauuugacauaggcccuggcaugaaggcccuggcacauaauaagaaaaauaguuaacauuuagugagcacuuaauuuguaucaauuuuuucuaagugcuuuacauauauugacucauuuccucccagaggacaagaguagguauuauuaccugcauuuugcaguuaaacucaaacucagagaauuuauguaacuugcacaaggucacacagcucuuagcuggcugagaagaaugccaguagucugguuccagaguuucacugccugucaauaaauauugagaugaacaagggaagaaagggagagaaaaggaagaaacccagguccugaguccuugugcugggcaucaaucgugguaguugugcuguggaauucguuuuuuugcugcuacuuuagcuggggugucagcccugaauggaugacuuuggggagaacugcaaugcccuguuuauucccuggggcuucuguaagggcaguaguaaaggaggggguacgugaauuaccagccauagacaauacaucacuaacagaaugguacuggcuacaggcaauucccaauuuauggacagauuuguuucccaaauuuguaauuucacuguuuggaacucagcaugcuucaccaauaaauagcuaaguuaaccccuagaguaacuggaauaguucuuacggcccggagcccuggagaggcuugggggcuggguggacagaugacuuccuguguggacaggaagccagccgugagggcuugggauggccugaagguuuacuauuuuugagagauucauauaagccaaguuuaaugaguaaguuuucacauuauuggaauggucagcauguaucuguguuagaguacaaagacauuuucaggacauaucuuucuguauguaaccuggaaacaaaacauuuaaaugaaauaaacgaacucaaccaacuguauuucuuaugcuugugauuuuaccauaggaauuaaggaaacaaauuguaucauucuuggccaauaacagagauacucuuccaucccgcccucccuuuuuauuguggcaaacaaacgcauaaagauauuaaaaaagacacacacgacauaaaauucaccuuccuguuuccaaguguauaguacaauauuguccaccacauauacauuguugugcaacagaucucagacccacccauuccccacaugacugaaacccuacauacauuaaacaacaacucucuaccucccacucccugucaggucggccccugacaaccaccauucuacuuucuauuucuuucauuuugaccacuuuagauaccucauaaguagaaucgugcaguggaaucaugucuuuuugugacugguuuauuucucuuagcauaagguccucaguauucgucuaugcuguauaacacaugacaggauuucuuucuuuuuaaaggcugaaugauauucauauauaugccauacccuaguuucuuuauucaucuuuggauggacauuuauguugcuucuuccccuuggcaauugcgaauaaugccgcaaugaacaugaaugugccaauaucucuuugagaucuuguuuuugauucuuuuggauauauacccagaggugggauugcuagaucauguuguaguucuauuguuaguuuucugaggaaacuccauacuguuuuucauagcaguugcacucuuuuacauucuuaccaacagugcacaaggauuccaguuucuccacaucuucacuaacacugauguguguguguguuuaauaguggcuguccuaaugggggugaggugauagcucuuugugguuuugauuugcauuuucuggaugauuacugauguugagcaucuuuuccuaugcgucuuggccauuugcauguuuucuuuggagaaaucucuauucaaauucuuugcucauuuuaaaaucagauuaguuuuuuuguuguuauuggguuguaggaauucuuuauauauucuggauauuaauucuuugucacauacaugguuugaaaauauuuucucccauuuuauagguugccauuucauuuuguuaauuguuuccuuugcuguucagaaguuuuuuuuuuuuguuuuuuuguuuuuuuguuuuuuuguuugugagauggagucuugcucuguugcccaggcuggagugcaguggcgcgaucucggcucacugcaagcuccgccuccuggguucaugccauucuccugccucagccucccgaguagcugggacuacaggcgcccgccaccaugcccggcuaauuuuuuguauuuuuaguagagacgggguuucaucauguuagccaggauggucucgaucuccugaccucgugaucugccugccucggccucccaaagugcugggauuacaggugugagccaccgugcccagcccagaaguuuuaauaaaguuuuauauaguucuacuuuugcuuuuguugccugugcuuuuggugucauagccaauaaguccuugccaaaugcaguguuauaaagcuuuuccccuauguuuucuucuaaaaauuauaguuucaggucuuauguuucagccuuuaauccauuuuaaguaaauuuuuaauauaguguuaaauacaggcccuauuucccucuuuuaugugugguuaucuaguuuucucaauauuauuuguagaagagacuauauuuucacccacuauguagucuuggcacccuuguugaagauaauuugaccauauauuugagguuuauuucugggcucucuguucugucccauuggucuacauaucugucuuuaugccaguaccauacuguuuuaauuacugcagcuuugugauggguuuugaaaucaguaagugugaagucuccagcuuuguucugucucacuguuuuuguucuucuggauucucugagguuacauaugaaauuuagaauuuucuuccuguuuuugcauaacaugccauugggauuuugauagggauuuuaguaacucugagauugcuuuugguacuguggacauuuuaacaauuuuuguuuucuguuuuugcagaauaugccauugggaacauuuuuuuuuucuuuugaaacagagucuugcucugucacccaggcuggagugcaguuguguggucucagcucacugcaaucuuuaccucuuggguucaagcaauucuugugcuucaggcucccaagaaacugggauuacaggugugcagcaccaugcccagcuaauuuuuguauuuuuaguagagaggggguuuugccaugcuggccaggcuggucuugaacuccuaaccucaagcaauucaccugccucagccuccccaagugcuggaauuacaggcgugagccacugcaccuggccaccaguggaauuuugauauagggaucuuaccaacacaggauaucuucucauuuauuuuuaucuuuuuuuuuuuuagcaauguuuuauaguuuuuaguguacaagucuucuacuaccuugguuaaguuuauuacuaaguguuugauucugagaacuaccucuuuaacauuagcuuauagaauugaguucauuuccaaguuuguccuuccacaaugacacucucuuuuucugaaauucagcccuucuuuucccucaccaagaacuacagcuuuuugaauagucaaaacaauguucacaaagccucuugcacuuuacuuguaggaaagugcuguauauccucacuuggaacuuugccuuuaaugucuuucuagccucagcguucuuauuuucucuaguggagaagaucauaugucccuuaugggguuguuugaauauuaaauaagguaauggacacaaagcucugagcauaauucgggaaacauacuaaguguucacuaaauaucuauuauuaaauauuuguuaaaauaccuacuuauauguuuaguggauuuccaaaauuacaguagaguagaugucauaaauuuugaggguaaaaagguuauuaugggaacacacuguagcaacagugggaaguaaccacugauaguguaaucagaagaaagagaacaaaaacuauaaauauaaaagugauaauaacgcaaaaguuauagccauguaguaugggaucaaaagagcuuucugccugucuguaauuucuucuggcugaauaaauuuauaaucaaauauagcaauugauguucauaauggugacuucugagucaucaagaaaagauuaaguuacaugacugugcacuuuauuuaagaaggcaguggaguuggcaguacaauuuagaaagguuuuccuucaaaauaauauguuuuacugcuagcuauacaaacauucaucucuuccaaaaucuuccauaugacugaaauuuugaaguacuggaaaucaugcuaggucuuaacuaugguuauggguuaagaguggugauaucauuaagacacauucuuuuugcucuuugcauggucuuauguuguggaggauucagauuuuuuuaaccccacucagcaaagcagcugaguuaaagggaagaagguacuaaauggccuuugcucugcugauagugucaggcuggauguaaauacaguugacccuugaaccacaugggcuugaacuacacagauccacuuauauguucauuuucuugugccucugccaccucagagacaguaaaaccagcuccucuuccuccuccucagccugcucaacaugaagaccaugaggauaaagaccuuuaugaugaucuacuuccacuaaaugaacaguauuuucucuuccuugugacuuuuuuuuuuuuuuuucugagauggaguuuugcucuuguugcccaggcugcaauucaauggcacgaucuuggcucauugcaaccucugccucccagguucaagcaauucugcuaccucagccucccgaguagcuaggauuacaggcaugcaccaccaugcccggcuaauuuuguauguuaguagagacaggguuucaccauguuggccaggcugaucuccaacucccgaccucaggugaucugccugccucggccucccaaagugcugggauuacaggcaugagccaccuuaugucuuucuuaacauuuucuuuucuuuagcuuuauuguaagaauacaguauauaauacauauauuaaauauguguuaauugacuguuuauguuauugggaagucuucaggucaagaguaagcaauuaguaguuaaauuugggggagucaaaaguuguauauggauuucugacugcauggcggggugugggggucacaccuuuaauccccucauuguucaagugucaacuauacauguuacucuggauggaacauggcuuaguagccuuuggggucucuucccugggggugagugcugccucugguccucccccaucuccugcccugcaugggaggcaauaucauacaugggcuuugagaaucuacuaauuugggaugcuuugggcuuuaaauaacugaaacccaacuuagauuggcuuaaacaauaaagaaauguaugaguucauauaacugcaaguccagaggauucagaguuguuuuuaauccaguaguuucuauucuguugcccuaucacucacuuggcuuugacuuccucuguguuuugguuucucccucaggcugguaguagugagaugucuauggcagugcuggaccucacagcugcacacacuauccaaaggcuuacucuuagaggaaauaaacuccaagaagcucccagcagacauuuccuuauuucucucuggccuguauuuuaucacuuguccauuuuggaaauaaucuuugauacuggagaaggauuaaguggcuuaggccaaguuccuuaacaggucacugccaagaggaugggauuaucaugauuggcucagacaaaucaugauucauuucgagaccuggggucaagacaccucaaucauaauggcuacugcacuguuagguagauggauguaggcuugugcacaccugcuauauagugaguccuggggaaggauuucaggaguggcccuggaagguagacuuggggcaguuugggcagggaauucugugcuaaaaagaacauauuuagaagggaaggugcagucucuuuguacauccccuugguuuuauagacaacuuucccuguggggaggaguuuggccaggaguggaccccauucuggccucucaaaagucagagcccaaggcaaacguuuaucuuucugguguaagagcaguuccaaugagcuguaagaccacuggcaagugacaauuccccuacaauucauuuuucuuuuguaaaggaggagcaaucccaguuauauccaguuuaucauguugugagguugaggugauauaugcagaguauucaauaaaugcuagcugcuuuuauuguucuugaguacuugguacacaguuguucccuggcucugucacucccugaugagaaaaccuuggcaaaucacuugaccuccucagacuucaguuccucaucuguaaaauauggacgugauggugguaccucagagcuguugguacuguagugggagggaacacguaagacacaaaguccacccucuguaguugucuuugcugucaggaaaccucaguuucugagaugagauagcgauucugggcuacugcuguccuucauaauuuuuuagggaaaauuuuccagguaaaaucuuccucugacuagaaaauuuguucauauuuuauagaaagucagcuuacuaacccagaaagaaauucuugacaaguuaucccuucuucuuuuuuguuuuucguuuuuccuauuucaaaauauugccuucaugucccacuacucaaggcaaucugacaaaguuggucuggcuuuuccuaggcuuuacuucaccaaaacuauccccgcaccaaugauuaacaggugacuauggcauuagaggcuggaaaaccaucaauggugaaaacacccccauguggugugguaauuaggguacugauuuucuuuaaaaaggccgugucugaauuggguccccagcuaaccaaagaucagaacuacagaggauuguauuaauaagaaaaaucuggguuggccuuucuuguguuucuuuuuaacagagcuguuaaugauaagugguugcuuauuuggcccaacauauuguuacgauauuaaaaaagaagaaauuguuuauuagugccauugaguaagucacuaugccugccuuuuauauuugauaacaagcaauuucagaaauaucuggaauauguggagauaaugaaauuauugugcuggggaaaaauuagcucucaaagcagaggcaugggguccuacacgcaugugcacacacauaaagcccaucagccaagaugugaguguuauguaauauuuguguccuuuggugaacaauuuuuguuuaaucauagaaauaacagauauuuuuauaguacacagagggauggggacugagugucuuggaacugauuugggaauaauguacauuuaaacaaauuugagcuguaauuugaaauccuuuaaacugcuagguaauguugaauuucccauaggcuuugaauuugaauguaaauucuagaauuuguuccauaaugaaggaaaaaaugugcauuuaauuaagaaaacaucauuuacaauguggcggcuguguugcuguaauacuuguaaugaaugcaaggaaagguagauaauaaaagaaauaagaugcugucuucacuucagucuuuccucuuaaaccugugccuguacuaauuuauauuagucuaauacaaaguuauuuuuaagugguaauuagaaaacucucuuuugcuuuguucuagguggguuuuaugguuguuuuugaguuaaaaaaacaaaaccugaauuuaaacgaggacuuucuucauuuuuuccccucuccccuaaguauuuuuuuuucuauauccuagauauggguaaauaagugucucuuucagauagaauggaaaguucaggcuugcugucauggauaacaaagccaugaauguuguaggaugcuacuaaauaauaucccuacaucucuuacagagugucagauggaacuuugauuaaaaagugacaagauguaacaucuccaaacaguucaaguuuuaaaauagaacaaaucagucauaaauagaaggauuauugauuaacuucuuauaacugauucugaucauuaguugguuuuccuaaauagaaaacaucuguagaacaaaugaguagcacuguuaauuaagugggaugaggauuaauuaagugggacaaggaguaagugggggugagauuuggucaccauggugcaagguggaaaaugucuacuuggccccuaagagggggccauacguguacgucagacuauuuuaaagcuaguccuuugggagagagauuaggguuuacccuuuugcccucuucucuggcuucugugggucucuuuagacauuguuuacaccgagggucaucuuucuggaagaugcaugggacaugcugauuaaugagucacggaagcaaucagccuuauaauacuguguguuauuggcaagagaccacauauuuuccugagguacaagaacaacgucaagaaugaaauaaauuagcuuaugcuuauguagaggaguuuccgcuucuacaaaacuagucucuuaauauugagaaauaggauaggaagauuucaggaccuuuauuccaccuguccugaggguaagauuuuaagacuuucucuguaccaaagaaaaaggacucuugggucuuggucauguuauuguuuuaauaagcacugucacuauagucacucaaugagaaaugucaccguauucauuucuguauguugagagaucagauaccuucugaaacuuacuuguugauggaauaagauauaauuuacacuaaaauacuucacagaauauauggaaaacauguaugguaucuuaggaugaaaagucuuuugaauuuuccuuagcuagcugaugauuuugaacucaagguuaguuugucuggaagcaugauauauuuaucuguaaaaaagaaacuuucaggaaauugugucugaaaagaguguuaaagaccucaauaucucuauuuagaguuuaaaaauacaacuuaacuuuuaauuuaaccacuuuuagucaaugcucuuaaagugcccauuccauaaaucacccuaucguuugccaaauaguugccauuuauagaucaauaaaaguccgaagagguuaagugacguucaaguaacacagcaaguggcaggaucaggaaaagguuugaggcuuuuaauuucuagucuuuuagcucugagacaauuagcugguucugcucugagaucagcacuauccaauuuaaauggaguccucaggugugcuuuuaaaagagacaaaaagagacaguugucuggccuggaugacucugugcacuuuuuuguuuuuugaauaaugcuuauuauagaaaaugucugauuuagcaaaacuguuuauaucacucuuuaagaagaaaugugaaagucauccgaggaaaggcugaauggaacacaucugaaaaauguaaaaaguugauuuuuugaaugagagaaaaaauguaaaagauaaaaacaggcuucuuuuaguauuuuugagaauaaaguuuucagaacagcaucccaauguaccuguuuguucauuuguuccauagauuucuucuuugagaguauaugguaucaguauauauaauuagacuuucauuuaaauuucuaguccauuuguggauuaccuuaccacuuuggggaguguuuauauuaacuauucugugccaguuuuucuuugcggaaaaucuuucucugcuuuuugcuaaaauaaguaacaaacaagaagcuaaagauuauagcuaauggucuagaacaaaggauuagaauccaauucuggcagaagccaaaugaguuacagugaauuuggcacaggguguaaaaggaacuagucucuguuaauuguauguuccuguuuguaaacagguguuugcccaaggggaguacacugcacuucuuuucaaauguuauggaagagugauucacuggaauaggugaacauuucucaguuucacaccccgaauacauuaugacaauucuuuuaguacucugggcucagugaguuuuauuaguagcagaaaagaugggauuccagaaacuguagcacccuccuuauuugguguuucugaguuuaacuggcaggcuguuguccuugucuuuaauuaaauuacuucucaaccaagugucuuugaaggacagcuuuugugaaaugugucaaacacuagggcuuuuuucuuuucugccaugaggcuuguuggcagcagugggaaugaaguuaggggaucaggaguacaguguuaaaccaguuauuaaaagggccuuauugccaauuacugaagaggaaagaagaaaauaaacacucaagaagacaaaacgaacuccuuuccauugagaucccucuucccuuugcuuguucuuuaacgccagccagaaucuugcgguauuguucugcuuguuuuaacuaucauguuuuauuuugcucagcauuuuggaaauuucucuagagcugugguucucaauugggagugggaugaucgagacuccgggacauuuggcaaagucugggggcauuuuugauuguaacagcuggggagaagggagaggauaccauuggcaucuaguaaguagaggccagugauguugcuaaacuuccuacagagggcagagcagcccucacagcaaacaaguauccagcccaaaauguccacagggcugagguugagaagcucugcucuauaggaagaaauuaaaaggcauuuaaaagaaguggcccgucucuacaaauucauagccaguuugugcaagcagauauucaaaauaucucauuucagugccuuugcacugaaaaugaguuuuuguuuugagcacuuccuuacucucuggcacuacaugcugcuccagguuugucuuauauaucucuugcccccugcuggaaucagccauuucuccaaggagcccuggucuuuuuauugaagaaaccaagaucugggcauuaggugugcuuauuggcacuuaguuuuuuaaacuccaaaaucuaagcuuaauuuguuaaugagaccaguuuuuaaaacuuggucuuuaccauauauuauauaaguguacuuuaaaaauucuuuucuuauguuugagcuuacauggaacauucuaauuacccaaguaauauugaaauucaaaaugaaucuuuauaaguuaaaugaaaccugcaauaacauggauuguaaaauguauugcuuuuauaauauacugaugguguuugagacuacuguuacuuuaaagcgacuuuguuauuguacacuuuuuaccauauguaguuuuauuuaguuuuauuucauagccuccuacagcugaaaggcacuuaauccugccuugucuacaaaucgauaauuuguucugaagugugugaaaaucugcauaaugaugaaccuggcuaaaagaguucuauugugauuuacguuaaacugauaguccuucauuuggguaauguucauaucucuguagaaauuuaagguuuaaauucuccuaagauaguuucuggaauuucuuggcuuuaucuuuaacugcuuuguuuauuucaaaaacugucuucuaugcccauaauugauugacguaaccugucaggguuuucucuuuaaguagcauuguugauuuuuaaaccauuuuagguacaagggaaaauaauuuugauuuuaaaaugaauauuuucucuuauuaaauauuuuuuauguacugaaaaacucuuaagauuuagacaaaauuuuauguuuuaucacacuuaaauagacauauaaagaaaaauacaagcaaaauaauuuguucaagguauucuuaauuuuuuuuucacauucagagucuauuugggaucacuuuuaaacauagaauugucaaugucuguauuuuuccaaacauuacuguccucuauaucaucagaaguuuuggugauguagcauuuaaaaaaauaauuugagaugaaauucacaugacauaaaauugaucauuuuaaagcgaagaauucauugacauuuaaugcauucacaauguuguaugaucucuacaccuaucuaguucuaaaccauuuccaucacuccaaaguaaaacgccuuacccaauaagcaguuucuuucauuaacccauuucccuagacccuggcaacuaccagucugaguucucucucuauggauuuaucuuuucuggauauuucauauaauuggaauuauacaauaugugaucuuugcaucugacuucuuuuacuuagcauaaugugcugaagguuuauccacuuuguagcauguagcaguacuuuauuccuuuuuauggcuguauaauaguccauuauguggcuguaccaugcuuuguuuuuccacucauuuauugauggauauuugggcuauuuccaccuuuugguuauugugaauagagcugcuaugaacauguguguauguguuugaguaccuguauucaguucuuuuggguauauaccuagaaguaggguugugggaucauaugguaauucuauguuuaacuuuuugaggaacagccaaguggucuuccacagcaguggaaugauuuuuaaaagcuauuccuaacuuuauguucauuaucaaaaucaaaaugcucaauuuggaaacauacuuuccucaaugcuuugauuuuuguuauuaaaaauagauuauucuuuaacauauccaccacuuuuuccaaaguuacuuaaaaaaaaaaaacuuuggauaauuuccauauucaucucaggagaguuuguaagacucucagaaaaagauuccaggcuuuuaauuucuagucuuccgcucuaagacaacuagcucuucccuaagauagcagaagucaauuuaaauguucgggcacaguaucuauuuuccauaugacuucaugaaaaugaaacaaaaauuaaaaaauuaggcugaguguucaauaacacuuuauuuauggaguuaauaaauauuuacucugaaugggaagaaaagagaucugcauuugacaguuaccuaugaaauagaauuaauuuuuuucuucuuugucauguugcugggguuuuugaagauuugccuaaaaagauagucuuuuaguuuggacccuuuuaacuucacaugacauaucucauuaccaaguacauucagaaauaguguuugaauucugcaguuuuuaauuuuagcaaccagcagucaguuuguauugcuuucuaagugcuggugaagcuaauucuucccauaucuaaggucguuuuaauuucauuucuuuauuugacaucuuuaugauauucaaacaugaagauguauaguuuuuuuguaggguaggaacacuagguuaauuauuaaauaauaaacuaaaucaaaaucuaaaaccuugacucuaguuugauuacacaagaauguuuuauugggauaauacuuguuccuuguuagcuucuccuauuaugaaauguucuccuuguguuaaacauauaaaauauuccaaauuuggaucauuagccaugacugucuuuuguaucccagauauauuuacauuugaaguuggucaggcuuuccuuguaaucauuucauugauugaggaaauauguaaaguuuuuuugacaagaaauauaaugucaguuuguaaaugcaguaauauaguugagacguggcauuggaagauggcacagaguaaauuuaacucuuaaguugccacaauuauuagauaucagaaauguucccccaugaauggcugcauauuucugaaaacacucuagggugacuguaaaaaauauuacaguagauugacuuggaaaaucacaguagcugaauuugaaacuguaaacguuccuaauguauguaguucacauuauuucuggcagugacagaaaaaguggugguaaguucuacuugcgguuaaaugaaguuuaaaaaaaugaacuuaggcacaugcuuauggaaaauauuuaaauauucugaguggguucuuccaaaccuacuccauacaaaugagggauauuacucagaauaagucaaauucagguuacccaggaagggcaaaaggacacauguuggaugggcagcucuuuuugcaaaaugagaguggucuucucaagaagcagucaugaagccauacucuguccacuuuuuaaaaaauggauauuuaaaguuaggaaauauuuaaaggaaaccugagugaguagauuaacuacaaucacuuugcacguuaaacauuuuaggacuuaggacaguagggacaagcuaggagaaaaugggugaaugggugaaauaagggugugugcucagcuaaauagaucuggggaggccuggagggucugccuaaaaaguaauagaccuguaguuugaugagauuugccaagacuuuuuaaagggagugguauucccaggcucucuuuguauuuaguuaucacugccagaggauugaggcuauugugcagcugaacagacagacaauugacaaaaccaaaccaaaauccuugcuuagcgucacguagaccaaaacacagacaggcaacagcuuagauuuuccuuuuguaaccaauugugcuggcauuguguaugcagaagugaaauagcaaagggaguuucuacauuaacuuuuugauagggggaaugccugcaucuugcucuguagauccaguuucaguuaggaaacuugugaaagaaaaaaaaaauaguugucuuguuuagauuagugggagaaaugggucccaaaauauuuccuuguuacaaugaucccuuccagucuuaaaaauucugugauucuggacugugaguuuauacaguaucucugugagccaggaugugcuuuuacacuucucuuagucucuuauuuuugucugaaauaaagcuaaucagauuccucuacacuggaacaaguuucagcuaguacaaucggguuuauagcaaccagauuguaaacaaaauuuuaaaaucauguuuuuuaaguauuuuagacaguuaagcuauucuguuuuccaaagcagaagagaaugagacccaccaaauauuaaacaaauguaaaguuccuacauucacuuauggaaauauuaaacuuaaaauuuaaauuugaucuccuaucaacccaccccuuucugaaauucugaguugacauuuauguuuuauguggguauaugaaaacuuuaaaauaauguaauauuuuucuggauguauccauugccuguuguucagugagguagacaaaucuuacaguauaauguccuuaaguauuuuuagaugugcuaauuuuaaaauacaguguauuuugugcuuuuaaauggcaauucuaaauuuuuuguuaaguuaaaaucauacaucauuuauaauauauccaaauuuguguaaugcuuacugaaauucauuuuauaaauuugacugucugguuugguuaauaggauugcuuaaaaugcuaauauacuugaaaaacauuagcuuuauuuaacuaaagacagacauuaucagaaaagcuaggucaagauaaaacaaacaugagccuuacgaaaaugagggaacuauuuuuugguaaccugggguaauuuuaaaaacuaaggguuguagaucagaagauuugggauuuccugguuuucuacuuacucccuggcuuuauuuucucuucuguaaaauaggaguaauaucucuuuucuucacaguagacagaaugagaauaauaaauauguaauggauaugaaacuggaaaacuucuuuacaauuauguaaagacuuuuggggagggagugaggacuaguuugcuuuaaacuucaguuuuucaccagaauuuuuaaaggucuccauuuagaugauccaaaugaaaauguaauaacaucuguucaauaauuuuuuuccuacuggaguauaggaagauacacugauuuuuucagauuguucuguuagguuguaaauaaaaagugcuagugauuucauucucaguuuuuauauuauauauuuaauuaauauuugauauuauaaagcacauuuaucaguuaauuuuauuauauucucaugagucuauuacauaacuauuauuauaaugaacauuuuacagaugaggaaaucgagacuuagaaacacuuccuuuuaaauuuaauuuaauuuugagauaaggucuuccacugucacccaggcuggaguacaguggugucaucauggcucacugcagccuugauauccugggcucaaucgauucucucaucucagcuucccgaguagcugggacuacagacgcgugccaccaucauucuuuuuaacuauuuacuguuuuuucugccaaccccaggugcuacugaugguacgucaguuaaucagauauuauaauuuaauugcugauuauguuguucuuuaauaauuuuguugguucuuccauaaaagccagaguuccuguacgugucucaguuguuuugcagcauguagagaugggaucugugguaauuccuguuaauuuugcuuuggagguaauacuuuuuuggugcuagaaagcuagugucuguaaggaaaaaaaaaaacaugauuuauucuuuuuuuuuuucagcuuccucucauuaaugcuuucaugaggcauauuuauuuuaugaucguguaaaauuucccaaugcagaucucuucuugggguggaguugugguggguggggcacugugaacugcacaccugcagaggaaugccagcaggggaaacaugaauguuauuuugcccaaaguacuuuaguuaauacagugaaggauuguuccuucuuuggcaguuucuuauauuaaaaagauaaaaugaacacucuauaaauauuaacggauuucagugcacucuuauucucucaaaagugucugguuuugaauuauaaaucccuuucugugaccuaucuggguuugaauccugucucucaccuauuaguuguauguccuuggacauguuacugccuauaucucaguuuucucaucuguaaaguguggugacaauagccucauuuuguaagguuauuguauggauugaguuaauacauauggauacauguuuacuuagaacagugcauggcacauacuaaaugcucaauaaaugucagcugcuaucacuauauauuauuauuuucuugcuuuguugcugacaguuaacuggacuauuaacuugaaaaaauacccuuucuagcaauaaaaaggauuucauuucuuacuauauuugaugaacuauaaaaaugaaucaaguugauauaaaucaaggaagaucauuuaacuagcaguagugguagucuuugucccccagcuuuauugaaguguaccugacaaauaaaaguuguauauauuuaaaguauauaacauuuuuugagagagagauauauauauauauacacacauugugaaaugguuaccaccaucaaacuaguuaacauaugcaucaacucacaguuagauuuuuuuguguguaguggaaaacuuaagaucaacucucuuagcaaauuucaagcguacaauacaguauuauuaacuauagucaccaugcuguacauuagauguucagaacuuauucauccuccaugaauaagugcuaaacuuuuguacucuuugaccaacauucucucacuucccccaccuuccagcccuugacaaccaccauucuacuuuggcuucuuuagauucugcauauaugugaggucaugcaguauuugucuuucugggcccgcccgguuuauuucacuuaacauaagauccucugaguuuauccacguucuugcaaauggcagggcuaacuucuuuaaagcugaauaauaaucuuuuguguauguguguguauauauauguguguguguuuacauaccauuuauucuuuauucauucaucugucugcagacacuucgguuguuuccauaucuuggcuggaguaaugauagucuugaaaaacaccaauuaauuacugaguggaagaguaagaaucaugacaucacauuucagauccuuaaaagucagaaaaacacuggaaaaaaagaaggauaaauggcaguugaagagucauuuuguaaccaguaaagaauaggacaaugccaaguguugauaagucagaggcggauacagagggaaguccaguggcauguauuugaccaagggacuuugucacaagcauggguuuauuagaggcucugccucaguguggaaaucuuggagggagagagugguauacacagaggucaagggugagccgguuucugauguagcuucccaaguaucaggaccccuuccucccacaauacacauucauucauauucauucauucauucauucauucucucucucucucucucucuuaugacaaccaaacuccuuacuaugacaacugaauaacaaacauucaaggacuguugaucuuuaaagagaauauggguuaccuuuucagugggggcggaggcugugauuaaagauggucugaagacauuuauugcacccauccuuagagauggggacuugauucuggggggaaacauugcauguaguaucucuagguugucugcuugcucaguuacugauauuaccaaaacaucucuuuuaguucuaguuuguuuacuagacccagaaugacaugcuauauccuuguuuguuuauaucaccuuccagcucuauuuaaaaccauuagagaucccagacccuguguuaucuccaucgauuuucuaugaggcuagacaagauuuaacuuuaauucauuugugauuuccuauuccuaguuuacacaaauaagucuguuaguucauuuguauauuuuuugcacuuugaccuaauuggccuguuuuucgcuaaugcccucuccuuuuucacuaauucaccagugcugugggaaccccccaacuccgccaccuccacuauuguaguuguuuuauaacuacucuuuauauaauguguuaaucuucuguccuuaccuaaggacacaaauugcacauaacauuagaucauccuuaggugguagaaauuaaauugagaaucagaauuagcagugaaaaaaauagauauuucuuguacugaaagauaauaaaugauauggaucuuuuaguguguagaaauucuaacagauucugaguaguuggggugccuaggugaaacacuggugaggagaaaaugugacacuuuuuguucaugugggggaggaagcaagugauaagagaaaucaacacagugcugaagcugaaaucuaaauauggaguuaauucacugaguuggccuggacccuggcagaagaucacauggucaccuuuaagauaauuuuguucaucacuuugcugauaauugauccagccugccaugugcucugugaucuaaaaguugaagugauuauuuauuuuuuagggaaaaauuuagcuacuggaagauauauauguucuuuuacucuaguguucuagaaaauaguaggaggaagaagaugaaaagagagagaucggggguagauaaaauagcuagguaaaguagugaggaagaagacucuccuagaauuaaugaaggccguguggacacagugagucaaaucaaguugucucaagcccaaauauuuuucaauacuuauuagaaaacuguucuaauggcuucauuuuauauucugcaaugaaggcugacccuauuacacagugauaagugcuugaguccuucauuucugaucugcauucagagaccacucuguuuuuauuaauauagaauaauuguacauauuuaugggauacaugugauauuuugauacauguauacaauguauuaaugaucaaaccaggguaauugggguauccaucaucucaaauauuuaucauuucuuuguguugaaaacauuugaaaucuucuagcuaucuugaaauauauaacaaacuauaaucauccuacugugcuaucaagcacuagaauguauuccuucuaacuuauuuuuguucccguuaaccaaccucucugccugcccugcuccccacuaugcuuuccagccucugauaaccaucauucuacucucuaccuccaucagaucaacuuuuuuaguucccacauaugaaugagaacaugcaauguuugucuuucugugccuggcuuauuucaauuuaauguccccccagccucagcuaugcugcugcaaaugacagaauuucauucuuuuuugugacugaauaguauuucauuguguauauauaucauauuuucuuuauccauucauccauugguggacacuuagguugguuccauauuuuggcucuugugaauagugcugcuuuaaacaggcauacagauuucucuucaaucuacugauuccuuuuuuuuuuuuuugugagagacuacuuuuuugagaagucaucugcucuuuuggagguuuuauuaauaaccacuuuuacaguagaguagauugacugugcauugguaaguagugucagacuggucaucaccccauucaguauauuggucgaaucugagggagaauaaagagacugaggaaugcauuguuugccaaaccacuuuagcccagaauggaugaguaguauaucuguaccaagugcaaugagauaaaagauuguccaugucugggaugccauaaauuguagcccaugaugucuuuucccccuaucuaggaagaaaagacccaugaaguagucaguaaaaucagugugcacagauaucucuauauuuggacaaugaguucauggacuuuauagccauuuucuucauccacaucaauuuuauuuggcuaaauaucuguggaauauacuguaauauuacaaaguccuaucuuucuguagacaggagggauaucauuacuaaauaagauggaaaaugguauagaaauugauaaggaguaggggaagauauuuuuuaacuaagaugcagaaugaaaugguugacgaagugggaaaauaucuggaggguuaaaugaacugcaacaaugcaauaucuauuugaaaugcuuuuuaguuuugcaaaacuaagcaaagccaaaaaaguaacuuuuuugcaucaagcaccucaccccacaacuuucccagcuguuaaaaaaagaggagaacaaagaaaagaaagaaaaagaaagcugccuggcccuuuuugguuccagaaagcauguaaaccugguuuguaacucaaagcgcccuaggguguuuucuuugcuuccacuuuaccucaugauaugaccuugaacaaaccagcuggcucuguugucuugauuuucuuaaaauaauaucuucuuuuucucuagaguauauacuuaugagcacauuuaaguuuucuuuauuuuaauuacuauaacuauuaauagcagauguugcuguguuaaauugaauuuguucugagaaagccuuuguugggcuuggaacuagaauguaagcucuucgaggguagaggccaugucuugcucaucuuuggaauugaggacuuacuacaaugccuggggucauggcagguccucaagaagugcuuauuguacuaaauccaacugugguacuacuuugccuuuucauaacaauauagaauuacaagaauauuuuuuccagauuuuuacauuuauuuucauauuaguuuccuagauuuuuguaaacauugaacaccagcauucuuuuuuuuucucagauaaaaugauuugauacaggucacucaauuauaggggaagcuagaaucuagguuuuuuauuuuuuaaaaaaaucacuucuggaccuucuaaaauauauauuuuuuucuauugcuauucagcuucucucccuaaucuucuaacguagauuccauuucuaccccuucacuuuuuuaccaccccuauuuauuguucucuuguagauuauccuccaauuuuccgugaaaauagcaagcuuuguuccucuauugauauguacgaugccaacgaucagugaugaauucucuauuuucaaagcuguacuggauuuauaucuuagcauaauagacuuuagaagaugcaaagccagggaggcagaaaauacuuagugccugcucaccguggguuauaauauacuaccucuggaggauuuaaaguccacuguagaagaacaaucacacacaaguucacaaagcaacacaugaauaauguaagagaauccuugggccagcuguguucuguggagaccugggcagcuaaauggacauccugaaggacacucauucagggggguguccugggguuagaggauagaugaugaguuuugaguaggcuuuucaaaagaugggagggauagaaaacggcugagaaauagauacugcugauacauaguagauucuauaaugccaucgugccacauacugauacagguucauuuuccugcggauuauucauuaaccagucuucaaugugacaucuucacauguggaauaaucugacacuuuuagcugguaucacuaaaaaguauguuuuccuucagcaucaacuuggguaacucuugguuguuccaguggcuaguuaucuaauugcugacuuauccaagcuguuucuccuguuucauccuccuuuuacuugauuuuuaaauguacagucauagugggaugggggaagaaaugcugcaagugauggucuuucauuuauucuaaaauuguuaccuauuuguuuguaaagaaguuggugaaguuuaaaaagaguuggccaaaaugagauguuggaauugauuuuggcuuuaucauucauuaguauuucuugucuuagcauaaaaaauggcaaguuggcuguucauagagucagaguaucauuagaacucccugaggcugggguuugugacuuguaucccuugcuacacguauaguccauaguaggugcucauaacugcagguggaacaacaguaugacuagaccuagaagggagcuuagaaaugcagaaacuaagaucuagaagggcauucucauuagugacagaagcaggacugaucccaggucuccuuagcuguccacugugcuuuccaccacaccacauugccagaggcaauggcaguguuagcuguauagagcccaacagccacgcuggagacugugcccagggacaguaaaucagaggcagcugggcaacagaggguucuugccaaauuuguaaagguugguugucagcaaaccagagcaacagaaccauuuuugaaaauuuccauuuaaaguggaauuuucaaaaccaugaacugccaccaggucacugaaguugauuuuaugggaagccaggguuccgcacagcugguagagcagacugguaaugguggcucaggcugaggauuucuucaggccagauugccucugaccacaagugccuaaaauuacucacuagggauuguucuccuagucauuucuuagggcaaaaaaaaccccacuuuccucuuaggaccuuuugacugacagagaaacuucuagaggaacauuuauucaucuaaucuuucuguaggcucugacugagaacuagcgaaguaagccagaggguguaggagugauugcucaaggauaaauagugacucuugcagagaaaugauauuuuuauuucuucagaggcaauaggcauaucuaaagcacugugaagauguccagguaaguuuauuaaguucugagggaaaagaaguagaugaggagcaaaugagaaucuuggauaaaggccuagaccuugaucauggaggauuuuauuuguuuuuugauauuauaguggauaauagcaaagcaaaauucauaaggaggaucauuuuccagaaaaauauguagcacugauuucuuaugcaauacuugagaaaauaucucucagagaagauucuguaucuaauucuaguaaaugggccaaauguaauaaguaagcuugaagccgggugacugcucagaucuaauuagaugagggcaugaugguagauaacauggagguuagguaguguuuauagacaggcugucccuagcaggccuggcauuaguuaacugcuugagagauucuuuagcaaagagguaauuguagaauacaucgacaagcagaguuuauaguugaaauuaauggcauauuuaauuguguaagcuauuugggccaaauggcuucuuuuuaucuuguaguucuuggauccuaacauacgguagcauuacccccacucucucaaccacccuuacuuuuuuccuguagugaacacguauacuuuauuguuuguggaacuugccacaugauaaacauugucaacagugucagugaccauaaucacagaacaaauugcuuuuccacuuggucaaauauguaauaaaaugauucaucccaagaacucuucuucauggugacuuggcuggguauugaucuaguuccuggauccaaccucuaccuuaccucaggcccuaaguugaccaggugggcccuggauggcccugccgagcuccagcucugggauggauucuucuuugaacuugggaagauuuugucauucaugaaauuggaaccauccuuggaauguuaguuuugaaagauuaugucuuccccuaccaguuagaaauuaaugaagauaaaucuccaagugcgaugaacuuuuaggaagaauaguauuuugaaaaacaaaaauguugccuacagacuaaaguauuuuaaauaauaucauucaaauuaauuggcuguacaaguaucugcaugcaacaauucccccucccucaccccacccccucacccccccgccccgaggcagagucuugcucugucacccgggcuggaguguaguggcacaaucuuggcucacugcaacuuccgccuccuggguucaagcaguucuccugccucagccucccaacuagcugggauuacagggacccgacaccacacccagcuaauuuuuguauuuuuaguagagacggaguuucaccauguuggccaggcuggucucgaauuccugaccucaugguccgccuuccuuggccucccaaagugcugcugggauuacaggcuugagcuaccacgcucagccaacauuuuaauaaauacuaguuuuucacacagcagcuuauaaaaucauuguauuugcaugguaaauuacaguuuccauaauauuuucauacucuugacuuugauucuaacuagauuaucugucucuccucugcauuuccauaaaacucuacaaacuucuaugcuauguuuccuugucuuacaauucucuguguauauuuaucacuuuccccaccagacauaagcugcucaaaggcagggaaucauaucuuauuuauuuuuuugucucuagaaccuaguccaaugccagguucauuuuauauuaugauguugcauuguauacuacguaaauauaugcugggcuguauucuguggaaaaugagguuguuuacacuuugaagauuuuaaauaucuauuuggauuuguuauaucacaaauucaaaugauuaaaauccaaauuguggucucuuuaguugcuguugauuucuuggagaaaaugauuucaaguauacugagcuugugcuguguguucccuguggugaaccuuugauuauauuucugccauguggccuguuaguuuaaauugcucugguuacaaugcaagaagaaguaguuacucuucacuguuguuggggggaaauuuaauuugcuucaaaccagaauuguuuuacuuuaacauuuguauggauuauggauccaaacauacauacacuaaaacagacuuaaggcaauuaaaaacuucugugguuauuuggauucagcuuccccgacuugucuucuuauccagucuuuuugccccuuaacuuuaauuuuuuucuuauuacucaaguaauacagcuucacuaugggaaaaauuuuuaacauauaaauaucagguucuuuccaugucucacuuuucuuaucuuuggaauauuguuuuugcuuuaaccuggcuuuccuuguaauugcgagauggcugcugcaguucuaguaucacauccagaugauguaauauccagaggaaaaaggaguacaucucuuucugucuaugcuccuuagaaauaccuuagaaauaaggaaugcuggcugggcgugauggcucacuccuguaaucgcagcacuuugggaggcugaggcaggugguucacgaggucagaaguugaagaccagccuggucaagauggugaaaucccauuucuacuaaaaauacaaaaauuagcugggugugguggcaggcaucuauaaucccaguuacuugggaggcugaggcagagaauugcuugaaccugggagguggagguugcagugagcugagauugcgccauugcacuccagccuggugacagugagacuccgucucaaacaaacaaacaaaaaggaaugcuuucccuaaugucccaucuucauguccagcaacauuugucuuccauccuauugauccuaauagucuuugccuuccuaagcaauccauuccuaaaccaauaacuggcaagaaaaauaagauuaccaugauuggcucuagggguuggcaaacuuuuucuuaaagggcaagacaguaaauauuuuaugcuuugcagucuaucuggucucuguugcaacuauucaacucugcuguaauagcaacaauagacaauaaauaaauaaauaaauaaauggauguggcuguauuuuuguaaaacuuaauuuacagaagcaggugguaagcccaugggccauaguuugcuaaccccuggaaccuuagaccaguaacucugaaacauuagcauuuguuagaaucaacuggggacuuguuaaaauacaagaucccauccugguugcugguucagcauauuugggauagagccagugaauuugcauuucuaauaauuucccagguaaugcugaggcugugaauucaagaaccucacuuaaauauauuucucuauuguggggcuauccugugcauuguaggauguuucacagcaucccuggccucuacccacuagaugccaguagccacccugccucuccucuaguaugacgagaaaaaaaaaaaaguuugaaauauugccagauguucccaaauguucccuaggggacaaacucucugauuucucccucucccuuagacauagacuuuucagauauauucccugggucugggaagagguucacuuuuccuuguagcauuuggggaaggaguguauacaaaaucacuaugauguaaagaaagagcgagaggaaugauuguuggacaggcaaccagcagugucuacugacaaucacaucauaauuccugagaacaaaagacuucacugccaaaauguuccagaaaauggaacaagaauacccaccugcuaacauuuucugagacuagaaucuaaucgcaaaauugaagaaaguuuagagucuggugcaauaaauacagagaggcggucaauugauaaguaaaauauccuaucagguaaagcuucaguuaaaggugacaucuguauuugggucuuuuagaauguuuuucaugcaaagguaguaaaauaauuuuuuuacaaaauuuauaacauuuuguaaaauucuguuagucuuucaaaaagaacauuaauagaauacaauugguuuucuauuuuacauaagugaaauaugacaaaucuggugaauuuauggacuuuuuuuuuggcuuagggagguuuuaaaucuuggauaguguuggauuccacuuggacuauuuauauggguaauaaagccaugguggaaaccugugcaguuacucugagccauuccucacccuucuuuggcucugcucuauaucuuagagggaugcaggcauuucucaggauccacgucagcugggaggcacugggaggagacuccagggcaguaggaauuuugaagucgguguugcuccauugcccugucugccuugggcagcaucuuggccauggcugcauuuccuccuuggcuccaaccaccuuuaaacaaaccuggaccccugggcugugauagcuuugucuccucccaguaucccuccagccugagggggugguauuggcuuccugcuguugcuaaucucuaaauuagcccaucauccaucccgucuuacuucucagcucccucauuaccuacuaaacuccacaucaaagucccucaauuguacauacucaaaaugguuuguuuucuugauuaaacucaugcugaugugaaacugucaaccccaacugucuugucauauaaaccuaaaagauuucuaucuuguuaagagauguuguuuuuaaaauaaaguguaaauuaaguauguauauagauugucaguaguaauuuauauuguaauauauaucuugauggcuugauaucagauaucuuguuagugucugauuccuauaaacauaaaaagaaguuuaaaaguugguaaauuauuucaccuggggaccuauuauagccuagugacaaagaacacuaguucugaagcugaacugcccagguucaagugggcccuuccacuuacuagccuuguggccuugagcaaaagaucuaacuucuuuguaccucagauuucucauccauaagauggugauaauaaagguaacuauuaggucucaaagugauuguugggaagauuaagggaauaauacacuaaaugcacuuugagaaguaauuggcauaucauaaguacccaauaaauauuagccaucaucgucaucauuguuguuacccuuauauucuagccauaacugauugagccaggcagucacuuugaagaacuauagccccuaaaaaugaguuuucuauaggaaauaagggugaaaauguacgucaaagagaaaaguccauuugaauguauccucccccaaacacuucuuuuuuccuucuaguuuguuuacugugcaucuggcuacuucaaagcauacauaaauuaacacagagaugcauaccuuaauaucucauaauagagguuauuauuuuuuuuaaagcuugugugaauguaaggacuucaauuuuaagagaauaaggaaggcucucccaaucacauggauuugauuagccaguggcaaguacuggcucagcuagaacuuuuagaaguucagaauuagaaguucaguucugacuuaacuuuccuacuaguuguucuucaguguccugaagcaccacgauuaaguaaguauagcauuagguuguucaccauagauauauuauugaccauaggcauuuaaucauggaauagacgcagugagcuucuagaagggguuaacuaauucauuaaaauaugugugcugaccacuaguuguguggugccauuagguggaauagccaucagaaauggggaagaaguaucauuugaaacuuuuggguugugucaucuuuuguuugguauuguuuguuggguuuuuuggaagaagugaaagguuuucagagagaaaugaaaagccagaaaguguuaaauaugacuuacugagaggguuaggacauauaaagggaaggaaauuguaugucucuugcuacaaggaaguagguaguuuuucuugacucugcuagaaauuccagaucugugaaauaauaaugguugugggccauuaaauaugaaagaggugaugaaaggggaauauuaaaauuauaguugugaaccuuuuuuugaggucaaagacuccagugggauucugaaaauguugggcucuuuccucuagaaaaaugcauaaaaacaugcaaaauguuaguuucaguuucaagggguuuaccaacaccuggggcccauucuugggcccagguuauaaaccucuaagcuaaaggaaaagcuagggguuuuaggaacaugccaauauauguaauuuuauuauucauuugggaagcaauugggagccacucuaguuuucugauuguggaauuggcauggccaugguaauucuuacauuucuuauagaauacuucuguuaguggcugauguaaggugcaguagaguuaaaacuaacugaaaaaaguaggcauuucaaauauucaucuagauaaauacaaaaaagcacauuaaguguaauuuuauuucagaaugaaagguguucuuaucaagagcuuugcucuagucaaaacaaucaggaauauuuguuagcaauuuguuuguaauuuuuuuuuuuacuugagagguggugccagguuuuuuguuuguuuuucuuuuuauuucacauaaaucagaacauaacucauuagagccagauauuuuauuuucuaacuguuugugaaccuucauuuagauacucuugacaugucugcaaaacagucaauauaguuuguucucccaaauaggcaggagaaguaaauaugauguuaguggguuuuuuuuuuuuuuuuuuuagcaauuuaaauauggugcuuuuguuuuccuugaacacaauuuauauuugauugauaauguuacuuuacuguucauuuacugauagcugucauuccugaaauaaaaauuagcaagcaagcuaggcuuaauucaagguauggcuauagaaaguagcaagcaguucugucuuuucaaggcugaauauuucuuuuuuucuuuuucuuccaacuuuaauuuuagguucaggguguacaugugcagauuuucuacguggguaaauugugugucccugagguuugggguaugaaugaucccaucacccagguagugagcauaguacccgcuagguaguuuuucaacccaugccuccuucccucccaccuuuaguaguccacaguaucuauuuuucccaucuuuguguccaugugucaguguuuagcuccuguugauaaauaagaacauaugguauuuaguuuucuguucuaauuucuaauuucuguucuguuucuaauucacuuaggauaauggucucuagcuacauccauguugcugccaaggacauuauuuuauuguuuuuuuauggcugcauaguauuccaugguguauaugugcaacauuuucuuuguacaauccauuguucaggggcaccugcauugauuccaugucuuugcuauugugaauagcauugcagugaauauauggguaaauguguuguagaaugauauauuuuccuuuggguauauacccaguaauggaauagcuggguugaaugguaguucaacucucaguucuuugagaaaucuccaaacugcucuccacaguggcugaacuaauuuacauuuucaccaccaguauauaagcguuccuuuucuccacacuuuuaaauacuagccauucugacuggugugacaugguaucuucauuuugguuuugauuuguguaucagugauguugaguguuuuuuuauauauuuguuggcugcagguauuucugcuucugagaagugucuguucauguucuuugcccauuuuuuaaugagguuguuuguuuuuugcuuguugauuaaguuccuuauagauucuggauauuagaccuuuguuggaugcauaguuugcaaauauuuucugucuuuuucaaaggauuucagaacauuggguaucaagcuuguugacuuuuugccuaauacugcuaaacugaucaggaggaaucacagcauuguuuucauauagcaaugcucaguaaggaggaaagucucaauaaagguuuuagguaaguggaaacaacuuagagauaugaggaacaguuguaaugauuaaaacauucuucuacauucuuaucagaagcuugaaauuacuagugauagucaaauucuuauuucccaguguuaacaacagcagcagcaguaacaauaaauuauuuauuuugugcaaggcucuauacuaguuucuagcaauacagaagaaggauaaagaggguuuuuauuuguaaggaacauaaccauuaaaugggggagaaagacguguccccuagaguuaauuacagugcaagaaagcauagaguaaguuuugaaaugaauagcguagguaauaaauaaauggcagaggaauucugaucugggaguagacauuaugggcaagaaugucuugucaaagcuucacaaaggaaguucucaugaugggugccccauagguuucugucauguaucuugaccuaauguuaaucuuauuuuuguguuaucacuugcuuaggugucauucuuggcaauuaguugguaaguugcuuaggggcagggcugguguguauauuguucaacucuaaaucuuuagcauugauucauagauguauagcaauauauguugaaugaaugucauaugguuaggcuuuguguccccacccaaaucucaucuugaauuguauuuacccacauguugagggagggaccuggugggaagugauuggaucauggaggcaguuucucaugauguucucaugauagugaguucucaggagagcugaugguuuaaaaguguuuggcaguuccccacccccagccccccacagccauguaagaaaugccuugcuuccccuucaccuucugccgugauuguaaguuuccugaggccuccccagccauguggaacugugagucaauuaagccucuuuuguuuauaaauuauccagucucagggaguuuucuauaguagugugaaaauggacuaagacagaaugaauaagggauacaugaaugaagagguggaacuuguauuuaaccuugaaggaagggcacacaaggagauaggaaggacuuauuggcagaaggaaaaauacaaguuaauguaugguagugggaauacucagaguauggauaggugaugagugauccaaguuuguuuugaugaagaggcuaauauaggagaguaguauagguugacauuggacaagauaaacacuugcaagauugggaagacauugaauauuguuauuaaauuacuccauagcauagguaagaccuauaacuuugacauguauuucucuauaaaauaaggguaggaaaaggucagugaagaaauacaacuaaagaaaaugauauuucagaauuaaauuauguaauaugauauuauauaauguugcaugaacaaagcaguguacaaauuuacauaaauaugcuuaugugauacaaugugaugaauaugaaauacaauguaaauuuguauacauguccauauauguguagguaguuuuagagagaauugucugaaaagguguuucccaaaauauuaauacuguaaaggcucucucuaaguaguaaauaauuuuaaguaaucuuuuaugcccuuuuuaaauuuagcugaagucuguuucuguaaccuaggggugauuuguagaggaugcucuuguuuggaguggagaggaagaaauaaauauagggagauauuuuaagggcagaauugaaaggacauggggucuuaauaaaggggauaaaaguagaauuuuuaggucugauuuuaagguuucaagccaauuggcauaauuaauagcaaauugggagggaugucguccuguaguuugggacguuuuucaugggaaaauuggcuuauuaauguccacaucuugaacuauuauguaaacacauauagcagcaacuggacuaguaguuaacggugucucugaucggguaaagauuggaguaaucagagggugguacuaaagugugauuuuuuuuuucuaccacagaacucaacauucaugaaaagucagacaguuacucaacucucacauauucuuuaggagaaugggaacauacuguuuguucucauuuuagagacugauaaagcaagaauuaggaaaauggagaaaaggacaguuauguucaggugcucacugaguggcagagggagggccuuccugcugguugacuaccauguugccuuggaugggggaacacauccaucacugcugcuccuguaucccacugugauugguucucugguugcaacucuucucuuauuuuuuaaucugaauuuaaaaaaggcuuuguuuccaaagucugucauggccuguuuuuuagguuuaacugguaacauaggggagaugccaugaaggauggcucaaaauaggaaauacaguuguauaauugagacaaaaaaggauauccuggaaauaauauuauguuagguuaguaaguuguagagcuucuaauuaugcggguauuuucucuccccuaauuacuaauuuuagaaagcauuucuuucaauuuaagaguuagccuuaaauuugucuccugaaacuauguuagaaaccacauauuuccaguucaguugaaauuauaugguauuaaaucuguaacuuuccagguucuauagacuggcagaaauggguuuaaaggauuggugcuucagugauuuucagaggaaagguccuccuguuguucuggccauucauaccuuacuauuucuguuucugggcuauucugggauagaaaugggauugaguccugugaaugggaaucauuuuccauuuacuaugaaugggaaucauuuuccauuuacuaugaaugggaaaugggaacuguccuaugaauauaaguauguuaguuaugucuauuuuaagaguggauuaguaaacuagauucuggauagaaauuuuuaaaaggggcaauuuuacauuuuaaucucauagcuugaauaacucaugaauucuaaaugaagaauaaacaccuuuucuuuggggggcggggggaauagcuuuaaaacagacugaaauguuucauaaguguauccugucuugcuauaauuugguccuagaccuugagcagaaaauccuuguacucuguaaagaaaauagugacccuguauauugaccuggcccaagauggaaaaacaaggaacccuucuuggacuuuguacucauuacacucaaaucuuuguucuagucacuaaguccuuucauaaguaaauuuuccggaacuuucuaugcuguaacuuuugcuuuuuucacguggcucuguucaaugauaauggugucuauuuuaccuuagugccuucacuggcauauauaccuugccuagaaucaccuuuuuccuucaacagaucuaauuuagguucuucaaccuccaauuagucuuuucuaacaacuucagccuucauuuuuuaaucccaucaaggucauaucuaggaaacauuuugauguuuaccacugaauucaguaucacgugauauuuuauauuugcuuugguuuaauagauucgaguuugaucucaacagauuuuuuuuuuuugagccagaaucucacucuauugccugcuucagugcaguggcgugaucaugccucacugcagcuuugaauuccuggacucaagcaauccucccaccucagccuccugaguaguugagacuacaucuacacgccaugcccagcuaauuuuuauuuauuuauuuauuuucuguagagauagggucuugcuuuguuacccaggcuggucucaaacuccuugccucaagugauucuccuaccuuugacucccaaaauguugggauuuacagaugugagccacugcgcugaccucaacagaccuuuacugaguuuuaucuucaagcuuucaaagaauuuucuuuuugagacacaguauugggaauauaguaaaugcuaaauaauucuuugguauuaguauuaaggcaauguggagaaaaaguucugaaaugugacuuauugagcugagaccuaaauacuuguuaauauugauugaucugaauugagaucauuuuuauucuucucuuccuggcauaagccacuuaaaucaaauucagcagaaguuauacauguuaaucaauagagucagcucaugaguaaucaggaaaaucuacaaaaaagguuacaucaaaguagauuucucaaaagccucaagcagucuggaugaaaaaauauauauuuuauauuauguauacagcauauguauauauuucuguguugccagauguagaauaugaccucucuaaucaauacaaaguuggaaucauagccauuuaaaauauucuuaauguuuuaaagaaacagaacacauacuuauuuuucuuguuguugugguuuguuuuuguguuugcuuuuuuguuuuuuguugguugguuuuucaacagcauuuugacugcagccaacaaacaggaaaaaagcucaacaucacuggucauuagagaaaugcaagucaaaaccacaaugagauaccaucucaugccagucagaguggugauuauuaaaaagucaauaaacaacagaugcuggcgagguuguggagaaggaaaaaggaaugcuuuuacacugaugguaggaguguaaauuaguucaaccauuguggaagacaguguggcaauuccucaaagaucuagaggcagaaauaccauuugacugagcaaucccauuacuggguauauacccaaaggaauauaacuccuucuguuauaaagauacaagcauacauauauucauugcagcacuauucacaacagcaaagacauggaaucagcgcaaaugccugucaaugauagcauggauaaauaaaauguuguauauauacaccauagaauacuaugcagccauaaaaaggaaugagaucauuuccuuugcagggacauggauggggcuagaagccguuauccucagcaaacuaaugcaagaacagaaaaccaaacaccucauguucucacuuauaagugggagcugaacgaugagaacacauggacacauuguuggggggcaacacacacugggaccugucguggggauagcggagggagagaaucaggaagaacagcuaaugggugcugggcuuaauaccuuggugauggguuuaucugugcaacaaaccaccauggcacacauuuauuuaccuauguaacaaaucugcacaucccaugcauguacccuggaacuuaacauaaaaguuuuuuuuuuuuuuuuuuugagauggagucucgcucuguugcccaggcuggagugcaguggcgcgaucucggcucauugcaagcuccgccucccggguucaugccauucuccugccucagccucccgaguagcugggacuacaggcgcccgccaccacgccuggcuaauuuuuuguauuuuuaguagagaugggguuucaccguguuagccaggauggucucgaucuccugaccucgugauccaccugccucggcuucccaaagugcugggauuacaggccugagccacugcgcuuggccaaaaguuguuuuaaaaaaaggcauuuuccuaauaaugagguuugagagaaauuuuucuucugagucuuuauaagguagacauugggugauauaaugaauaacagccuugacaauaguaggccaaauuaugacaagauauggucaaauuaguugacacucaaauccaaaauuaaauaauugauuaggugugaaccuuaagaaggcuauuggaucacuuuaaccaaauuguucauuuuugccaguucuuugcuggaauggagauagcuggucaccucaauuaaagaggaaaaaagaugaauucauucacugauugaauccagugccugaugacucaugaguaguuagguguaauucuuaugacuacacaaugguggguugaagccugauuuccuaacuuuggaaauuaaucuuucguguguucuuguuggcggugugggaguagggggaaaguagaaaaaccgaagcagccuccaucuuccccaaaauucaggggcacaauuuagccuuauuguucaagacccucugccagaguugagucuaaggcacaguuuuuuuuucccucagucuaaacaauccaggcuaaauucauuuuucagcuuacaauacugaacccucuuggaauaaauaggugcugugacagcuucucaaauucauaacauucaagugggcugucaauggccuccugauggaugugugggucaggaacagccccagggaaaucuccucggagaggaaguacuggaagugagaagccagcagucagacaaucuccuguucaguuguaucacaguugugcuucugagaaaaagcuguaaagaaauuaaauuuguuuaaaucaaauuguauuuucagugcacuuaaguaguugcuaaaccuaaauggauccuguuaagaauuacucuuuaaagugaauaaaucccuucaaaauuguaucauuucauauuuuuacauauucagagauccuugcuaacuuuuggguauguagauuuuaagguauagguuuauuucagcaaugagagauuugggggacaaagucaaacuccuauucuuuccugacccaaacuggaagucagcuucuucuucuuguuaguguuguuguuuggauagaugcuaaaaaaucccaggauucuuuccaguaacuucucucuguaggcagcaagccaguugcuguuuagaggugacccugguagccauucaggugaaaaggggaauucucaggggaagucuuuuuuucuaauucucuacagcugcuucagaccagugcugauacacagcaaaugaaacauaauucauuguccuagccaauaaugucuuucauaagcacaaguugaauuugugauuuguuggguagugucuuaccccacugggguaucuucguaauuuguaugugcugaacuaaugauguuuuauuuuauaaauuggaauucaaugccaguaugaaggaaagcaaaaauucuuucuauaaaguuuugugauauuggaaguccuuugauccucaccuugugacuacuaaauguccccucuacccuguauaaucuggccaaucuuuacucuuaaauagcauucuuuguuuaaagacguaagcuuaggauucauuguaauucguugguuucuccauuuuuuaaacuguaauuuguuccaaaugcuaugggguuuuuccagauaagcuacugguuuuuauacucuuuccauguaaauuagcugaacaguaggccucaguuuggagaauauuaauuaagauuauuuagagauguuaaauuccuuaugcuucuaguguaaugauagcuaacuuuauauaguaucuaacaguuuacuaaaauucaucacauagaucacuuaaauuggccccuaaaaaacuaaaucugugaggcaaguuaauauuacuuugcuacuuuuuacauuagagaaacaggaggauugucuagaaaaguaaaaugauuugccugagguaaacagcacaauucaaacuauugagucaaaggccuguguucuuugcaugauaucaagcaagcuuuaggcaggcuuugcugcuggaggaagagaucugggccauuucuuucucccuuguacccuaugcucacauuuuggggccucucaucccaguaauucugaugagaauggucaggggaugugucugggugacugcccuuucugaacuguguuguucucagccaucagggaacaccuuaugcccaaacugagaaauguaagguugaggcucauagcucucuuuccacaugcccuucuugucucuuuuaacauaaaaagacugucucaacuugauagcccacuaucauagccucuuaaucacagggaaaauaauuaucaauauccgaggugugauaggcuauaaauuguacaugaaaucagcuuuguaaauuauaaaacugugacagugaaggaaauuacuaaguuucugaaaaaauagaaaaucaagacaaagccaaacucugaucccauuuuauggagagggcugucacuccagcuucaagcucuccucuucucuccagccaacuguauucaugcuuccucauauuaauuuuuuuaugcuacaucuguguuuccauuuucuucugugcuguccaucuacuugcacacuuggacuagauucacuuccccuuugcaagcucaugccuuguagguaauaaguggcauguuucaaauccucugugcuauaggaacaaaaucucagaccagaaguucugaguuugauacccuuauuagccuucccuguaacuugacauuuugcauuuuuuccucauaaaagggggacuuaggugcucugccuguuuaauuuguaaaguuguugugaauacuuaaugagauaguguagguaauauccuuaaaggaggauguugaugugagggguuagcccugguuccaguacuaaccuccugugugauuuaaggcaagucaccacaucucucugggccuuagaacuuuucuguuuccuuaacauuaaaauaugggguuaggauuagaugauuuugaaggucuuuucagauucaaucaguugaauucagaugaguauauugaauauuuacagugucaugaacuauaaauaagaacauuguccuuguucucaaaaaacauguaaucuaaggaaaagagauguaaauaaaugaccauagugugauauaguaaauuucuucuguucuagcccugaaauucugauucugugauugcaaaacuuaucuccucucagucucuuccauuuuagagcuuauuucuguccagaggaaagaaauucaccaagaaaaguaguuuucauaugagggaauagaguuuacuugguuuuuagcagagcauuacuggugauugauaauagcuguaaguggcguguuugucugagacaccagauaacauucaggacagacuucuuuuuuuuuuuuuuuuuuuuuugagaugaagucucacucugucacccaggcuggagugcaauggcaugaucuuggcucacugcaaccuccgccuccuggauucaagcaauucuccugccucagccucccgaguagcugggauuauaggcgugcaccaccacgccuggcuaacuuuuuguauuuuuaguagagaugggguuucgccauguuggccaggcuggucuggaacuccugacuucaagugauccacucuccuuggccuccuaaagugcuggaauuacaggugugagccacugcacccggccaggacagacuucuuuaaacaaaaauaaccacuuauggcuuuuuuuuuuuuuuuuuuuuuugcugaaauugaguuuucuccaguagguagaaggaaaacuuggauauuuaauaacuuaucaaaguaguguugaugaccaagaccuuccuuguguacucaucucuguucaggcaauagcugguauaaaacuagagauauaaucuaaauauucugcauaucgguaaacuaagaggagacugcucaacuuaccauucucagauucugccagaaucaacuucugauauaccagaaguuuuaugguggccaguuccccaauaaucuguguaaucuuucuuaauauuauuuuugaucaucaaaucauaacuuuucugaagauugcuaaacacuauuuucuaagguguuuuuaggggaauuaaaaugauggccacaggauaaaacccuagagaacugaaacaaagaacucuuuccugaagcuucacgugcuauugugugauauuuccuaucacucaugaacgcuuccacuaugaagaugguauucuauccccagaauuaaaauuucuucuccggaugguuugugugauacuuguuauuuuauccaaauucagcucuuuaucacaguguuggauauugauaccaagaauuuaaacaaaaaguggcugugugaaucaguuauuuguaagauaauaaucuuguucuuauucucugaaaauggauucagauuucuaguaaauggauucuauuagaggauuccaauuugaacugugacaccuguuuaauuuguuaagugaacuagaaagugaguuauuuuuaaaacuaguuguaauccauaccucucuuaacagaugcucucauccucauauagucuauuuuagcuacuucgaaggaagaaauacauggguuuagaggggccccuuauccauucaaauccaaauuuggacauuucaagaaaagaucuguuuuauacauaacacauuuacuuagguuuguagauuuuucuuuauuugcugaguuuuaaaaagaucaaucuuuuuucuuuuucuuuuuuguuuuuuucugccugguuugauuuucuuuuuauuuguguguuuuaacagagaagcuuuacaugagaauaucaaugccaggaccaaagcugucaugucccuuuuuguuuaauucucaucuguauuagaauuauacauggauaucaacuaucuuuuggcuaguuuuauaguugaaaaucacuucaaagauagucauuaagaauuaucucauaacugugaaaaaugucacuaucucacaaauguuuauuaaccccaguuucaguugcucauugagccaaauuucuuccuccauuaagguucaugcagcaccuaacacuccagugggugcucaauuuguacucuuugaagagauugaauaaacauauauuuuauuuuuucucaggguaaauugaucuuagcuucuauucuauuaauaagaaauaaacuuuauuacuuucccagaaugcauaguuucuuucauugaagucauaagcauaauuaaucugaaaauaaguaacaacuuuguggaaguuaauuuucuagcuccguggaguucuuucaaagcgguguggacagugacagaacaugggcuuuguuggguagccaguccuggguuugaaucuugcugcaugacuguggacagucagcaucuuaaaccaccaguuucgucacagccaaaguagaucuaauagccccacugcacaguuucauuauagagaccauaugaaggaacucaugcuuggccuauaguagguccuaccuaggaaguauggggagagggaucauuguguauauuggagagaaugccccacaagggguagccagggaguauucuuagaauaguuauuuccuggaaacuggaugaagacacugggagguauaacuccaaacaaaauaccacacaaaaauacauuuaaugaauucuaagacauuaauuuuagagcacacuauugauuagauaacuuuugaggauaaaaagcaaagcuaccacauuaaauguggcguauccugauuugaaaaccauuaaaguguuuaucaaaaauggguguaugggugggagaggugccuaacaagcaaagggcauuauggaauuaaggaaaucuauuauuggcucugccucacaacugguauucuagguacuagcucuacuucuaagagaauguucugcuaguaauauuaagcuaauaugcuacccuucuaggauguaccaaaugggauuuaauucaguucaauugaacaaauauuuguugagcccuacuguguguuaggcccuaugcucuaugcuggggacacaguaguaaauaagacaagacacagucccugucuucacagagcuuacauguauuaagcaagucauuccaaaugugauggauauaauagaaggggacacacagggugcuuugagagagaagauguggagauuaugacacauacuuugguaaauaauguaaguauuuuauauacaaaaucaaucccaugaagagguacugaaauuauugggauuguauaaacuagagaugaagaggccaaagggaguguuauuauugucuucagguauaugacauuuuuugaauuuuauuuugcuuuauuaaaggauauguugggcugggugugguggcucaugccuguuaucucagcacuuugggaggcuaagguggguggaucacuugaagccagggguuugagaccagccuggccaacauguugaaacucugucucuacuaaaaauacaaaaaaaauuagcugggcgugguggcgaaugccuauaaucccagcuacucaggagacugaggcaugagaauugcuugaaccugggagguggaggcuacagugagccaagaucgcaccacugcacuccagccugggugacaaagcaagauuccaccucgaaaaaaaaaacaaaaaaaaaacaaaaaaaaaacuugguugaguguuuagccagggaauaauaaauaauaauaauaauguuaaccuuuauugcaugcuuccuaugugcuagccaccgugacaaauacauuuuaaguuguaucucauuuaaucuucaagccacguaauuacuugucucuuacaaaggagaaaacugaagcuuaaagacgucgaggaccuccugggauuaaauuaccagagcccagauucaguuuaaucacuuaugaugaggacgaucucuguuuuuccauaccugucacagauuuuuuaauguuuagaguucaugauuacugaagugguuacaaacucaaaugacuagagggccaggcagguaacacagauguagaugggaaacaauaaggaguaaugugcaggacuugaauguuguucugaaccaaaggcauucaaacauucaaaugcagguuuacuuaaaagagggacaaacaaaggaaucugugggcccuucaccccaggagaucaguuguuggggaggagucauuuauagguauuucucauacucacuuaaccugauagccguuuguauagcacuuaucaucuaguauaggagugaguguguguguguguguguguguguguguguguguguguguguguauguguugaaggguacaguauggcacaguggaaaaugcuugggcuuuguagguuuuaaagauaccugguuugaaucuuggcauugcugugugauuuucaccaaguugcuuaaccccucugcucuuagucuucuucuucuuucuucuuucuucuuuuucagaugaagucucacucuguugccuaggcuggagugcaguggugcauucuuggcucacugcagccuccaccucccagguucaagugauucuugucccuuagccuccugaguagcugagauuacaggcaugagccacuaugcccggcuaauuuuuguauuuuuaguagagacaggguuuugccauguuggccaggcuggucucaaacuccugaccucaagugaucgccugccuuggccucccaaagugcugggauuccagcugugaaccaccgcgccuggccuauuuuuguugugagacuguugguuccuugcagguagcucuuaaacacauguauccccgucacucagcacacacuugauguggcacacuacuuuugccaauuuagucacacacaaaucugaaauucuuuucaguaaguaaugauagccaucaaaaagcuugagguaaaugagaaugagugacuugccccaaaccucucucccugauucuaaugaaaguacgucucauaccuaauuuugucacauaugaagacauuuauuaaauaaacauuuauaagcaugggacaauucauauggcuuauucugcaggcugggugaaggcccagcuguccuuuagguaguagacuaccaccuuucuggaaagguuccacuggggcggauuggacaauaauccaaggcagugucuuuuuccccucguaauggacgucaaguagcuagaaaucugcuucccaaagucaagacacaggaacauuuagguuuacaccuuggaccccaucccaugagugucuugcuggaauucguguacccuguucaugcagaggagggucugaguauaaaaauauucagucaauccacaugucuuuaauaccauuaauuuuugccagugaaccaauucuaauaucuauaaugcugacuaucaaacuucugaucaucaaacuucauuaaucaaaauccauuucugacauuuauuauggaaugaaaaagucuccaguguugcuggagauacuaguagccuaaguccuugugguagccccucuggcuuguggguuuugcugcugaugagaaggauaacuguuuugagcacaaucucacugacucuagaccgauggaucucaacccagggugauuuugcccccagggagacauuugacaauguccggagacauuuuuugguugucacaacugguaaugagagaugcuauuggcaucuaguguguagaguacaggggugcagauaaacuucauauaguaccuggggcagccccaacaacaacaaauuaucuggccccaaaugucauuaacgaggaggaugagaaacccugcucuagagugcacuuaaaacugacgcacaugcuugcaugauaugacucugugaugauguauuuuaaaguuaaauuacagacuucauaacacuugcaguaaacucagcaguaaagacuugaaugaauuuaggaauucauuguaauauaauacauguggaagguauggauuuagagcccaguuauuuacaaccugugguaaacccaaugaauaacauagccugcaaaaacuuuucaaaaaugggaggcuuuggucuuguuuaccuggaguauagggagggacuucccuuacccaaguagugguccuauaaauuaccaucuuaauggauacucuuggcuacugagucaucagaauuuuaaauuuacuuuaguauuacaaacauucauugaaugccugcugugagccagaggcuguaggaggguacaacaaacaauaaaauagucucugaccugggggaguuuauagcacaguagaaaucaugcauaacauaucuucaccaaggcaacuuccaauuacaauguuccaauagccugugauuguaaaaauaaccuacaguuuacccuaguuucacuccaugugaaaccaggcagcucuccucauugccuuuuguauuauuuccauguggucugagccauauagacauuuacauauuuugccaaagaacuaccagauaguagugguguaacuauuuuaucuaaaaaagcaaaaauacauaaaaacuacaaauacugaagagaaguaggcccucugaaaaaacuagauguuuuaaaagaggauucauagaaaagccucaacaauuucacucuauugugaaaaugucacuuucaccucuuaaacucuggaaccaaggaaaugauuggcagugucaccagcauuguuggggucuccagccucccuuuuugccuuuuugggagcaugcccuaccugaucacguguaauaaugugucuuagcacuugcuaccuuagcuaaaggaaugcucuuaggacaccgccaacugcccaucuauccaucauuucccuucacuggagauggcacucgaggcagugugggugguugcauaauuacugacaugucugcauguaggaauguggccugaaacauucuaaacuuagaaacuauucagaucagaccuuguagauguuguuuuuggagagugauaacuguggcauucuccagggcuuguaaaaugagcucugacauugccaaccauagauuccagcuuuaauagcgaucuguucaaugaguaaccauaguccggagaacauucauucuucuuuuuacaaccugauuccaucaauuauuauuuuuuaaauugggguuucacuuggcuauaggaagauaauuuuauggaaagggguaaaaauuuggucagccagggggaaaaaaagguaaaaauaguaagcaggcuugagaucaguuguauuuuuaacuuuauauuagccaagcauuggaguucguuuccuuucaacugauuaaguuacaugucuauauggugaauaaacuuugcagaaauagcaaaauuugucucuaugucacuaauaaaugauuuauugucucucucagagucauacuuauauauauuauaaagaaaugucucagaaauaauuuguuuuucuaaaaccgguuuuaugugaauucucaaggcauuuugcaaguguggauugguguccgggauaauuguaaucauagaccagaaaaaccauugugacuuccaagagucacaugaucauaccuuaguguuucgaaggaucaggugguuuagcucauuaggaggucucuuuuuaugaagacaaaucauuuuuacaacugaaguuuuuuacugacuggguacacuuuugcaguugccuuaauggcuacccaaaaugauacuaugauuaaaaauguauucugggccaggcgugguggcucucgccuguaaucccagcacuuugagaggccgaggugggcagaucaugaggucaggaguucgaaaccagccugaucaacauggugaaacucugucucuauuaaaacuacaaaaaauuagcuaggcgugguggugggcaccuguaaucccagcuccucaggaggcugaggcaggagaaucacuugaaccuggaaggcggggguugcagugagcugaaauugugacauugcauuccagccugggugacagagcaagacuccaucucaaaaaaaaaaaaaaguauucugauccugguuuugguuuacaaauuuaagcuaaaugcauguuaaaggggagucucagguuuucuuuacaauaugaagugcaauagaaugaaauccaguucacuguccuauuaauacaaaauaauauaauagcaaaaacagcuaagaauuagauucuugcuaugccuucaaaguaaaagccucagauuucucuuuuaucuagucauaaguucagcacagagguaaugaaugcauguagguaaugaaugaauuaguuauaagcuugcuacccaaaugcuucuuacaugccugucuggcauuuaaaccaucuccaugccguuucuuuuucauuugagcccuauuucauuguuuuugguaaaagaacaauucuuuuggauacaaauuggaucauuucauccaaaguaaaagcuuagcccugguaaaaucuuuucuuuuuuccuuauugcaaagccuuugccauguuggaauugcagcaaaugccaucacaaacaacauuguugggagggaaguaugcccuauuucuugucugcuuccaguucucuccuagacugagagugcgccuuuccaaccaaagggcugccaucugaagaauaaauucauuucaacagucauuagagcugucuguuugguguuuaggaagcucuggcuaaaggugaacuggagcaauuuuuuaaaaaguagaugacagauauauugaaguaggucuguuguuuccaugugacaucacuuggguuccauucaaauugggagccugacagugccugauucaguguguccaggauuuaagaagcagaaaaaauauaguugcacuauaucuuuagguggacugacuuugaagcucaucaauucacccagcauuuaugggacacccaauguguaccucguacuggaaaauugugggcauguuggggucuuaucagcugauauuuuuacacuggaauuuucugggcuuuuugagcuugaguuuugauuuucuauggcuuuuuguggugaacuucagaaacauuuuauucaaaucaccaaauuuucuaacauuuucaguaagguauaaaagaagaacaagcaaugucuggcuccccaaguaacaagccucagaggauuucuagagaacaagucauaccaggcaaaguuguaugucugugugcuuguuuuaauaguauugcuaaaggaguggauaaagggaaauccaacguugaguaacuuacaagcuuuucaucaagcuuugaaacuugauuaaacuuagcugcaaaaugaacacuguuuucacugagugaccacagagugagggucaggguacggugcagggugaucagcuauccugccuaacuuugggagguaguaguugguagacugccucaaacagaagagucuuccuuuuucaaugucauuauuaaucuaauagaaaaagcagaauuuuccugguguuacuaaauugaaaugagcccuaaacuauagaaaauuuuaagaaauaguaaccaggagcccaaccaauuagaaaugaacagcagggauguucacuagcuuuuaccgaguauuguuuuauaggugagaaaacuaaguuugagggagguaagguaacuagccaaaaguucuacaacuaauaaguagcaucaccaguagucauaguuagaugugguugacuccagucacaugguuauuccaucauccuuaagguaauuaagcccuaguuucaauaugauauggccauuaauauaucaaaauuguugccuaaguaaagaugccuuuguguuuauguauuuaccuuacaggaauuauacuugcaaaguaucuuuuauucgcuuacuauuuucacagcuuuauugagauaucauuuacauauauuacaauucagucauuuaaagaguauaauucaaugauuuuuaguuauucacaggauugugccacaauuaccauagucuaauuuuagaacauuuuaaccccuccuaaaagaaaccaaacccccauuagcugucacuucccauuccuccuauuuaccacccacccccagcccuaagcaacuauuaaucuacuuucuguguuuauagauuuaccuauucuggguauuuuauauaaauggaaucauacaauauguuuuccuuugucauaggcuucuuuuguuuagcauaacaucuucaagauucacccauuuuguagcguguauaaguacuugguuucuuuuuauggcugaauaauauuccauuauaugaauaugccacaauuuguuuauccaugugucuguugauggacauuugaguuguuucuacuuuuuggcuauuauaaguaaugcugcuauaacuauucgugagcagguuuuuaaauggacauauauuuucauuucucuuggguguauaccuagaaguggaauuucuaggucauaugguaacucuauguuuaacuuuuugaggagcugccagccuauuuaacacagcagcuguacuguauuacauuuccaucagcaauguacguggguuccaauuucuccacauccuugccagcacuuguuauuguccaucuuuuuacuccucucauuuaauuuucauaauccuaugaauuagccaaagaaaaauauucauaaugcuauuuuauagauaaaacccccaugucaacaagaauccuauuaugugugcaaauagaggggaagaaguggcauggauaauucaaaacaacacaucauccaaaaguaguuuaaaacuuuuugaaucagacacuuacagcuauguuggauguuagagaucauguuuccuacauuuuaaaggugaugaaacuagagcccagaaaagggaaguaaauugaugaacacugacauaaagcugcuugguagcaaagucaggacuagaagcucugucuccuugguucccaggacauugccuguuccagcacagccuauugcauucuucccuaggggauguauaaauucauccauaucauaggaaugucguuuucuuaacucauucaucuaugcugaccuuuuauuacaacaaaucuaucugguuuauuguaauaaauuucagguauugggagauuagcgaagcugaaaccugcaauuggggagcuccugauagaauuaguuucacauauugcacaugaugagacugauaugcaggcagaagguuaaugcaggcagugcuucauagugacguuucuugggucagauugcuuguauaugaauucuggcucuacugcuuacuguuugacacuuucuguacucuggucuuauuuuuaaaaugggagcaauaauaguauauaccucacaguauuguuuuuauaauuaagugagauuauuucuguaaagagguuagcacagccccuggcuccuagauacccuucaauaaauguugacaauuauuaucacaaaacauuaaccugcucagaccacugaaaauguuguaaugugagauuuuauagaaaauaaaugaaucauccccuugaaaaaaguagcuucacuaaaggagcaggccuagaaaaugucuguuuucuaaaaucuucauauuuuugagcuauauggaaaauaauaaaauucucuuuguuaagaaaaaaaccuuaguauguuaacuucccauucuuacaaguuaugaacuaauuuccuuuauaauguaacuuugggcaguaccacacaacuuugugcagaaaccagccaauuugaauugaccucauguuuaaagcugcgacaguaggaaagcauaacuaaagcacauaugccuaucguggauguaauguauuaguaguguucuuccuuagugucuuugcuuaaauaucaagaugaaaauucacuggauuauuuuauggggcugaauguauaauuuguauauugguuuauauuauggggcugaauauauaauuuguauauugguguagaagaaagggcacccaguaggaaaucagaagacaggauuagaauccuagcccuuaucuucccuuauucaugaccacaggcaguguguucagaugccuguaagcuucuguuuccucaucgggaaguggggggacagggggucagcaguuccuaucucagaggguugucaugaggaccacaugauaaucuggguaugacagccuugcacacagugccuggcccacagucaguccucaggaaaugacagcuaaacagcaauguaguguuuaggcagugguagugccacacaugaaauauggaggcagauucaaugguaaguuuaggugaagaaauuggacauguccguguucacauaguaugaugauucaugucuacucugcuguugcugcugcugcuuuccuguaaccaauuuuagagccuaucuuggcagcuggaaguauuugggauuaauuucacacucacuuuaugaguugagcguuuuccugcaagcagcucccugggccucugccucauuacuuuggcaucaacugauaugucaguuggacagagauguccuuuggggucuccauuuuauuuggaaaccuucaauuugaaaaaacaaaacaaaggccaucaacacauugugcuugaaaucguuagcauuuauuguuuccuaaaccccucccuuucuguaguucuguugaacacuagggaacacacaucuugcucagccagugaugcacccuuaaaaaucgcucucccucaaauuuaaguccuagcagcugguuggccucauuucucaguuccaggugagcagcgagaucuucuaggccuuggucucagagaucugaaucuugauggguguaguuuuuccagucuuuuuacuauguuaauucuguuaaauucauuuggcucuuguggggaacacaguaaacuuggcuguuacguguaaaacuaaauugagaacauggagagcuguuuaguauuucaugcuggccaguaggucaggaagauuuuccuuggggguaauuuacauaaggaauuguuuaucccauuucuuuccaguuucugugaccauuuggggauagcagacuccuuccacaauggcacaggaauauauccaaugagacugagacuuagacgaugcuucuguccgauugauauauuuugggccuugcucaggaaagauccuguggcuuggacugcugucucacugagaagucauucuuccauaacagcuguguuuagcaaguuggguggguccaugaacugacauguuguugcacuuagugaggauuuuucccuugauagugaggaacguguguaaaagcauccuuuaaguccagaaaaugccccaaauauuuguuaugaucugauagcugcuuagagugcagccuccauuaaguaacacccacacucagaauacucuguggcuccccagugccuacagaguuaagugaaugcuuucacugugacauuuugguuccucuacaacagugcccagccuaccuuuuuaaugucaucaaacacugucccuaaacuggacuuauucaauaucuauucuuuuuuuuuuugagauggagucucacucugucaccaggcuggagugcaguggcacaaucucggcucacugcaaccuccgacucccugguucaagugauucuccugccucagccucccgaguacugggauuacaggcacgugccaccaugcccagcuacuuuuuguauuuuuaguaaagauggguuuucaacauguuggccaggcugcucucgaaugccugaccuugugaucugcccgccucggccucccaaagugcugggauuacaggugugagucacacgcccagccuucaauaucuauucuuuaggacacauuucagauaccucuucucauuggugugcuaguaaauagcucucuggggaagaaggggaaggguaggaagccugauuuuguaacauuuguggauuuucauguaguaaauacuuccaccauggcugauuucaggcuaccaaugugaggucccugaaugcaaaguugggaagaaauguaaaccguagcccauugcaaaguguuuccaacauauggauacaauaggcauaaauaaccucaagaaacuagauaauaguaggaaguaaugaauguugaguauuuauuaccuuuguuuuaaauguaauuuauuuaguuuuaaguuuaugugauuuaauuguuaguaauggccaugugugacagcuggcuugcaaaauuucugaaaacugaacaauagguucuuucuccugaugugggaggagcugacugagcuaguucuggcauaccacugcuucuuucucuaccucuuccuuccuaaggcccccuacacucagcuaguaguaguaugcccaucucugaaccuacaacaugcuuaaggucucaaacaaaauuuagagugagacacacuccagaguuugaauccuguucuuucaucuacuaggugauggucaggcugacuacuuauuuuguggaucccagugcaaaaugaaaaugaggggcccuuguucaaaaugcaggaagaaagcgcuguuaaaaccacuaaaauaaaaagcuuuuucuuuucuucaguacucucucuuucacagcuucugaugguauuuucuuauuuucuuuuuaguagcuuucuaaguaagaaaaaaacuaaaauuucaaauaaguagcaugaauuuuaccauuaaucguuacauuaauucaguuuuaaaugcaaguaugagcauuuaacucaugagugcacaugacuccucugcgcaugugcaugcuccauugcccuaucaauuuuacuuacaaaacgcaagcucaaaaauaaaauuacuaagaauuucaaggcagagacagcagagcguuaaacaaguucaggcccgucaaagcucgagcacaguuugcacacccugcguacaguccugggcaaauaccuuauauuugcugagccgcagaguucucaucugugaaagaaaauaucaacuaagucgcaggggagaugugaggauugaaggcacugauaccuguauggcacagggcagaaugcuuggcaugcggccuauguucaauuaauuggagggauaguuauucacauaauaaucgcaauguuaguggaauucuccuuuauagccuauagagucuuccuuauguggucaauauuugccuccuugacugauuuuccuauuacaaacucuuugaagguggagauuagaucugucaccauugaauucccuacaauacuucccgcaaauucuugcacauaucuggcauucaguggguguuuaugaccuugauccuuguaugauuuggacuuuuugacaauaagcaucugugucauaaugugauggccccacaaugaggcuuaauugguaacauucacaggaagaaaaagaguauaaacucagacuuuaacaggaguccguuguaaucauggugggggugggggaggaacacgauuccagguguuuugguuuaaggaaagugggcucuuuccaucuuuucgaggggacuucuugaaguaauggggaagggaugaguuccaagcuccguuugaguaaaagaggccccagggauguuaacucuggcccacaguaauccgucccuuugcuaacuucuuucacacuuacuuucuguucugcacaauuaggacauuauuauaguaauguuucuucccacuaauuggcuguguauguauguuuucuuuccaacaaauuauaagauccuguggacuguaagauauuguguaguucuuuugaauguaauuggggaguagcacaguacuaggcacauagcaagcaaugcacuuuacauuaugcuacucuucguuuaaacuuccaugccucccuguagagcuaaaugugaauugucauugccuuuuauaacuccugcaagcccucagcgaaguggcaaagaaucuuggucgccccagcaauuucaggcaaggaccuucaguugcucugccuacaucucuuuuccaguaucuccgagacacucugagggcuguuucuguacagccccucucccaacauggaauuugggagaccacacagcuguacauuguacuuguuugaaugaugauuuuuuaaaaagcccuuugggcccgugucaauaaaccgugaaauaucaccaaauggaucaucugcaccagacuucugaaacucaucugaacuccagucccccagcuggugggggcuuguagaaaggagcucauauggcccuggcuuuugcuaaugcuguucuggggacugucagacgccuugagccucugcggcagucaguucauuacuuuuaaugagcacaaaauucaccaagacauuaaacuaaaauaaaacaccaaugggaaguuuuggauguuucauccaauuguugcuuuaguucuuuuuuccacagaauuauucaaaaagaugaaaaaaagucaauucuacucacuccugccaauuuuauccuaaguagauuuggcauuguaaaguuaacacacccugaacuuuuuuuuuuuuuuucuuucaggucccugugggcuggugccugauauuuguguuaaaaaugacauuacucaacuggucaaauguuugaacauuaucuaccuuuuagauauaauaaagaaauauuagauaucucaauaccauguagcaucuaaagacuaauauuagaggaaagcgauguucugaaaaaaguguaaugaaguuauuuugaacuacaaggcaaaugcaauuauucuucugagaauguuuuaauugauuaauuuauguggcugguaauaaagacugugauaacuuuauuagagguuacuuauauuaccauauauugaagaaagucaauagauggcaaagcagacacugaacacugucccugcuaagcuuauuuuguggauauuuuccacuucuggccauauggauuuggaauuacugugggcauuuuuuuuuaaagaaggaagugagcagaugaaugauaacucuuuuauuacuuaacauagcuuguguuuguggaagacaaaguucaucaaguugucuugaagaaaaacaaaagugugccagacauaauuuguugagggcucaauaauugugaaauuaucccuaaccgaaguuuguaauaucugcagguaauugcucuagcagaugcaguggaggaaaaccaaggcaaucuguuccagucauucaccaggcugaagagugccacccauuuggugauucugcugaucgcgcuguggcagaagcuuagugcugaccagguugcuauucuggaagcggcauuucugccgcuacaagaagacacucaagaauugguaaggaccugaaagccuguggugggaacagccagcauuauugaaguuucggcuuuaggaagauaucacauggcuaucagguuuucuaagguaucaaauaaggguuugauuuuuuacaaaaaugcugcuuuccuugucuuuaaaccauaauaaaaaugucaaacaaaggccuuuuucuguagagcuauuuuaagaauagguauauagucaauuuuuaugugguccagucuacuuuuuauguguucuucaaucacuuagaagccagggaaacagucauuugacagucuagaugacagcaguaaccuucagauuagcuaauccuuuccuuuuccgccagagaaaacacuucggccauuuuaauuugcucaaccuucuuaaauuuaagugucacuucaaagguuagagagaauggagauagccuugcuauaacugaugugaauaguuccuuacauuuauagaguucuuuauguguaguuuauaaacucuuuuacccucaguccuagcauaggcaguuuagaaugaaaagagaaaaaaugaggguaguauuuggcauuuucaggaaaggauuauuuaacuuaaaaccucugagauccuuugaauuguagagauauauaugaccaccacgggccguucugggggacuuuuugugugcuuuuauuuacaaaagaaaauacaaaucucggaaauuagagaccguugaacuuaguucuucguauuggaugaaaacauuucaaggggaaaucauuucaaauccauuuuaaaaccuagauuugagaacuaaaaauaguaauauuaaaaugaacaauuuuuuugagugguuauuagguaccagguguuaaguguuuuguaagaauuauuuacucuuaaacaugggccagugagguaguuaaaguacuguuuccaucccuguuuuaccuaugggaaaauuuaggcuuuaagaguuaaguacuuuucuuaacucuuucugucugccuauauuuuagugaacaggaucaugaauguaauuuugaaaaccacaguuuuaucagcugaauugaauauucuacaguuaggucagaggauugccagauuuuuuuuuaaaaaagaagcuauauuuuaugugcuaaccaaacuauuaauaaguaaauuggaaaaaguuagaauacacauuuuuguuuaguggugaaugauauauuauaaggugauugacaaaauugcgacuaaaauugaccuuugagaaacuagaaauggagacacaacuguaauacuagaaaauaaauaaugguuaggauuauauuaauaagaaugauagcugucacuuaugaacucagauuuaguagucaaacagguuugggugacuucaguuauugguuccaccacuuggugacaaaaucacugugguucaguuucuuaacuguucuaaaucucucuucuguagcuguaagauggaaacaauaguaggaccuacccaguaaguuguaauagggauuaaaugagauaauuacauagagugcuaaagauuagcaaucauuacuggaagugauuuguacauuuuauguauauuauuuauuguccucacuaaaguuaugcaagaucaguuuuuuuguuuguuuguuuguuuguuuuuucguuuugagauggagucuugcucuguugcccagacuggagugcaauggugugaucucagcucacugcaaccucugccuccuggguucaagcgaaucuccugccucagccuccagaguagcugggauuacaggugcgugccaccaugccuaacuaauuuuuuuuguauuuuucauagagacagaguuucacuguguuggccaggcuggucuugaacucuugaccucaagugauccuucugccucggccucccaaagugcugggauuacaaggcgugaacuaucacaucuggcccagucuuaguaacuuucaugguuauuuguccaucuucacaacuacacuuaagaaugauaauaucuuauuccuuuuuauauccucaguaccuggcacagugccugagcacagagcagucaguauuugucggguagaugaaugaaggaaagggugaaaacuaacaaauggugaccucaaagaauagaugcaguggauguaaucuggagcaugaggaagcgggucagggccagcuacauaauuugcaaggccuagugcauaaugaauacuugaacuuccuuguucaaaaaguaggggaagaggugauaaagugcuguuaaaacacguacuaaaagcaaagcuuuuuuccuucugcagcaucucuccugacuugucauggcguuuuuuauuugcuauuuuauguucuaaguaagaaaaauaaaaaauuuaaauuguuagugugaauuuuaccauuggucuuuguaaugugcagugccucuuugaaauacaaauaugacugcauuagacucauaugcagaaucaacaaaauuacacaauuuauauuuuguagcuuguacuuacacauauauuuuguucuuauagaacuguggaaucaccagacuuaacuuuuuauuucauuucuugauaugugccuaucuuccagugcucucuaccuucagcuuacugaugagaaaggaaggacugaaaggaaaaggaacuauguaucacucuuuuucuuuccuucuauguuaucauuuucacuguaagugauuagguaauacaggggaaguaacaggaguaagaaaagauacaaugggcuucuucggucauuccuguugcuuugaacucuguugccuuccuucuuuauucaaaauaugucugguucucauggaaagccucucagggcuaccaguguccccacuuaaucagucuagacauaacaugccuuccuuguaguugcuuugagucucccugaaccccuacucaucauggggccacaggaauucagagcucauggggcuacaugugaaugagacagaaaggagaaagggggcaugcauacugcauauaucuucccuuuuuauacacgugcuucauugcuccaucagaguucacuuaggaaacacaaauucagagguaaaauuauuaaaaauuucaagauggugacaacaaaacauuaagccaggcagggcuggcagguuguccuucugagcaugagccccuuugugacugcagagcuugaaugcucaugaagcuggcccugaagcaugguuagacucaaaggaagacuuuccuagaaauaaauguucuaaauguaggaauugguacccagaagagauugugguauuucuuacuugagagaucuuuaaaaagucuuauuuaucugggaauauguaagcaugcuuaucccuguaggcaggugaauggacuuagucucuccugaaagccccuuucuacccugccuguacauucucugcugucauagcccccaaaacauguagaagaaaauucuuucaacucucuucugaauucggugagauuagaagguauguauacucauuaugucuuuggagucauuaaugagacaaaacauuugauaaaaacauaacuuggagaagaaugaaucaaaaaagacauuuuaauacugcuuguuaugcucuucaucuuuaauuagguugugguauucacuucggacuuauacuguugagacagcuuauacaucuugagaaaaaaggaaaccuuuuucauucuuuaagacauacgcaugcaguaugugguuuugacaugcuaguucacaaucccccacauuaugccuuuagaccucacaaauaaauguuaugugauggguaucccacugaguugugaaaaugaaauaugcaaaccugaaauaacuuggaagaagggugaggcagggaagaaaggacucucuuaccagaauguugaaaauauaucccauauugaaguuauuaugauaccacaaaaaucugaauguaauuuagaugguuugguugaggguggauggcagaguacaugugugagagggaaaacuuuagacauguggacgacauuuucagaagagccucucagcucaaggucacauguccccacaaguauugagagguaaaagaaagugcucagaagauguuuuguuuauguuucagacagcacuguguaaugauuuguuguuauuuugaugguauguguuaaaaggcagccuaaaugcaauagccaaccguggaguguuuucucccuaaugacaucagguucacaaugcaaaaauauuuagaaugugcuauugcugaugaaaaguaauguucuccacacuauauugucaguauuuuguuuaaaaugccauuucauuuggagcagaauuaaucguugucugugaucugucucuuuaaugaugccuuuccauuuuugucacuccucaauacuauuuuggggcaaauaaaugcugguauauguaaauuuuuaaaagugcucaaaguuauaugggccagauguguuuuuguggggauaccccuuuucaugacagaagaacauuaaguauucuauuuggugucuccuaaaaaagcucuuacacuugguuccguuugauaaccuaguauugucucuaccaucuuccugugaugauaaagaagugucacccaaaauaauguucuagcagaguaucagauugggcaauuuuaaaauaaauuguuuucauaucuuucagguuaggggcuggagauauuucaggguauuugaauucucaaugcagaauuuaaacaugucucgauugacccucugucugcuugaaguucuauggaaaauacuuuaucugcuaagcucagugagggcuguguuacugguuugagucugagagaguguugaauugugguauuauacacaucucccucuaaucaugcugcacagaagccaaaagaugcaaaaccauccauacuucaggauggccugauaggacaaaucucuuuacucauuuauucauucaaugaagaucuuagcacauacuaugucuuaggcaguguucuaggcacauagcauaccucacuaagcaaaacagacuuagagccaauccuuuguggauuuacuuuaacauugcaagcaaacauucuaguccugugcugccuaauaugguagccccuugucaugugaauuuaaauaaaaagaaauaagaacacacuggcuguauuucagcuacccaauagccacaugugaaugaguggcuaccacauuggauagcccagauauaggacauuuccguuauugcagaaaguucuguugcauagcacuaucagucgucaagagaaaaaacaucuuaucaguugaguugaccaccucagcacauuuuaacacacuaaugaaauuaggguaggauacugacauuaaguuauaccaugguguuugcauuugcaguaccuauuugugauauccuagguucagccuguucagaugugcaauaaccagacacuuuuaggaacaagaaacuucucuggggagauguaugcauauaagagaggcaagaagcuggcacaagugaugcuguuccuauucccccauguggccuugguaaacauuguaaccaugauuaauuuuuuucuguugagccugcacguggucucagaauccuuuugaauacagcauucuagguggucacugucacuuagaguugguauguagaugaauccucuuugcccuuccugaucucuguacaaaucuccuucucauuaucuuaguaaacagcuuaaaugacuaagauucuucauccagcuuauggcaagagaacaagaaggagcaguuuugauauuuccaaaacugccuguaucagaugucuguucuaauauucauuuaugcucaccugacuccagaggaaucucuaaugaaaagagcaauagugcacugguuuggggaccugauugcauagaaucccagaguuggaaggaauauuagcacauuguauagcauuaugccuguuucuuuucuuuuaaaguacguucaaugucuuuacuagauauuaucuauaauuugaagaaggaaagcuuuacuguguucuuaaggguuuaauaguuaccuucccuaguacugaacuuaaaaauccccugggaaaguuaggauggaaauuuacaucagugggggaaggagacuugggccuucagccuuauuuuuugauugauuaucccuuuuacaaacugauauggaaagagaaacuuauuuauaacauguucagcaugguucaugugagaaaacagauguuuauaauaggaaaugcuauuguguggagggaauuaucaaagcucacuuacaagguuuaaagacuucuacgucauaggucagguuuaauguaagggccauugugcuugcugucuggguugagugaugacugcgauggcuaaucauugccguuauuaaugaccucuucuuaaaaggcaaacaaaaagaggaagucuggugucaguauuaagucugccuuugugacuguuaaaguaucaucccaauuauaacugucuaugggaacacagugcagaaaguaaauauuuugguaauucccaugaucuuagccagcaagauaaacaugaaagaacuaguuucauguuauaaugaccacauacccuguguugcugcuagugagaugcaacugauauuacuuaauuguauaauauucugccucacuacaguugaauaugguauaucuuagaggcuuucugaugguuuucuugcuguuuugaaaaauugaaauaguugaaauacuguagaauauaguauaggauagaagucaaguagaauacaaugcacaaguugugauguguacuuuaaaaaacuuucuuuacaucaaauauugaauggugcuuuaauggacacauuugguauuuaugcauuuuaaaauaaggagacuaaaaaaacaaauaaagaauuaauugaagcaucacuuucucuguaugccuuuucaaauccucugugaaauaaaguaggauuuaaaugugaauaagguaauaauuaaauucaaacaaucacagugaggaaaauagugaucaucaucaacuucauaaugcuuaccaauuuuauuccuggcuagagguguguuuauauuaguuuaguuuucuuaaaauacuuuucccugaccuaguuugagucugcuaauuacaaagagaugauuuugaccuuucugugacaguacauuguuuuagaaacauauacauggaaauugcuggccuucguuccuuuaaaagcagcacgcccgcugugcuguggaccacaacauguggcucugugucucccugaaucuccguguucaguucaucucccuggcccgcuguuguucauuuggaaaucuuucuggaaacgccccuuggcucaggcccuguuuuuccaccugacuuucuguguuggcauccgaaguagccuuuuugcccaugucucugcauuggugugccccucacaccuuugcuggacucacagcccagugcucucccaucacacaccuguguacauacuuuacauggcucuuuuggccccuguucagauugaacuccagugccaggcauugaguaccuucagucacuuggcucuaccauaucucauuucuaaagcucauuuuaugugacuccccggcuacccccuucauucugggaaaugugaaccauggguacacagcuucuuccaucaagccagagcgaagaaggauuuuuucuucacuuaaaauugugucuccugucuacccuuccaucuauucucuauucucuuuaagaaguaaaucaauguucauuuccucccucuuuauucuggcuucccauucucuugugaauuucacuuggauggugugaugcaauuuauuucucauuaaguacucuaaaauuauuauauguacuuguccuauauucuaauaaauauaaggaaauauucuacauucccacagaauuaaagcaauuaaacauauaguuguauacaaguauugcuugauacuccauguauuuucauaaugucucacauaauuacagaugcuuguccaauaacuguguaguuuuuaaucauuuuuugaaaaggaaguauacuaccucuguuuccacaccccuccccuuuuucuaagauaccucaaauauuuuuggguuuuauaagaacaaaaccuggucucuccuguacagaugcuaaaagauauagauagauuauagucaaaccaccauaaauaaauauucacauacauguucauucacauauccucauaauucaagucaauauacacaaaaauuuccaaucuuaccagugaugaauauauacaagugaaagcaacuguuagguacacuucaccuauauugauuuagccaaauuuguuaauauauagugcugacagacauauggugaaaucgacauacccacuuauuugugauauggucuuuccugagaguccucuaggaaaaugucaaucauaaaacuaaucuuguacuuggcaucagucaucuaacuuaaugcacuaaaagcaguaaccuaaaauccauuugguaccauaauguuuacauuuagaauuugaauuaugaagcacugaaagcaaccuaaaagcuaauaguugcaaaauauaaacuguggcauaucaguugaacagaauuaggucagacugggguucaaaucccuuuuggaacaaauacuuaacuagcucuguguccuuagcaagugguggaacucacggaguauugguuuccuuaucuguacgguggugaacuagacuauuccccaaggacugguucugcuuuggagaggugagaguggccauucggauuugauuucagguugcuuucuuuuuauauucuuacugaaccagcaaacaaacaguacagaaggggaacaugauauuaagaaaguuaaugaauaugguucuuuagugccuuucucaucaaggggugacuggaguuugauggaaaacauagucuguacagagugaggaaauggccauuucugaggugcucagaaccacaggcucaccccuuucacaggguuaggaugggagcuguuacagggaguuuccuguacuuuaaaaaaguuaaacaacagaauccagccuuugcuagcuuuggguacuguaaaugauuuacuguaacauaaaacacaucgagugagaaaaauauagaauaaguuuuuucuucuucaauaagauaugcaaauauauauccaaauuauguugcuuacacaaaguaacuaaaaauggcguugcuuguuuggucucaaugaauuaaaccacacauugaguuucccuggguuaucuucacuaucauuucagauucaggguuuugguucuuaauuacugauauccuuuggaagacaauaauaauaacaacaauaauaauacaguggugcuaaaugcuguaaaaacugcauuagaugcaugaccccauuuggcaucuacuuuucaaaggugugcauguuucacgaggacacucuauauauacaucuuaaggcuuuguaaggacuaauugagauaaaguacaugaaguuccaaguaauggugccuggcaugugacaggcauccaagaauugguaguuacuauugccacuguaugacaacaaugccaucuacucuaaguuauggcauugcuuuguggacgaaucaggaaaaaaaaaccagacacugccaauuaaacuaugauguaauaguuuuaucccuuacuuuuauuuuuguuuuugaaagagcucucuuagacuuauuuagacauacauuuuaucauacauuacucuugugccugaauaagaagaaagauacaagcaacauaaacugaguaagguaucccugaaacuucuucacauucaaaguuugauuccccuaaaucauggcaagucauuaaacuacagcucaucgcuguguuuuuccauguagcauugucccucccguguacuauaacgagcauuguugaugcggcauuucuugggugugccacuguugccuucaugauuucuuuuuucugagccucuuauauccuuucaaaaacuuuccuuuucgacuaaacucaaaacuucauuuuuccuccucaguugaacuguacguugccugaaguuaagaagccucuguucaaagucagcaagaaauuuuaggcaaauugauguuuaaugcucucacaauaguccuacaugauacauuaauuaauuaaaccacaucuauuucagggauuugccaguuuuuccugagcuuaguuguauugcuugaccuugacauagguuagugaucucugugcgugucuuucaguaacaaagcauaacacaguuuauucuaucuggauguauuuucuugucucacauccuggaaagcuuucagcuuagcuuuugcuuugugagaaaauaugaaauugcugucauucuucagucaugaauguuugccucacucaguucaacuuuauacuucuaacuacacuauuuccauaccuuucugugcacacaguaacuuuuuugcucaaugauaagucauggugugguuuuaaaagauaauuuaaaugguaauuaauucauugaggaguauuaacauugcacacaagucaguggacgugacauaauaugaacugcuaagauaaaggcuguacaugcucaggcaaugaaaacuauagcaugaccggaaccugaaagccagaaguuauuauaugccacugaguauaagacacaacccuacuucugagaugugggggagaaauguccuauaauugauggaacauaggccgggcgcgguggcucacaccuguaaucccagcacuuugggaggcuguggcggguagaucaugaggucaggaguucaagaccagccuggccaagauggugaaaccccaucuuuacuaaaaauacaaaaauuggccuggugcgguggcaggcaccuguaaucccagcuacuugggaggcugaggcaggagaaucacuggaacccgggaggcagagguugcagugagcuaaaauugcaccacugcacuccagccugggcagcagagcaauuucaucuccaaaaaaaaaaaaaaaaaaaaaaaagaguugauggaacacauuuguaagcacagaguaaagaaauuaucacuguagucuuguuuuaaucaagagggaauuuaugagugguuugaauuggggacaggaaguuauagaaaaaggcaaguccaugacuuccuaucuuggaguagguguuuuugacuagaagcacauuucauauacaauaaauaggaaaaaucuuaccaguuguugcuuuuugaagagaaagccauguauaaacagugagaaguagucaagacugagucucuauugguaucauuuuaaauuuggucuauugccuaacauaggaaauuuagguuuagaucucacugauaaguaguuugugagaaccgaaugaacacagaucuucucacccacaacaaugaauaagaauuuguggaugaaaucacuaacaguguuaacaggaauauguuucauuuuuugcauuuggaguggugaaacuccccagcugccugagaaauaaaaaucuagcuuguauuguuuaacggcaguuguuaguuccuuucuaaccuauugggucugaagucaaggucauaaacauugguuagcagucuuagaacuaaguccagugaacuucacuaacuagauuucucuauuuuguaaagaaaaugggagaagaguuaaacacacacccaaauaagauaugccaaaggaauauaagaaaauuaacuuuuauugagcauuauuaugugcuaggcauugaucaaggacuuuucauauguuauuucauuuaauccucaccaugucccuuugaaguaggcagugguagcacaugcugugcaugucccauuccuaucucuuaaccucucaccauuccugaaugcuuccaccugcucaacaccugcaguuuuuugccugagggcuaucccuguuuggcagaggcuacauagccaccaugcucagccaaugacugauagacuuaguagauuaaugcccagguucccucauccuuuaugcaggguaagugugagaguuauguuauacaccauccuccagaguucucuggcaggagugagcacccguugccgcucaacagcauacacccuuuauugcuuuuucuccacuuuucaucacguuuugccacuccccauuggcacuucuuggcucugcucucaagucaacuacucgggcuuuuaucuuugucucaggacuauuaguuccaauuuauagaugaggaaaugaguccaaggccacauaucuagaaaauaacagaggcaagauuugaacccacacuaaggggccuaacaaaaaugaacagucugacucaauggaguaacuuuggauaauaggagugacugcuccaaguauucucaaugaugagugccugaucauacugaauuuuuacucuucuccaaucuauuuaacaaggauaaauguagauuuauauuuuguaguuauaugugcaugugcuuaagcguauaccagaaaaaugcuggcacauuuaaucaacucauggcuugcuucauauaacacuaaaacaaacucaagcuauauaauuaauuuuuguacaaaacuguuggggaaguuuuauauuauuuguauuuacaguauuguauagaucuuucugucaugaauaacuuuuauuugacaaauaauucuucauauuauucuaggaugaggcuagggcaugagagcuaaaacaaauaauuacuaaagcacuuuacuguacuucucuaaguacauuccauuuucuacaucauuauauuuuuguauauauucuuuuuuuuuuuuuuuuuuuuuuuugagauggagucccacccugucgccaggcuggagugcacuggcacaaucccggcucacugcaaccucugccucccggguucaaacgauucuccugccucagccucccgaguagcugggauuacaggcgugcgccacuacgcccagcuaauuuuuguacuuuuaauagagacgggguuucaucauguuggccagaauggucuugaucucuugaccuugugauccgcccgccucggccucccaaagugcugggauuacaggcgugagccaccgcgcccggccuauauucuuauauuaucacuugagugucagcuacuucaagguaggauccauaucugauucaccuuuuuggaagaaaaaaaccccccauaguauuuagugugucuugugcuaguuggcucuaaauaaauauuuuuaaaauaaaugacuguauagacucaaauuuaaacuuuauuugauagacaaugauauuuaaaauuaggaugaauguguggguaaacauacuacuucaucacuauuacucuacaguuuugagauuugugcugcuccccuacuguuaucuuagcuugauagcugugaaaauugacacuaacauugaaugaugugcagcucugucauuccagaugcaauucuaaauauuuuuuuucuccagacuugauuucuauuugaagaaaauagaaauagaaaucuagcauauggaccuucuggaacuguuucauauccauuggcggucuugaucaagagagaaauaaauagccaugucuuaaaauagugaaguuucugggugguccugaaaaauccaaaguaauuaaagagaggagagaaaaaaagaaagaaaagaaaccuguacugcuuuucacuuaaaucagugguuucauguauuuuuagacacguuuuucccugaguucagucauuccuuguucuuugagauuauuaaggacacaucauugucaggagaggaguugguaccuuuagcuuacucacaugguucuucucuuguccuagguggcaauaaaguuuuccccagacucugucaaauauaugggcaccugaggagucuuaugugaccccuuguguuguaugucuugauaauaggaguagcugcuccaaguauucucaaugaugagugccugcaaugaguguuuguacuucagauucauuagaaucaugucugaccauuguuauguuuucgagagccaugguguccaaaggcuauaaccauaaugucaguuacaguagucuaugaaggugcuaaaagcuuugguggacucuuguaaaaguuucgcccaaccaaacuggcacagagcauugugcuuuuuuuuuauuaugcaguaaaaucucauuuaauuauaugcaaguuauucauuuggauaaagaagcugauuuaaauuuugguucugcgaauauguuaauuaugaccaugaaucuucuaggggaagaagucauuucugaagcccaguaaaguaaaaggagccuaagcagaucuaaugauaacagauugaaagacaaacauaacgaaaugggaaagacgggcucugggccacaguggucaagugugguauuuacagcuauauaguccuggauuauauuacagcucccacuuuuaauaauuaugacauuuucagugaaguaccuuacaucuaaauccucaguuggaaguuauaauacccacucauaggguagucgagagaauuaauugaaauaauauuuguaagauucucagcacauaagaggucugaaauagguuuuuuuuuuuuuuuuggauggagucuugcucuguugcccaggcuagagugcagugaugcgaucucagcucaccgcaaccuccgcuucugggguuuaagcgauucuccugccucagccucuugaguagcugggauuacaggcaccugacacugcacccaacuaauuuuuguaguuuuacaaaauacaaaacgaggguucaccgucuuggccaggcuggucucgaacuccugaccuugugaucuaccugccucggccucccaaagugcugggauuacaugcgugagccacugugcccggccccaaaauaguuuuuacuucuguugcuguugcugcuauuucugcugcuguuauucaagugaacccgcacagaaaagauaaacuuuagagagaacucucacaaguaagaauaaugguaugggaauaacuaccuacauuugcuaaauaugucucauuaaaucuuaguaagcaucuggcaaggaaaauauuguccugguuuuuuacugaugagggaacugagauacagagaacuaaaauaauuuucccagagacauuaagcuuauguuuaaagcuuaaauuuucucagagacauaaagccacagucuaggucuucugacuuguaauccaauguacuuucauggcccauacuuccccuuauguggaaauauauaaauaagugcaagucauagugugagauggugaauaagugaaggcucaguguugcaggccacauagcuaaugaccacagaggaaaaggcagccuuaaacucaggguucgucuuucuugggccuccauuguccccuggcucuugaccugguaauuuaucacuaucuuguuagcuuuccugugccuucaaaggaaugauuuuuauauguucuuuuccaguuguucucacugggaaaucugguccaagugauguaauuuaccaccaccagaaacagcuuuccccuggauuugcauuaucaauuugauuuaccagucuuuauuuuuuuuuguaaguugcuucugaguagugcagguaacuggaagcuuuugccugaacuaaacuuuaaugcuuagucaaggugacuggcuccaucagacaucauuaguauuuugcuuuguuuuaaaacucauuaucuccauccaggaucacguuuuauaauaauucagguaaucuacuuuguguuccuccaucuaaagaauuugggguuggaaugggaguacaggucaaauagaaauguuccuggcaaaauauaaacuuacaaaagggaucagaguggguugguuugcagcagcuuucugcuugcacugcagccgaaccuucugaaggucucuuagcuuguauuuguuaaggagguuuuagauuuucauccaauaggaggcagugugcuugauuuuccacaaaaugguguggauaaacuugcacacugcucuaccguugguugaaaccucaauuaaguuuuuucagcuugugaguugugacaaagauacggagaacuccaaaaguccaauagauuguuuccauuuaaaauaaaaaggaaugguacuggggaaugagaguuaguagauuacauguggaauuuucuucauuuuaugaugaguugaaaaaauuaaagcugauuuuuuucagugcuuuauuuuauaaaaacaugaauaugauuuuaaacuuaagauggcauauagaccauauaacuugcuuucauuuuuauguuauuuuauuuucuauuuuacauucaaagggcuguuuucuuuuucuuuuuuuuuuuauuauacuuuaaguuuuaggguacaugugcaccuugugcagguuaguuacauauguauacaugugccaugcuggugcgcugcacacacuaacucaucaucuagcauuagguauaucucccaaugcuaucccuccccccuccccccaccccaccacaguccccagagugugauauuccccuuccuguguccaugugaucucauuguucaguucccaccuaugagugagaauaugcgguguuugguuuuuuguucucgcgauaguuuacugagaaugaugauuuccaauuucauccaugucccuacaaaggacaugaauucaucauuuuuuauggcugcauaguauuccaugguguauaugugccacauuuucuuaauccagucuaucauuguuggacauuuggguugguuccaauucuuugcuauugugaauaaugcugcaguaaacauaccugugcaugugucuuuauagcagcaagauuuauaguccuuuggguauauacccaguaaucggauuguugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaacgucuucuuuugagaagugucuguucauguccuuugcccacuuuuugaugggguuguuuguuuuuuucuuguaaacuuguuugaguucauuguagauucuggauauuagcccuuugucagaugaguagcuugcgaaaauuuucucccauuuuguagguugccuguucacucugaugguaguuucuuuugcugugcagaagcucuuuaguuuaauuagaucccauuugucaauugugucuuuuguugccauugcuuuugguguuuuggacaugaaguccuugcccaugccuauguccugaauggugaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauagcuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugccuuggugaugcgggcucuuuuuugguugcauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuugggcugagacagugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuguugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucguuuugccaguauuuuauugaggauuuuugcaucaauguucaucaaggauauuggucuaaaauucucuuuuuugguugugucucugcccagcuuugguaucagaaugaugcuggccucauaaaaugaguuagggaggauucccucuuuuucuguugauuggaauaguuucagaaggaaugguaccaguuccuccuuguaccucugauaguauucggcugugaauccaucugguccuggacucuuuuugguugguaaacuauugauuauugccacaauuucagcuccuguuauugguuuauucagagauucaacuucuuccugguuuagucuugggaggguguaugugucgaggaauuuauccauuucuucuagauuuucuaguuuauuugcguagagguguuugcaguauucucugaugguaguuugcauuucugugggaucgguggugauauccccuuuaucauuuuuuauugcgucuauuugauucuucucucuuuuuuucuuuauuagucuugcuagcggucuaucaauuuuguugauccuuucaaaaaaccagcuccuggauucauugauuuuuugaaggguuuuugugucucuauuuccuucaguucugcucugauuuuaguuauuucuugccuucuucuagcuuuugaauguguuugcucuugcuuuucuaguucuuuuaauugugauguuagggugucaauuuuggaucuuuccugcuuucucuugugggcauuuagugcuauaaauuucccuguacgcacugcuuugaaugcaucccagagauucugguauguugugucuuuguucucauugguuucaaagaacaucuuuauuucugccuucauuuuguuauguauccaguagucauucaggagcagguuguucaguuuccauguaguugagcgguuuugagugagauucuuaauccugaguucuaguuugauugcacuguggucugagagauaguuuguuauaaauucuguucuuuuacauuugcugaggagagcuuaguuccaaguauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucuuggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuuaguagaucuuccuccauccuuuuauuuugagccuaugugugucucugcacgugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcuggugauuuugcucguuaguugaugcaguuucuuccuagucucgauggucuuuacauuuuggcaugauuuugcagcggcugguacagguuguuccuuuccauguuuagcgcuuccuuccggagcucuuuuagggcaggccugguggugacaaaaucucucagcauuugcuugucuguaaaguauuuuauuucuccuucacuuaugaagcuuaguguggcuggauaugaaauucuggguugaaaauucuuuucuuuaagaauguugaauauuggccuccacucucuucuggcuuguaggguuucugcugagagauccgcuguuagucugaugggcuucccuuugaggguaacccgaccuuucucucuggcugcccuuaacauuuuuuccuacauuucaacuuuggugaaucugacaauuaugugucuuggaguugcucuucuggaggaguaucuuuguggcguucucuguauuuccugaaucugaacauuggccugccuugcuagauuggggaaauucuccuggauaauauccuguagaguguuuuccaacucgguuccauucuccccaucacuuucagauacaccaaucagacguagauuuggucuuuucacauagucccauauuucuuggaggcuuugcucauuucuuuuuauucuuuuuucucuaaacuuccuucucgcuucauuucauucauuucaucuuccauugcugauacccuuucuuccaguugaucacaucagcuccugaggcuucugcauucuucacguaguucucgagccuugguuuucagcuccaucagcuccuuuaagcacuucucuguauugguuauucuaguuauacauucuucuuaauuuuuuucaaaguuuucaaccucuuugccuuugguuugaauguccucccguagcucagaguaauuugaucgucugaagccuucuucucucagcucgucaaagucauucuccauccagcuuuguuccguugcuggugaggagcugcguuccuuuggaggaggagaggcccucugcuuuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcugcaggucuguugcaauacccugccgugugaggugucagugugccccuguuggggggugccucccaguuaggcugcucgggggucaggggucaggcacccacuugaggaggcagucugccucuucucagaucuccagcugcguacugggagaaccgcugcucucuucaaagcugucagacagggacauuuaagucugcagagguuacugcugucuuuuuguuugucugugcccugcccccagagguggagccuacagaagcaggcaggccuccuugaguuguguugggcuccccccaguucgagcuuccuggcugcuuuguuuaccuaagcaagccugggcaauggugggcgccccucccccagccucgcugccgccuugcagugugaucucagacugcugugcuagcaaucagcgagacuccgugggcguaggacccuccgagccaggugugggauauagucucguggugcgccguuuuuuaagcgggucugaaaagcgcaauauucgggugggagugacccgauuuuccaggugcguccgucaccccuuucuuugacucggaaagggaacucccugaccccuugcgcuucccaagugaggcaaugccucgcccugcuucggcucgcgcacggugcgcacacccacugaccugcgcccacugucuggcacucccuagugagaugaaccagguaccucagauggaaaugcagaaaucacccgucuucugcgucgcucacgcugggagcuguagaccggagcuguuucuauuuggccaucuuggcuccuccucucgggcuguuuuauuuuucaaaggugaauugcucaacauuuugagcccucuuugcaugacaaggggauuucacugauuacagucaagcaaauaauauuuggaaauaaucugaaccuagauguuuccugaaaaggcccuguacuuuccaagauauuuaauuuagaacuaaaguaccaaguuuuauuuguucugggguuuacaauaacccauuauacgauuagcuuuagauauaauauuuagauauaaucuaauaaguauuuagauauaauguaauacaauuccauacaauaugauacaaaguaauaaccauaaucuucuguggaucaauuauaaauaccaaacacuuuucauuuugcauccuuuacaucuauugaagaggaaauuuuuuucccuuuaauacaguuuguuauuaagauaaaugaauaugauaugaagguuguuucgccuucauauaugcaaugcaacaugggccauuucugagagucuucucuuuucacuugaaaucuggacuccugccacaaaaucuccauuuguucuuuuaacaggucucgugguuuuuuguuuguuuguuuuuguuuuuuaaccuuuucucucucucuuagguuuaacuguguacacauuugguaauaaauguuacuguggcauuuugugguuuuucccuauaccacuguaguuaaggaugugguaguguuucuauuauaaacauagguuuguaggaguuuauaauuuguuugaaaaaaaguuuaaggauauuacuuggaaauuuagauuucaauuacauacuucuauuuucugauuuuaaaaaaaaguaggauugaauauauuuucucauuucauagucucuuccacuuaagauuucagagugccguaccacuuauauaaguuuggcauaaugaauaguguuauugcuguuuuguggagaccucacguguacccuagagagauuaaaugaguuaucuaagcucacacagugaaggggcagaugaggugagugagguuaagucagaacucaggagccucgggacagcuaucaucaacucaacuguuuugauucacagguggcaugggaauacuuucuuaguuuauuuugugcuuugguuacuuuggucgauacccuaggaaauuaacuuuacaaguguggucaaacuuucugcuucuuacuguuucuaauaagccacuugcuugaucugguauuuaggccuauugaccaguggagacuagcaggguaguaaagcaaagcagucagaaauucagcuguggcucucuggucucuggauagcaagaagcauagcucagcugaauucagucaggaggagcagacuaggcaaggccagguccuugaauuuaaagagcuggcucacagaaaaagggcacaccagcaaucacacugguacacaaaggcaucugggaccagcauggacuguaggagccucugcacaggcugguaagauguggaaacaggggacugggcagccauguugggggaugcauacagcaggcaacuuggcauuggagaagucagguagcaggcagggccucggccccugaguccgguuccuuggagggaucuugcagaagcuaggcagcuaucuaucaaggagugacacuuucagcaggcuccuaaggcaggggcucugguagaggacuuggguaaagccaaggucuggaaacaaaggaaaacccaguuaucaaugcuagacuagacaaaguaaaccaaaaaauccccacaaaacccaauggauaaguuaauuuccaauaacgacaagggcuguggaaaagauaaaguaguguaacaugcacauuuaacuaacaccuucucccuucccuucccuccccuccucucccauccccuucccuuccccaguugccucccacucccccaccgcuguuguuuucuaaaagccauacacaggucaaccuggaauuuacagcaaauuguggauuugaggacuauaacaaaaaucauuucucacugaagagcacaugcccaauucccuuccagaaauuuuuagugcuauauuucccaaauuaagauuuucuuuuacucucacaauauaagacaaaaauacuaguaugauugauauuuaucuuuaaaagauaaagguuagguaugugcauguaguauguguauguauuuagacauuaaaacugaacauuagccuuaccaauuuaagggcuaugaauaaagguaaugagcucaaauaccaaaaagguguuuaaaauagcuuaccuuuaagguacuucucacaccugagauucuagauuccacaguuuuauuucauauuuccauagguaaguaugcuacauguuugaucagugaauuaucacauuguauuuuuauuuaacaaaacucucaaaggcucuuuuuuugucucagagauauuccuuuuaguuuuauauuugaauuuauguagcaauucagucccuccaaguaauaacucuguauuuuaguggcaaucuuucuaaaguacuggcaucaugccucaucuauauuaaagaaauauaccaugccaaauaccuaaacaugacaugguuuuugacuugaucugcaaguuggcaucaggaaaauaaauucuguaguacucuguauuaacuaaaugucauaucuacuuaaauuaucuaauauguuacuguaaucuauuuaugauacaguaguuugcuuaaaugaaugacaguaugaacuauuuuaaugcugaaaugacugcagagcauacaaaugccaaauuauauucaaaggauuuuuuucuucuuuacuccagaggucuuugucaauggcuccaauugaaaacaugcccucuccagugaugucuggguuacuauuuugucuucauuuaucucuucccauuauuacugaaauucaaacucaauucuagauauuagucuaguuuagauuuugguaguaguaaagagaugucuuuguaacaaccaguguuuauuauucuuuagugauuugggguaggaagcuguuuuuauggucuuuuaggucucuugaaucuguugaaaggauuuucaagaugacuuuaaaaucauuuacuuguuuccuaacuugccuagugacaccuacaggugggucaauagaaaugggccaauagagugaaaagucccgauuaacccauuauggcaaucagugggaaguucucuaguggaaauauguagagucugcacuuugaucugaagaaccaacugcagggccagacaugguggcucaugccugcaauccuagcacuuuuggaggccaaagcaagcagaucaucugaggucaggaguucaagaccagccuggccaacacagugaaaccccaucucuacuaaaaauacaaaaauuagccagauguggugacacccgccuguaaucccagcuacucaggaggcugagacaggagaaucacuugaaccugggaggaggaaguugcagugagcugagaucacgccauugcacucuagccugggcaacaagagcuaaacucugucucaauagagagagggagacagagagagcgagccucauaaaccuagaagaagagauguggcaaguguggcaaagaccuggggcuuaggugucagugcacucaaugugaaucaagaauguaauccaacugccaagagagcagaggcaacuggaggccaggcuggcaggagaauuccuagaaaaaaggagggagggcugugggauaccuacacuccaagccgcagcccaguguuuuggggucagucugggguucucuauuuagcuguauaaauuuuuaaguguuucaaauuggagcucauucaaagaagaguggucaggauggagaaaaaacuugaaacucaguuuauauaaggaagaacuagaggaacuaggauguuuauucuggaggagaggguacagaauugcugucuccacagauaaaaugggcugucauguagaagagagguuagauuuauucugcaugccucuggaggguagaagaagggccaaugggguagacuuuggcucagugcgggaauaguuuucuguugguuacacaugucccugaaaggagugaacugccucaaaaaguagugauuuuggaucuugaagacagcuaugccuaggcagaugguugccguuguauaaaugauccugggaaaacccccacgagacuagacauaaagaucuccaaagcucucccaacuuuaaggcccugguuuuauaucucaccaucucugugcagcaaacauauuucuugaccauccucuguauaccaagaacaguguggggauguggagaacuccagucacucucagggaauaccagacaugcaaacagcacccacgucacagggugacaagagcuaugaugcaucugggugugugaagucucagagccccaaagagggcccacccaucaacccuuggauggcaaugccugagcaagucauuaaaugggaguuggccagcuaaagaauagagguuagggcauuguagcaugagcgacggccaugugcagaggccuaagggagagacagugugggugcagguggaugggaacagaauacaguggagcaagagcuggagcagaaaguuccuuaaaugccagucugaccauuugaauuuaggaguuuguauuagucuguucucaugcagcuauaaggaaauaccugaaacuggguaauuuauaaagaaaagagguuuaauugacucacaguucugcauggcuggggagaugucgggaaacuuacagucauugcagaaggaaccucuucacagggcagcaggagagagaaugagugccagcaggggagaugccagaugcuuauuaaaccaucagaucucaugaaaacucacuaucacgagaacagcaugaggguagccaccuccaugauucaguuaccucccacugggucccucccaugacacgugggguuaugggaacuacaaaaugagaugucgguggggacacagccaaaccauaucauaguugaagcuugggaguaaccuuaucugauuugcauauuugaaugguggcucaaaugauaaguuugaggauggaaugauggguuccagaugaaccuucucucugagucucagggcucuuacuucuaauauaagggacuugcacuguuccgcaguauucuaugaucauaaauucauuucuugucguucuuuauaauuguauuggauggucaggcccauggugcucuaggccuuaccagccuuuguguacagauggagucacauucacagcaacacccagauuucacucaugcuuugcuuccuuguucugcuucuuaggaccuccagauccccacaaagaucuuacccaguuauuccugggagccucuggggaugccuaaagggagcuccuaaacugaccccuccugcucuuuaccucauacuccuuguugccaguguuagcugaacccaccugaggguggugccuccccaugccaguccugcuggugccagugcucuccaugacaaugcugaggucccugccuugugcugacguuccugaauugcagcugucacugcacuuuucuagguuuuucacugcagcgcagccacacuguucccaacaaaagugggggcaauggccuacuuccugugggucauuuaccgucaccuggacagugagcaguacuaggcaggcccugugucucacacgauccuucuugcaauagcuccuuuguuucugccuauaaccccaaggcuguggaaccaguaccugagggagacaccaggguuuucccuccauuccaguuucccccaggguauccaaagguccuccuucuccuggcccgcuuuccuuuagccgaagauaagaaagauaaggcaaaacaaacuauaauccuagcagcuuuacccaccagaucauuaaacagacgugugccugauacucuuuuuguuguuacucauuacucuaugccuggcucagagcuaaacccuucucauagaucuccaacccuuggagggacagacuguuaacauccucauuuguagaugaggaugaggcuaagaggaauuaaguaacuugcucaaggucaaacaggugacagagccagaauuccaaaccagccuagucuggaauauuccagauaccacacucuucacagguucccaacacuugaacauaaacacucaauaaucuguauaauacaucaagugcccacuuuucuuauugucaucuuuguauuaauucaaaauuggcuuuuguauccagggcugggaagaaacgguggaugccgccauuucccaccuguugaagacuugccugucgaagaguucuaaggagcaggcuuugaaccucaacagccagcugaacauacccaaagacacaagccaacugaagaaacauaucaccuugcucugcgauagauuauccaaagguggccgucucugccuaaguaccgaugcagcagccccacagaccauggucaugccagguaagagcucuguccaugcucccuaaucacaauuguacuucuccuaaauuagaggaaugugccugugguuguauuugggguuuaaauuucauauuaaagugaugauagccaagaaaauugauuucacguuuccccucugacaucccaggguaaccccuugaauaaauaucccugagauauuugcuugcuagacauuuccagaaugguaugucuuuuuucuucucucugcuuuuaaauauaugauccauuuuguuuugcuucuaacuaauaaaaaguggauuagaagauaaacuauuuuuaagaaaaaguuuuacuaaaugugaucucgcgauacaauauuucguaaauguaaauagcaugauacaagcaacuaauguaauccagaugaguccagucucuucugcuguuugcuuggauuguggucaucagaauaagggggaagagacaaagugaaagaugaggaucaagagaugugagcaggcuucagagcccaggcacccaugggccagcaaggagagagauuccacuugccccuccaugggcagucagugauggucgugggcacccagggcuguccuucccauggucauaggggcugagcagucagucgugcagcccucaggucucuuaggcgcagcaguucccaacuccuguuucccucuuccuagccucucuguggcagcagcaaggagcauuacaucaaugaauuaauugaugcagcagcuauagcaucucuuuccuccuacagcaagaaccacagugugggaaguggugugguuuucucuucuuccuucuuacaugccuuuucuuuacuuccccgcccccauucccucucugguagucuugcuguugcuuccuuuucccccucacucagcauuccuagaagugaaaaggaaugcaagugaaauuguaaaagauaaacauggagacagcauagcaugaucuaauaggcacagacuguggagacagacagaacaaugcuuggauccugccucuuuuuauccauuacuacuuauaugacccugaguauguuacuuucuuuucuagagucuucaugucuuccuaaaaaaaugaauguaauaacgcuugcccugccgcuggggcccuaugaguuuaucaagcaccuagcacaaugcuuggaacagagacacucaaaaaauuuaagcuguaauuauuaucguuguuauggauauaugcaugauucagccuuuaaauuuagagguggaaaaauagcugguuugggguuauggauucuauauucuaugauuugaauaucuuuaccucaacuauacauagguagaagccaacuuuauuccaaauaauauuuuuuauuuggccuuuuauaauagaaaugcuuuucuauagagaaauaguucugacauuguuugccuucauuuagaaccucuuuaucuugcccuguaacacccucuuaacuguuccacuuguucaucuucuguccacuguuacaggauuguuuuccuaagagauauuuaggcuuaaugagauaguaaaugaaaacuauucauuauaaucaguaucaguuuaugacucucccucccugcuugcccacaggaaaaacaaaggagacuugagggaaaagggcagauacauuaauuuuacaaaaaagagagagagagaaaaaaaauuugaagagggaugggauggcccaucugauuggcugauuaccugugaguucaggcugcagcagccccaaauucucuucucaggucccugucugagcuuuccuguucagggauccucaaaucccugucuuagucguuuuuguuuaaauaacuagauuuguaaguaaccuaagggcuguguccguaucuaggauguggaacauuuuaaaaccucugugcaaaguuuuuaaauguauggaaguaaaggacagagaaagaaggaaaagaaggaagggagaaagaaaugaaaagaagaaagauggacaguguguuuguucacaguccagggcgggccaucagucagauuuaugccuggccuggcugaguucguucuguuggagagauucaggcugugugcaugggcaaucagggucacagucgcaaugccuugccuuuacuugccgacgacccgcuugccacucugugguugaguggcucucccucccacuugucuugaucuaaucagaauagugagguuuuaaaaaauuguuaaaucagcacuuguugucauuaacaugcuuaauuauugccuauacuacuuuucuucccuauaacucagauuuuucccaugcuuuaucucuguauuggcauacuuuugagguagaagagacauguagaauuauugcugucuuacaaauagaaaauggaggcaggaaaauugaaaucucuugccuugggguuucaugguuacuggaaggguuagaucuagaauccaaaucucccagcccacugugcuucccucuagaccacacagaccacagugguacagauuuguuuuuaaccagagccuccuccuguguaagcuguucugugauucggccuuccccccgccccccgccuccccccaccccacuuaaauuggucuagcagugugaaaggaaaagggcagaaauaguuucacacagucucuuuucuuuucuuugcuaugagaaauauauuaaagauuuaucuuauauuuguuuugugcuuaauuuuuauuauguccaaaggugacaugauaacauuaucaugaguauuucuuauuaagaaauacugugaggaguuauuucugcuucaagccuguaauugugcaguuuacaauguugguuuagcuccaguaguuguaucagaauauacaaaguggcauauuagaaaggacuggauuacugaauaagcauaaaaguuuuuuuugcagagaugaucuuuuuuuaagauuuaguugggaccuucaaaaucgucugguucaccucccucacuuaacagcugagguaacgaaggucuaagaaggugaagugaauaaguguucaguauuaaaaggcaggaguguguguaauuuugccauguucccuauuaaauugcagauggauaaacaucucagaauaaaaaaccuuuggucuuuucuagccucaugacuuuaugagcccagcaccuuggcugugcccuuuuuuugcucuagcgaaggccauggugacaacauccucccuggcguccagaguuugaaaaucuuucccagugggaauuaccuuaugaacuucuuugccuuacauuucucuugcuugacuuuuaccaauucucuaucaguuuuucccuuaaccuuuucuggugaacuuuuuguuguuguugcagagcuaucaaauuuauuucucucaucuguagcucugguguucacaucuuucugcuggugaauauagcuuguaaggaaucuacuuucguuaaauaucuauuuuccagucucagcuguaugcauucuacucuuagagcagaagucacaaagggccaccugauuaguguuuuuuaaaaaucugaguguaagugauuuaguggucuaucuggccuuuucaugcauauauguucccaaccuucucccugcagcugccuaggacuaaaagacuugcuguauuuugcaggaggcuuccuuuuauaaccucaguaucuagggcaauauuucaauagcccuaauuauagcaaagauuugaaccucucaagcauauaugcaaaacuuaauguauacaugagugggccuaacucaugauauuugaagacuuaucauuuuaaccucaugaacacuggagcuuuugucaccucuaugcuuuucuuaaacuuaauuucaacuaggugaugcuuugccuaagaaauaauauagauaagugacggcccaucagauagaagcuuggagagcaaaugcuguaggcaccacagcagggcaggcauagaaagcugggcaaggaaaagggguguaaagacaauccaggcugaucaggugccucaagugaacauucucuuaaugugaucaaaugacuucacaugucauaaugggccguagcuucagcuguauuuucuuucacacugccagauuccugggcuaaaaggaagccaagaggagggaguaaaaggaagcaaagaagauuugauaaauaagauuagguaucuuauauaauccauauauuuucauagauauggauugaaaaaguuaucauuuugagaugugguagggaccacccaggaauuagcauuuugugcaucuuuauuguauuaaguggaugggagaaaagacaguaugaaucugaauacagaguauaaaugugaauaagaugucuauucuagccuuuugagagagggauuuuaaauucuuuuuaguauuuaaaacuugagucaaugaccuuuugccuuaaggauuugauauuauuuugaagcuacuuccaauuggcccauuucaacugaauuuaaauuuaauucuuccaggucucacuuagaugcucaauaagacauuugguguuuacuuucauauugucaguaugauuuaacuguugguuuuacauuuugaauuuuuauaaguuugaagucauucuuuaaggagauuuagaugacuuaaauauacaaaaauggcuucugagccuguuuuuccuacagagaauacaauacuuuaucuugacauuaaaaaaaaaaaagggagugaguuccaaaaugggaaaaugcuauugugaaguggacuucucaucagaaguauauggguuccauagcuagguuggccaguuauaugauauggaacaaguuacuuagucugucuacuucuuuguuuucucaacuauaaguaggaaaaauaaugauacuucacuauagauuuguuggccaaauuaaauauaguaguacauggaaaaugcuuagcaaguaccugacauauagcaaauucucacuaagugugagcuucuguuacuaauaauaaugaauacuauuguaaaaucccaaaggaacuugggagaacuugacaaaaggauucuagaguucaauuagaagaauaaaauuauaagauuauacaggugugaguuuccagcccaagcugaggucugaggggaauugaugggguaguggguagcugaaagaacacuugagagaccacagguaggugggacauggcuuuauucagcaacucacucacacuguuggugcugcauuuaugcaccucccagacaauaguggcucagagccaggugaugagcccucccauguuauggcuacguagauaugauuauauaaugcacaggauugugcaccugcacuccaauccugcugugucaugcugugccggguguguaccuugggcuguacuugacugcagugcagccauuguccuuauaacaggaaauuuuuaaaaagaaagaguguguaacauuugccuuuucagauuauucauuauuaagcaaaagugaaugacaauagugcauacucaacuuuggccuuacaggcaccuuuacagaaaggguccuuuuaagaaaaaauauuccgaggcaugaucuguuuuccuagcagucucucuuaguccuuugauaugcaaguuauuuucaucagaaacaucuaucaugucaucauuguugucaguuuucuuuucuuuauugucaacugaacugacugccagauuuucacugcucacuggccuugcgugugacaggcacaguucuccaguaacacuuuaacugcauuaaacuuggcauaauuugcaggauuuauaguuuuccucugcagccaauucguguuguauuugcaguaauuuccuacagucagugagggauuaaccaauaaaauguugguagcaggcagagauucuucuaguguuaaaugcaggaggauauuugaguacagacuaauuuuagaaguggucaguuuuugaguguguaucuuuguguuaugcuucugcuuuucuaugauuauagcaacugggauaauuaaaacuuccuuaagcaggaggauccacccucuuccccucaauuauauauguaaaaacuuagaauguguuaaccuuaacucuaaccacaugugcuaaugugacguuucaaagcaaugaggagaggacaagaauuaguuuaaaaauaguguuggaaacuggccaaccauuuggagagaagaaauagauucccuaccucaucccauaucacacaauacauuucagacaaauaagguauuuaaauucaaaaaaagaaauuucauaaaucacagaaggacauaaagguggauacauugauauggaagcaggauaggccuuucuauguaaguuagcagaggcaauaaacagaagacugagcuuuuguuauagacuucucaaaauuggguccagaagaauauaaaccaagguguguauuaaugauaacuaucccugcguguuagaauuacagguggugucugagucuccucuugcucuuucucuuccauauauuuuguacauuuucugaaaaugacauauauaacuuuuguaaaaaggccccgugauagaaagaaccaacaggaaaacaacuauauaauuguaucagaaauggugguaaggaaacaacaagggcuaauucauaagucaggaaaauuaauuuuuuucaaaaggaaguuauuaaaagggcaaugaccauguguuuauggagcguguuuguauuucaguucucaugaacuaacccaaguccuuugcaggacugcagaaaugugcgcagcuguuuuuuggauucucuccccucccaucucuguaucuccucuugagcauaggccaagucauucaaguuauugaucucugacuaauguuucaccuugucaaagugacuccauaauuucgcacuuugcuuauaauccauuuuacuacuuugcagcauuuuacaaugagacagguuuccucauagaacauucucauucuuuggcuucucauucucucauucucuguggcuucuuuuucccuuuucugucuccugacuauugguuuuccaucuucgugcuccccuggacagucucaucaagcuaccacuguaauucguaugccuucugguuggccucucuuccaagcuccacaugucuccaccaauacuccuucaggcaauuccacaugccugaaggaaacucaccuccuucuguaugucugaucucaguguaugauguuacucaaugcccaggccagaggccucaagaaacaaccuugacucucuguuucucuuacucuccauauucagccagucaccaagaccugaugaugcuaccucccaaauauaucucuuuucauggcccacacugcuauuuccaacccaaaugcccaucaaucaaugauaacacucuuaucgcuuauuuagacaguuaaaaugaccuaucauucaucucuguguuaauauucugucuucauuuucagugcuaccauaaaaaauaugacuauuuguagcaguauuauagccaaaaaguggaaauaauccaaauauccaucaacugauaaauggauaacaaaugugguauauccauacaauggaauauucuuuaauaauaaaaauaacugaaguucuaguacauacuacaacauggguaaacauuaaaaacauuacgguaagcgaaagaagccagucagaaagaccucauauuauuauaaagccauucguauaaaauguccagaauaggcaaauucaaggcgacagaaaguauguuagugguugccuaggacuaggaguaggggaaugagaagugauagcuaaugaguacagaguuuccuuuuggguaagaaaaauguucugaaauuagauuguggugauaugacuauacuaaaaaccauuguguauuuuaaaaggguaaguuauauaugaauuauaucucaauaaacuuguuuaaaaacauuuuuuaguguaaagauaaaacauguucuuuguauauauuuagaaaauucaggugaacuaaaagaagaaaauuuauuuauauuucuguaaguuauugggguacaggugguauuugguaacaugaguaaguucuuuuuuuuuuuaagacagagucucacucugucacccaggcuggagugccguggugcagucucagcucacugcaaccucugccuccuggauucaagcaguucuccugccucagccuccugaguagcugggauuacaggcgugugccaccaugcccggcuaauuuuuguauuuuuaguagagacgggguuucaccauauuggucaggcuggucucgaacuccugaccucgugauccacccaccucggccucccaaagugcugggauuacaggcgugagccaccgcacccagcccaugaguaaguuauuuaguggugauuugugagauuuuggugcacccaucacccauguauacacugcaccauauucguagucuuuuaucccuugcccuccucccacucuuucccucaaguccccagaguccauuguaucauucuuaugcauuuguguccucauagcuuagcucccacauaucagugaaaacauaugauguuugguuuuccauuccugaguuacaucacuuagaauaauagucucuaaucucauccaggucacugcaaaugcuguuaauucacuccuuuuuaugccugcguaguauuccauuauauauauguguguguguguguguguguguguguguguguauauguguguguauauauauauacacguauguauaugugaguauauauauauauauguacacacacacacacacacacacacacacacacacacacacacacacacaguuucuuuauccaguuguugauucaugggcauuuggguugguuccaugguuuugcaauuguaaauugugcugcuauaaacaugcaugugcaaguaucuuuuucaaauaaugacuucuuuuccucuggguagauccccaguagugggauugcuggaucaaaugguaguucuacuuuuaguuuuuuaaggaaucuccacacuguuuccauagugguuguacuaguuuacauucccaccagcaguguagaaguguucccuguuuacugcauccacgccaacaucuacuguuuuuugauuuuuugauuauggccauucuugcaggaguaaggugguaucccauugugguuuugauuugcauuucccugaucauuagugauguugaccauuuuuucauagguuuguuggccauuuguauaucuuuuuuuugagaauugucuauucauguccuuagcccacuuuuugaugggauuguuuuuuuuuucuuaaugauuugaguuugucguagauucuggauauuacucccuugucagauguauagauugugaagauuuucucccacucuguggguugucuguuuacucuacugacuguuccuuuugccaugcaaaagcucuucaguuuaauuagaucccagcuaauuuauauuuguuuuuauugcauuugcuuuuggguuuuucgucaugaaauccuugccuaagccaaugucuagauguuucugcugagaaaucugcuauuaauuugauagguuuuccuuuauagguuaccugguguuucugucucauggcucuuaagauucuuuccuuugucuuaacuuuguauaaccugaugacaaugugccuaggugaagaucuuuuugcgaugaauuucccagguguucuuugaacuucuuguauuuggucuaggucucuugcaaggacagggaaguuuuccuugauuauucccccaaauauguuuuccaggcuuuuagaauucucuucuuccucggguauaccgauuauucuuagguuuguucauuuuacauaaucccagacuucuuggaggcuuuguucauauuuucuuauucuuuuugcuuugucuuuguuggauuggguuaauucaaagaccuugucuucgagcucugauuuuuuuucuucuauuuauucaguucuguuucugagacuuuccagagcauuuugcauuucugaaaguguguccaaagauucuugaauuuuugauuguuuuuucuuuaagcuaucuauuuccaugaauauuucuccuuucacuucugguaucauuuuuuggauuuccuugccuugggcuuugucuuucucuggucccucccugauuagcuuaauaacuaaccuccugaauucuuuuucagguaaaucagggauuucuucuugguuugcuggugagcuagcgugauuuuuuuggugguguugaagagccuuguuucaucauauuaccaguguugguuuucugguuccuucucauuuggguagucucugucagagggaaggucuauggcugaaagcuguuguucagauucuuuugucccaugggguguucccuugauguaguacucucucccuuuuccuauggauguggcuuucugugugccgaacuauagugauuguuguuucucuucugggucuuagccacccagcuagucuaccuggcuccgggcugguacugcggguugucugcacaaaguccuguaaugugaaccgucugugggucucucagcaguggauaccagugcauguucugguggaggugguggagaguucaauggacuccauaaagguccuuagcuuuggugguuuaaugcucuauuuuugugcugguuggccuccugccaggaggugguacuuuccagaaagcaucagcuguaguaguguggagagggaccggcaguggguggggcccuagaacucccaagauuauaugcccuuuguuuuccacuaccaggguggauagggagagaccacacaggucggggugggacuagguguguaugaguucaggcuguccuugagggggucuuguugcagcugcugucugggaugggggcaagauucccaggucacuagaguuguguaccuaggagguuuauggcugccccugcugagucaugcagguugucagggaagugggggaaagccaggagucacaggccuuacccagcucccaugcaaacugaagggcuggucucacacccaccaugccccugccaacagccccgacucuguuucuaggcagagggcgagaugagcuugaaaauuugccugagacuauccacuucccagcugugagagaaaagggcuuuaguucuuccucugccuguagagucugcaugcccgauuugugcccucgcccaaguucugaccaggaggcuucuugucccuagccuuucuuguucaaauuguuacaaaguucagcuagagaauuccuucucccuguggaguuuuacccccuguuccucuggccacccucgcaauggaucccuguggugccaggcagaaaugggcuacuuggggacccagugagcuccuagggccuuucugcugcuuccucuaucccuguauuuugcuuggcucucuaacuugacucagcuuuaaguaaagucggaaacuucucccacaaaccuucaguuucugcaguggggguguguguucgggacaggagggucucccuuucccacuucugcaguuggggcacucacaguauuugagggggucucccaagucuugcuuccuugagggagucuguggguccucgggauugcugguuuguucuugcaggcgaucugcagcuaaaauucacaaugcaagccuccccguacugcucuguccggagcugcaaucuaguccugccucccgucugucaugauccccugaaucgaaaauuuaaaaucauuaauaaucuaaccauucugaaauagauauaaauccaacuauuauucaauauauguaaauguuuguauauguguauacacucacuacguauguguuuguaugcauauccuucuagacuuuuuucuuugcauauguguacauucuguuuuauaaaaauuggaucauacuauaccuacugcuuuauaauccuuuuuuuuuuuuuuuuuuuuuuuuuuugagauggagucuugcucugucgcccaggcuggagugcaguagcgugauuuuggcucacugcaagcuccgccucccagguucaugccauucuccugccucagccucccgaggagcugggacuacaggcgccugccaccgcgccuggcuaauuuuuuguauuuuuaguagagacaggguuucacuauguuagccaggauggucuugaucuucugaccucgugauccgcccaccucggccucccaaagugcugggauuacaggggugagccacugcgcccggccuauaauccauuuuuuaaacuuucauuagguuauuucauuauuaaauagcauacauuuuuuaaaaagcuacauacuuaaccaguucccuuuugucaaacauauaaacugcuucugauauugguauguacacaauuacuuaaugaauauucuuguagcuaaaucuguguacauccugaugaauuuauacuuuuccaugaauaugaauuggagcugguuauauuacuucucugcuuuagaagauuuuauaguugccuccuaucuaccauauuaaauugaaauuucuaagccugaaauacuauguucuuuacauagaaauacuauguuauuuuacuagaacauuauuuuucuagccauaucuucuacauuuucuuccuuaggaccuuuuacugauacugaaauacucauuauucuccacacacaacaugcauuucaaguuucuaugcuuuuaaagaguucccuuggccuggagaggcagucuugaccugaugguaaaauuaccacuaauuucugaagacccagcugaaaugauguuccacaacgcauucccugguccuccuccuggaacugcuaguaaauuuuccaucugugcucccugguccccugagcauauggcuguuauaguacuuguguuauagaguacaaucauuuaauacauugauuccaugccucacccucagguagaagauguuggauuguauucuauucuucuuuaugaccucaauacccaauuugugccgcacaugcagacacacacacacacauauaguucaugcccaccauguauuuuuuuaaaguuuuuuauuuugaaauaauuauagacucgugggaagaugcaaaaauaauacauacaaucucauauacucuucacucagcuuccccugauggugacagcuacagagcuauaguugggggcaagaagaggacucuguagggagcagugaauuuuaagaaauucacauaagagaugguaucacuacuaucaaagauagcagaaggucaggaaggaucugucuauaacuagaagaaaaaauauaggaaagcaaauaaauggaagaaaaaguaggcuauugucaggguuuuaauuucuucuccuuuuguuuuucccuuaaaagacauuuaaagacguuugaaguucaggugguauagcaagaugagagugccaaaauccaauguuuguauuaaauggaaaacuuuugggaggcagaaagaauaaucuagaauauacauagacugaauaaaguuagcauuugagaagagaaaaagugagcacccagauauaugcuggguauacaugaaaaauuuuuuuuaaaaaggaaagcuuagugaagucuagccacauaggcuuuagagagaaguaaagucuuauaaugguuuuugacagagcgagagggguaaauggucagguuauaauuaaaucacauuaaaguugauuugcaauagccauuguggaaaggacaaggccagccauuuagcaaucgugcagcuguuuauuuuucuggagccauagcuuuucacuuucauaguucuuuuaccuccuuguuuugaaacauuauuguuucaaaaucguuuugaaagucaagcuauaguuuauaaauaaagagguguucaguuauugauaguaugcucauucuuauccaguguaacagggaguccauaaugagaugaauggaagauuaguggaaaaauauuugaaucuaggauuagaguuggauuugacagaagaagcaauuaggagcaacuguagggaaaggucuaccaucaaagaccucauagaauaacauucucccuguguguacuuagcaaauacuuguugauagacaugcuggcugguaacuaauuacaaugugaugaccaaagaccagcuucuuggaaguaggguuguuaauacaggaauagaauaccaggggaguuugaguaauuuccuucuuagcagauguuuauacuaauguggauacucaacagucuaaagauaauuuggggaaaaaaucugucuaaaaguagggggauaaauuaaauagcuuuugaaagacaucacuauucuuauuucuuuaauugucauguagauaacucuguaaaaugcccauuuuuaucuucacccaucuauaaaugugaacugccuuuuuuuuuauuauacuuuaaguuuuaggguacaugugcacauugugcagguuaguuacauauguauacaugugccaugcuggugcgcugcacccacuaacucgucaucuagcauuauguauaucucccaaugcuaucccuccccccuccccccaccccaccacaguccccagagugugauauuccccuuccuguguccaugugaucucauuguucaauucccaccuaugagugagaauaugcgguguuugguuuuuuguucuugcgauaguuuaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaagggaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauaugcaaccaaaaaagagccugcaucaccaaggcaauccuaagccaaaagaacaaagcuggaggcaucacacuaccugacuucaaacuauacuacaaggcuacaguaaccaaaacagcaugguacugguaccaaaacagaguuauagaucaauggaacagaacagagcccucagaaauaacgccgcauaucuacagcuaucugaucuuugacaaaccugagaaaaacaagcaauggggaaaggauucccuauuuaauaaauggugcugggaaaacuggcuagccguauguagaaagcugaaacuggaucccuuccuuacaccuuauacaaaaaucaauucaagauggauuaaagacuuaaacguuagaccuaaaaccauaaaaacccuagaagaaaaccuaggcaucaccauucaggacauaggcaugggcaaggacuucauguccaaaacaccaaaagcaauggcaacaaaagacacaauugacaaaugggaucuaauuaaacuaaagagcuucugcacagcaaaagaaacuaccaucagagugaacaggcaaccuacaaaaugggagaaaauuuucgcaagcuacucaucugacaaagggcuaauauccagaaucuauaaugaacucaaacaaauuuacaagaaaaaaacaaacaaccacaucaaaaagugggcaaaggacaugaacagacacuucucaaaagaagacguuuaugcagccaaaaaacacaugaaaaaaugcucaucaucacuggccaucagagaaaugcaaaucaaaaccacaaugagauaccaucucacaccagugaacugccuuuucuacuguccuaugaaauagcacaauggaaaucugaacucuguauaauuuucaguauucuuaaaaauugcaucgauuugccaaaagauagaguaucucaagaacacuggaguaucccucaggaagauauuuagcucugagguuuuguaucacaucaaaaauaacuuuucucacauauucuacuggcauuugguacuguuuugucuucaaauaugaggaugaaaaaguugauauuuauuccagcagauucuggcucuaaaaauaaaaucaugaagggauuucuacugauucauauaacaauuuuuuuuucaacuguuacucccaacuucugcuaccucaguguaucuaucuuuuauaguacgguuuucugagucaccuaaaacuuacaauaaacauacuuccuguuucuuuuccuucaaguucuacucccaguaucugcucgcucucugagaaauucaguuuccaacaauaagaugaauguuucuguuuucaguguaaauuugugaauauuauuaaaguuuuauuuuuuuuguauuuuccuuuagauuuuagggugccuagauaaaguauuuuaauuacuuacaagcaacucauccaaucaauuacucaugugagacagucauuaagacuuauuuuauauugcauuauuuuuauuuaaauuuuucaaauauaugcauaaugugaguauccacaaguaaauggggcagacacaacaauuuggccuauuccucuggcuuaggccuuuuaauucuggccaauauaacuggccuaaaauaggagcaacacucugcuucugacacuacucagccacaacacgcaaagaugacguucuuuagaacugucaugcugaaugaagccagaucuaugcugccaaccuuuaaaaaaaaaaaucuuuucauacugaacuuuuucuaaaaacaauuuuaguguguuuauuccaauaaauuguuggaauagucaaguccugauuuaugugucauguggauauuuuuaaacaauuaaaaauuaaaaugaaaaacaauuaucuuguuccuggugguucucagaacauaugaauauccaauucuaaaaaguaaacaccuuuaguuguauuucuguguacaggaugucucaacucuguauauuauuuaaaauuuagccuuuucuuuuagaaaugcuuaauuuuuuauuuaaaaauaauuauuuuaguuagcuaggguuuuuguauuccuuucaagucugcuuucugagccauacuccagugucauguggaaaauguuaccaaaaaaauaaaaugaugucacuuuaacuuucagaaguuaugauuuaugcuaauaccaauaggaugguuuuuauuuaguacagguguuugcuuguugguugcucuaagauauuuuuagcauuuguuaaaaauaggcuugggagugacugcaguuguaaaauaagaagcaaauacauuguccucguaaggaucauagcaagggggugccaggccccaguugacugccgcuauaguuaugagcaaauguggugauagauauuaagggcugagguguaggagucuggcuggguuucaaagaaaaauaaaauuaguugcagcaguaaacggagcaccuaaucaguauaugugacuauguacuguguaaauaaauuaccugauauuuuuaccugcuuuugaaagagaugaaucuucccuuucaaaauaagauaagacaccagauugugaucuuuuuuaaaacuuaaccuauuaacucauggaaaaucacuuagcuguggaaauuguacacuuuguacauuauuuccauugaaaaacacaacauauaccagccaagacugagaccccaaggugaaauuuuuugagugcuuacuauguuucaggcaugguuccagguacugggggcacagugguaaaucagacuaauccaagcccugcccucagggaauuuauuauguucuggcaggggacagucaauauacagggaaacaaauuucagacagcgaaaagugcagugcagaaaaguacaucaagacaaggagaaagaaugccagcuguugaccauuugugccacaucuuucuuaugacuuuuuuucagucauuuggugaaaugagaggauggcauauuguauuauuugagacagauuccuuuugugaugguuaaaauaauuauguuuggcuauauaauauaauauuauaguuuaguuuauuacuguuaauaguaauauuauuggaguaccacaguuuuugaaguuuucugaucaaagaauauguuucaauuuuagaaaagaagccaaagcaauucuugagaaguguuccuaaaaaauaaauuagauaacauaucuguagugaucauugaaauguuuugugacauaaaagaauuuucauauuauuguuuuaucuuuauuuugaguuuuuuauuuuuauauuauaucaugagccacuguuagauguccacugucuguugacaucagcuuacuacacuauaauaucugauagcagagacuuuaucauucauuuccacaucucuagaaucuaauacaauuggaacacagaagaugcucaacagaucuucgaguagauuugaauugaaucacuuacgugaacauuauuccuucccuuucucaguuucuuaucagucagcucucuacuccuccccaccucaccuuccaacacauccacuccacuuccauuggccccuccaccagcccuuggugcucuucccuugaaaccccauggguuucucucuuggauuccuugucaguuuucagcccugagucaaucuuuggcuuuucuuagaucaacucugcaacuggaaauuguuacuaaaauuaauuauaaaacuaccuccuuucuggcuguguaacuucaccugggcccuucugugcuaaucuguuucauuuacuuguuucuaauugauuucguaucucauucccaacagaaguuaaugccugucauuuugcuuaagcuccaaucucaucucaaacugugcagaagaccuuacuucuacugcacuaugaaaaucaaagcaaacugcccuucccauccauuuauuucaaaauuuauguguaauuuuauuaaucuuuugucuuucuguucuuucucagaagaugacuugguuuuaggauuaaacuuagacuuguuaccguggccugcagaacucugcuucugucucuccauccacuucuccaccagcaauuucuucacaauucuccuugcccauucugcuuuacccacacaaaucuuccuucacuucuacucaccaagcguuuuccugccucugguuuugcauaugcuguucacuuugccuugaauacuguccucuauccauucccaaacauucccucuccuguacccgccccacacugucucacuggcugacuuauagccauucucagaucucaacuuaaagauggcuuuucuguaagaugucuucugugaccccuauuauucucacucauggucucuuggacuuuuucuuuauagcugaagcauaguucauaauugcaucuucauugugggcuauuuaauauuuccccacuguauucuaaguuucaugaagagcuggacaaugucugcguuagcuacuaugguauagcuuagugucugccauguaaugggugucccaaggaaagcugaugaaugaacugcauccucuucuauuuccuguuuuccucagggaccuuguggccucauauuugucucacuugaccugucuacuauauauuuucugcugucucccucccauuucuaaucuuuguucacuuuuccucuguuccaguaaugcccucugacucuucauguuauuauauuaacuauuuuauuuucauucccuuccagaccuacaaauuguaccaauuguacuguggccucuuaaagauaaauuuggaauuaagcuaaauagcagcaucuguaaauaauuccucuuuuggucaagagaacaguauuaggagcaucaauauuaacaaauguagaguucuuaaaauggggaaagaauauuuacucaugaauaggacaauuuuuaaaaguuuaacagauuuuuuuaaaugcuacugugugcugggcucuaugcuaggcauugggguaugaugacuaacaagagagacaggauucguacccacaggagcuuacauucugggggaugagccggauaauaaacagcuauacaacuaaacaugagaauugcagguuauauuaaguacagugaaacaaugaguugagagaguuugugguggaggcuacuuucgauagggugauuggggaaggcuucugugaggagaaggaugaagaaaugaggaagcaggggaauagcauuccaagcugaaggaauagaaguuaaaggccgggaggggagaaagggcuuggcacauucaaaagacacauggucuaucuggcuugaucuugaugaggacaaauggcagggagaguuagauuguguaauguuccuuaccucucaugguaaggaauuuagaugauagugauccuaugaguaguaggaagccaucaaauagucuuaaguauuacagacauuacauaauuugauuuaugccuuuaaaaauuacuguggcugcuauguggggaauguuuuggaaaacagcuggaauggaaaccaggagcagcugaagagacuauuguagaaauguaggcaagagaugagguugacugggguuauggcaauggagauagaaguacaaauaucuacaguguguuuuaaaggcuagaauacacagagcuuggugcuggauuguguguaaggggugagauaaagggaggaagcaaagaugacuccuggaauguugccuuuaguaccaagguggacaguagugcuauugguaaaauggggaagucugagggaagaacaguguguguguaugugaguuggggagggcagaaucgaagacucaguuuuggcuauauuccauuugagaggccuaguuggcacccaguuguagaugccaagugcuccggagcucaggggaaaagccugggcugcagauggacugucaggagacagcagucuauauaugguauuugaaacugaaugggcuuucacuuauauggagagagaaaagagaggaggagcuugaucuaaaucuggaggccuuccaacaucuagaggucagguggaagggcaagagccaacaucggaaauugaagagaagcagccaaggaaugagaaagaggaaaacucugagaaagcagccacacagaagccaagcgaagggaggauuuccaaggucagcagauggagcaaggugagggcaggggugggagcuuacauacuucuaccugagauucguauaaauuuguaacauuucuccuuuuauauauucacuccuucucuuuccuauaaaguuuuaaaccuguguugcuaacuuuuuuaaguauacagaauauagccaauauaaacacugucucaaaugaaagagcacugccccaucuuguuauuucaucagagggacacauauccagacccauuccuaauuagaaugaauaaacaagcuucuuguuuuagguccaggcuuuucagaaucuggcuuaauuguguugucuucucccacucuucuuuaucuugaacacuuaacuacauuuaggucaauuucuuuacuuauuccuuccuuacauucaggugcugucacaggcaauggaaaaauaauggugagcaaagcaggcuuggucucugccaucauggagccuguuuuuucagauaaugaaguaauuaagcagauacucaauuacaaaaugagagaaauaguaugaaggcaagagaugauggaggcucagacuuuggaagcagcaagcgugaugaagaggagcaaauggguaugagaacuuuuucaggagauaaaauugagaggauuugguaguuaaaauugagaggauuugguaguugauuggagauaaggauugaggggaaaggagagguaucagaaggaacccccagauugcugguucuaguuggccaaugugucauucaucaagaagacaucuuuggaaaagcauacaguuugagggagacagaucaucaguuuaguuuuguacauguugaauuugagagcuuucucauguuugcuuuucuuacaggaagccuucccugaauauucuacccuuugauaauuauucuaaugcuuaucgauuaauuauuagcuguuucauaugcuucaacuuaauaauuacugccaguauaucucauugucauuucaugucacacuguguuucucuaauugcuauguacguguguuuuaagugagaguagaaaauccauguggguacaaaauacaugauuacuauuuuuguuuaucuaacugaucacacuugguagugcacaauguuaugaaguaguacguauuuggauuaccagugucacuaagugauuuccuugagacacagccucauuucuuaugguuaauucaucaucuacaaaaauuuauuagacagcaagucucucucacggcaauaggagugaguuuauuaacaggaagugaauuauauccuccgauguacuagaggaauuuguucucuaucuggaacuacuuucuaauuaaagucaugacaucccuaccccgacuuacuguguugaauauuauuuaaccacgccucaagucaaacacaagggugaugagcccuugagaguuuucccagucuuauguuuuccuuucugugaguuuuccuuuaguacauuacaaaacaucaucuaaauuugugucuuuaauagaauuugauagccuucuuuauacuguuucucaaauuagccucagaaauuucagcauuggaaaauuaguauuuuauuuucccagcuguuuaaauguaauauauuugaagacagaggcacuguccuguaaguuuauagccuaaauaaaucuauuuuaaagguguacuggucagaggccagguggcauaaugggaugacauaugagcuauucacauuugaagaccuggcacuaaauucaacucaagaugccaggaaaaugacuuuagaggugucaauuugcuggaguccuuggugggcaucugagaacaucacagaacugcucuaaggucuaacauaauguauccucuguaaauuauauugccacauuagccaccuaagguacaaaagggcaguuugaaugacuucaguagacauuccaaaaucuaguuuuaaugaguaauaagaaguacaagccugucuacaagaagacuaaccuaaucuaaaggguucuacgugggacugggaguugaaauguaagcuuuucuaugucucugaucuuuaucuggcucaucaguuauucagcaaguauuuacuuaagcccccuuuucugagccuuugucauuuuaggcaugaauuuuauaacaagaccaguugccuuuccucucccuggcuucaggucuccuacaaaugccaauaauaauauuucaaagaaaugcuuugaagaauuuauuaguucuccaaaaaaauaccaugauaacccugucuagaauacuuguaaaaucaucucuucaauuaucccaaggugcuuaauuggaccgcuuaucugaagaucuuuuacuuuuuuucauuugccaagaaugucuaguaauuaugcacucaguuuccauuugaguagcuuuucgaauuagcuagaaggucaucaucauuacuuuauauuuaauaucugaaucuaagguuucugguuucuuuauuguaguaauacauugugugcuauccagaaacaucacuuaauuugagaaagcauaaaaugcucaaagguaccauacuuugauuuuuauugugaaaauauauuucaauaacugacagacuuauucucuacaaacuugacccauuuaguuucauuccuuugcaauuaaugucaguccuuuggauacaauggacugguggaccaugccagcugaugagggguaauccugggcauaguggguucucuuucucuacucaacaggcagguuuagcaugaaacuaaucugcacaugaauuuguggcauuucuaaggagcgcaucuaaguugauaaugcugcagucugcuuccagacucuuuuccaacgauccugcaguuggcuugggacauccuccguggauugcaagaugcuggaagauaagcagaugguuuuucacuugaccucucugaaccacaguuucuuuuucuuuaccuccaacuauuaggaucccaggauccuuaucuuagugagagucuauguuguaauccuuaccaccaccaucccaaguucaagguuauggccuguggccuugcuaguagcuuacguagagcccuuugauggcucaugaagucaguucauagaaagaagugagguaaacugggaacaaauugaacauauuuaacugaagaggugauuuugcauuaaaauauaccuuuauuaucucuuggaaucaaaaauuauuuuauaaauccuuauugaauacguacucugugcccauucugauacuauauagccugcauauauuauggggaacaaaauagacaaagucucguaaaguauccauccuagugggaagggaaaacaguacacaaacaacaaaaaagaucauuacuaacuguuguaauuagaugaaggcaguaagcaggguagugugauaagaguaaauggcaggggagaagauacuugaggaagccuuacugaggugggggcacgugaggugaggauggaugggaaggagccagcagugugaagaugcacuugaugggcuugggcauggcagggaaggcuagacauuccagagagagggaacagggcaggcaaaggauucaaaggagguacgaaaggaggccagggugacuggggagaaugaugugagauggcguuuguaagguggacuggggccagauuauagaggaggccuuguuucaaaauuuagguuuuauuagaaaugaaaauucuugaaacaggccuuuuuuuuuaugaaccuauuaucucuuagaccaaaugaaaggugacaguuuuaaccuugaauggccaaccugcauucauaaucuggaauaauugugagcagaagcccgcagcauguugaaauagcauuauauuauauucaaaggcuaaagacugcucaguucucaggcauuuaucacuugaaaguggagagaguagaaaaguuuaaaaggcuacagcaauaacauuugagaaaaugaauaauuuagagaaugaaaucaugacuaaugaauuuuuuaaaaagacuccucacuugugauuagagauucauaauuuucauuuuauagcaaaauauaguuggcugucaugcauuccugaccuucuuccccuaaguacaauugggcccaacacauuaaugccuugaugugcagacuuacgacuagcuucuuguguugaaaccauuaaauuuuaauguauucagcuuaagcguaaguggucauagaugauucauaauggugcucccugcuuuuggugaaaaugaucaucagcaagagaauuguccccaguggccacacuuaucuucguagaugauuuccuaaacauuuuuugugcccguagaagacuaggaauaaacacugcacagcuguuggguaaagcacuaugauaauugcucagaaaccgcaggguauuugaugaagauaaaguggaacucuguaacucuugacauuuuauuuuuuaauuccuggugucuuggggguacaagugauacaagcugcucuuuaagaauggaguuagccaacgaugauuuuuuuucuuuaagaaauauaacccaagaguagcccccaggauuaugacuucaucauuuagcuguugggcauagaagcaggaugagccaggaggcuugacuggccgaagcuucagauagcagccuuacccgauaaaaacaggauugugucuugggaauaugagacuuaacagccugguaauuacucgcauguucaccugaccuaaccacuauccguguacugaaaaaucgcagccaaauaugcugccagcugaguuuacuuauauuaugcaaccccuauagacacaugugaucugaucauaucccucuagagcuugaaguccuucauugccuucacaauaaacuccuaauuaucugccacgacucgugagucccuucauaaucuaguuccugugucuccagccccuucauucuuacuugccaccagcaauuaugcugccaucauucucaccuaucugcagcuuccagaaggaugcauauucuccuuuguucccagaucucccugauccugggcauauuauuccucugcccaggauucccaucuuuccuacugcagcuggcugacuccuguaguccuucauaauuccaauauugccuaacgccauucaugacucuuccccugacccacaacaccccucucuaucaguuuacccagauaccguaucugggauugcauuguauuauagagcucuguuucccuuaacccaacccugcagugggauccuugaggauagugcauguguuuuguggcuuugguaccccuagcgcuuaacauagagccagcacaugguagaugcuugcugcaggacggauggguauauguaguauaucucuuuccuggcccugaaauuguguagaacaacuggauuuucuccaaaccagccuagggaucauaguggauuauucuggguaggaacaagauaaccaaacuuacuuuagucuucccaucacauuacaaacaauucaacugcuucccuuucuaaaugaagacauuuuuuccaaucccuuuguuuaaugaaggaacacaguccaaacuugccguuaacuuugugaaaucaccacgagaugcauucauuaacuauuauaagauuagccacaccuggguauaagcuuugguucaggugcuuugagaauugcuuuuauccaagcaaggucaaaauaaaacagugcugcugcuuacuucccccucccccguucacuguugcuucaguggauguaccaaggagauggucugucucauuaaauaaagcaauaguauuuuaggacuggaagauaaaucuaaaagucuccauucaaauacuccaggcccuucugcauguaaaaccaccccagaaagauagauguuuauucuuaagcaucucuagggauaggcuuccacagcccucucaauuauguguuccauuaucucaccagccuucucaucaggaagguuuuuucccuuaauguuuaacuuuaaucccuccuguugcaauuuaagcucauuuccuuuugucuuggcuucaguggaaauaaacaauacucacuagcaccuacccaucccuauuuuuaauugaacaugucugacuuccccaggcagcuuuuucuuucuagugcuaaauggaccccauuuugccuuuuucuccuuaugcuacuucuuggagacccuuccuuuuaaaacuugcuuugcucuuacugcaacaacuauuagggacuauacauuucaagucugucguuuaauccugcaguucauuuuucuaaucuaccaaucugugugaucuuaguaagccaccuaauacacugaagaagaauugauggacaccauuuuaaagugcuuuagaguuguggaguucuuuucuaagugaacugcuaccauuguccaauauucuucucucuccgcccaacuccacccugguuuuccuacuuaaggguaaauguuuguccugucuuauuuccuacuucuucaugcauaaguuuaaugcaggccaugaugacaguauuucugaguccugcucugccaagauagcucaaaggauggaggaagaagaaaagggaacaguuuucucuuuuccucuagccuuucccaaaucguagagguaguagccaccugaguugacagaaacgauaaauucccagcucuuggaacacugaucuuuuugggacucugagaugagaauuugggaaugauaugaggaggaagaugagucagaaaauaaaaauaugccgugcauccaccaccuaaaaauagagacuucucucuaaaaacuagagaggagaucauuaaaagugugaaugagaauuaaacggagucaaaaacuagaacaagagaaaagaagaacaggaagaaacagaucugaucaaguaugaagaaggaaaaaugcuuuaauuugugaucuuccaacaggacaaugucaugguaagauuucuuauuaaaauuaaaccagcugaaaauuccagaauaagaacagugauuugaauuuguaauacaaguacagcaguauuuuccacugauggcuauguacuuuauguuauugauucaaagauauuacauagacauguuaccaacaauagucuuuucuuucuugaaaaauagucguuauuaauuuuaccccuuaacaauucuauguagucugaccuuuuaggaauaauccugggcugaaaauagaguugccauugaaauuucaaaguaacuucaauuucaaaguaggaauauaaguaguaguauguuuuauucuauuaauugaagauuguauuaaugauacucugccuuuccuauaacugugccauauagggcauuucaaagaaagacuaguugacccuuagauuuaccauugaaaaucaaaggaugaaauugaaauguauggcugguggacugugaagucucugugguauauacaacaaagugauaaaaaacauauaugguaauaaucacuuuugggggauuccuuaaggagauauuucuuuuuaaaugugcaugucuguaaccuaggacuauucaaaauuaacaacagcuacucaaaaggaaaugaaauauucuuuucuccugcuucucugaaaaggcaccauuugacuaaaguuucaaucugcagacaaaauagaauuccuucuucccccaaauuuaauuaauuggcuuccgcuaggucaaggaggugccuuauuauaugguacagccccaaauccuaaacugaacuugaaacagcuaaccugugaaagcugaaaaagccaaaucgcuuggaaauguagugacagaagccauagaaaagggaaaggaggcugggcgcgguggcucaugccuauaaucccagcacuuugagaggccgagguggguggaccacgaggucaggagaucgagaccauccuggccaacauggugaaaccccgucucuacuaaaaauacaaaaauuagccgggcaugguggcacgcgccuguagucccagcuacucgggaagcugaggcagaagaaucacuugaacccaggagguggaagucguagugagccgggauugugccacugcacuccaggcuggugacaaagcaagacuccaucucaaaagaaaaaaaaagaaaaagagaaaggagaccauucuuaacauauuuuuacaaaaccaagaaaugcucauuuugaugacauauugaugucauguugaugcaauggagaguauagguauaauuauuauuauagaguguauuuuuaaaauuuauauugcuaaagccuacagauugcaaugggucuaggaguguaaaucagaaguacugucaaaacaguacuccagauguguugagucaucucuggugucaaaaggauaaguucagauaauaaucaaauaaaggauuugcuagaauauguguaggcacucagucugauuuauguucccaguuuuaagacaucuaugcauuucacuucaacuuuaaaccaaggucaagaccacuggaaccugggaucuggaaauggguuuauuguuaggauuaguaacaguuguuuuguuucacaaacaacuauggccaucauucuaagagauugcuuuuaaaagaauuuacgaucuccacugacacaggagguaaagucuauacugaaaaagcaguucuauuugagcuauuucugaugucauucugauccgaaauaaggacauuugauuagaaaauugaauuuugauaacuuuguuauggccuauuguacaacuacucucuaucuuagcaugaagauaguguggugcuuuugcugccaaagaaauaguguguauuuuuggccucuuuuacgcauuucaaaagcaacuuuuuauucuagucugguguaaaauugauucucaggugaauaacucaauccucuauuccuguugaguugcacguauggggucacuguagcugcaauguguauuguaagugauggucgagggaaggaaugucugaguaugacugcaauauaguaucugugccaaucugcauucggcgcuaaaacaaagucaugagaugcgaagugcgagcuucuuugaacaguguuuacagcaggccuuauugcaugaucagaguuucugagaaagcagcuaacuuaagacugcagaucucuguauauugcugccgauaagaccacauacuuacuggaacuuaugcuuuauucauuuuagcuuugaaagauuuucuaaaaaucuugccuggaauucaucaauucuuuaaaaaaaauuucauuauguuacugaaucuugcuuuaaagaugaagauugucuucuuuugagcuaucaccuccccuucuuuguuuuauuggcaaauuggagagagaggagagauaucuuauuuauuuuaucuuaguuacauuauaguguaauuuaucugcuauagaccuauucuuacacuauccacccauggcacccucaucaccauaguuguaacucaccuguaauucgucuugcauguuugacauuggaagggauuuuaauacaacacaaacaacaaauaauuaguuggaaaugauguguuauauuucaggggcauuauauauggagacaggcugaccuggauuuguauucuagccuaucacuuacguugccaugugauuuugaguaaguaacuuaaccuuucugggccuuagucuccuuaucugagaccauaguaguguuguaaggacugaucaagauaaugcauggaagacacuuagcauaggaccuagcccaugggaaauguucaauucacgaugacuuuucguuuuauucugauuauuauaauggaaaggugauuuauucuuuuuuuugcgucagauguucugaaacugcgauagaagauuacauaaauucuuggcugucacuuuaaagcccugauccauuucuucuggaaaagaggugaaaauguaaugugugcucauucugugaugagaauaacaacaaucucacaaauauuucuauguugccuuaccaggcauuugagauugaaagcagauccagccuguuucuccaaaaacugaauucauugcugggagauaaucucucuuuuugagguaaagaaugauuuguacuaauuuuuuggaacuaacacuuaagaaucccuggcuguagaacugcaguguagauauaacaucaaaaggaaauauuuauauaauguagugcaugaggcuacacagggaagugaaaauagcuugaugguugguauuaggugaaccuauuuaaaaucuagauucuacuuacuaaucauuugcuuuggugucauuucuaaaauggugguuauaaugccuacuucauaaggauauugaaauaucaaaaaagauaacauauaugaagugccuugagcuagucuuugguacauagucgaugcucaguaaaucuucauugucuucuguccuuccuacaguguuucacauauuuccauguacuacuaucucuuuuuuacugacuugucuuacuuuuagacuuucugaccuugagccuucacuucugagccauuccuauguuugcuuacuugguaugaggaagccugauucugucacauaaguugccuauuagaguuucaggaaaaugcaacuuaaagggaaauuaggugguaacuguguacuggcugaaacauuugugagcucccaaaaaaugcaucacugccagguaaugacuucuguucaauaagucuauguagucaacagaaugauguuauucaguaguuuauuuucuuuuguuguuuaucuugguucccugucuuuuuguuuuccagggugcaugaugauagcagagauuguuuuaaauucuauauucaguucagagcuucuggguuguggguauugucuugccagugaaugugaaagacaggcaugucaucacuuaaguuuuaacagucuaucuucaggucugacuuggaaacuugcauaauagccagcauccaaauaggguugaaggcagagcccagaucaauacaaaacauuaaggcuaucaguaguauauauauauauauauauauauauauauauauauauauauauauaccgcuauauauacugcuuauauauauauauauauauauauauagcuauaaauaaauuaggauaccucuuagacugcaguuguagaguauuuauacagguacaaggugagaaguggaagagauggugucccaguaucuuauuugaaucacuuauuuacuauuggggaaaaaaaauguaaggaguguggucugcggauaacaucuggaccaguuuuaucuacaaaugucuauuuaaguuuccuuccauuagacagauucuguugacuucugccuuauggguaacagacuccauucuauacucacaccuucacauauuuauagacacaauauugauauacugauggaaaagauugguucucauuauuguuaagauauuggcauaauguuaggucagugaucaagaaaugcugcagacaagaauuaaugcuuuuuuaaaaaaagaugucuguacuuuugccaaguuugaaagauaugcauguaauauauauauauauauucacaauacauaauacaugaugcauaacauaauuacuaauauuauacaucuaugauguauauguauacauuauguauauauauuuugaaauucugaugguagguuauuuccugaaagacagagaauuuugggaguaacaucacccuuaaaguucccacuuaaugaagaaaaucaaacacuuauaaggaccuuauaacuuaaaauuuaaagaggaguugcucuguuguuuguuuugaagaaguaucuaugauuugaaagguagagauaaaagauuuagugcuuuucaaauuuaaaugccuguuuucuauuuuuauagcucugguuauuaucagaaugcuaccuuuuuauuuuuuuaacaaggugaauuaguuagucauuacuguauguauacagugcauuuuugccaaaaguuauaaaacacauauguuauuaauauaaagacaaaacuuucaaaucacagaugcuaaauuggcuuaaauuucauugaagaagaauguacauuugacaaauuagagacacauuuuuccaaagaaaauuauaagaacaaauauuagauccuuuauguuaaaaguguaaacagcuagaauuuaagaacguaagaagaauaacuguauaugaggaacuaaguuuccccagguuguaaguuucuuuccagugguaguucagugggguaaugagaccaauaaaaggaaagggagauaggaaugaugaugggguucuguucgccuucagaauggaagccugaugucauguggaaguagauuuaauuagaugugcauuucuuaaggaauccguaaaucaaguccagacuguucucuauuaaauuuuuagggugagccuaccugaaguucuaucuuugugcguuuucauucuaucugaugauacagugcucuuuaugugaccugaaaaauauauaaacucauuucuucucccagcagcauucaaacucagcagucucucucuucuuuaaaugugcauauuccauauaucucccuggauaccaggacucucaguagcuguugcuauuuuguucuccuacuuugaaacauacuuuucugaaaucaccuaccuuguuauuucucuuaacuuuugagcaguauuuggugcugcugacgauuuucuccuugagcacucuuccccaggcuccagggcaucacuuuccacugauugucucaucuccuuggcugcuccuucucagccucuuucaugggccucucuucucugcuuagccugagaaguugguauuccuucagauucuguccuuggcucuucucauuuacugggugguuuuaauuucuguuauuaguuacuuucugcaugcugaugacuucucaauuugaauucucaccaggucuucucucccaagcucuagauccauacauccaguuguuuauugaccuuuuccacuuaaaugugacagaaguaccuuaaucucaauauuuucagaaacugaagucauuaucuuccauaccccgucuuaccccaaaaccuacuucucuuuguauuuaauaucucaggauuaguacuggcaccuauaggugcucaagcuagauuuaaauagaugcauaaaaucucuugcccugaaccauaucucucuguccccacccauuagccuagcuuaggccaccacuauugcuacauuugcuuuguugcagcagccuguucucccuuccuguagucuuucuucuucaauacauuuuuuauacuucagaacacauagaaagaacuuccuuggcuuacagucuuacuucuuugccuccuauuaucucuaggcuuaaguaccaauuccuuaauaugguuaucaggcccuucgugaccucaugauuucaucauugcuuucuuuucuagccuugucucucagcacuccccauaccagugcaugacauggauuuuucucuuuaaaaauguguacguggcuuccucucuggagcuccugccucuuccucccuuaccacuuuugcuuggugaguuucuaauugacuuaauuucucagcaugcaugauaucuccuccagaagcucuugcugacauccccacuuccuuccucccacuuaaccagaguuuuguguuuucuccuagguaacccuaucgcuuaccccuaucauggauuuauccuaauguauuagaacugucuuuuuacucucacauuucccuucuagacuguaaguuccuuaagguuagcaaugggcuuaucuguguuguaacuuguuaguaguuccuggaacauaguggauacuacaaagcuauuucuugaguugaguguaugcaugaauuacugugacaauuccuuacuguuuccauagugguuuugccaaugucaucauguaucauaucuucucuuauuuucagaauuucucuucuaacuucuauaagagcuuaacuucaaaacauguugaacaguauauacugcuaaaugaaaaagggaaauacagaaugguguuaugguaugcuucccuucggguaagaaggaaggaauauaagaaaauauauguguauguauuuauuuguguaaaagaaauuaaagcaggauaaaucagaaacuaaagagauugguuaccuauaggaagugaauggcaaagggguagaaagaaggggagagagauggaaacaagauaaaaaggauaaggagggugcaauucuuuucugagaagcucuuuguguuuugcuugauuccuagaaacauaguaguguuuugcauacucccucucuauaaauaaauagaucaauaaaaccaggauguaggggaaccuaaaauuggauacaaaaauauaacagaugagccugacuuuauugugaauugauauugauaacauauuuacacugaagggggugggaaagaaaagcacuaaucuggguauuuugacugguauugugaggcuaaggguaaaaaguauuauacacaaacgcuucgcucaaguuagugaauuuguguauccuagcaguguggauuaucaauucugaaacugcuuuauguguaugcuaggauuaaacaaagaaguuagaaguacagaagugggaacccuguaguaucaaacucaaucagagguuguaguaugaacucaugguuuuuaguauauacagauguguauauauauauaguagcauacagacauauauauauaugcagauauauaaaugcaaaaauaaaaauaggccgggcgcaguggcccacgccuguaaucccagcacuuugggaggccgaggcgggcagaucacgaggucaggagaucgagaccauccuggcuauggugaaaucccaucucuacuuaaaaaaaaaaaaaauacaaaaaauuagcugggaaggguggcuggcgccuauaguccuagcuacucaggaggcugaggcaggagaauggcgugaacccgggaggaggaaauugcaaugagccgagaucgcgccacugcacuccagccugggugacagagcgaaacuccguuucaaaaaaauaaaauaaaauaaaauaaaugcaaaaauaaaauagacgaaugugugcaugcacaugcauacauaauacaugauauucccuagcucugucugaagaggaccugggaacaaagagggccugggagcaaagacauacuaguaguagugaacauaccuggugcccagauuuugguuucuaauuaccaucucuaauaaaaauaaccaggcugauuauguagguaauacaugcuuaucuuaaaaagugguuuuauucugcuuuucuuacuuucuguauuguaagcacugucccauaugagaaaaagcauuuuucaagauucaaagcauauccaaaagcaaggaaguuuugcauuaaauauaaauaguaauagcaccuucuucuacgugacagaagauauaaaaauuaaauacuuuaaaaaaggaaccagagcuccuuggagaagugguugauuccagggcagacucaagaaaacacaagaugagccagaagcaucuucuagugccagaaggcugaaagugcgcucaaaagacauagaagccagccucaaagagcuuccaacagccaaagcuggaacaauuugagcaacaaaacaaauaauggugauauuagauuauagccuguagaauaaaagaaauaugaacccauacugauauaaauaaauaaauaaaaauaggggggaaaggacagcuauuccuuacaguaaaauuccauuugauaaaugaagaagaaaugagagaauguaaaaucaccauuagacaaacaucacaauagccauuacugcaagcaagauccagcaguggaugcuaacaucagugagagaaaguuugaagagaaacaaaauauuugcauagucucaaauauauuuauuaauuuuaagggaaaacuguuacuuuacaggagagagaccuaguagacaucaccuuaaccaaaugaucacaguguaaugagacauaucaacaucauguaucacacaugugaugcacugagaaguguacaacaucauuucugugguauuagugacaaaggcacacaaccucaaucuaauuaugaugaagcaccagacaaccccaaguugacaaacauuucagaaaauaauucgucaguaugcuucaggagugccagugucaugaagacuaaggaauuaucacagacuggaggaaacuaaggagauauaacaacagaugugauguggaauuucauaauggaugcugaaacagaaaagggacauuaguggaaaaacuggugaaauuugaauaaagucugucagcuaacuagcuaacgauauaauaccaauguuaauuuccugguuuugguaauuuuacugugguuauauaagauguuauauaggugagggguauauggaaacucauuguacuauuuuguuuucaaucuugcucuaaaauuauuuaaaacaaaaaaguuuauaaagaggaacuacaaauaugcucuauggucucuuccuaaaaacaaauacauacagauauuuaggauaaagcuauuggguuaucgauugacuuuugacuuuuauaauuuagguauguguuuuaccauuuugagggaaacuacugaaagaacagaauagaauagagaaaaaacagaaaauauuaaaggagacaagaaaaaagaagaaaaugggaggacaacuggaaaacauaaaaugcucuuucugccagauuaaggaaagucucuuuuauucugaguuugcugaaaguucuuaccaugaguggauguuuuaagcucauuaaauguaucuucugcaucuuugaaaugaucauuuaauuuuucuuauuuuuuugccauauuucuuuuaauuuuuaucuauaauuaggaaauuuuucucaaucccaggcuacagaggaaguuuauauuuuuuuauaguuacaugguuucauuaguauagaacucuuaucauuuuggaauuugagaugccacaguaagguacacucaacuuccaugugcaauuaaauuuuacauucaucaggcagcauucugcuaaaagaacccucucuuuuucaauauaaauguuuaauuuuuacauauagauaauauuuguacauaccauaaauauguaguacaugugauauuuugauacaaggauaccauuggcaaugaucaaauuaggguaauuggaacaucagucacuucaaauauuuuaucauuucuuuguguuaggaacauaucaauuccacuccucucguuauuuuuaaauauauaauaaauuauuguuagcuauagucuuuuuauugugcuucugaacauuagaccuuauucccuguaucuaguuguauuuuuguauuuacuauccaaaccuuuuuauccccugcuccucacuacccucccagccucuaguaacugucauucuacucucuuauuuccaugaggucaauauuuuagcuuccacauaugaguuaaggcaggauaagaacaugcaauauuugucuuucugugucuagcuuauuucacuuaacguaauguccuguaguuccauccauguuauuacaaaggaaaggauuucauucuuuuaugucugaauaauauuccauuguuuauauguaucacauuuucuucauucauucguugauggacacuuaaguugauuacauaucuugccuagugugaauagugcugcaauaaacaugggaaugcagaucucucuucaauauaccaauuuccuuucuuuuggauauauauacagcagugggauugccagaucauauaauaguucuauuuuuaguuuuuugaggaaccuccauaccguuuuccauagugguuguauuaauuuacauucccaccaacaguguacaaacauuccccuuuccccacauccucaccaacaucuguuacuuuuucucauuuugauaaaagccauuuuaacuggagugagaugaugucucauugugguuuugauuugcauuucucugaugauuagcgauguugagcauauuuuucauguauguguugcccauuuguauaccuucuuuggagaaaugucuguucaaucuuuuacccauuuuuaauuggauuuucuuucuuuuuuuugcuauugagcuguuugagaacuuucucuugucuaucaaucaacuauuuaccuauccauuuuuaaaauuaauauaggauugauggauucauuuuauucagugguuauacuucacuacugccuuugcuuauuuugauacugaaaauuucccagauuugagcagaggaaaauaauucaggcuccuguguccuccuucccucucaccccucccuggcuccucuuucuguucuucccuuucccucuuucuuucuuguaauuuuauugagauauaauucacaugccacaaaauucacccuccuauguccuuuuaauaugcccccaucauuuuuuucccuaauuuucuaauuuucugguacaauaagacauuuuuggccuauuuuguaccuucccaagcuugaaauaagcaauuucuccugguucuuuuuaguauaggauauuauuaagaaaccaguaucugaguaguaguugugcuuauugcuauugguguguuauugcuucuugauucuucaguggacaggaaaaacguacgaagaaguaaauguuuaugauuuguuugcucuucuauucccuagacugcuuuuuuaacaucuaaaaaugguagcucaugaaauauacucuuuugcacuuugauuuugcaggguaacaguguacccuagauaucagguucuaccaguucauagagcucuuucuuauucuugucuaagcuuuauaguucuccaauuuauggauauaccauaguuuauucaaccacucucauuuaaguaguuucaacuguuuugcuacugcaaaaaaaugcuguaauuuauuacuuugugcagauauauuuucauuuuauuaaagguauugauaauuaauuuuaagacuucaucuuagcuauuucuuaaaacuuuaucaaaggcgcucacuagggguguuacugacugauuuguuccaccuuauuuuuuauuucucauuuacucucugguagauauaguaauguacagugaaauagugaagaugcagauagccaaggaguagaagagaguaggguaugagaacauuaacuccuaaauaauaaagguuggcuacuuaguuguucccauuucacauguacaaggcuauuugcaccuagcuugggguuuuuaguugcuggcauuagugguggcgcugcuaucuuugucuucaggugguucacugguagaauauuuaaaaaggaagguccucaaagacuguccacuucaacuucuccauugugcauguggggucccagugcccacaggcuuaccugauaucacauagcauuuuaauggugagcugugacuggaaccagaucuccaaacacaugcuuguuccaccuacaccacaucaucuuuccuuuuacaaacaucagacuuuggcauggagugggaaaaacuuuuuuugcaaauagugaauauaagaagcuaaauaacuuauuuugauuuuaacuuuuaagguccuuuauuuuuuugcuccaauuuuugcugcaacucuuugcccuuucuucucaccaacugugggucagugguaagcagcagauacacagugcuuacuaugugcuggccacuuuuuaagcacauuacacauauuaaagcauuuaucccuuccagucauccaacaagguagagaugauuucagaugaagaagaugaggcccagagaagcuaaguaacucauucaaggucacaugcauguucaaggucugggcugcugauugauaaaguccuggcagcacagacaagaauaugucucccugaugucuuuuauuuuuuuccccugccauauuugguaccagagccagagauccccugggaccacacagauuauccuagaaauuucugauacagggaagaauaaguacuucaauuguacuggaagucauagaaaacacacacacacacacacacacacacacacacacacacacacgcgcacacacacacacuuucacuauuuauuuauuuuauauagguuauguguaaacuauauagagagaguuugacagguuauuucagagugaguggaaagacuuucaaaagaaaauuugaagacauuuuaaaacuuuuuccuuucagcaguuaauugauugcuauuuuuaaauuuaaaauaugcauacuuuaaauaccucaagauuucuugaaguuauaacuugggcuucuugcuuacgauuaauuaaaaagaagugaucuuuuuauucacaaguggggcuuuuaucuggcuucuacuauuauguaaccuuaucugacuugaacaggucuggugauaggaugauuuaccacucuaaacuucaggacuugaggcugguaaguauuugucuuuuaaaaguaugaaaugauuuaaaaaaagauauuccaaccucucccaaguagaggaggacagagaagaauugaugcugcaugcucuuggcuggcccaguauuccuuucaacuuuuuaguugaauuagagugguguucucauggguucaaucaugcugucaugaaacaguucaucaguaugucucuuaaaagccuuaaauaaauguccucuugguacacauacacccucccaagacuaaaccaggaagaaguugaaucucugaguagaccaauaacaagcucugaaauggaggcaauaauuaacagccuaccaaccaaaagaaguccaggaccagauggauucacggccaauuucuaccagagguacagaaaggagcuguuaccauuccuucugaaacuauuccaaucaauagaaaaagagggaauccucccuaacucauuuuaugaggccaguaucauccugauaccaaagccuggcagagacacaacaaaaaaagaauuuuagaccaauaucccugaugaacaucgaugugaaaauccucaauaaaauacuggcaaacgaaauccagcagcacaucaaaaagcuuauccaccacaauuaagucagcuucaucccuggguugcaaggcugguucaacauacacaaaucaauaaacauaauccaucaccuaaacagaaccaacaacaaaaccacaugauuaucucaauagauguagaaaaggccuuagacaaaauucaacagcccuucaugcuaaaaacucucaauaaacuagguauugauggaacauaucucaaaauaauaagagcuauuuaugacaaucccacagccaguaucauacugaaugggcaaaaacuggaagcauacccuuugaaaacacgcacaagacaaggauauccucucucaccucuccuauucaauguaguguuggaaguucuggccagggcaaccagacaagagaaagaaauaaaggguauucaauuaggaaaaaaggaagucaaauugucccuguuugcaggugacaugauuguauauuuaggaaacccugucaucucagcccaaaaucuccuuaagcugauaagcagcuucagcaaagucucagaauacaaaaucaaugugcagaaaucacaagcauuccuauacaccaauaacagacaaacagagagccaaaucaugaguggacucccauucacaauugcuauaaagagaauaaaauaccuaggaauccaacuuacaagagaugugaaggaccucuucagggagaacuacaaaccacugcucaacaaaauaaaagaggacauaaagaaauggaagaacauuucaugcucauggauaggaagaaucaauaucgugaaaauggccaugcugaccaagguaauuuauagauucaaugucguccccaucaagcuaccaaugacuuucuucacagaauuggaaaaaaacacuuuaaaguucauauggaaccaaaaaagagcccgcuuugccaagacaauccuaagcaaaaagaacaaagcuggaggcaucacgcuaccugacuucaaacuauacuacaaggcuacaguaaccaaaacagcaugauacugguaccaaaacagagauauagaccaauggaacagaacagaggccucagaaauaacaccagacaucuacaaucaucugaucuuugacaaaccugacaaaaacaagaaauggagaaagaauucccuauuuaaauggugcugggaaaacuggcuagccauauguagaaagcugaaacuggaucccuuccuuacaccuuauacaaaaauuaauucaagagggauuaaagacuuacauguuagaccuaaaaccauaaaaacccuagaagaaaaccaaggcaauaccauucaggacauagguaugggcaaggacuucaugacuaaaacaccaaagcaauggcaacaaaagccaaaauagacaaaugggaucuaauuaaacugaagagcuucugcacagcaaaagaaguuaccaucagagugaacaggcaaccuacagaaugggagaaaauuuuugcaauuuacccaucugacaaagggcuaacauccagaaucuacaaagaacuuaaacaaauuugcaaggaaaaaaaacaaccccauccaaaagugggcaaaggauaugaacagacacuucucaaaagaagacguuuaugcaggcaacagacacaugaaaaaaugcucaucaucacuggucaucagagaaaugcaaaucaaaaccacaaugauauaccaucucacgccaguuagaauggcgaucguuaaaaagucaggaaacaacagaugcuggagaggauguagagaaauaggaacacuuuuacacuguuggugggaguguaaauuaguuccacuauuguggaagacaguguggagguuccucaaguaucuagaacuagaaauaccauuugacccagcgaucccauuacuggguauauacccaaagaauuauaaaucaugcuacuauaaagacacacgcacacguauguuuauuguggcacuauucacaauagcaaagacuuggaaccaacccaaauauccaucagugauagacuggauuaagaaaauguggcacauauacaccauggaauacuauacagccauaaaaaaggauaagaucauguccuuugcagggacauggaugaagcuggaaaccaucauucucagccaacugucacaaggacagaaaaccaaacaccgcauguucucacucacaggugagaauugaacaaugagaacacuugcacacagggcggggaacaucacacacuggggccugaugggggauugaggaguagaggaggaauagcauuaggagaaauaccuaauguaaaugacgaguugaugggugcagcaaaccaacauggcacauguauaccuauguaacaaaucugcacauugugcacauguacccuagaacuuaaaguauaauuuuaaaaaauguccucuugcuaagaagucugaaaauuggauucagacauaucuuugcccuaucacuuuauuuuuuuauuuguaauaauuuuauacuauuaucaugccuucacacaaguuaucacauuuaauuucuacauagaucuugaaauaaggagggaagcuauuaccaccaguguguagagaaaacugagucuuagagauuuuaagcaauuugccccagguugcaguacaguggugagguagagcugguaggaaaugaguaagcuggacuccugacuccaaugcuuguucuucccuacaaggcaggacacucccaagugggaugacuugcgaucccagaaaucacaauaguuguucagcuguggucuggaauggagcaagacaaugccagagacugcuucuucuuuuuucacaggaagucaccugcuugugcaggcccuuuaagacuacuuuugcacugcucuacauauuucucuuguuuugguggagaacucugcuaaauauuugaagccuaguuuuggcaaguucugaaagauaaaccagaaguuacauaggaaguugaguguguuaccacucaccuagcauaaucucccugccacacacagccugaaaacaaaaacaaaaaccaagguuucagguaggaauuuaugcuuuuacguugcauugccuuuugggaaggacucaucgucacagcuguguucugagaugccugagcuguuaaaaucuaucccauaucaguauauaagcuuucauauuuccuguaucucuaggacaaaggacaaugguguaguuuuccaacuggauucagaauauacuuagcaaagcauaugcaaaaacauaugcaagaacuaguaugaaacauuggaguaaagcccaaaggaaauaugcauuaaaaguaccagaacaugaaaauccuguguucaaagaagcgcauucagcggcuuuaggcugcugccuuuugcaggcucugcucucccaccaggcuucagggcugucuguuucuccacagucagaaagcuaaagcuugcucuuuggcccuaaguccugacaacuugaaaaucuuaguauugggcauuccuauuugaaaucccuaauaaaagugggaaauuuuugaagggccauccuuuucaguguuuagcuuggaauucauccugcccuucaggggccuccaaaaaagacaaaccacuucauccucugaaacacuucauuaugagcugaaagggagccaguacagaagacccuauucuaucugagauggaacaggacaguauguuugucuuguuuccuaguauugccaggucuuagggucaccaagccauccacugucucaaguuggucuuauuuauuugugucaugcaaaggggaauucauuuucuaaauuguuaagaguuaaaauauguuuauuacacucuuuggaagguuuggcccggcguguaucacagcccugucuugaagcacugagguuuguuuuccaucaauuuucgccucaaacaugaaagaaguuucaacaguggcuaggauauuaccugucauuuuaaugaucagaugaagagaaguuaaauuauaagaugaccuggacaacaaccagacuucagaauccauuucaauaaaguguuagugagcuucccaguaccccugaugauggugaaaaaaauaaaaugucagccaagcauuucaagacagauuagagaauuacccaauucccuccaccuccucacucuaagucuaaggcaaauguuuguuuaaaaauuuaaaacuaagcaguuuauguucaacuggaugaauucauucauuugggacagaacaccaaccaaaaaauguaaucuauaauguuugcuucauaccuaguauauucuucaugaagaacucucuuuucugugucauuacucaauuggaacaccauaaaugcagcaaaaaguuuuauuuaauuauuagcuguuuuaaaaccaauuuauuuaugauaacaauaacauuugucgaccacuuuuguaugccuggcauauccuuaugggaacuuuuauuuaaucuuuuaaaaaauccuacaagauagguacuuauuaccccccuacuuuauagaugacugaauagaggccucugcugguuaggugacuugccaaaggccauccagcuguggagcaggaacugaagcccaggagucucacuccagcacgguacccucuucacuagaugauuuucugucauguagcucaauuagcccggguaacaugguugguugaugacacgucuacuagaugaucacucgagaaaagaaaguuaaucacgaggcauuguuuuucagggacaaugggagaaauugacuuuuuaacaugcuuauuuagcaucuguauaauuguagugggcccuguagaaguaauuuuauagaaguagacuuagguagaaaugaaguagguaacagucaagaaauaagauugcuuauuuguaugcaaaacaauagccuauggcuuauguugccaagaaaagacuuuguuuuuccuuuuuaagugaugacuacccauaugcugcucaaaagagaccagagaaaacaucaaagaacccuacaagaggcugaaccagagaauauucuggaagguuguuaaagaauaauuucacugaggagaaauuuuuuacagaugaaacuggcagaugggaguuauucauucaucucuuccagaaauagcugaaaggaauacaauagaaaucauucuauuuugaacauauauagggugauggauucagccaggaugcuaagacaguuuuggauuuuuucaguuuuauaugcuuaggguuuccaugaauaucacugaaacccgugauucaguaacuuggagugcuagagguuuaaugcucucucugcauugugaaccacaucauuuagaacagaaccuuuggaaaaaguaaagguuguuuugaacauugguaaguauccauaccaagcuguguuauacagccagucauuggccauggccgucagagaaagccuuugucuaccacuuaccgaaagguguguauuuuguguguauuuuugugugugugugugugugugagagagagagagagagagaggaagagagugagaagaaucuuuuuuauuuguuuuuuuuuguucuaaaauguccaucuugggccaagacacuguguacuugcuucggggaaaaagacuauaaaauaggacacuuguuucaaaaauaaguaguuuuucuaguagaauuaaaugauagcagaguaaguucuucucacuggcgaaauggaaggucacuguauguccagagacuuuauuuacaccuauaaacguuaugacuguggcacauuaagcccauauucuuguacauaaaaagccacuuuaccucagccuuaacuuguuccuguaaaaacagagcuuuguuuuauagccugucuagcuguaucucugcuugacaaauagacaucaaauaaagaagcaauugugcaagaaggcucauguaacuuacucagagacuuuggcuagaucuacuuaccugaacagccuucaguaguaacaaacggagcccagcugauaaauagcugguuuuaauuuucaugaaaguuagaaguaucaccugccaagaggguugguuauucuuguaguuuggguucaaaagccuugcugguuccagaaugaugauagccacuaacauuuauaugauauucugaccuuuucaaaaucauuuauaugaucucauuuuauccuuacaagguuuuuagaaaguaaaagccauaauauauauagcauauacuguuucaguuuguuuuucacgcacaugaauuuaaacacacacgauuuccagaauaauuuacuaucaauuccuuaauagacuaauguacucuuuuuuuuucuuuucuuauuuuccuuuucuuauuuuccuucuuuuguguugucuagacaguuuuacuuccaauuauuuuacaccaugguuagucaucggugagcuuccaggccuuugcagaacauugugauuuuuucuuuucuuuucuuuuucuuaagacuugauguaaaaucaugacuugucuuuuuucugcuugguuuucucaccuaccccuagccccucuuugcuguaauagauauugacccuaaguccuugaguuaucucagucagggcacugggugagggaaggccuaucagacaucugagugguuguuggaaaauauggaggaguuaggccaacuaggaggcagagguguuccaggcugaguaaacuguaugcaugcaaaaaggcacagagguggggcacagugugaggaggcucggaaauguaaugugagcagacccauggggcugcuuggaaggggugguguccaucagaggaggcugggaaggggcuaagugaaggccaggacagguugggagaacugcagucuacuccaaaaagcuaaacagaaccacuuaaggcuuuuaaguacaaggaugauaugaucacuguucccuuuucauaguuauaccuuguuucuacaauacacacacacacacacacacacacauacacacacugcaucugaugcucacaaggucaaaguuacauaguuaacauuucuggacacuuuugcccuucagguucuauuucuacucacuugaccuccugcccauucauuuuauucaauucaguaaacauuuaguuaggaacaucuuaaagcccuccaggagcagaucugccacauuguauguuuacauggacuuaaagagaauaugaggauuugggugaugaaagacuuuucuuaauuuaaacuuggcaacauccuuucccauccucauacuuucuuguuaaauguguccccuuaugacugccaugguguugcacgucugcucaguuugugggagcuccauaccacaucuauuccugccugcuaccagaggaccagccuuuggaacaagacugcugguccagaacuaaguaaugugggagccuguacuuucuccuguauuuugcauuaucuugaauauacccucuuguuucauuuugcugguaucuacaauuugacccgcauaugucugaaaacagaauucuauuuuuucuaagacuaaccuuaccaagcucagacauaguaguaaagaaaucuccuuuuugacuacuucagugacauaucuuaauaugaaagcauuuagcaccaugccugacaagugggggaugcucaguacuuucguuuccucuccccucuacccuuucucccuauuuuuauuuauuuguguugcuuuuugguguuuugguugauauuguugcaucagcuuacaugcauuugauagauccaugauagauagauaaauagacuucuuuaucuauagacagacuaucuauagacuagaucuuccuuuccuuuccuguccuguccuguccuuucccccuugauucucuuuauauauauauuucucacauuggauucuugauauuugguuucuuuaauuuucacauauaguuuuuguuuguuuauuuauuuauugaaagccauuuuauccaagugauuguacuuaauuaugggagauacaagccaggauaagauaaaauccucagcauaggagagucugguacaggagauacacaaauaaagacgccaaaacaugugaugugcccuuugggaacaucuaggguauuugagagcuagggcuugacucuggauuuggggcuggaaaaaauuuuacagaggaagugaccuggagaggccaaaugcuacgaacaugguuuuagagccacguuuuugguugaguuuguaucauagcuucgcacuaacuagcugugugaccuuggguaaguuauuuaaccccucugugccucaguuuucucaucuguaaaggggagauuauaauagcauuaccuuguagauguuguuaccaguguugaauguuauuauauauaucucauuuagaauagcacuugccuuuuagaagcacuugauagauauuagccauugucauuauuauuauuauuucuauaauuauuaucauaguuauucuuuaagcugauucaugaagaauguuauuuaaaggaacauuccuggcagaggauauaauuuaauugguguuacuuugaauauaauaaccccuccacuauauuuucuaaguggauauuguuaaugcagagagaaaugaucaauauuuuuauacuuauauuuuacauguauuuuguaaucuucuaccuagucuaugugauagguggaaaauaagacuuuuuauuuuauauuuuuggaauuuuuuaggucuacaauuauaucaucuggaaauuaugauuauucuuuuuucuaaugcauacauuucuuccuuucuaaaauaucuuauuauacugcuuugaauuucuggaacaaugucaaguaguaguugugauagcuaagauccucauuuuuaaccuaaugcuaacgugaauauuuugucugcuuuacuuauaaauuuuauguugccuauuaguuuuagauccuuauuccuaguucacuggcauuuuuaaaaaaauuagaguccagagugcucaucauuacacuauggaaucucuauuuuuuuuugaaaauuagaaguggauguuaaauauuauccucuauugagauuccguuuugauauauuuauuugaggacuuaauugaaucauuuugcauuucuggaucaaguuaucuuuaauuauacuuuuaaaaauaugauucugaguuugaauuacuaauaccuuaauggauuuugcauacauauacaugcaugagauugcucucaaauuuuuuccugaaugaguuuguacucagggauuugggugguuuuauagcauggugaugcuaacuuuggaaaauagaucuuccuagaaauguuaaauguucuaccacuguccagcaucuuuagaaaaugccaaguucccuucccuaagaucauucuuuuaauuauuuuuccuuuauauuuguuguaauuaaauuuuauccucuaugagcuccuuugaauuuucccaacuuucagaagauugauuuugucuuuuuccucaacagaauugguaaaggcuuuauuuuccacuuuauuauuuuacuucuuuuuaguuguaaauccuaucuacucuaaugagccacuuucucuccuuuguaauuauaugcuggauuccuauagaaguauccaccaaugcugaauucuuuuaaaacagugcaagauguuuuuagacagucucagggucuaucuucauuggugucucuuuaaguuacuucugugcuaauuccuuuuuuacuaagaggaaacuucagugauuuucccaaacccuuucacuuuucuuuugagcaagggguguaguagguguugaggauauggaguauauaccaugaucuucuuuuugccagucuagaacucagauuguuuggacaguaauucacaacugcauuucuaugugucuuuccuuucugacaaggagaagcgagagaaugggauaguuuagacuugaauuuuggaaucagcauauaacagauuugaauucaaguucucccaaucacuauguaugugacuuugagcaagucacuuaagcuuuuuacagcuuaguuucaucauuagugaaaugagacacuaaucacuaccauucuagaucacuauuaaaugagcaaacacaaaauaaguaacacuauggcuagcacauaagugcuaaaaaaaagguacuaauguaauuauuauucaauuaugauuaacauauucuuauauaaaaauugcauccgguucaucaccccucaaaacccauagucuggaucuaguugucuggauuaucuaaaguguagauaaucuguacauuccugccuuguacauucguaccuuuuuuugaguuucuucaauuucugccuucuguguuucucucacuacugcagugugcuuugguagaaaauacucaugacacagcagaccugggcucuacuccuaacagggucauuggcucacugucugaccuugggucaguaaaucuuuuuaucauuuauuauaauaacugccaauuacugagcaucacuuuaccucugaugccuuauauaagguuuuauuuacuccccacaaucaguuuuaggaagauacuuucauuucucaaaugaagaaauagaaacucaaagguauuggguaauuugcccgggagcuaacuugaugugugguuuuucugggacauaaaggugcagauuuucuauaaggaacuuaaacaaauaaacaaguaaaaaccaaauaaccucauuaaaaaugggcaaaagacaugaacagauacuucuaaaaagaagacauacaagcagccaacaaaccugaaaaaaugcucauaaucacuaaucaccagagaaaugccacccaaaaccacaaugggauaccaacucacaccagucagaauggcuacuguuaagaaguaaaaaaaaauaaauaacagaucugggugaggccacagagaaaagggaaugcuuauauacuguagguaggaaugugaauuaguucagccacuauaaagagcaguuuggagauuucucagagaacugagaguugaacuaccaugcaacccagcaauuccauuacuggguauauauccaaagaaaaauaaaucauuuucccaaagacacauguacuuguauguucaucgcagugcuauucacgguagcaaagacguggaaucaacccaggugaccaucagcaguggauuggauaaagaaaaugugguacauaugcaccauggaguacuauguagccauaaaaaacaaaacaaugaaagcauguccuuugaagcaacauggauacagcuggaaaccauuauccuaagugaacuaugcagaaacagaaaaccagauaccacauguucucacuuaugaguggaagcugaacauuggguacaauggucauaaacauagaaucaauagacacugcagaauguaagaucagggagggcaggagugaagguuaauaaaagcuaccuguuggguacuaugcucacucccugagugauggauccauucauacgccaagcuucaggaucacacaauauaccccuuccaaaccugaacauguacccccgauucuaaaauaaaaauugggaacaaaaaaggugcagauuuuuaccuacucuacugcucaaaguugugagacccagggucaggugaaguucuuucauaaacuguggacuaugaugucaauggaacagcucucucagcucaguauuuucucuccuggccaccacccugucaucccuauaccuucugacuuguggauuguacagugagccacuuacccucauucccucuggguuuucacauccuuuguuucccuccauucucucccuuccuuuucuuuguucuguaguguuuccacagagcugcuucuuggagcuccuauucuacauccccuuuccuuaaccagagagagcucucucuucugccugauguuuucuguuucaguugaucuuuuugguguuugauaccauuuuaaaaauuguuuucauagcuuaauugaaggcagacaguucuacauuuccucuuuguguuuauaaaagcuugguuugaaaaagggcagugcaggauguauaggagguaagaaagaaaagaacagaaaccauugggaagggcugcuauguuccaucuucaaagaaaguagagcugggguuaguccaauuguuugacaauugcaagggagucuuaguaccauaguuuggacaaaaccugacuuuuuauugccaaaaaaauauaagauagagauggagguaaaugugaauaauucaaaguaauguuuaaacuuucaggauauuucaccuucucuggaauuagagauuuaugcuaguaaagaguuagggaggaauuugaaauguuuauguuaccagaguguaaaaaacauuguccaguuguuuaucuaaucuuucauugggcuugcuuuuaaaaacacguuuagauuugaaguagccugggaaaaauaaacuguuccaggccauaacuugaugccccaguggauauaacauggauccuucuucauucguuuugagaaauuucccaagcagacagaugucuuuauaccuucuuuugcaguuucuucauccauaaauaacuauuaucaagaacuggaauuacaaaugcucuguuauuucuuuuuaacuuugauuccuacagaaauuacuacugggaucuuauuucuucucugggguggacauuuuguuguuguaccuauucagucucacaaauucuccauguguuuuuauccagugaaauucauuuccuaaagauuuguaucagcuaaagcaaagaacuuuuugagaaccuuuuuugguucacagagcagccaggucuacugggggaguagaaagaagagauucuauacuguguucuguuguaacugcuuuccaaccucccagcggaaaaggcagauaauacuauguaaaaauuagaauugauuuugguuuccguugcuuccuccuaaucucucagccuaaauucauucauuuaaguugacaacuaaauaucgugugccuguugugugccaagcgcuguuccaagacuuaggauacuguagccaccaaauuagauagagaucccugccauuuuggaacucuuauucucacaagugaagacaauaagcaauaagcaugauaaauaagugaacuauguaugugagaaaguaguaagugcuaauguuaaguguuacagaaaaagaaaaugugugucagaaaaggggugggggccacauggucauaauuucaaauuggguggucaggauaggcuuuguucacaagacaauuuuugaagaaagacuugaagaaggugagggaauuauucaugcagaaaucagagggacaaguguuucagguaaagggaauggucagcaccaucccuaaagugggaaugggccugguguguuccagggacagcaaagaggacagugagguggugugguaggagaggaggcuggagggaccagaucaugugcagccuuugugcagacauuugcucauuugcuuuuccucugggugaaauggggaaagccauuuugaaugaaggaaugacaugacuuuaccuuuuaaaacgaucacggguuacucuuuugagaauagacuauagugggggucagagguaaaaaugggcaguccaguuuaaggguuacucagagaagcaauuuagcaauacaguaauucccuccuuauccauggaggauguguucugagacucccagugguugccugaaacugcagauaguacugaacccuguacuaugaaaaaauguuguguuuuccuauacaauaacaggcaggcagcauaugcagcauggaugugcugaacaaagggaugaguuacgucccaugcaggauggagaaggaugacccaggauuucaucacacuacccaaaacagagugcaauuuaaaacuugugaauuauuucuggaauuuuuuauuuaauauuucagacugugguugauugcagguaacuuaaacugcagacagcaaaacugcagauuacuguaauucagguaagagaugaugauagauuguaccaaagugguaguaguggugagaaauggucuuauucuggauauauuucaaauguugaaacaauagaauuuccuaacaaaauggacaugauaugugagaggaagaagggaauuuagaaugacucuaguaguuuuggcucgagacacugaaaggguggaguugagauggggaaggcuguggggugagaugggaaagguuugugaaggauaagaguaaaguuugggacauguugaguuugagaugcuguuagagaucuaaguggagauauuaaguaagaaguuggguaugaaucugggguucaggagagaaaucugggcugaaguuacaaaauuaggaguugucagcaugaaaauguuacuuuaaagccagaagacuggauaaagucaccaagggaguaaguuuagaaaagagaugaggaccaaaaacugagugcuggauauuguaacuuuuaggaaguuugggagaagagaaggaaccagcaaagaauacugaaaaagagccugcagugagguaacaggaaaagcaguagaaugugguauccuagaagucaagcaaaaaaaguuucaaggaagacugaaugaucagcugugucaaaugcugcucacagaucaagucagcugagagcugaaaauuagcccauugauggaaccaugugaagaucauugugaucuugggcagcuucuguagaguggcagaggcaaaagcuagacugggauggaugugugagagaaaggaaaaaagaagaguuguaaagagcauauauagagaacucuucggagaagcuuugcugcuaagaggagcaaagaaacggaagaaaaugcuggcaugaaaguggggucaagagauaguuaauuuuucuugauuugauguauauuguuguccucuauuauugaucuggacccuaaucuuuguucuuucuuuacaaagcuguuauuucuuacuggccacuguuuguuuuuuuguuuuuuuguuuuuuuuuuuuuuuuuuaccagaucagacaaccaauuaagguuuuauuugaauauuuaacccaacuauugguguuccuagauagcuauaguugcugcucugucuuccuaaaauuuacuacccuuuguaccuucaguuccccacucaucuuacaugagaaucucaggcuuagacuggaauaauuuggcaguauagggcaaaaaugaugcugaugcuguaaaugcuuauuauuauaacacuuguguaucauuuacuaugagucaggcaccauuugaagcgcuuuacauccauuuacucacuuaaucuuuacaauacccuaugaacuagguauaauuauuaucugcauuuuacaaauaaggaaauugaagcagagaaagaucaaguaaauaguuuuucuuuuuuaaaaaaaaaacuaauaaucauggagcugggauuaaaauucugacgguuuagcuccagaggccaugcuuuugaagcaacuggagaauuuuaagagcaggcaguuagcuagagagauuucauuuuacauaauauaggaauuugcuugagugaauggguuauguuuuuggagaaacaggauagaauacaggagcugauuggucauuuccuuagauuuacuagccuauacauuagugggcugugcucagcccacaauccuggaaggaugugguggaacauucuuaaaugaugacuuuuuuuuuaaaggcuguauuuccucaaguuucaugaauuccuuuuuaagucaacaaguaaauauuaagcaccuacucuuugcauaagaggaaaaaaauuuaacuccuucccucuauauguuuauuuuccugugggaagcugauuuguuuaucacacaggcuauagaaucauuuggaaacuaaaauagaaagggcuuugcaugugaauguaauauuuuacuauuuuuuaaaaggauccuuaaaauuucuaugucuuuagagaugaggugugaacuaaaugauucuuuguuaaguguuauuucuuagagcacuggugagcaguugccacugaauccuucauuaauaaucccuuccuuuuccagaaggacuugccaacacccguaaaguauucacugggagaauuaaagucauauaaaaauaauugguguuugcuuccuucaaggcauacauuuaaauacauugcucuauuucucuguuccuuggcugccuccuauguuuaguaacacuagaucagcagacuuccucuuucaagguucagcugcuggccauuacgauuucccaugagaaagcaaaccuaccacuguuuuacccuuuuaucuuaauguuucauccauuugugucauauuaucuuguggguuugcauuucucaguaguaauagcacugcugguaaauagaaaacaaugaaugugauuauguaccccuggccgucgucgccaucaucaucaucaucaucaucaucaucauuugagcccuuuaaaaauuccuauuguaaucucagaggagugguuaucuaugauaguagacuauccgugguuucauuuuaaaagggauguguacaguauuuucaugugaauuacuuuuaaugccuuggugacaauuuugccauucaccacugaguucagcuaugaacauuccaccacuggucuacuuacuccauccucaacuuuuuuaccugagcguuuuuuagaaagucauauauaaauuuaugcuguauucauggccugcaguuucauguguauuuggcuguaacuuguaaugacuaauauauauugggaguuagaacugaaaauaauagcuaacauuuacugggagucuuucucugugccgggcauugugaugagccccauuacaagcaucuaauuuaauccuaaucucucagaaagcacaugcuauauuuucugcauugaaaggaaagggaaugaaggcccagacuuugacuuugcucaagauacaugauacuugccaugucauguccccuuucagagugucccuuucuaugaucaaugguuuaguuugccacucuguguguauuucucuuuucuuuaaaauacgacauuguuuaaugggcuguuaaacaaauauaucgcuagauaguagaguugccugggaaugaguccugaguguuucuucaguuuccuuguccuauguggaaggauaugauaaaacaggcacacuccagagcuguuguguucuuuucugucuucucucaaccuguuuccaagccagugacccagcuggacucucaguuuccuaaucaccaccuagacucugucauuauuaaaaacaacacaauuuggucaagauuauggcuuuuaauugggauguggaaagaaacucaaguugaagaaauguugccaggaucauuggggaaugaauagccacuugaugcaagagggaaagcugugaagaacacuagcucucuuauuaugugguguccaggcaaaggggaguuaugcucuuacuauuucauuucauuucauuuuuuugagaaauuauuauugcagaaccauuggcuuccuuucuuucucaacuguagcuguaauguuuuauuugugcauguguacuuuugagagaguauuggucucugaagagggaguuagaaaaggaaaguauuugaaauggaaauaucuuaaaauuaugugucuuuccaauuguacauuggacuucuuuaggauuuagaaacaaaauggaaaauaaaaaaucacaaauaccuucuuuucaaacuagaaaacauuguacuguauagugaagaauuaguugaaagacaguagaucuuacauuucauugcagaguguuccagacauugaucaaauggcaaggaaaagcaaauauuaacuuucuuuuccuccccaccuucucacaauggcugggcaauacuuuuguauuccuguuuggaggauuuaauggccuuguuaacauguguaaaaacccugugauugaagacuuuaacaaaauagugaguagagguuuuuuuuguuuuguuuuguuuugguuuuuuagguuccauguuuauguucuuacugggugugugucuuuccuagugcucuagguuaagaacuaaauguguuagaaaaaacagauguaaugcaaauaaauagaagaguucucauuuccuucagugaacagagcucugaguuccugagcaguaauuuuacaguaccuucucaccauaucagaagaauuugugcugaacccagcugcuuuucucugaguuuuguuguaucauaacugauuaacaauugauagggccagacagcaauucaccuacauaugguagggggucgcaaugcaccaacauaguguagagaccgcucuugccaacaauuaauuggggaauucacuuuaugaagcccuguuuacagacugacaucuggagaaauucuuaaccuggauccauuccaaucuguaggauuuauggacugugcuugcuuuuuuguaaauagaacucuuuuucugcuuaguacauuguguuuacauaauuaucaauggaugaaaauggcuauguuucuguaauuucuuaauucucgccaccaagugagucuaaauucuaaccagcaauccagcuaaaagaauacuuggacaccuaucauuauucaaguuguggaaacaucuuaauacuaggagcacccugcucucuuaaaucccgacucucugacuggagcccuuauacccuaagggacuuaguguucagccuuuacggggguuuuaaaacuuguugagacacaugcuggaccucuuaaaauguauuagacucucuuuuauucacacgcuuuaucucugcucugaggugugaaauggaaauauuuucauacauggguacaugcauagucuuaaacacgcuuucaguucccaccauguuguggggaucaaaguugguuaucaggcagcggaacugagcuccauacauuucgcggggcauccuauuggacacacacuacagugaccuucaccugccccucugcagcugaacacuguugucucugucaauguggucagcauuguuuugcaaaaacagggagaaagaaaagucaugggauggauuuacaaggaacguagaaaacugaauaucauauguuggcacuggaaaccuaagacuauauagaaaggcauuuuuuucugcugcuuugcugaguuugcaacuguaaaauuauaccugguuaaggggguuuugccucuauaugacaacacagugaagaguagaguagaaauggaaaugagagagaaauggacauaagucuuccagucuuaccuagagagcaacagcagcauugaauggugucaaccugauucaccaugcuguauuaagagcacaguaagcaaaauguuccauucccaagggcuuuauuuccaagaugugcuuugaugaggucugugccuguuguauuuauuaagaaucuccuauauauauguuauucuggaaaaugucugcucagugagugccuuugaaaacccaauuucauaagaccacacaucuacaaccauuucaucuuggacaaaccugaaaaaaacaagcaauggggaaaggauuuaauggugcugggaaaacuggcuagccauacgcagaaaacugaaacuggaccccuuccuuagaccuuacauaaaaauuaacucaagauagauuaaagacuuaaauguaaaaaccaaaaccauaaaaauccuagaagaaagccuaggcaauagcauucaagacauaggcaugggcaaagacuucaugacaaaaccgccaaaagcaauugcaacaaaagccaaaauugacaaaugggauuuaauuaaacuaaagagcuucugugcagcaaaagaagcuauaucaucggaguaacaggcaauguacagaauaggagaaaauuuuugcaaucuacccaucugacaauggucuaauauccagaaucuacaaggaacuuaaauuuauaagaaagaaacaaccccaucaaaaagugggcaaaggauacagacagacacuucucaaaagaagacauuuaugcagccaacaaacaugaaaaaaagcucaacaucacugaucauuagaggaaugcaaaucaaaacuacaaugagauaccaucuuacaccagucagaauggcaauuauuaaaaagucaggagacaauagaugcuggugaggcuguggagaaauaggaacacuuuuacacugucggugggaauguaaaugaguucaaccauuguggaagacaguguggcgauuccuuaaggaucuagaaccacaaauaccauuugacccagaaaucucauuacuggguauauacccaaaggaauauaaaucauuccacuguaaagacauaugcauguguaauuauuuacaauagcaaagacaugaaaccaacccaaaacccaucagugauagccuggauaaagaaaaugugguauguauacaccauggaauacuaugcagcuauaaaaaugaaugagaucauguccuuuacaggaacauagaugaagcuggaagccgucauccucaggaaacuaacacaggaacagaaaaccaaacaccacauguucucacuuauaagugggaguggaacagugagaacacauggacacaaggaggggaacaacacacacuggggccagucaugggguuggaggcaaggggagggagagcauuaggacaaauagcuaaugcaaguggagcuuaaaaccuagauggcagguugauaggugcagcaaaccacuauggcacacauauaccuuuguaacaaaccugcauauucugcacuuguauccuggaacuuaaaguaaaauaaaaaaaaaaacccaacaauuucacagaaauguuggcuuuccaagauggccccugagcacagaacagaaacacacacacacacacacacacacacacacacacacacacacuuauauaugugugugugacuauugauacauauaauuguagauauauaauugauauauaauuaucuaucuaucuaucuaucuaucuaucuaucuauauauaauuagucaaaaaaauucccaccaucauaccuuuaccaauugggugcucuugaggaaaaguuaaguccaagugagggcagacuaagcccuuuggucugaaguccaguguggaagaagagaggucauggaggauggaucagaggaagugcagucccacuuuuucuccauaacuuuuugcauuuugucuccauuguaccccuuguguaaguccuugucuguguuuauccaugauucuuccucgcuauaccuccuauucugguuuacguucuucuuacugcuaauauauuuuguaugauuuacuauuuugucauuuacaccuuuuguaaaucaccucuaaugucuuguguagaagugcauacacagaaagauaaaauauguuaugauccauucucucuccuccccuuugcuuuuaauccugucucccucucuccugcccaucccccuuccuucuauucuuccauuuugccaaaaacuuucuaaauacucagccaguauugcuacacaagcauacagcagaugccuggcuuuuuauagcuuacauucuccuugggcuagaaaaaaauauuugaaacaacuggaaaacuaacagaguagagaauuaucagaaaauuuauacaugucuauguaccuaugugcauauauaugaaucaucucucucucucucucucugucacacacacacacacacacacacacacacacacacacacacacaguaaaauuucuccaaaugaauauauuuauagagucucugagucugagggaagcuucauauuuaagauagugcgauauucuuuucaaaggacccauuccucacacugcacaugaauuauaaaccauugaaaugaaaucucaaaaaaacacuuuauucaucaaguaaaucuugaucaaaagaaaaaugucacugguguauauuuuugagguuucugcuguuuuuaauucuuaguggcaauucaggucaugcaaacagaagauucuuuggcaagucagaacaaggucuguggucauuugugauucucuuaaugugucuccuugccugauuccucuuaaauauaugaagaaaaaaagaagaaaagauuuucuccucugugaaggagugggacacucucauccaauacccaguuuauuacaaaggucacuauugcaagaaaauaaaccagcaaagucuucaaauauacccacagaacagcuugccagcccucuggauuuucuguaucacugaaaggaaggacuaguuaggacggccaacucacaagcaaauccauuaagaucuuccugcaaaaaaaaaauguguuauugagaaagcccuggugcgauaggaaggaggggaaccugcacuagcucugggacauuuguggcaucaguuccccucucugagccucugucuugauaucuacuacaugaaagugauuaaaccuaaagcuacaguucuuugauuccaccaaaaaaauggugcagaaagugcauguauaccaaaaaaaaaaaaaaacaaaacaaaaacaaauagaaggcaggaggugauaaaaugcacggugugcugagcgugaugcuagguuuacaugaucucauggcaugcucacagucggccucagcaucacccccucuuuaaagauggggcaacugaugaucugccucggguccuacagcuaggugcagcuugguccacuacugugauaacuugaacuccacuguucaagacuuaagccuuguucuuugccuucucuccuucaggggccucucuguucacuccccacuuggcuucacuuuugauagaggagaagagaaacuccuggaaacaauuguaaaauauuggaaaaucuaagaguuuaugggaaaaaaaaaaaaaccuucuuuaaaaaaauuuccccaguguaaucauaagaaggacaucagacaaauuccaauagaaaaguaucaugcaauauaccugaccaguacuccucaaaacugucaaggcuaucgaaaacaaagugugagaaauuaucaugaccaagaagagccaaaggagacgugacaaugaauguuaugaaguauucuggauagcauccugaaaaagacaaaggacauuaaguaaaaaugaaaaaaccugaauaaacuguggacuuuaguuaauaauaauguaucaauauugguucauuaguuguaacacauguaccacacuaaugaaagauauuaauaggggaagcuaugcagaggauauauaggaauucucuguacuagcugauaaauuuuucugcacaucugaaacuauucuaaaaaauaaaaucuauuagagaaaaauuuuuuuaccguuacccaacaagaaagaacauuugucacaguugggcaaaaacuaugcuuucaaacuuaugauaauaacaccauaggauauucugguaguaguauuguaagauaagacaucuggcaguguuaaaugccucuaggaaguuugaaaauuacaauacuguaugcagagaagcuuuccgugagccuuagauuaggccaggguugccaaacuacuuauggcccacaggccaaaccuggcccaacaccuguuuuaguaaauaaaguuuuauuggaacacagccagugcucauucacauuuauguauugacuauggcugcuuuugcacuaugacagcaaaauggaauagugguaccagagaccagauggcccacagagucuaaaaaauauuuacuaucuggccaacccccugguuuaggcuauuugaauuacaaaguagguuuugaggcaagcuagcuaagaggcccaauucaccugggguagaaucaaauauuggaacccagcagaucaaguagcaggagagauauuaggcagggcuugaguaaaauagauuagccaacucccuagguggccaucugguuaagguuuucaggcacuuuucucuuugcuggagagcugucuuuggccccagggauauaucaguuuguuugaaaccuacccugccuaucccccaccuuagggacuuuaucuugaccuguuuauccuacucuucuuuugguguuccugacuuuggccugaaaauagucagugaaauuuucuacuuaaauaaauuuuuggcuggcuaaugauugcuauauguaugaauauguuaucaauguggaaaagucaaauuuuuacagugagguuuaguuaacacaaagggccauauacauaauuugauugucagcaauucagucauaggccccauaauaaagugccucaaagacauucuuuuuaacauccauugauguagucuccaauuuauaaaugguugguucuaugcugauuguucaaaauucauuauauaugcuucauauuuuauaauuucacgaguuaguuuuccagauuaguccagaaaaguuuuuaaaguaauaacuuaauuguaauagggcucaauaauaaaacuaucacauauaacagcaauauuccauuguagaaaugcaucuagaguucugacucaagaugccagauucccuuaauuauauuccaccuagcaguggugaggggaaccuagacauccugcgcuggugggagagagagauuguucugaacaccaugaccacuagagagagagcugccacauuuagucacuagauguaugacuagaaagaaugaacauaaguugggaaagcccauuuuguugccacaaggaguuugcugguauuugaaccuuagauaaauaggaauuugcuguauuauuauuuuuaacccuaauucuacauaucacauuaauuaaguuagaucauaucuaacuuaauuauuaguuaaguaguuagugcuacucaaaguaucgccggaagacuggcaucugucugcaaacuuuuuguuaccugacauucacaaaguguugagaaacuuuuguagcaauugaaagggcuuuuuuacgacuguugaaccuaauucuaaaaggugaaagcugaugucuuauucauuuaauuuuucuacuaguucuuuuuauucauuucuguugccuuuuacaaaaguauugguuuagauagauuggaaauuugaaaagcaaguuuuuuuuuuuugagaagcauugcuguaaacuauagagagccggguuacagugguauagaaacuuguguaagccuuagcaaauaccauaucucuugguuuuauuuaauaaauugaaacuuucuagcaggcccgacucugcauagcuaagucagagaugcaagaaauguaaaauuuauauuuucuuuaauagcgagaggguaaggaauucagucucaguuauuauugcccacccuugccacaccccacugcauccagggaggcuuauacauggggcucagaaaaugaggacacaguagcuacccacagccucaaugccugagccaucaguggagucaacuccagggcucacuauggcuaaggcuggggcuucuggugcccaguccuucugugucccaugccuccaucucuggaugaugucuuguuaccuugggcugugggcugcugccucugagccaacucagguaccggcugccucuuacucucucaguuccgucucuucagggagcccuggcuauggaaaaccaaagcuggaaagaaaaguauuuccaggcuacuuuuauucaugggggccccauuacaaacuuccuuggaggugaggaggcacaaaaugaucugggguaacauuguaggaaaaggggcagggggagggccaguagaagaaaagcacacauuacuaucaauacauuuacccuugcgaagugagggcacugagcccuuugugacagcguuauuugaggauggagugaguuacuguacugaaaaugcaagguagagugcucagcacacaguagguccaugggauuuuaagucuccugcccuccucgaggcgagacgcuugccugauuuccaggccagaagccugcaguucugcuuguccuugccugagggcucauuugugucacacuugccauuguguuuggaugacuuccuccagcugcagcuuuucuuccccuucuccuuuuaugggauggacucuaagccaaggguacuucaucuggaguccauagaacccaggcuucauuuccauggaugaccucagagaguuucaguuuguuuggaaguuuuauauuuuaucuauauucuuuuguuugcuuaaccuuaaauuuuuaacaaauacauauuuuuuuccuagcaaaaguaucagauauacucaucuguuguuucuuagcagaugucaauuuaguagaugugggauggggccugagauucugcauuucugacaggcucccaggugauuccuguucggcuggugugaucucauuacaugagcaaggccaaagaggccuuccgaauuuguggacuuaccucccauugcccauuagcccaugagcugccauuuucuuuuugcaagauacgcagucaucagaagcagcaucugaaauccuuauaauuacaugccacagccccuugaucucccagugucuugacuucugccugcacaucauccuaguuaagcauggguaaaagcauaaguaauugcacaccaggggcuauuaccaucccguucaccuccagcuauggagccccuagugcuuucagauggauggccagucuaacuucaaaauuccauugugaagaccuacuucuuguuauacaacuacucccaguaucagugauuuucucaagaggacagagccuggggcaaggauuaaagugauggcuguuugagaacacaaacucagggaagggagggugaggacaaagggcagcaaccaagggaauaugugaggccaugcagaguggugcugccugcaccugggagugccucuuuccaagagccaugaagaggcugagcaggugcagcuacacagcccuuuuuuucgaggccuacagaagagaacuaaucaucuggcauauuccuaguuggugggagcagagggggaauucucugcucagcuucggcuucuuuucuuuuccuaugaugcacccgcugggcaggaugccagagcccaccaacauuguucuucccaaacuggaaguggcagacacucugggugugcuguugggcagucuggcuacaggaggcauccaaagaaaggggggugguaccaggcaggguggcucacgccuguaaucccagcacuuugggaggcugaggcaagcggaucaucugagguuggaaguucgagaccagccugaccaagauggagaaaccccaucucuacuaaaaauacaaaauuagcugggcaugguggcgcaugccuguaaucacagcuacucaugaaggcugaggcaggagaaucgcuugaaccugggagacggagguugcggugagccgaguucacgccauugcacuccagccuaggcaacaagagcgaaacucugucucaaaaaaaaagaaggaaugaaagaaagguggguggcauucccagggcaaguggcuggucagcccuugcuguggguguggagucugaggaggugcaugcaaucuguguccacuacagcaccugaagguuagagcaccagggcagggcaccuugccgucucuguaugugggauagggcaaagagaagagaggaaauuacguucauuguugauaaucuauagcaacuggcuuuuccuuuugagcccacgugauagagaacuaggaagucuucuauuucuguuuugucaaaauacugagucagcuggaaugaaaaggacacuaauuuaucaguggagaccugccuguccccaagcacauggcagcugucuuaacugcucaucaaacucgcucucaucuguuggcugggggacgucucuuccuugcuccugaaguugucuugugugugaaggccgcugccugaguacagcauuccuggccucccccaccucccucugucucagggauggagaagugacuuuucugccuuuuuuuuucaggguucuguucagcagggugcacaucccuucuuucugcucuucccugucauuagucuuccaggucuccccucagccccugccaccaccgcauauacccuuugccuuuuuacucaguuggaugaguguaaagaagaagaaaagaacuggcuuuuugggccucuccaaaggucucagccccaccgugugacaagacuggaguucugugacauuggcaaguuacugaaucucaugagaccucaguuuucuuauaaaaugagaauaauaauaauaccuauuucaugguguaguguguaggaauuaagugagauaauaugggcaagauuucuaacccuuagaaaguacucaauaaugauaguucuuguuacugugaucuacaggcuuuggagagauuaaaaauaagccugguucuccuucuggguaaggcccuugucauuuucggguauggcugggcaaguuccauugcauugauggauaauucuaauguuuucuauucagggaaucucugaggauagcucuaauucuuauuuuaugaguguggaaauguguuucucucauuucccucagcaucgauuucuguuucagaguugaugcagaggcguggauaguaagguguguuuuccuucaaaccugggaucuugccacuucccucucauuugaaugaugugguuuugaaaucagugcugcugauacccucucuuuccucagaaugaugugagcuucauaaaccccuuuaugcauaaaaccaaacuugagagcugaggcuuuggacucugugugugagaagccucagaaaaagaaaucacacuucauuaacaagaagaauggcuucggaaaaaagcauguacaguauacaacauguuaguacauuuccaggaaaugauggcaaaucagucaaaucaaguugcagauguagucaggaaauucucucaugauugugaguuucccauacaagauuuugguggauaaagucaaaugaguuauacccaguacuucaaaagcacagcagugccagcucauccucaagucaccuuuggauugaaaucuuccacaaugcaguucaugacuuugcuguugaauuaugaaguguuugugucugugcuguaagguguugggauucaggaauagaaucaaauuccagagaaauaccaccacaaccaccgucccagaacaccagcaaccuuucucuuuccucaaggaaggcuucuuucccucaugguucaugugcuuugcuucuuuuauaguuucugaugcucugguauuaaagggaauuccugccgaggggccuuuauauucuggauaucacauaugcuauaggauagguuuuguccuuucugacuuuaaaaaggauaaauuuaaagacaauacuguugcugcuguugccaagucauaaucaguauaauaugucuuuaggggcaguaauucauucccaguauucucaccaaaaagaaacauuuaagguuauucuuuucaggccacuccugaagauuguugucacgucauuuauuaucuuuaugaucaguguguuccuaagcuaugauugcuguguagagaggcagauuuucuuacacauugcuuaaaauauuguuuguauuuuucaacuaggugguuguacuacaaucccagagucagaccuagaagaaagaucaguagaacaagacucuacagaacuguuuaccaaccacagacaucucacugcagagacacccaggccugguaagagacuggauggccuucacaagcguuaguuaagucagaagcagugacaaucuggucaguuuuugucauaccagagagcauuccgcaaagcugcuuguuuuccaauuucuucauucuuccccuuagcacuggugcagcugaauuugauccuuuguguauuccugucacuauucagaucuuuucucucucuuucucucuuacucucuuuuuuuccagaaguuucaccccuccaaggagucucggaauaauucaaguagaguuguuugguugagaggaacauccccaucucaaggccgaaccugugugaaccucaugccaagcacagauauagggcuggcgcaggugcuuccuaaagcucaccuuccuggagaugacaugcauagaaagagggguugggacuuuuuacuucacuaggagaacuuguaacaccauggggaagucagcugaaacuugucuuguuuugccaggaaaggaaguaguugccuuuggucauccaucugcuaauagucacagaauacagugaaaugacauaguuuuggguuagauuuuauaaugcaaagauucagauccaaaauaauuucauaccccauuuuuucacagaauucuuauauaguaaauguaucaaguuuaauaaagcaucucauugucaaauaauaucuuggauuuuauuuauaauuagagggauuuaugagugauugcucuacauuauuucuucaaaggaaaggaaaggaauugaagacuuugcuacucucugguaagacuugaaugugauuauuuuauaaauaaaagaaccacuaugaaacuuucaugugauuuguucuauuaagcuaaacguggaagaagggaaguuuucuaguauuguaugaaaauguuuaaauauuuucaaggaagcuaguacauuaacauccccuuuucauuaccccauuggguggcaccuuuuaaaaauccagguuauuaaaggauucacacuuuauuacaguuaaaauuuaagguuuuuauguguaagaagugaaagaaacuuugcuaauuucaaguucgaauuacaguugugagauugauuuauuuaaauaaaaauaugccuuugccaguu

SEQ ID NO: 192036 - RNA, 476529 nt, Homo sapiens
aacuggcaaaggcauauuuuuauuuaaauaaaucaaucucacaacuguaauucgaacuugaaauuagcaaaguuucuuucacuucuuacacauaaaaaccuuaaauuuuaacuguaauaaagugugaauccuuuaauaaccuggauuuuuaaaaggugccacccaaugggguaaugaaaaggggauguuaauguacuagcuuccuugaaaauauuuaaacauuuucauacaauacuagaaaacuucccuucuuccacguuuagcuuaauagaacaaaucacaugaaaguuucauagugguucuuuuauuuauaaaauaaucacauucaagucuuaccagagaguagcaaagucuucaauuccuuuccuuuccuuugaagaaauaauguagagcaaucacucauaaaucccucuaauuauaaauaaaauccaagauauuauuugacaaugagaugcuuuauuaaacuugauacauuuacuauauaagaauucugugaaaaaaugggguaugaaauuauuuuggaucugaaucuuugcauuauaaaaucuaacccaaaacuaugucauuucacuguauucugugacuauuagcagauggaugaccaaaggcaacuacuuccuuuccuggcaaaacaagacaaguuucagcugacuuccccaugguguuacaaguucuccuagugaaguaaaaagucccaaccccucuuucuaugcaugucaucuccaggaaggugagcuuuaggaagcaccugcgccagcccuauaucugugcuuggcaugagguucacacagguucggccuugagauggggauguuccucucaaccaaacaacucuacuugaauuauuccgagacuccuuggaggggugaaacuucuggaaaaaaagagaguaagagagaaagagagagaaaagaucugaauagugacaggaauacacaaaggaucaaauucagcugcaccagugcuaaggggaagaaugaagaaauuggaaaacaagcagcuuugcggaaugcucucugguaugacaaaaacugaccagauugucacugcuucugacuuaacuaacgcuugugaaggccauccagucucuuaccaggccugggugucucugcagugagaugucugugguugguaaacaguucuguagagucuuguucuacugaucuuucuucuaggucugacucugggauuguaguacaaccaccuaguugaaaaauacaaacaauauuuuaagcaauguguaagaaaaucugccucucuacacagcaaucauagcuuaggaacacacugaucauaaagauaauaaaugacgugacaacaaucuucaggaguggccugaaaagaauaaccuuaaauguuucuuuuuggugagaauacugggaaugaauuacugccccuaaagacauauuauacugauuaugacuuggcaacagcagcaacaguauugucuuuaaauuuauccuuuuuaaagucagaaaggacaaaaccuauccuauagcauaugugauauccagaauauaaaggccccucggcaggaauucccuuuaauaccagagcaucagaaacuauaaaagaagcaaagcacaugaaccaugagggaaagaagccuuccuugaggaaagagaaagguugcugguguucugggacggugguuguggugguauuucucuggaauuugauucuauuccugaaucccaacaccuuacagcacagacacaaacacuucauaauucaacagcaaagucaugaacugcauuguggaagauuucaauccaaaggugacuugaggaugagcuggcacugcugugcuuuugaaguacuggguauaacucauuugacuuuauccaccaaaaucuuguaugggaaacucacaaucaugagagaauuuccugacuacaucugcaacuugauuugacugauuugccaucauuuccuggaaauguacuaacauguuguauacuguacaugcuuuuuuccgaagccauucuucuuguuaaugaagugugauuucuuuuucugaggcuucucacacacagaguccaaagccucagcucucaaguuugguuuuaugcauaaagggguuuaugaagcucacaucauucugaggaaagagaggguaucagcagcacugauuucaaaaccacaucauucaaaugagagggaaguggcaagaucccagguuugaaggaaaacacaccuuacuauccacgccucugcaucaacucugaaacagaaaucgaugcugagggaaaugagagaaacacauuuccacacucauaaaauaagaauuagagcuauccucagagauucccugaauagaaaacauuagaauuauccaucaaugcaauggaacuugcccagccauacccgaaaaugacaagggccuuacccagaaggagaaccaggcuuauuuuuaaucucuccaaagccuguagaucacaguaacaagaacuaucauuauugaguacuuucuaaggguuagaaaucuugcccauauuaucucacuuaauuccuacacacuacaccaugaaauagguauuauuauuauucucauuuuauaagaaaacugaggucucaugagauucaguaacuugccaaugucacagaacuccagucuugucacacgguggggcugagaccuuuggagaggcccaaaaagccaguucuuuucuucuucuuuacacucauccaacugaguaaaaaggcaaaggguauaugcggugguggcaggggcugaggggagaccuggaagacuaaugacagggaagagcagaaagaagggaugugcacccugcugaacagaacccugaaaaaaaaaggcagaaaagucacuucuccaucccugagacagagggaggugggggaggccaggaaugcuguacucaggcagcggccuucacacacaagacaacuucaggagcaaggaagagacgucccccagccaacagaugagagcgaguuugaugagcaguuaagacagcugccaugugcuuggggacaggcaggucuccacugauaaauuaguguccuuuucauuccagcugacucaguauuuugacaaaacagaaauagaagacuuccuaguucucuaucacgugggcucaaaaggaaaagccaguugcuauagauuaucaacaaugaacguaauuuccucucuucucuuugcccuaucccacauacagagacggcaaggugcccugcccuggugcucuaaccuucaggugcuguaguggacacagauugcaugcaccuccucagacuccacacccacagcaagggcugaccagccacuugcccugggaaugccacccaccuuucuuucauuccuucuuuuuuuuugagacagaguuucgcucuuguugccuaggcuggagugcaauggcgugaacucggcucaccgcaaccuccgucucccagguucaagcgauucuccugccucagccuucaugaguagcugugauuacaggcaugcgccaccaugcccagcuaauuuuguauuuuuaguagagaugggguuucuccaucuuggucaggcuggucucgaacuuccaaccucagaugauccgcuugccucagccucccaaagugcugggauuacaggcgugagccacccugccugguaccaccccccuuucuuuggaugccuccuguagccagacugcccaacagcacacccagagugucugccacuuccaguuugggaagaacaauguuggugggcucuggcauccugcccagcgggugcaucauaggaaaagaaaagaagccgaagcugagcagagaauucccccucugcucccaccaacuaggaauaugccagaugauuaguucucuucuguaggccucgaaaaaaagggcuguguagcugcaccugcucagccucuucauggcucuuggaaagaggcacucccaggugcaggcagcaccacucugcauggccucacauauucccuugguugcugcccuuuguccucacccucccuucccugaguuuguguucucaaacagccaucacuuuaauccuugccccaggcucuguccucuugagaaaaucacugauacugggaguaguuguauaacaagaaguaggucuucacaauggaauuuugaaguuagacuggccauccaucugaaagcacuaggggcuccauagcuggaggugaacgggaugguaauagccccuggugugcaauuacuuaugcuuuuacccaugcuuaacuaggaugaugugcaggcagaagucaagacacugggagaucaaggggcuguggcauguaauuauaaggauuucagaugcugcuucugaugacugcguaucuugcaaaaagaaaauggcagcucaugggcuaaugggcaaugggagguaaguccacaaauucggaaggccucuuuggccuugcucauguaaugagaucacaccagccgaacaggaaucaccugggagccugucagaaaugcagaaucucaggccccaucccacaucuacuaaauugacaucugcuaagaaacaacagaugaguauaucugauacuuuugcuaggaaaaaaauauguauuuguuaaaaauuuaagguuaagcaaacaaaagaauauagauaaaauauaaaacuuccaaacaaacugaaacucucugaggucauccauggaaaugaagccuggguucuauggacuccagaugaaguacccuuggcuuagaguccaucccauaaaaggagaaggggaagaaaagcugcagcuggaggaagucauccaaacacaauggcaagugugacacaaaugagcccucaggcaaggacaagcagaacugcaggcuucuggccuggaaaucaggcaagcgucucgccucgaggagggcaggagacuuaaaaucccauggaccuacugugugcugagcacucuaccuugcauuuucaguacaguaacucacuccauccucaaauaacgcugucacaaagggcucagugcccucacuucgcaaggguaaauguauugauaguaaugugugcuuuucuucuacuggcccucccccugccccuuuuccuacaauguuaccccagaucauuuugugccuccucaccuccaaggaaguuuguaauggggcccccaugaauaaaaguagccuggaaauacuuuucuuuccagcuuugguuuuccauagccagggcucccugaagagacggaacugagagaguaagaggcagccgguaccugaguuggcucagaggcagcagcccacagcccaagguaacaagacaucauccagagauggaggcaugggacacagaaggacugggcaccagaagccccagccuuagccauagugagcccuggaguugacuccacugauggcucaggcauugaggcuguggguagcuacuguguccucauuuucugagccccauguauaagccucccuggaugcagugggguguggcaagggugggcaauaauaacugagacugaauuccuuacccucucgcuauuaaagaaaauauaaauuuuacauuucuugcaucucugacuuagcuaugcagagucgggccugcuagaaaguuucaauuuauuaaauaaaaccaagagauaugguauuugcuaaggcuuacacaaguuucuauaccacuguaacccggcucucuauaguuuacagcaaugcuucucaaaaaaaaaaaacuugcuuuucaaauuuccaaucuaucuaaaccaauacuuuuguaaaaggcaacagaaaugaauaaaaagaacuaguagaaaaauuaaaugaauaagacaucagcuuucaccuuuuagaauuagguucaacagucguaaaaaagcccuuucaauugcuacaaaaguuucucaacacuuugugaaugucagguaacaaaaaguuugcagacagaugccagucuuccggcgauacuuugaguagcacuaacuacuuaacuaauaauuaaguuagauaugaucuaacuuaauuaaugugauauguagaauuaggguuaaaaauaauaauacagcaaauuccuauuuaucuaagguucaaauaccagcaaacuccuuguggcaacaaaaugggcuuucccaacuuauguucauucuuucuagucauacaucuagugacuaaauguggcagcucucucucuaguggucaugguguucagaacaaucucucucucccaccagcgcaggaugucuagguuccccucaccacugcuagguggaauauaauuaagggaaucuggcaucuugagucagaacucuagaugcauuucuacaauggaauauugcuguuauaugugauaguuuuauuauugagcccuauuacaauuaaguuauuacuuuaaaaacuuuucuggacuaaucuggaaaacuaacucgugaaauuauaaaauaugaagcauauauaaugaauuuugaacaaucagcauagaaccaaccauuuauaaauuggagacuacaucaauggauguuaaaaagaaugucuuugaggcacuuuauuauggggccuaugacugaauugcugacaaucaaauuauguauauggcccuuuguguuaacuaaaccucacuguaaaaauuugacuuuuccacauugauaacauauucauacauauagcaaucauuagccagccaaaaauuuauuuaaguagaaaauuucacugacuauuuucaggccaaagucaggaacaccaaaagaagaguaggauaaacaggucaagauaaagucccuaaggugggggauaggcaggguagguuucaaacaaacugauauaucccuggggccaaagacagcucuccagcaaagagaaaagugccugaaaaccuuaaccagauggccaccuagggaguuggcuaaucuauuuuacucaagcccugccuaauaucucuccugcuacuugaucugcuggguuccaauauuugauucuaccccaggugaauugggccucuuagcuagcuugccucaaaaccuacuuuguaauucaaauagccuaaaccaggggguuggccagauaguaaauauuuuuuagacucugugggccaucuggucucugguaccacuauuccauuuugcugucauagugcaaaagcagccauagucaauacauaaaugugaaugagcacuggcuguguuccaauaaaacuuuauuuacuaaaacagguguugggccagguuuggccugugggccauaaguaguuuggcaacccuggccuaaucuaaggcucacggaaagcuucucugcauacaguauuguaauuuucaaacuuccuagaggcauuuaacacugccagaugucuuaucuuacaauacuacuaccagaauauccuaugguguuauuaucauaaguuugaaagcauaguuuuugcccaacugugacaaauguucuuucuuguuggguaacgguaaaaaaauuuuucucuaauagauuuuauuuuuuagaauaguuucagaugugcagaaaaauuuaucagcuaguacagagaauuccuauauauccucugcauagcuuccccuauuaauaucuuucauuagugugguacauguguuacaacuaaugaaccaauauugauacauuauuauuaacuaaaguccacaguuuauucagguuuuuucauuuuuacuuaauguccuuugucuuuuucaggaugcuauccagaauacuucauaacauucauugucacgucuccuuuggcucuucuuggucaugauaauuucucacacuuuguuuucgauagccuugacaguuuugaggaguacuggucagguauauugcaugauacuuuucuauuggaauuugucugauguccuucuuaugauuacacuggggaaauuuuuuuaaagaagguuuuuuuuuuuuucccauaaacucuuagauuuuccaauauuuuacaauuguuuccaggaguuucucuucuccucuaucaaaagugaagccaaguggggagugaacagagaggccccugaaggagagaaggcaaagaacaaggcuuaagucuugaacaguggaguucaaguuaucacaguaguggaccaagcugcaccuagcuguaggacccgaggcagaucaucaguugccccaucuuuaaagagggggugaugcugaggccgacugugagcaugccaugagaucauguaaaccuagcaucacgcucagcacaccgugcauuuuaucaccuccugccuucuauuuguuuuuguuuuguuuuuuuuuuuuuuugguauacaugcacuuucugcaccauuuuuuugguggaaucaaagaacuguagcuuuagguuuaaucacuuucauguaguagauaucaagacagaggcucagagaggggaacugaugccacaaaugucccagagcuagugcagguuccccuccuuccuaucgcaccagggcuuucucaauaacacauuuuuuuuuugcaggaagaucuuaauggauuugcuugugaguuggccguccuaacuaguccuuccuuucagugauacagaaaauccagagggcuggcaagcuguucuguggguauauuugaagacuuugcugguuuauuuucuugcaauagugaccuuuguaauaaacuggguauuggaugagagugucccacuccuucacagaggagaaaaucuuuucuucuuuuuuucuucauauauuuaagaggaaucaggcaaggagacacauuaagagaaucacaaaugaccacagaccuuguucugacuugccaaagaaucuucuguuugcaugaccugaauugccacuaagaauuaaaaacagcagaaaccucaaaaauauacaccagugacauuuuucuuuugaucaagauuuacuugaugaauaaaguguuuuuuugagauuucauuucaaugguuuauaauucaugugcagugugaggaauggguccuuugaaaagaauaucgcacuaucuuaaauaugaagcuucccucagacucagagacucuauaaauauauucauuuggagaaauuuuacugugugugugugugugugugugugugugugugugugugugugugacagagagagagagagagagaugauucauauauaugcacauagguacauagacauguauaaauuuucugauaauucucuacucuguuaguuuuccaguuguuucaaauauuuuuuucuagcccaaggagaauguaagcuauaaaaagccaggcaucugcuguaugcuuguguagcaauacuggcugaguauuuagaaaguuuuuggcaaaauggaagaauagaaggaagggggaugggcaggagagagggagacaggauuaaaagcaaaggggaggagagagaauggaucauaacauauuuuaucuuucuguguaugcacuucuacacaagacauuagaggugauuuacaaaagguguaaaugacaaaauaguaaaucauacaaaauauauuagcaguaagaagaacguaaaccagaauaggagguauagcgaggaagaaucauggauaaacacagacaaggacuuacacaagggguacaauggagacaaaaugcaaaaaguuauggagaaaaagugggacugcacuuccucugauccauccuccaugaccucucuucuuccacacuggacuucagaccaaagggcuuagucugcccucacuuggacuuaacuuuuccucaagagcacccaauugguaaagguaugauggugggaauuuuuuugacuaauuauauauagauagauagauagauagauagauagauagauaauuauauaucaauuauauaucuacaauuauauguaucaauagucacacacacauauauaaguguguguguguguguguguguguguguguguguguguguguuucuguucugugcucaggggccaucuuggaaagccaacauuucugugaaauuguuggguuuuuuuuuuuauuuuacuuuaaguuccaggauacaagugcagaauaugcagguuuguuacaaagguauaugugugccauagugguuugcugcaccuaucaaccugccaucuagguuuuaagcuccacuugcauuagcuauuuguccuaaugcucucccuccccuugccuccaaccccaugacuggccccaguguguguuguuccccuccuuguguccauguguucucacuguuccacucccacuuauaagugagaacaugugguguuugguuuucuguuccuguguuaguuuccugaggaugacggcuuccagcuucaucuauguuccuguaaaggacaugaucucauucauuuuuauagcugcauaguauuccaugguguauacauaccacauuuucuuuauccaggcuaucacugauggguuuuggguugguuucaugucuuugcuauuguaaauaauuacacaugcauaugucuuuacaguggaaugauuuauauuccuuuggguauauacccaguaaugagauuucugggucaaaugguauuugugguucuagauccuuaaggaaucgccacacugucuuccacaaugguugaacucauuuacauucccaccgacaguguaaaaguguuccuauuucuccacagccucaccagcaucuauugucuccugacuuuuuaauaauugccauucugacugguguaagaugguaucucauuguaguuuugauuugcauuccucuaaugaucagugauguugagcuuuuuuucauguuuguuggcugcauaaaugucuucuuuugagaagugucugucuguauccuuugcccacuuuuugaugggguuguuucuuucuuauaaauuuaaguuccuuguagauucuggauauuagaccauugucagauggguagauugcaaaaauuuucuccuauucuguacauugccuguuacuccgaugauauagcuucuuuugcugcacagaagcucuuuaguuuaauuaaaucccauuugucaauuuuggcuuuuguugcaauugcuuuuggcgguuuugucaugaagucuuugcccaugccuaugucuugaaugcuauugccuaggcuuucuucuaggauuuuuaugguuuugguuuuuacauuuaagucuuuaaucuaucuugaguuaauuuuuauguaaggucuaaggaagggguccaguuucaguuuucugcguauggcuagccaguuuucccagcaccauuaaauccuuuccccauugcuuguuuuuuucagguuuguccaagaugaaaugguuguagauguguggucuuaugaaauuggguuuucaaaggcacucacugagcagacauuuuccagaauaacauauauauaggagauucuuaauaaauacaacaggcacagaccucaucaaagcacaucuuggaaauaaagcccuugggaauggaacauuuugcuuacugugcucuuaauacagcauggugaaucagguugacaccauucaaugcugcuguugcucucuagguaagacuggaagacuuauguccauuucucucucauuuccauuucuacucuacucuucacuguguugucauauagaggcaaaacccccuuaaccagguauaauuuuacaguugcaaacucagcaaagcagcagaaaaaaaugccuuucuauauagucuuagguuuccagugccaacauaugauauucaguuuucuacguuccuuguaaauccaucccaugacuuuucuuucucccuguuuuugcaaaacaaugcugaccacauugacagagacaacaguguucagcugcagaggggcaggugaaggucacuguaguguguguccaauaggaugccccgcgaaauguauggagcucaguuccgcugccugauaaccaacuuugauccccacaacauggugggaacugaaagcguguuuaagacuaugcauguacccauguaugaaaauauuuccauuucacaccucagagcagagauaaagcgugugaauaaaagagagucuaauacauuuuaagagguccagcaugugucucaacaaguuuuaaaacccccguaaaggcugaacacuaagucccuuaggguauaagggcuccagucagagagucgggauuuaagagagcagggugcuccuaguauuaagauguuuccacaacuugaauaaugauagguguccaaguauucuuuuagcuggauugcugguuagaauuuagacucacuugguggcgagaauuaagaaauuacagaaacauagccauuuucauccauugauaauuauguaaacacaauguacuaagcagaaaaagaguucuauuuacaaaaaagcaagcacaguccauaaauccuacagauuggaauggauccagguuaagaauuucuccagaugucagucuguaaacagggcuucauaaagugaauuccccaauuaauuguuggcaagagcggucucuacacuauguuggugcauugcgacccccuaccauauguaggugaauugcugucuggcccuaucaauuguuaaucaguuaugauacaacaaaacucagagaaaagcagcuggguucagcacaaauucuucugauauggugagaagguacuguaaaauuacugcucaggaacucagagcucuguucacugaaggaaaugagaacucuucuauuuauuugcauuacaucuguuuuuucuaacacauuuaguucuuaaccuagagcacuaggaaagacacacacccaguaagaacauaaacauggaaccuaaaaaaccaaaacaaaacaaaacaaaaaaaaccucuacucacuauuuuguuaaagucuucaaucacaggguuuuuacacauguuaacaaggccauuaaauccuccaaacaggaauacaaaaguauugcccagccauugugagaagguggggaggaaaagaaaguuaauauuugcuuuuccuugccauuugaucaaugucuggaacacucugcaaugaaauguaagaucuacugucuuucaacuaauucuucacuauacaguacaauguuuucuaguuugaaaagaagguauuugugauuuuuuauuuuccauuuuguuucuaaauccuaaagaaguccaauguacaauuggaaagacacauaauuuuaagauauuuccauuucaaauacuuuccuuuucuaacucccucuucagagaccaauacucucucaaaaguacacaugcacaaauaaaacauuacagcuacaguugagaaagaaaggaagccaaugguucugcaauaauaauuucucaaaaaaaugaaaugaaaugaaauaguaagagcauaacuccccuuugccuggacaccacauaauaagagagcuaguguucuucacagcuuucccucuugcaucaaguggcuauucauuccccaaugauccuggcaacauuucuucaacuugaguuucuuuccacaucccaauuaaaagccauaaucuugaccaaauuguguuguuuuuaauaaugacagagucuagguggugauuaggaaacugagaguccagcugggucacuggcuuggaaacagguugagagaagacagaaaagaacacaacagcucuggagugugccuguuuuaucauauccuuccacauaggacaaggaaacugaagaaacacucaggacucauucccaggcaacucuacuaucuagcgauauauuuguuuaacagcccauuaaacaaugucguauuuuaaagaaaagagaaauacacacagaguggcaaacuaaaccauugaucauagaaagggacacucugaaaggggacaugacauggcaaguaucauguaucuugagcaaagucaaagucugggccuucauucccuuuccuuucaaugcagaaaauauagcaugugcuuucugagagauuaggauuaaauuagaugcuuguaauggggcucaucacaaugcccggcacagagaaagacucccaguaaauguuagcuauuauuuucaguucuaacucccaauauauauuagucauuacaaguuacagccaaauacacaugaaacugcaggccaugaauacagcauaaauuuauauaugacuuucuaaaaaacgcucagguaaaaaaguugaggauggaguaaguagaccagugguggaauguucauagcugaacucaguggugaauggcaaaauugucaccaaggcauuaaaaguaauucacaugaaaauacuguacacaucccuuuuaaaaugaaaccacggauagucuacuaucauagauaaccacuccucugagauuacaauaggaauuuuuaaagggcucaaaugaugaugaugaugaugaugaugaugauggcgacgacggccagggguacauaaucacauucauuguuuucuauuuaccagcagugcuauuacuacugagaaaugcaaacccacaagauaauaugacacaaauggaugaaacauuaagauaaaaggguaaaacagugguagguuugcuuucucaugggaaaucguaauggccagcagcugaaccuugaaagaggaagucugcugaucuaguguuacuaaacauaggaggcagccaaggaacagagaaauagagcaauguauuuaaauguaugccuugaaggaagcaaacaccaauuauuuuuauaugacuuuaauucucccagugaauacuuuacggguguuggcaaguccuucuggaaaaggaagggauuauuaaugaaggauucaguggcaacugcucaccagugcucuaagaaauaacacuuaacaaagaaucauuuaguucacaccucaucucuaaagacauagaaauuuuaaggauccuuuuaaaaaauaguaaaauauuacauucacaugcaaagcccuuucuauuuuaguuuccaaaugauucuauagccugugugauaaacaaaucagcuucccacaggaaaauaaacauauagagggaaggaguuaaauuuuuuuccucuuaugcaaagaguaggugcuuaauauuuacuuguugacuuaaaaaggaauucaugaaacuugaggaaauacagccuuuaaaaaaaaagucaucauuuaagaauguuccaccacauccuuccaggauugugggcugagcacagcccacuaauguauaggcuaguaaaucuaaggaaaugaccaaucagcuccuguauucuauccuguuucuccaaaaacauaacccauucacucaagcaaauuccuauauuauguaaaaugaaaucucucuagcuaacugccugcucuuaaaauucuccaguugcuucaaaagcauggccucuggagcuaaaccgucagaauuuuaaucccagcuccaugauuauuaguuuuuuuuuuaaaaaagaaaaacuauuuacuugaucuuucucugcuucaauuuccuuauuuguaaaaugcagauaauaauuauaccuaguucauaggguauuguaaagauuaagugaguaaauggauguaaagcgcuucaaauggugccugacucauaguaaaugauacacaaguguuauaauaauaagcauuuacagcaucagcaucauuuuugcccuauacugccaaauuauuccagucuaagccugagauucucauguaagaugaguggggaacugaagguacaaaggguaguaaauuuuaggaagacagagcagcaacuauagcuaucuaggaacaccaauaguuggguuaaauauucaaauaaaaccuuaauugguugucugaucugguaaaaaaaaaaaaaaaaaacaaaaaaacaaaaaaacaaacaguggccaguaagaaauaacagcuuuguaaagaaagaacaaagauuaggguccagaucaauaauagaggacaacaauauacaucaaaucaagaaaaauuaacuaucucuugaccccacuuucaugccagcauuuucuuccguuucuuugcuccucuuagcagcaaagcuucuccgaagaguucucuauauaugcucuuuacaacucuucuuuuuuccuuucucucacacauccaucccagucuagcuuuugccucugccacucuacagaagcugcccaagaucacaaugaucuucacaugguuccaucaaugggcuaauuuucagcucucagcugacuugaucugugagcagcauuugacacagcugaucauucagucuuccuugaaacuuuuuuugcuugacuucuaggauaccacauucuacugcuuuuccuguuaccucacugcaggcucuuuuucaguauucuuugcugguuccuucucuucucccaaacuuccuaaaaguuacaauauccagcacucaguuuuugguccucaucucuuuucuaaacuuacucccuuggugacuuuauccagucuucuggcuuuaaaguaacauuuucaugcugacaacuccuaauuuuguaacuucagcccagauuucucuccugaaccccagauucauacccaacuucuuacuuaauaucuccacuuagaucucuaacagcaucucaaacucaacaugucccaaacuuuacucuuauccuucacaaaccuuucccaucucaccccacagccuuccccaucucaacuccacccuuucagugucucgagccaaaacuacuagagucauucuaaauucccuucuuccucucacauaucauguccauuuuguuaggaaauucuauuguuucaacauuugaaauauauccagaauaagaccauuucucaccacuacuaccacuuugguacaaucuaucaucaucucuuaccugaauuacaguaaucugcaguuuugcugucugcaguuuaaguuaccugcaaucaaccacagucugaaauauuaaauaaaaaauuccagaaauaauucacaaguuuuaaauugcacucuguuuuggguagugugaugaaauccugggucauccuucuccauccugcaugggacguaacucaucccuuuguucagcacauccaugcugcauaugcugccugccuguuauuguauaggaaaacacaacauuuuuucauaguacaggguucaguacuaucugcaguuucaggcaaccacugggagucucagaacacauccuccauggauaaggagggaauuacuguauugcuaaauugcuucucugaguaacccuuaaacuggacugcccauuuuuaccucugacccccacuauagucuauucucaaaagaguaacccgugaucguuuuaaaagguaaagucaugucauuccuucauucaaaauggcuuuccccauuucacccagaggaaaagcaaaugagcaaaugucugcacaaaggcugcacaugaucuggucccuccagccuccucuccuaccacaccaccucacuguccucuuugcugucccuggaacacaccaggcccauucccacuuuagggauggugcugaccauucccuuuaccugaaacacuugucccucugauuucugcaugaauaauucccucaccuucuucaagucuuucuucaaaaauugucuugugaacaaagccuauccugaccacccaauuugaaauuaugaccauguggcccccaccccuuuucugacacacauuuucuuuuucuguaacacuuaacauuagcacuuacuacuuucucacauacauaguucacuuauuuaucaugcuuauugcuuauugucuucacuugugagaauaagaguuccaaaauggcagggaucucuaucuaauuugguggcuacaguauccuaagucuuggaacagcgcuuggcacacaacaggcacacgauauuuaguugucaacuuaaaugaaugaauuuaggcugagagauuaggaggaagcaacggaaaccaaaaucaauucuaauuuuuacauaguauuaucugccuuuuccgcugggagguuggaaagcaguuacaacagaacacaguauagaaucucuucuuucuacucccccaguagaccuggcugcucugugaaccaaaaaagguucucaaaaaguucuuugcuuuagcugauacaaaucuuuaggaaaugaauuucacuggauaaaaacacauggagaauuugugagacugaauagguacaacaacaaaauguccaccccagagaagaaauaagaucccaguaguaauuucuguaggaaucaaaguuaaaaagaaauaacagagcauuuguaauuccaguucuugauaauaguuauuuauggaugaagaaacugcaaaagaagguauaaagacaucugucugcuugggaaauuucucaaaacgaaugaagaaggauccauguuauauccacuggggcaucaaguuauggccuggaacaguuuauuuuucccaggcuacuucaaaucuaaacguguuuuuaaaagcaagcccaaugaaagauuagauaaacaacuggacaauguuuuuuacacucugguaacauaaacauuucaaauuccucccuaacucuuuacuagcauaaaucucuaauuccagagaaggugaaauauccugaaaguuuaaacauuacuuugaauuauucacauuuaccuccaucucuaucuuauauuuuuuuggcaauaaaaagucagguuuuguccaaacuaugguacuaagacucccuugcaauugucaaacaauuggacuaaccccagcucuacuuucuuugaagauggaacauagcagcccuucccaaugguuucuguucuuuucuuucuuaccuccuauacauccugcacugcccuuuuucaaaccaagcuuuuauaaacacaaagaggaaauguagaacugucugccuucaauuaagcuaugaaaacaauuuuuaaaaugguaucaaacaccaaaaagaucaacugaaacagaaaacaucaggcagaagagagagcucucucugguuaaggaaaggggauguagaauaggagcuccaagaagcagcucuguggaaacacuacagaacaaagaaaaggaagggagagaauggagggaaacaaaggaugugaaaacccagagggaaugaggguaaguggcucacuguacaauccacaagucagaagguauagggaugacagggugguggccaggagagaaaauacugagcugagagagcuguuccauugacaucauaguccacaguuuaugaaagaacuucaccugacccugggucucacaacuuugagcaguagaguagguaaaaaucugcaccuuuuuuguucccaauuuuuauuuuagaaucggggguacauguucagguuuggaagggguauauugugugauccugaagcuuggcguaugaauggauccaucacucagggagugagcauaguacccaacagguagcuuuuauuaaccuucacuccugcccucccugaucuuacauucugcagugucuauugauucuauguuuaugaccauuguacccaauguucagcuuccacucauaagugagaacaugugguaucugguuuucuguuucugcauaguucacuuaggauaaugguuuccagcuguauccauguugcuucaaaggacaugcuuucauuguuuuguuuuuuauggcuacauaguacuccauggugcauauguaccacauuuucuuuauccaauccacugcugauggucaccuggguugauuccacgucuuugcuaccgugaauagcacugcgaugaacauacaaguacaugugucuuugggaaaaugauuuauuuuucuuuggauauauacccaguaauggaauugcuggguugcaugguaguucaacucucaguucucugagaaaucuccaaacugcucuuuauaguggcugaacuaauucacauuccuaccuacaguauauaagcauucccuuuucucuguggccucacccagaucuguuauuuauuuuuuuuuacuucuuaacaguagccauucugacuggugugaguugguaucccauugugguuuuggguggcauuucucuggugauuagugauuaugagcauuuuuucagguuuguuggcugcuuguaugucuucuuuuuagaaguaucuguucaugucuuuugcccauuuuuaaugagguuauuugguuuuuacuuguuuauuuguuuaaguuccuuauagaaaaucugcaccuuuaugucccagaaaaaccacacaucaaguuagcucccgggcaaauuacccaauaccuuugaguuucuauuucuucauuugagaaaugaaaguaucuuccuaaaacugauuguggggaguaaauaaaaccuuauauaaggcaucagagguaaagugaugcucaguaauuggcaguuauuauaauaaaugauaaaaagauuuacugacccaaggucagacagugagccaaugacccuguuaggaguagagcccaggucugcugugucaugaguauuuucuaccaaagcacacugcaguagugagagaaacacagaaggcagaaauugaagaaacucaaaaaaagguacgaauguacaaggcaggaauguacagauuaucuacacuuuagauaauccagacaacuagauccagacuauggguuuugaggggugaugaaccggaugcaauuuuuauauaagaauauguuaaucauaauugaauaauaauuacauuaguaccuuuuuuuuagcacuuaugugcuagccauaguguuacuuauuuuguguuugcucauuuaauagugaucuagaaugguagugauuagugucucauuucacuaaugaugaaacuaagcuguaaaaagcuuaagugacuugcucaaagucacauacauagugauugggagaacuugaauucaaaucuguuauaugcugauuccaaaauucaagucuaaacuaucccauucucucgcuucuccuugucagaaaggaaagacacauagaaaugcaguugugaauuacuguccaaacaaucugaguucuagacuggcaaaaagaagaucaugguauauacuccauauccucaacaccuacuacaccccuugcucaaaagaaaagugaaaggguuugggaaaaucacugaaguuuccucuuaguaaaaaaggaauuagcacagaaguaacuuaaagagacaccaaugaagauagacccugagacugucuaaaaacaucuugcacuguuuuaaaagaauucagcauugguggauacuucuauaggaauccagcauauaauuacaaaggagagaaaguggcucauuagaguagauaggauuuacaacuaaaaagaaguaaaauaauaaaguggaaaauaaagccuuuaccaauucuguugaggaaaaagacaaaaucaaucuucugaaaguugggaaaauucaaaggagcucauagaggauaaaauuuaauuacaacaaauauaaaggaaaaauaauuaaaagaaugaucuuagggaagggaacuuggcauuuucuaaagaugcuggacagugguagaacauuuaacauuucuaggaagaucuauuuuccaaaguuagcaucaccaugcuauaaaaccacccaaaucccugaguacaaacucauucaggaaaaaauuugagagcaaucucaugcauguauauguaugcaaaauccauuaagguauuaguaauucaaacucagaaucauauuuuuaaaaguauaauuaaagauaacuugauccagaaaugcaaaaugauucaauuaaguccucaaauaaauauaucaaaacggaaucucaauagaggauaauauuuaacauccacuucuaauuuucaaaaaaaaauagagauuccauaguguaaugaugagcacucuggacucuaauuuuuuuaaaaaugccagugaacuaggaauaaggaucuaaaacuaauaggcaacauaaaauuuauaaguaaagcagacaaaauauucacguuagcauuagguuaaaaaugaggaucuuagcuaucacaacuacuacuugacauuguuccagaaauucaaagcaguauaauaagauauuuuagaaaggaagaaauguaugcauuagaaaaaagaauaaucauaauuuccagaugauauaauuguagaccuaaaaaauuccaaaaauauaaaauaaaaagucuuauuuuccaccuaucacauagacuagguagaagauuacaaaauacauguaaaauauaaguauaaaaauauugaucauuucucucugcauuaacaauauccacuuagaaaauauaguggagggguuauuauauucaaaguaacaccaauuaaauuauauccucugccaggaauguuccuuuaaauaacauucuucaugaaucagcuuaaagaauaacuaugauaauaauuauagaaauaauaauaauaaugacaauggcuaauaucuaucaagugcuucuaaaaggcaagugcuauucuaaaugagauauauauaauaacauucaacacugguaacaacaucuacaagguaaugcuauuauaaucuccccuuuacagaugagaaaacugaggcacagagggguuaaauaacuuacccaaggucacacagcuaguuagugcgaagcuaugauacaaacucaaccaaaaacguggcucuaaaaccauguucguagcauuuggccucuccaggucacuuccucuguaaaauuuuuuccagccccaaauccagagucaagcccuagcucucaaauacccuagauguucccaaagggcacaucacauguuuuggcgucuuuauuuguguaucuccuguaccagacucuccuaugcugaggauuuuaucuuauccuggcuuguaucucccauaauuaaguacaaucacuuggauaaaauggcuuucaauaaauaaauaaacaaacaaaaacuauaugugaaaauuaaagaaaccaaauaucaagaauccaaugugagaaauauauauauaaagagaaucaagggggaaaggacaggacaggacaggaaaggaaaggaagaucuagucuauagauagucugucuauagauaaagaagucuauuuaucuaucuaucauggaucuaucaaaugcauguaagcugaugcaacaauaucaaccaaaacaccaaaaagcaacacaaauaaauaaaaauagggagaaaggguagaggggagaggaaacgaaaguacugagcaucccccacuugucaggcauggugcuaaaugcuuucauauuaagauaugucacugaaguagucaaaaaggagauuucuuuacuacuaugucugagcuugguaagguuagucuuagaaaaaauagaauucuguuuucagacauaugcgggucaaauuguagauaccagcaaaaugaaacaagaggguauauucaagauaaugcaaaauacaggagaaaguacaggcucccacauuacuuaguucuggaccagcagucuuguuccaaaggcugguccucugguagcaggcaggaauagaugugguauggagcucccacaaacugagcagacgugcaacaccauggcagucauaaggggacacauuuaacaagaaaguaugaggaugggaaaggauguugccaaguuuaaauuaagaaaagucuuucaucacccaaauccucauauucucuuuaaguccauguaaacauacaauguggcagaucugcuccuggagggcuuuaagauguuccuaacuaaauguuuacugaauugaauaaaaugaaugggcaggaggucaagugaguagaaauagaaccugaagggcaaaaguguccagaaauguuaacuauguaacuuugaccuugugagcaucagaugcaguguguguauguguguguguguguguguguguguauuguagaaacaagguauaacuaugaaaagggaacagugaucauaucauccuuguacuuaaaagccuuaagugguucuguuuagcuuuuuggaguagacugcaguucucccaaccuguccuggccuucacuuagccccuucccagccuccucugauggacaccaccccuuccaagcagccccaugggucugcucacauuacauuuccgagccuccucacacugugccccaccucugugccuuuuugcaugcauacaguuuacucagccuggaacaccucugccuccuaguuggccuaacuccuccauauuuuccaacaaccacucagaugucugauaggccuucccucacccagugcccugacugagauaacucaaggacuuagggucaauaucuauuacagcaaagaggggcuagggguaggugagaaaaccaagcagaaaaaagacaagucaugauuuuacaucaagucuuaagaaaaagaaaagaaaagaaaaaaucacaauguucugcaaaggccuggaagcucaccgaugacuaaccaugguguaaaauaauuggaaguaaaacugucuagacaacacaaaagaaggaaaauaagaaaaggaaaauaagaaaagaaaaaaaaagaguacauuagucuauuaaggaauugauaguaaauuauucuggaaaucguguguguuuaaauucaugugcgugaaaaacaaacugaaacaguauaugcuauauauauuauggcuuuuacuuucuaaaaaccuuguaaggauaaaaugagaucauauaaaugauuuugaaaaggucagaauaucauauaaauguuaguggcuaucaucauucuggaaccagcaaggcuuuugaacccaaacuacaagaauaaccaacccucuuggcaggugauacuucuaacuuucaugaaaauuaaaaccagcuauuuaucagcugggcuccguuuguuacuacugaaggcuguucagguaaguagaucuagccaaagucucugaguaaguuacaugagccuucuugcacaauugcuucuuuauuugaugucuauuugucaagcagagauacagcuagacaggcuauaaaacaaagcucuguuuuuacaggaacaaguuaaggcugagguaaaguggcuuuuuauguacaagaauaugggcuuaaugugccacagucauaacguuuauagguguaaauaaagucucuggacauacagugaccuuccauuucgccagugagaagaacuuacucugcuaucauuuaauucuacuagaaaaacuacuuauuuuugaaacaaguguccuauuuuauagucuuuuuccccgaagcaaguacacagugucuuggcccaagauggacauuuuagaacaaaaaaaaacaaauaaaaaagauucuucucacucucuuccucucucucucucucucucucacacacacacacacacacaaaaauacacacaaaauacacaccuuucgguaagugguagacaaaggcuuucucugacggccauggccaaugacuggcuguauaacacagcuugguauggauacuuaccaauguucaaaacaaccuuuacuuuuuccaaagguucuguucuaaaugaugugguucacaaugcagagagagcauuaaaccucuagcacuccaaguuacugaaucacggguuucagugauauucauggaaacccuaagcauauaaaacugaaaaaauccaaaacugucuuagcauccuggcugaauccaucacccuauauauguucaaaauagaaugauuucuauuguauuccuuucagcuauuucuggaagagaugaaugaauaacucccaucugccaguuucaucuguaaaaaauuucuccucagugaaauuauucuuuaacaaccuuccagaauauucucugguucagccucuuguaggguucuuugauguuuucucuggucucuuuugagcagcauauggguagucaucacuuaaaaaggaaaaacaaagucuuuucuuggcaacauaagccauaggcuauuguuuugcauacaaauaagcaaucuuauuucuugacuguuaccuacuucauuucuaccuaagucuacuucuauaaaauuacuucuacagggcccacuacaauuauacagaugcuaaauaagcauguuaaaaagucaauuucucccauugucccugaaaaacaaugccucgugauuaacuuucuuuucucgagugaucaucuaguagacgugucaucaaccaaccauguuacccgggcuaauugagcuacaugacagaaaaucaucuagugaagaggguaccgugcuggagugagacuccugggcuucaguuccugcuccacagcuggauggccuuuggcaagucaccuaaccagcagaggccucuauucagucaucuauaaaguagggggguaauaaguaccuaucuuguaggauuuuuuaaaagauuaaauaaaaguucccauaaggauaugccaggcauacaaaaguggucgacaaauguuauuguuaucauaaauaaauugguuuuaaaacagcuaauaauuaaauaaaacuuuuugcugcauuuaugguguuccaauugaguaaugacacagaaaagagaguucuucaugaagaauauacuagguaugaagcaaacauuauagauuacauuuuuugguugguguucugucccaaaugaaugaauucauccaguugaacauaaacugcuuaguuuuaaauuuuuaaacaaacauuugccuuagacuuagagugaggagguggagggaauuggguaauucucuaaucugucuugaaaugcuuggcugacauuuuauuuuuuucaccaucaucagggguacugggaagcucacuaacacuuuauugaaauggauucugaagucugguuguuguccaggucaucuuauaauuuaacuucucuucaucugaucauuaaaaugacagguaauauccuagccacuguugaaacuucuuucauguuugaggcgaaaauugauggaaaacaaaccucagugcuucaagacagggcugugauacacgccgggccaaaccuuccaaagaguguaauaaacauauuuuaacucuuaacaauuuagaaaaugaauuccccuuugcaugacacaaauaaauaagaccaacuugagacaguggauggcuuggugacccuaagaccuggcaauacuaggaaacaagacaaacauacuguccuguuccaucucagauagaauagggucuucuguacuggcucccuuucagcucauaaugaaguguuucagaggaugaagugguuugucuuuuuuggaggccccugaagggcaggaugaauuccaagcuaaacacugaaaaggauggcccuucaaaaauuucccacuuuuauuagggauuucaaauaggaaugcccaauacuaagauuuucaaguugucaggacuuagggccaaagagcaagcuuuagcuuucugacuguggagaaacagacagcccugaagccuggugggagagcagagccugcaaaaggcagcagccuaaagccgcugaaugcgcuucuuugaacacaggauuuucauguucugguacuuuuaaugcauauuuccuuugggcuuuacuccaauguuucauacuaguucuugcauauguuuuugcauaugcuuugcuaaguauauucugaauccaguuggaaaacuacaccauuguccuuuguccuagagauacaggaaauaugaaagcuuauauacugauaugggauagauuuuaacagcucaggcaucucagaacacagcugugacgaugaguccuucccaaaaggcaaugcaacguaaaagcauaaauuccuaccugaaaccuugguuuuuguuuuuguuuucaggcuguguguggcagggagauuaugcuaggugagugguaacacacucaacuuccuauguaacuucugguuuaucuuucagaacuugccaaaacuaggcuucaaauauuuagcagaguucuccaccaaaacaagagaaauauguagagcagugcaaaaguagucuuaaagggccugcacaagcaggugacuuccugugaaaaaagaagaagcagucucuggcauugucuugcuccauuccagaccacagcugaacaacuauugugauuucugggaucgcaagucaucccacuugggaguguccugccuuguagggaagaacaagcauuggagucaggaguccagcuuacucauuuccuaccagcucuaccucaccacuguacugcaaccuggggcaaauugcuuaaaaucucuaagacucaguuuucucuacacacuggugguaauagcuucccuccuuauuucaagaucuauguagaaauuaaaugugauaacuugugugaaggcaugauaauaguauaaaauuauuacaaauaaaaaaauaaagugauagggcaaagauaugucugaauccaauuuucagacuucuuagcaagaggacauuuuuuaaaauuauacuuuaaguucuaggguacaugugcacaaugugcagauuuguuacauagguauacaugugccauguugguuugcugcacccaucaacucgucauuuacauuagguauuucuccuaaugcuauuccuccucuacuccucaaucccccaucaggccccagugugugauguuccccgcccugugugcaaguguucucauuguucaauucucaccugugagugagaacaugcgguguuugguuuucuguccuugugacaguuggcugagaaugaugguuuccagcuucauccaugucccugcaaaggacaugaucuuauccuuuuuuauggcuguauaguauuccaugguguauaugugccacauuuucuuaauccagucuaucacugauggauauuuggguugguuccaagucuuugcuauugugaauagugccacaauaaacauacgugugcgugugucuuuauaguagcaugauuuauaauucuuuggguauauacccaguaaugggaucgcugggucaaaugguauuucuaguucuagauacuugaggaaccuccacacugucuuccacaauaguggaacuaauuuacacucccaccaacaguguaaaaguguuccuauuucucuacauccucuccagcaucuguuguuuccugacuuuuuaacgaucgccauucuaacuggcgugagaugguauaucauugugguuuugauuugcauuucucugaugaccagugaugaugagcauuuuuucaugugucuguugccugcauaaacgucuucuuuugagaagugucuguucauauccuuugcccacuuuuggaugggguuguuuuuuuuccuugcaaauuuguuuaaguucuuuguagauucuggauguuagcccuuugucagauggguaaauugcaaaaauuuucucccauucuguagguugccuguucacucugaugguaacuucuuuugcugugcagaagcucuucaguuuaauuagaucccauuugucuauuuuggcuuuuguugccauugcuuugguguuuuagucaugaaguccuugcccauaccuauguccugaaugguauugccuugguuuucuucuaggguuuuuaugguuuuaggucuaacauguaagucuuuaaucccucuugaauuaauuuuuguauaagguguaaggaagggauccaguuucagcuuucuacauauggcuagccaguuuucccagcaccauuuaaauagggaauucuuucuccauuucuuguuuuugucagguuugucaaagaucagaugauuguagaugucugguguuauuucugaggccucuguucuguuccauuggucuauaucucuguuuugguaccaguaucaugcuguuuugguuacuguagccuuguaguauaguuugaagucagguagcgugaugccuccagcuuuguucuuuuugcuuaggauugucuuggcaaagcgggcucuuuuuugguuccauaugaacuuuaaaguguuuuuuuccaauucugugaagaaagucauugguagcuugauggggacgacauugaaucuauaaauuaccuuggucagcauggccauuuucacgauauugauucuuccuauccaugagcaugaaauguucuuccauuucuuuauguccucuuuuauuuuguugagcagugguuuguaguucucccugaagagguccuucacaucucuuguaaguuggauuccuagguauuuuauucucuuuauagcaauugugaaugggaguccacucaugauuuggcucucuguuugucuguuauugguguauaggaaugcuugugauuucugcacauugauuuuguauucugagacuuugcugaagcugcuuaucagcuuaaggagauuuugggcugagaugacaggguuuccuaaauauacaaucaugucaccugcaaacagggacaauuugacuuccuuuuuuccuaauugaauacccuuuauuucuuucucuugucugguugcccuggccagaacuuccaacacuacauugaauaggagaggugagagaggauauccuugucuugugcguguuuucaaaggguaugcuuccaguuuuugcccauucaguaugauacuggcugugggauugucauaaauagcucuuauuauuuugagauauguuccaucaauaccuaguuuauugagaguuuuuagcaugaagggcuguugaauuuugucuaaggccuuuucuacaucuauugagauaaucaugugguuuuguuguugguucuguuuaggugauggauuauguuuauugauuuguguauguugaaccagccuugcaacccagggaugaagcugacuuaauugugguggauaagcuuuuugaugugcugcuggauuucguuugccaguauuuuauugaggauuuucacaucgauguucaucagggauauuggucuaaaauucuuuuuuuguugugucucugccaggcuuugguaucaggaugauacuggccucauaaaaugaguuagggaggauucccucuuuuucuauugauuggaauaguuucagaaggaaugguaacagcuccuuucuguaccucugguagaaauuggccgugaauccaucugguccuggacuucuuuugguugguaggcuguuaauuauugccuccauuucagagcuuguuauuggucuacucagagauucaacuucuuccugguuuagucuugggaggguguauguguaccaagaggacauuuauuuaaggcuuuuaagagacauacugaugaacuguuucaugacagcaugauugaacccaugagaacaccacucuaauucaacuaaaaaguugaaaggaauacugggccagccaagagcaugcagcaucaauucuucucuguccuccucuacuugggagagguuggaauaucuuuuuuuaaaucauuucauacuuuuaaaagacaaauacuuaccagccucaaguccugaaguuuagagugguaaaucauccuaucaccagaccuguucaagucagauaagguuacauaauaguagaagccagauaaaagccccacuugugaauaaaaagaucacuucuuuuuaauuaaucguaagcaagaagcccaaguuauaacuucaagaaaucuugagguauuuaaaguaugcauauuuuaaauuuaaaaauagcaaucaauuaacugcugaaaggaaaaaguuuuaaaaugucuucaaauuuucuuuugaaagucuuuccacucacucugaaauaaccugucaaacucucucuauauaguuuacacauaaccuauauaaaauaaauaaauagugaaagugugugugugugcgcguguguguguguguguguguguguguguguguguguguguguuuucuaugacuuccaguacaauugaaguacuuauucuucccuguaucagaaauuucuaggauaaucuguguggucccaggggaucucuggcucugguaccaaauauggcaggggaaaaaaauaaaagacaucagggagacauauucuugucugugcugccaggacuuuaucaaucagcagcccagaccuugaacaugcaugugaccuugaaugaguuacuuagcuucucugggccucaucuucuucaucugaaaucaucucuaccuuguuggaugacuggaagggauaaaugcuuuaauauguguaaugugcuuaaaaaguggccagcacauaguaagcacuguguaucugcugcuuaccacugacccacaguuggugagaagaaagggcaaagaguugcagcaaaaauuggagcaaaaaaauaaaggaccuuaaaaguuaaaaucaaaauaaguuauuuagcuucuuauauucacuauuugcaaaaaaaguuuuucccacuccaugccaaagucugauguuuguaaaaggaaagaugaugugguguagguggaacaagcauguguuuggagaucugguuccagucacagcucaccauuaaaaugcuaugugauaucagguaagccugugggcacugggaccccacaugcacaauggagaaguugaaguggacagucuuugaggaccuuccuuuuuaaauauucuaccagugaaccaccugaagacaaagauagcagcgccaccacuaaugccagcaacuaaaaaccccaagcuaggugcaaauagccuuguacaugugaaaugggaacaacuaaguagccaaccuuuauuauuuaggaguuaauguucucauacccuacucucuucuacuccuuggcuaucugcaucuucacuauuucacuguacauuacuauaucuaccagagaguaaaugagaaauaaaaaauaagguggaacaaaucagucaguaacaccccuagugagcgccuuugauaaaguuuuaagaaauagcuaagaugaagucuuaaaauuaauuaucaauaccuuuaauaaaaugaaaauauaucugcacaaaguaauaaauuacagcauuuuuuugcaguagcaaaacaguugaaacuacuuaaaugagagugguugaauaaacuaugguauauccauaaauuggagaacuauaaagcuuagacaagaauaagaaagagcucuaugaacugguagaaccugauaucuaggguacacuguuacccugcaaaaucaaagugcaaaagaguauauuucaugagcuaccauuuuuagauguuaaaaaagcagucuagggaauagaagagcaaacaaaucauaaacauuuacuucuucguacguuuuuccuguccacugaagaaucaagaagcaauaacacaccaauagcaauaagcacaacuacuacucagauacugguuucuuaauaauauccuauacuaaaaagaaccaggagaaauugcuuauuucaagcuugggaagguacaaaauaggccaaaaaugucuuauuguaccagaaaauuagaaaauuagggaaaaaaaugaugggggcauauuaaaaggacauaggagggugaauuuuguggcaugugaauuauaucucaauaaaauuacaagaaagaaagagggaaagggaagaacagaaagaggagccagggaggggugagagggaaggaggacacaggagccugaauuauuuuccucugcucaaaucugggaaauuuucaguaucaaaauaagcaaaggcaguagugaaguauaaccacugaauaaaaugaauccaucaauccuauauuaauuuuaaaaauggauagguaaauaguugauugauagacaagagaaaguucucaaacagcucaauagcaaaaaaaagaaagaaaauccaauuaaaaauggguaaaagauugaacagacauuucuccaaagaagguauacaaaugggcaacacauacaugaaaaauaugcucaacaucgcuaaucaucagagaaaugcaaaucaaaaccacaaugagacaucaucucacuccaguuaaaauggcuuuuaucaaaaugagaaaaaguaacagauguuggugaggauguggggaaaggggaauguuuguacacuguuggugggaauguaaauuaauacaaccacuauggaaaacgguauggagguuccucaaaaaacuaaaaauagaacuauuauaugaucuggcaaucccacugcuguauauauauccaaaagaaaggaaauugguauauugaagagagaucugcauucccauguuuauugcagcacuauucacacuaggcaagauauguaaucaacuuaaguguccaucaacgaaugaaugaagaaaaugugauacauauaaacaauggaauauuauucagacauaaaagaaugaaauccuuuccuuuguaauaacauggauggaacuacaggacauuacguuaagugaaauaagcuagacacagaaagacaaauauugcauguucuuauccugccuuaacucauauguggaagcuaaaauauugaccucauggaaauaagagaguagaaugacaguuacuagaggcugggaggguagugaggagcaggggauaaaaagguuuggauaguaaauacaaaaauacaacuagauacagggaauaaggucuaauguucagaagcacaauaaaaagacuauagcuaacaauaauuuauuauauauuuaaaaauaacgagaggaguggaauugauauguuccuaacacaaagaaaugauaaaauauuugaagugacugauguuccaauuacccuaauuugaucauugccaaugguauccuuguaucaaaauaucacauguacuacauauuuaugguauguacaaauauuaucuauauguaaaaauuaaacauuuauauugaaaaagagaggguucuuuuagcagaaugcugccugaugaauguaaaauuuaauugcacauggaaguugaguguaccuuacuguggcaucucaaauuccaaaaugauaagaguucuauacuaaugaaaccauguaacuauaaaaaaauauaaacuuccucuguagccugggauugagaaaaauuuccuaauuauagauaaaaauuaaaagaaauauggcaaaaaaauaagaaaaauuaaaugaucauuucaaagaugcagaagauacauuuaaugagcuuaaaacauccacucaugguaagaacuuucagcaaacucagaauaaaagagacuuuccuuaaucuggcagaaagagcauuuuauguuuuccaguuguccucccauuuucuucuuuuuucuugucuccuuuaauauuuucuguuuuuucucuauucuauucuguucuuucaguaguuucccucaaaaugguaaaacacauaccuaaauuauaaaagucaaaagucaaucgauaacccaauagcuuuauccuaaauaucuguauguauuuguuuuuaggaagagaccauagagcauauuuguaguuccucuuuauaaacuuuuuuguuuuaaauaauuuuagagcaagauugaaaacaaaauaguacaaugaguuuccauauaccccucaccuauauaacaucuuauauaaccacaguaaaauuaccaaaaccaggaaauuaacauugguauuauaucguuagcuaguuagcugacagacuuuauucaaauuucaccaguuuuuccacuaaugucccuuuucuguuucagcauccauuaugaaauuccacaucacaucuguuguuauaucuccuuaguuuccuccagucugugauaauuccuuagucuucaugacacuggcacuccugaagcauacugacgaauuauuuucugaaauguuugucaacuugggguugucuggugcuucaucauaauuagauugagguugugugccuuugucacuaauaccacagaaaugauguuguacacuucucagugcaucacaugugugauacaugauguugauaugucucauuacacugugaucauuugguuaaggugaugucuacuaggucucucuccuguaaaguaacaguuuucccuuaaaauuaauaaauauauuugagacuaugcaaauauuuuguuucucuucaaacuuucucucacugauguuagcauccacugcuggaucuugcuugcaguaauggcuauugugauguuugucuaauggugauuuuacauucucucauuucuucuucauuuaucaaauggaauuuuacuguaaggaauagcuguccuuuccccccuauuuuuauuuauuuauuuauaucaguauggguucauauuucuuuuauucuacaggcuauaaucuaauaucaccauuauuuguuuuguugcucaaauuguuccagcuuuggcuguuggaagcucuuugaggcuggcuucuaugucuuuugagcgcacuuucagccuucuggcacuagaagaugcuucuggcucaucuuguguuuucuugagucugcccuggaaucaaccacuucuccaaggagcucugguuccuuuuuuaaaguauuuaauuuuuauaucuucugucacguagaagaaggugcuauuacuauuuauauuuaaugcaaaacuuccuugcuuuuggauaugcuuugaaucuugaaaaaugcuuuuucucauaugggacagugcuuacaauacagaaaguaagaaaagcagaauaaaaccacuuuuuaagauaagcauguauuaccuacauaaucagccugguuauuuuuauuagagaugguaauuagaaaccaaaaucugggcaccagguauguucacuacuacuaguaugucuuugcucccaggcccucuuuguucccagguccucuucagacagagcuagggaauaucauguauuauguaugcaugugcaugcacacauucgucuauuuuauuuuugcauuuauuuuauuuuauuuuauuuuuuugaaacggaguuucgcucugucacccaggcuggagugcaguggcgcgaucucggcucauugcaauuuccuccucccggguucacgccauucuccugccucagccuccugaguagcuaggacuauaggcgccagccacccuucccagcuaauuuuuuguauuuuuuuuuuuuuuaaguagagaugggauuucaccauagccaggauggucucgaucuccugaccucgugaucugcccgccucggccucccaaagugcugggauuacaggcgugggccacugcgcccggccuauuuuuauuuuugcauuuauauaucugcauauauauauaugucuguaugcuacuauauauauauacacaucuguauauacuaaaaaccaugaguucauacuacaaccucugauugaguuugauacuacaggguucccacuucuguacuucuaacuucuuuguuuaauccuagcauacacauaaagcaguuucagaauugauaauccacacugcuaggauacacaaauucacuaacuugagcgaagcguuuguguauaauacuuuuuacccuuagccucacaauaccagucaaaauacccagauuagugcuuuucuuucccacccccuucaguguaaauauguuaucaauaucaauucacaauaaagucaggcucaucuguuauauuuuuguauccaauuuuagguuccccuacauccugguuuuauugaucuauuuauuuauagagagggaguaugcaaaacacuacuauguuucuaggaaucaagcaaaacacaaagagcuucucagaaaagaauugcacccuccuuauccuuuuuaucuuguuuccaucucucuccccuucuuucuaccccuuugccauucacuuccuauagguaaccaaucucuuuaguuucugauuuauccugcuuuaauuucuuuuacacaaauaaauacauacacauauauuuucuuauauuccuuccuucuuacccgaagggaagcauaccauaacaccauucuguauuucccuuuuucauuuagcaguauauacuguucaacauguuuugaaguuaagcucuuauagaaguuagaagagaaauucugaaaauaagagaagauaugauacaugaugacauuggcaaaaccacuauggaaacaguaaggaauugucacaguaauucaugcauacacucaacucaagaaauagcuuuguaguauccacuauguuccaggaacuacuaacaaguuacaacacagauaagcccauugcuaaccuuaaggaacuuacagucuagaagggaaaugugagaguaaaaagacaguucuaauacauuaggauaaauccaugauagggguaagcgauaggguuaccuaggagaaaacacaaaacucugguuaagugggaggaaggaaguggggaugucagcaagagcuucuggaggagauaucaugcaugcugagaaauuaagucaauuagaaacucaccaagcaaaagugguaagggaggaagaggcaggagcuccagagaggaagccacguacacauuuuuaaagagaaaaauccaugucaugcacugguauggggagugcugagagacaaggcuagaaaagaaagcaaugaugaaaucaugaggucacgaagggccugauaaccauauuaaggaauugguacuuaagccuagagauaauaggaggcaaagaaguaagacuguaagccaaggaaguucuuucuauguguucugaaguauaaaaaauguauugaagaagaaagacuacaggaagggagaacaggcugcugcaacaaagcaaauguagcaauagugguggccuaagcuaggcuaauggguggggacagagagauaugguucagggcaagagauuuuaugcaucuauuuaaaucuagcuugagcaccuauaggugccaguacuaauccugagauauuaaauacaaagagaaguagguuuugggguaagacgggguauggaagauaaugacuucaguuucugaaaauauugagauuaagguacuucugucacauuuaaguggaaaaggucaauaaacaacuggauguauggaucuagagcuugggagagaagaccuggugagaauucaaauugagaagucaucagcaugcagaaaguaacuaauaacagaaauuaaaaccacccaguaaaugagaagagccaaggacagaaucugaaggaauaccaacuucucaggcuaagcagagaagagaggcccaugaaagaggcugagaaggagcagccaaggagaugagacaaucaguggaaagugaugcccuggagccuggggaagagugcucaaggagaaaaucgucagcagcaccaaauacugcucaaaaguuaagagaaauaacaagguaggugauuucagaaaaguauguuucaaaguaggagaacaaaauagcaacagcuacugagaguccugguauccagggagauauauggaauaugcacauuuaaagaagagagagacugcugaguuugaaugcugcugggagaagaaaugaguuuauauauuuuucaggucacauaaagagcacuguaucaucagauagaaugaaaacgcacaaagauagaacuucagguaggcucacccuaaaaauuuaauagagaacagucuggacuugauuuacggauuccuuaagaaaugcacaucuaauuaaaucuacuuccacaugacaucaggcuuccauucugaaggcgaacagaaccccaucaucauuccuaucucccuuuccuuuuauuggucucauuaccccacugaacuaccacuggaaagaaacuuacaaccuggggaaacuuaguuccucauauacaguuauucuucuuacguucuuaaauucuagcuguuuacacuuuuaacauaaaggaucuaauauuuguucuuauaauuuucuuuggaaaaaugugucucuaauuugucaaauguacauucuucuucaaugaaauuuaagccaauuuagcaucugugauuugaaaguuuugucuuuauauuaauaacauauguguuuuauaacuuuuggcaaaaaugcacuguauacauacaguaaugacuaacuaauucaccuuguuaaaaaaauaaaaagguagcauucugauaauaaccagagcuauaaaaauagaaaacaggcauuuaaauuugaaaagcacuaaaucuuuuaucucuaccuuucaaaucauagauacuucuucaaaacaaacaacagagcaacuccucuuuaaauuuuaaguuauaagguccuuauaaguguuugauuuucuucauuaagugggaacuuuaagggugauguuacucccaaaauucucugucuuucaggaaauaaccuaccaucagaauuucaaaauauauauacauaauguauacauauacaucauagauguauaauauuaguaauuauguuaugcaucauguauuauguauugugaauauauauauauauauuacaugcauaucuuucaaacuuggcaaaaguacagacaucuuuuuuuaaaaaagcauuaauucuugucugcagcauuucuugaucacugaccuaacauuaugccaauaucuuaacaauaaugagaaccaaucuuuuccaucaguauaucaauauugugucuauaaauaugugaaggugugaguauagaauggagucuguuacccauaaggcagaagucaacagaaucugucuaauggaaggaaacuuaaauagacauuuguagauaaaacugguccagauguuauccgcagaccacacuccuuacauuuuuuuuccccaauaguaaauaagugauucaaauaagauacugggacaccaucucuuccacuucucaccuuguaccuguauaaauacucuacaacugcagucuaagagguauccuaauuuauuuauagcuauauauauauauauauauauauauaagcaguauauauagcgguauauauauauauauauauauauauauauauauauauauauauauacuacugauagccuuaauguuuuguauugaucugggcucugccuucaacccuauuuggaugcuggcuauuaugcaaguuuccaagucagaccugaagauagacuguuaaaacuuaagugaugacaugccugucuuucacauucacuggcaagacaauacccacaacccagaagcucugaacugaauauagaauuuaaaacaaucucugcuaucaucaugcacccuggaaaacaaaaagacagggaaccaagauaaacaacaaaagaaaauaaacuacugaauaacaucauucuguugacuacauagacuuauugaacagaagucauuaccuggcagugaugcauuuuuugggagcucacaaauguuucagccaguacacaguuaccaccuaauuucccuuuaaguugcauuuuccugaaacucuaauaggcaacuuaugugacagaaucaggcuuccucauaccaaguaagcaaacauaggaauggcucagaagugaaggcucaaggucagaaagucuaaaaguaagacaagucaguaaaaaagagauaguaguacauggaaauaugugaaacacuguaggaaggacagaagacaaugaagauuuacugagcaucgacuauguaccaaagacuagcucaaggcacuucauauauguuaucuuuuuugauauuucaauauccuuaugaaguaggcauuauaaccaccauuuuagaaaugacaccaaagcaaaugauuaguaaguagaaucuagauuuuaaauagguucaccuaauaccaaccaucaagcuauuuucacuucccuguguagccucaugcacuacauuauauaaauauuuccuuuugauguuauaucuacacugcaguucuacagccagggauucuuaaguguuaguuccaaaaaauuaguacaaaucauucuuuaccucaaaaagagagauuaucucccagcaaugaauucaguuuuuggagaaacaggcuggaucugcuuucaaucucaaaugccugguaaggcaacauagaaauauuugugagauuguuguuauucucaucacagaaugagcacacauuacauuuucaccucuuuuccagaagaaauggaucagggcuuuaaagugacagccaagaauuuauguaaucuucuaucgcaguuucagaacaucugacgcaaaaaaaagaauaaaucaccuuuccauuauaauaaucagaauaaaacgaaaagucaucgugaauugaacauuucccaugggcuagguccuaugcuaagugucuuccaugcauuaucuugaucaguccuuacaacacuacuauggucucagauaaggagacuaaggcccagaaagguuaaguuacuuacucaaaaucacauggcaacguaagugauaggcuagaauacaaauccaggucagccugucuccauauauaaugccccugaaauauaacacaucauuuccaacuaauuauuuguuguuuguguuguauuaaaaucccuuccaaugucaaacaugcaagacgaauuacaggugaguuacaacuauggugaugagggugccauggguggauaguguaagaauaggucuauagcagauaaauuacacuauaauguaacuaagauaaaauaaauaagauaucucuccucucucuccaauuugccaauaaaacaaagaaggggaggugauagcucaaaagaagacaaucuucaucuuuaaagcaagauucaguaacauaaugaaauuuuuuuuaaagaauugaugaauuccaggcaagauuuuuagaaaaucuuucaaagcuaaaaugaauaaagcauaaguuccaguaaguauguggucuuaucggcagcaauauacagagaucugcagucuuaaguuagcugcuuucucagaaacucugaucaugcaauaaggccugcuguaaacacuguucaaagaagcucgcacuucgcaucucaugacuuuguuuuagcgccgaaugcagauuggcacagauacuauauugcagucauacucagacauuccuucccucgaccaucacuuacaauacacauugcagcuacagugaccccauacgugcaacucaacaggaauagaggauugaguuauucaccugagaaucaauuuuacaccagacuagaauaaaaaguugcuuuugaaaugcguaaaagaggccaaaaauacacacuauuucuuuggcagcaaaagcaccacacuaucuucaugcuaagauagagaguaguuguacaauaggccauaacaaaguuaucaaaauucaauuuucuaaucaaauguccuuauuucggaucagaaugacaucagaaauagcucaaauagaacugcuuuuucaguauagacuuuaccuccugugucaguggagaucguaaauucuuuuaaaagcaaucucuuagaaugauggccauaguuguuugugaaacaaaacaacuguuacuaauccuaacaauaaacccauuuccagaucccagguuccaguggucuugaccuugguuuaaaguugaagugaaaugcauagaugucuuaaaacugggaacauaaaucagacugagugccuacacauauucuagcaaauccuuuauuugauuauuaucugaacuuauccuuuugacaccagagaugacucaacacaucuggaguacuguuuugacaguacuucugauuuacacuccuagacccauugcaaucuguaggcuuuagcaauauaaauuuuaaaaauacacucuauaauaauaauuauaccuauacucuccauugcaucaacaugacaucaauaugucaucaaaaugagcauuucuugguuuuguaaaaauauguuaagaauggucuccuuucucuuuuucuuuuuuuuucuuuugagauggagucuugcuuugucaccagccuggagugcaguggcacaaucccggcucacuacgacuuccaccuccuggguucaagugauucuucugccucagcuucccgaguagcugggacuacaggcgcgugccaccaugcccggcuaauuuuuguauuuuuaguagagacgggguuucaccauguuggccaggauggucucgaucuccugaccucgugguccacccaccucggccucucaaagugcugggauuauaggcaugagccaccgcgcccagccuccuuucccuuuucuauggcuucugucacuacauuuccaagcgauuuggcuuuuucagcuuucacagguuagcuguuucaaguucaguuuaggauuuggggcuguaccauauaauaaggcaccuccuugaccuagcggaagccaauuaauuaaauuugggggaagaaggaauucuauuuugucugcagauugaaacuuuagucaaauggugccuuuucagagaagcaggagaaaagaauauuucauuuccuuuugaguagcuguuguuaauuuugaauaguccuagguuacagacaugcacauuuaaaaagaaauaucuccuuaaggaaucccccaaaagugauuauuaccauauauguuuuuuaucacuuuguuguauauaccacagagacuucacaguccaccagccauacauuucaauuucauccuuugauuuucaaugguaaaucuaagggucaacuagucuuucuuugaaaugcccuauauggcacaguuauaggaaaggcagaguaucauuaauacaaucuucaauuaauagaauaaaacauacuacuacuuauauuccuacuuugaaauugaaguuacuuugaaauuucaauggcaacucuauuuucagcccaggauuauuccuaaaaggucagacuacauagaauuguuaagggguaaaauuaauaacgacuauuuuucaagaaagaaaagacuauuguugguaacaugucuauguaauaucuuugaaucaauaacauaaaguacauagccaucaguggaaaauacugcuguacuuguauuacaaauucaaaucacuguucuuauucuggaauuuucagcugguuuaauuuuaauaagaaaucuuaccaugacauuguccuguuggaagaucacaaauuaaagcauuuuuccuucuucauacuugaucagaucuguuucuuccuguucuucuuuucucuuguucuaguuuuugacuccguuuaauucucauucacacuuuuaaugaucuccucucuaguuuuuagagagaagucucuauuuuuaggugguggaugcacggcauauuuuuauuuucugacucaucuuccuccucauaucauucccaaauucucaucucagagucccaaaaagaucaguguuccaagagcugggaauuuaucguuucugucaacucagguggcuacuaccucuacgauuugggaaaggcuagaggaaaagagaaaacuguucccuuuucuucuuccuccauccuuugagcuaucuuggcagagcaggacucagaaauacugucaucauggccugcauuaaacuuaugcaugaagaaguaggaaauaagacaggacaaacauuuacccuuaaguaggaaaaccaggguggaguugggcggagagagaagaauauuggacaaugguagcaguucacuuagaaaagaacuccacaacucuaaagcacuuuaaaaugguguccaucaauucuucuucaguguauuagguggcuuacuaagaucacacagauugguagauuagaaaaaugaacugcaggauuaaacgacagacuugaaauguauagucccuaauaguuguugcaguaagagcaaagcaaguuuuaaaaggaagggucuccaagaaguagcauaaggagaaaaaggcaaaaugggguccauuuagcacuagaaagaaaaagcugccuggggaagucagacauguucaauuaaaaauagggauggguaggugcuagugaguauuguuuauuuccacugaagccaagacaaaaggaaaugagcuuaaauugcaacaggagggauuaaaguuaaacauuaagggaaaaaaccuuccugaugagaaggcuggugagauaauggaacacauaauugagagggcuguggaagccuaucccuagagaugcuuaagaauaaacaucuaucuuucuggggugguuuuacaugcagaagggccuggaguauuugaauggagacuuuuagauuuaucuuccaguccuaaaauacuauugcuuuauuuaaugagacagaccaucuccuugguacauccacugaagcaacagugaacgggggagggggaaguaagcagcagcacuguuuuauuuugaccuugcuuggauaaaagcaauucucaaagcaccugaaccaaagcuuauacccagguguggcuaaucuuauaauaguuaaugaaugcaucucguggugauuucacaaaguuaacggcaaguuuggacuguguuccuucauuaaacaaagggauuggaaaaaaugucuucauuuagaaagggaagcaguugaauuguuuguaaugugaugggaagacuaaaguaaguuugguuaucuuguuccuacccagaauaauccacuaugaucccuaggcugguuuggagaaaauccaguuguucuacacaauuucagggccaggaaagagauauacuacauauacccauccguccugcagcaagcaucuaccaugugcuggcucuauguuaagcgcuagggguaccaaagccacaaaacacaugcacuauccucaaggaucccacugcaggguuggguuaagggaaacagagcucuauaauacaaugcaaucccagauacgguaucuggguaaacugauagagagggguguugugggucaggggaagagucaugaauggcguuaggcaauauuggaauuaugaaggacuacaggagucagccagcugcaguaggaaagaugggaauccugggcagaggaauaauaugcccaggaucagggagaucugggaacaaaggagaauaugcauccuucuggaagcugcagauaggugagaaugauggcagcauaauugcugguggcaaguaagaaugaaggggcuggagacacaggaacuagauuaugaagggacucacgagucguggcagauaauuaggaguuuauugugaaggcaaugaaggacuucaagcucuagagggauaugaucagaucacaugugucuauagggguugcauaauauaaguaaacucagcuggcagcauauuuggcugcgauuuuucaguacacggauagugguuaggucaggugaacaugcgaguaauuaccaggcuguuaagucucauauucccaagacacaauccuguuuuuaucggguaaggcugcuaucugaagcuucggccagucaagccuccuggcucauccugcuucuaugcccaacagcuaaaugaugaagucauaauccugggggcuacucuuggguuauauuucuuaaagaaaaaaaaucaucguuggcuaacuccauucuuaaagagcagcuuguaucacuuguacccccaagacaccaggaauuaaaaaauaaaaugucaagaguuacagaguuccacuuuaucuucaucaaauacccugcgguuucugagcaauuaucauagugcuuuacccaacagcugugcaguguuuauuccuagucuucuacgggcacaaaaaauguuuaggaaaucaucuacgaagauaaguguggccacuggggacaauucucuugcugaugaucauuuucaccaaaagcagggagcaccauuaugaaucaucuaugaccacuuacgcuuaagcugaauacauuaaaauuuaaugguuucaacacaagaagcuagucguaagucugcacaucaaggcauuaauguguugggcccaauuguacuuaggggaagaaggucaggaaugcaugacagccaacuauauuuugcuauaaaaugaaaauuaugaaucucuaaucacaagugaggagucuuuuuaaaaaauucauuagucaugauuucauucucuaaauuauucauuuucucaaauguuauugcuguagccuuuuaaacuuuucuacucucuccacuuucaagugauaaaugccugagaacugagcagucuuuagccuuugaauauaauauaaugcuauuucaacaugcugcgggcuucugcucacaauuauuccagauuaugaaugcagguuggccauucaagguuaaaacugucaccuuucauuuggucuaagagauaauagguucauaaaaaaaaaggccuguuucaagaauuuucauuucuaauaaaaccuaaauuuugaaacaaggccuccucuauaaucuggccccaguccaccuuacaaacgccaucucacaucauucuccccagucacccuggccuccuuucguaccuccuuugaauccuuugccugcccuguucccucucucuggaaugucuagccuucccugccaugcccaagcccaucaagugcaucuucacacugcuggcuccuucccauccauccucaccucacgugcccccaccucaguaaggcuuccucaaguaucuucuccccugccauuuacucuuaucacacuacccugcuuacugccuucaucuaauuacaacaguuaguaaugaucuuuuuuguuguuuguguacuguuuucccuucccacuaggauggauacuuuacgagacuuugucuauuuuguuccccauaauauaugcaggcuauauaguaucagaaugggcacagaguacguauucaauaaggauuuauaaaauaauuuuugauuccaagagauaauaaagguauauuuuaaugcaaaaucaccucuucaguuaaauauguucaauuuguucccaguuuaccucacuucuuucuaugaacugacuucaugagccaucaaagggcucuacguaagcuacuagcaaggccacaggccauaaccuugaacuugggaugguggugguaaggauuacaacauagacucucacuaagauaaggauccugggauccuaauaguuggagguaaagaaaaagaaacugugguucagagaggucaagugaaaaaccaucugcuuaucuuccagcaucuugcaauccacggaggaugucccaagccaacugcaggaucguuggaaaagagucuggaagcagacugcagcauuaucaacuuagaugcgcuccuuagaaaugccacaaauucaugugcagauuaguuucaugcuaaaccugccuguugaguagagaaagagaacccacuaugcccaggauuaccccucaucagcuggcaugguccaccaguccauuguauccaaaggacugacauuaauugcaaaggaaugaaacuaaaugggucaaguuuguagagaauaagucugucaguuauugaaauauauuuucacaauaaaaaucaaaguaugguaccuuugagcauuuuaugcuuucucaaauuaagugauguuucuggauagcacacaauguauuacuacaauaaagaaaccagaaaccuuagauucagauauuaaauauaaaguaaugaugaugaccuucuagcuaauucgaaaagcuacucaaauggaaacugagugcauaauuacuagacauucuuggcaaaugaaaaaaaguaaaagaucuucagauaagcgguccaauuaagcaccuugggauaauugaagagaugauuuuacaaguauucuagacaggguuaucaugguauuuuuuuggagaacuaauaaauucuucaaagcauuucuuugaaauauuauuauuggcauuuguaggagaccugaagccagggagaggaaaggcaacuggucuuguuauaaaauucaugccuaaaaugacaaaggcucagaaaagggggcuuaaguaaauacuugcugaauaacugaugagccagauaaagaucagagacauagaaaagcuuacauuucaacucccagucccacguagaacccuuuagauuagguuagucuucuuguagacaggcuuguacuucuuauuacucauuaaaacuagauuuuggaaugucuacugaagucauucaaacugcccuuuuguaccuuagguggcuaauguggcaauauaauuuacagaggauacauuauguuagaccuuagagcaguucugugauguucucagaugcccaccaaggacuccagcaaauugacaccucuaaagucauuuuccuggcaucuugaguugaauuuagugccaggucuucaaaugugaauagcucauaugucaucccauuaugccaccuggccucugaccaguacaccuuuaaaauagauuuauuuaggcuauaaacuuacaggacagugccucugucuucaaauauauuacauuuaaacagcugggaaaauaaaauacuaauuuuccaaugcugaaauuucugaggcuaauuugagaaacaguauaaagaaggcuaucaaauucuauuaaagacacaaauuuagaugauguuuuguaauguacuaaaggaaaacucacagaaaggaaaacauaagacugggaaaacucucaagggcucaucacccuuguguuugacuugaggcgugguuaaauaauauucaacacaguaagucgggguagggaugucaugacuuuaauuagaaaguaguuccagauagagaacaaauuccucuaguacaucggaggauauaauucacuuccuguuaauaaacucacuccuauugccgugagagagacuugcugucuaauaaauuuuuguagaugaugaauuaaccauaagaaaugaggcugugucucaaggaaaucacuuagugacacugguaauccaaauacguacuacuucauaacauugugcacuaccaagugugaucaguuagauaaacaaaaauaguaaucauguauuuuguacccacauggauuuucuacucucacuuaaaacacacguacauagcaauuagagaaacacagugugacaugaaaugacaaugagauauacuggcaguaauuauuaaguugaagcauaugaaacagcuaauaauuaaucgauaagcauuagaauaauuaucaaaggguagaauauucagggaaggcuuccuguaagaaaagcaaacaugagaaagcucucaaauucaacauguacaaaacuaaacugaugaucugucucccucaaacuguaugcuuuuccaaagaugucuucuugaugaaugacacauuggccaacuagaaccagcaaucuggggguuccuucugauaccucuccuuuccccucaauccuuaucuccaaucaacuaccaaauccucucaauuuuaacuaccaaauccucucaauuuuaucuccugaaaaaguucucauacccauuugcuccucuucaucacgcuugcugcuuccaaagucugagccuccaucaucucuugccuucauacuauuucucucauuuuguaauugaguaucugcuuaauuacuucauuaucugaaaaaacaggcuccaugauggcagagaccaagccugcuuugcucaccauuauuuuuccauugccugugacagcaccugaauguaaggaaggaauaaguaaagaaauugaccuaaauguaguuaaguguucaagauaaagaagagugggagaagacaacacaauuaagccagauucugaaaagccuggaccuaaaacaagaagcuuguuuauucauucuaauuaggaaugggucuggauaugugucccucugaugaaauaacaagauggggcagugcucuuucauuugagacaguguuuauauuggcuauauucuguauacuuaaaaaaguuagcaacacagguuuaaaacuuuauaggaaagagaaggagugaauauauaaaaggagaaauguuacaaauuuauacgaaucucagguagaaguauguaagcucccaccccugcccucaccuugcuccaucugcugaccuuggaaauccucccuucgcuuggcuucuguguggcugcuuucucagaguuuuccucuuucucauuccuuggcugcuucucuucaauuuccgauguuggcucuugcccuuccaccugaccucuagauguuggaaggccuccagauuuagaucaagcuccuccucucuuuucucucuccauauaagugaaagcccauucaguuucaaauaccauauauagacugcugucuccugacaguccaucugcagcccaggcuuuuccccugagcuccggagcacuuggcaucuacaacugggugccaacuaggccucucaaauggaauauagccaaaacugagucuucgauucugcccuccccaacucacauacacacacacuguucuucccucagacuuccccauuuuaccaauagcacuacuguccaccuugguacuaaaggcaacauuccaggagucaucuuugcuuccucccuuuaucucaccccuuacacacaauccagcaccaagcucuguguauucuagccuuuaaaacacacuguagauauuuguacuucuaucuccauugccauaaccccagucaaccucaucucuugccuacauuucuacaauagucucuucagcugcuccugguuuccauuccagcuguuuuccaaaacauuccccacauagcagccacaguaauuuuuaaaggcauaaaucaaauuauguaaugucuguaauacuuaagacuauuugauggcuuccuacuacucauaggaucacuaucaucuaaauuccuuaccaugagagguaaggaacauuacacaaucuaacucucccugccauuuguccucaucaagaucaagccagauagaccaugugucuuuugaaugugccaagcccuuucuccccucccggccuuuaacuucuauuccuucagcuuggaaugcuauuccccugcuuccucauuucuucauccuucuccucacagaagccuuccccaaucacccuaucgaaaguagccuccaccacaaacucucucaacucauuguuucacuguacuuaauauaaccugcaauucucauguuuaguuguauagcuguuuauuauccggcucaucccccagaauguaagcuccuguggguacgaauccugucucucuuguuagucaucauaccccaaugccuagcauagagcccagcacacaguagcauuuaaaaaaaucuguuaaacuuuuaaaaauuguccuauucaugaguaaauauucuuuccccauuuuaagaacucuacauuuguuaauauugaugcuccuaauacuguucucuugaccaaaagaggaauuauuuacagaugcugcuauuuagcuuaauuccaaauuuaucuuuaagaggccacaguacaauugguacaauuuguaggucuggaagggaaugaaaauaaaauaguuaauauaauaacaugaagagucagagggcauuacuggaacagaggaaaagugaacaaagauuagaaaugggagggagacagcagaaaauauauaguagacaggucaagugagacaaauaugaggccacaaggucccugaggaaaacaggaaauagaagaggaugcaguucauucaucagcuuuccuugggacacccauuacauggcagacacuaagcuauaccauaguagcuaacgcagacauuguccagcucuucaugaaacuuagaauacaguggggaaauauuaaauagcccacaaugaagaugcaauuaugaacuaugcuucagcuauaaagaaaaaguccaagagaccaugagugagaauaauaggggucacagaagacaucuuacagaaaagccaucuuuaaguugagaucugagaauggcuauaagucagccagugagacaguguggggcggguacaggagagggaauguuugggaauggauagaggacaguauucaaggcaaagugaacagcauaugcaaaaccagaggcaggaaaacgcuuggugaguagaagugaaggaagauuuguguggguaaagcagaaugggcaaggagaauugugaagaaauugcugguggagaaguggauggagagacagaagcagaguucugcaggccacgguaacaagucuaaguuuaauccuaaaaccaagucaucuucugagaaagaacagaaagacaaaagauuaauaaaauuacacauaaauuuugaaauaaauggaugggaagggcaguuugcuuugauuuucauagugcaguagaaguaaggucuucugcacaguuugagaugagauuggagcuuaagcaaaaugacaggcauuaacuucuguugggaaugagauacgaaaucaauuagaaacaaguaaaugaaacagauuagcacagaagggcccaggugaaguuacacagccagaaaggagguaguuuuauaauuaauuuuaguaacaauuuccaguugcagaguugaucuaagaaaagccaaagauugacucagggcugaaaacugacaaggaauccaagagagaaacccaugggguuucaagggaagagcaccaagggcugguggaggggccaauggaaguggaguggauguguuggaaggugagguggggaggaguagagagcugacugauaagaaacugagaaagggaaggaauaauguucacguaagugauucaauucaaaucuacucgaagaucuguugagcaucuucuguguuccaauuguauuagauucuagagauguggaaaugaaugauaaagucucugcuaucagauauuauaguguaguaagcugaugucaacagacaguggacaucuaacaguggcucaugauauaauauaaaaauaaaaaacucaaaauaaagauaaaacaauaauaugaaaauucuuuuaugucacaaaacauuucaaugaucacuacagauauguuaucuaauuuauuuuuuaggaacacuucucaagaauugcuuuggcuucuuuucuaaaauugaaacauauucuuugaucagaaaacuucaaaaacugugguacuccaauaauauuacuauuaacaguaauaaacuaaacuauaauauuauauuauauagccaaacauaauuauuuuaaccaucacaaaaggaaucugucucaaauaauacaauaugccauccucucauuucaccaaaugacugaaaaaaagucauaagaaagauguggcacaaauggucaacagcuggcauucuuucuccuugucuugauguacuuuucugcacugcacuuuucgcugucugaaauuuguuucccuguauauugacuguccccugccagaacauaauaaauucccugagggcagggcuuggauuagucugauuuaccacugugcccccaguaccuggaaccaugccugaaacauaguaagcacucaaaaaauuucaccuuggggucucagucuuggcugguauauguuguguuuuucaauggaaauaauguacaaaguguacaauuuccacagcuaagugauuuuccaugaguuaauagguuaaguuuuaaaaaagaucacaaucuggugucuuaucuuauuuugaaagggaagauucaucucuuucaaaagcagguaaaaauaucagguaauuuauuuacacaguacauagucacauauacugauuaggugcuccguuuacugcugcaacuaauuuuauuuuucuuugaaacccagccagacuccuacaccucagcccuuaauaucuaucaccacauuugcucauaacuauagcggcagucaacuggggccuggcacccccuugcuaugauccuuacgaggacaauguauuugcuucuuauuuuacaacugcagucacucccaagccuauuuuuaacaaaugcuaaaaauaucuuagagcaaccaacaagcaaacaccuguacuaaauaaaaaccauccuauugguauuagcauaaaucauaacuucugaaaguuaaagugacaucauuuuauuuuuuugguaacauuuuccacaugacacuggaguauggcucagaaagcagacuugaaaggaauacaaaaacccuagcuaacuaaaauaauuauuuuuaaauaaaaaauuaagcauuucuaaaagaaaaggcuaaauuuuaaauaauauacagaguugagacauccuguacacagaaauacaacuaaagguguuuacuuuuuagaauuggauauucauauguucugagaaccaccaggaacaagauaauuguuuuucauuuuaauuuuuaauuguuuaaaaauauccacaugacacauaaaucaggacuugacuauuccaacaauuuauuggaauaaacacacuaaaauuguuuuuagaaaaaguucaguaugaaaagauuuuuuuuuuuaaagguuggcagcauagaucuggcuucauucagcaugacaguucuaaagaacgucaucuuugcguguuguggcugaguagugucagaagcagaguguugcuccuauuuuaggccaguuauauuggccagaauuaaaaggccuaagccagaggaauaggccaaauuguugugucugccccauuuacuuguggauacucacauuaugcauauauuugaaaaauuuaaauaaaaauaaugcaauauaaaauaagucuuaaugacugucucacaugaguaauugauuggaugaguugcuuguaaguaauuaaaauacuuuaucuaggcacccuaaaaucuaaaggaaaauacaaaaaaaauaaaacuuuaauaauauucacaaauuuacacugaaaacagaaacauucaucuuauuguuggaaacugaauuucucagagagcgagcagauacugggaguagaacuugaaggaaaagaaacaggaaguauguuuauuguaaguuuuaggugacucagaaaaccguacuauaaaagauagauacacugagguagcagaaguugggaguaacaguugaaaaaaaaauuguuauaugaaucaguagaaaucccuucaugauuuuauuuuuagagccagaaucugcuggaauaaauaucaacuuuuucauccucauauuugaagacaaaacaguaccaaaugccaguagaauaugugagaaaaguuauuuuugaugugauacaaaaccucagagcuaaauaucuuccugagggauacuccaguguucuugagauacucuaucuuuuggcaaaucgaugcaauuuuuaagaauacugaaaauuauacagaguucagauuuccauugugcuauuucauaggacaguagaaaaggcaguucacuggugugagaugguaucucauugugguuuugauuugcauuucucugauggccagugaugaugagcauuuuuucauguguuuuuuggcugcauaaacgucuucuuuugagaagugucuguucauguccuuugcccacuuuuugaugugguuguuuguuuuuuucuuguaaauuuguuugaguucauuauagauucuggauauuagcccuuugucagaugaguagcuugcgaaaauuuucucccauuuuguagguugccuguucacucugaugguaguuucuuuugcugugcagaagcucuuuaguuuaauuagaucccauuugucaauugugucuuuuguugccauugcuuuugguguuuuggacaugaaguccuugcccaugccuauguccugaauggugaugccuagguuuucuucuaggguuuuuaugguuuuaggucuaacguuuaagucuuuaauccaucuugaauugauuuuuguauaagguguaaggaagggauccaguuucagcuuucuacauacggcuagccaguuuucccagcaccauuuauuaaauagggaauccuuuccccauugcuuguuuuucucagguuugucaaagaucagauagcuguagauaugcggcguuauuucugagggcucuguucuguuccauugaucuauaacucuguuuugguaccaguaccaugcuguuuugguuacuguagccuuguaguauaguuugaagucagguagugugaugccuccagcuuuguucuuuuggcuuaggauugccuuggugaugcaggcucuuuuuugguugcauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauucccuugagcagugguuuguaguucuccuugaagagguccuucacaucccuuguaaguuggauuccuagguauuuuauucucuuugaagcaauugugaaugggaguucacucaugauuuggcucucuguuugucuguuguugguaaacuaucgcaagaacaaaaaaccaaacaccgcauauucucacucauaggugggaauugaacaaugagaucacauggacacaggaaggggaauaucacacucuggggacuguggugggguggggggaggggggagggauagcauugggagauauacauaaugcuagaugacgaguuagugggugcagcgcaccagcauggcacauguauacauauguaacuaaccugcacaaugugcacauguacccuaaaacuuaaaguauaauaaaaaaaaaggcaguucacauuuauagaugggugaagauaaaaaugggcauuuuacagaguuaucuacaugacaauuaaagaaauaagaauagugaugucuuucaaaagcuauuuaauuuaucccccuacuuuuagacagauuuuuuccccaaauuaucuuuagacuguugaguauccacauuaguauaaacaucugcuaagaaggaaauuacucaaacuccccugguauucuauuccuguauuaacaacccuacuuccaagaagcuggucuuuggucaucacauuguaauuaguuaccagccagcaugucuaucaacaaguauuugcuaaguacacacagggagaauguuauucuaugaggucuuugaugguagaccuuucccuacaguugcuccuaauugcuucuucugucaaauccaacucuaauccuagauucaaauauuuuuccacuaaucuuccauucaucucauuauggacucccuguuacacuggauaagaaugagcauacuaucaauaacugaacaccucuuuauuuauaaacuauagcuugacuuucaaaacgauuuugaaacaauaauguuucaaaacaaggagguaaaagaacuaugaaagugaaaagcuauggcuccagaaaaauaaacagcugcacgauugcuaaauggcuggccuuguccuuuccacaauggcuauugcaaaucaacuuuaaugugauuuaauuauaaccugaccauuuaccccucucgcucugucaaaaaccauuauaagacuuuacuucucucuaaagccuauguggcuagacuucacuaagcuuuccuuuuuaaaaaaaauuuuucauguauacccagcauauaucugggugcucacuuuuucucuucucaaaugcuaacuuuauucagucuauguauauucuagauuauucuuucugccucccaaaaguuuuccauuuaauacaaacauuggauuuuggcacucucaucuugcuauaccaccugaacuucaaacgucuuuaaaugucuuuuaagggaaaaacaaaaggagaagaaauuaaaacccugacaauagccuacuuuuucuuccauuuauuugcuuuccuauauuuuuucuucuaguuauagacagauccuuccugaccuucugcuaucuuugauaguagugauaccaucucuuaugugaauuucuuaaaauucacugcucccuacagaguccucuucuugcccccaacuauagcucuguagcugucaccaucaggggaagcugagugaagaguauaugagauuguauguauuauuuuugcaucuucccacgagucuauaauuauuucaaaauaaaaaacuuuaaaaaaauacauggugggcaugaacuauaugugugugugugugucugcaugugcggcacaaauuggguauugaggucauaaagaagaauagaauacaauccaacaucuucuaccugagggugaggcauggaaucaauguauuaaaugauuguacucuauaacacaaguacuauaacagccauaugcucaggggaccagggagcacagauggaaaauuuacuagcaguuccaggaggaggaccagggaaugcguuguggaacaucauuucagcugggucuucagaaauuagugguaauuuuaccaucaggucaagacugccucuccaggccaagggaacucuuuaaaagcauagaaacuugaaaugcauguuguguguggagaauaaugaguauuucaguaucaguaaaagguccuaaggaagaaaauguagaagauauggcuagaaaaauaauguucuaguaaaauaacauaguauuucuauguaaagaacauaguauuucaggcuuagaaauuucaauuuaauaugguagauaggaggcaacuauaaaaucuucuaaagcagagaaguaauauaaccagcuccaauucauauucauggaaaaguauaaauucaucaggauguacacagauuuagcuacaagaauauucauuaaguaauuguguacauaccaauaucagaagcaguuuauauguuugacaaaagggaacugguuaaguauguagcuuuuuaaaaaauguaugcuauuuaauaaugaaauaaccuaaugaaaguuuaaaaaauggauuauaggccgggcgcaguggcucaccccuguaaucccagcacuuugggaggccgaggugggcggaucacgaggucagaagaucaagaccauccuggcuaacauagugaaacccugucucuacuaaaaauacaaaaaauuagccaggcgcgguggcaggcgccuguagucccagcuccucgggaggcugaggcaggagaauggcaugaaccugggaggcggagcuugcagugagccaaaaucacgcuacugcacuccagccugggcgacagagcaagacuccaucucaaaaaaaaaaaaaaaaaaaaaaaaaaaggauuauaaagcaguagguauaguaugauccaauuuuuauaaaacagaauguacacauaugcaaagaaaaaagucuagaaggauaugcauacaaacacauacguagugaguguauacacauauacaaacauuuacauauauugaauaauaguuggauuuauaucuauuucagaaugguuagauuauuaaugauuuuaaauuuucgauucaggggaucaugacagacgggaggcaggacuagauugcagcuccggacagagcaguacggggaggcuugcauugugaauuuuagcugcagaucgccugcaagaacaaaccagcaaucccgaggacccacagacucccucaaggaagcaagacuugggagacccccucaaauacugugagugccccaacugcagaagugggaaagggagacccuccugucccgaacacacacccccacugcagaaacugaagguuugugggagaaguuuccgacuuuacuuaaagcugagucaaguuagagagccaagcaaaauacagggauagaggaagcagcagaaaggcccuaggagcucacuggguccccaaguagcccauuucugccuggcaccacagggauccauugcgaggguggccagaggaacaggggguaaaacuccacagggagaaggaauucucuagcugaacuuuguaacaauuugaacaagaaaggcuagggacaagaagccuccuggucagaacuugggcgagggcacaaaucgggcaugcagacucuacaggcagaggaagaacuaaagcccuuuucucucacagcugggaaguggauagucucaggcaaauuuucaagcucaucucgcccucugccuagaaacagagucggggcuguuggcaggggcauggugggugugagaccagcccuucaguuugcaugggagcuggguaaggccugugacuccuggcuuucccccacuucccugacaaccugcaugacucagcaggggcagccauaaaccuccuagguacacaacucuagugaccugggaaucuugcccccaucccagacagcagcugcaacaagacccccucaaggacagccugaacucauacacaccuagucccaccccgaccuguguggucucucccuauccacccugguaguggaaaacaaagggcauauaaucuugggaguucuagggccccacccacugccggucccucuccacacuacuacagcugaugcuuucuggaaaguaccaccuccuggcaggaggccaaccagcacaaaaauagagcauuaaaccaccaaagcuaaggaccuuuauggaguccauugaacucuccaccaccuccaccagaacaugcacugguauccacugcugagagacccacagacgguucacauuacaggacuuugugcagacaacccgcaguaccagcccggagccagguagacuagcuggguggcuaagacccagaagagaaacaacaaucacuauaguucggcacacagaaagccacauccauaggaaaagggagagaguacuacaucaagggaacaccccaugggacaaaagaaucugaacaacagcuuucagccauagaccuucccucugacagagacuacccaaaugagaaggaaccagaaaaccaacacugguaauaugaugaaacaaggcucuucaacaccaccaaaaaaaucacgcuagcucaccagcaaaccaagaagaaaucccugauuuaccugaaaaagaauucaggagguuaguuauuaagcuaaucagggagggaccagagaaagacaaagcccaaggcaaggaaauccaaaaaaugauaccagaagugaaaggagaaauauucauggaaauagauagcuuaaagaaaaaacaaucaaaaauucaagaaucuuuggacacacuuucagaaaugcaaaaugcucuggaaagucucagaaacagaacugaauaaauagaagaaaaaaaaucagagcucgaagacaaggucuuugaauuaacccaauccaacaaagacaaagcaaaaagaauaagaaaauaugaacaaagccuccaagaagucugggauuauguaaaaugaacaaaccuaagaauaaucgguauacccgaggaagaagagaauucuaaaagccuggaaaacauauuugggggaauaaucaaggaaaacuucccuguccuugcaagagaccuagaccaaauacaagaaguucaaagaacaccugggaaauucaucgcaaaaagaucuucaccuaggcacauugucaucagguuauacaaaguuaagacaaaggaaagaaucuuaagagccaugagacagaaacaccagguaaccuauaaaggaaaaccuaucaaauuaauagcagauuucucagcagaaacaucuagacauuggcuuaggcaaggauuucaugacgaaaaacccaaaagcaaaugcaauaaaaacaaauauaaauuagcugggaucuaauuaaacugaagagcuuuugcauggcaaaaggaacagucaguagaguaaacagacaacccacagagugggagaaaaucuucacaaucuauacaucugacaagggaguaauauccagaaucuacgacaaacucaaaucauuaagaaaaaaaaaacaaucccaucaaaaagugggcuaaggacaugaauagacaauucucaaaaaaaagauauacaaauggccaacaaaccuaugaaaaaauggucaacaucacuaaugaucagggaaaugcaaaucaaaaccacaaugggauaccaccuuacuccugcaagaauggccauaaucaaaaaaucaaaaaacaguagauguuggcguggaugcaguaaacagggaacacuucuacacugcuggugggaauguaaacuaguacaaccacuauggaaacaguguggagauuccuuaaaaaacuaaaaguagaacuaccauuugauccagcaaucccacuacuggggaucuacccagaggaaaagaagucauuauuugaaaaagauacuugcacaugcauguuuauagcagcacaauuuacaauugcaaaaccauggaaccaacccaaaugcccaugaaucaacaacuggauaaagaaacuguguguguguguguguguguguguguguguguguguguguguguguguacauauauauauauauacucacauauacauacguguauauauauauacacacacauauacacacacacacacacacacacacacacacacauauauauaauggaauacuacgcaggcauaaaaaggagugaauuaacagcauuugcagugaccuggaugagauuagagacuauuauucuaagugauguaacucaggaauggaaaaccaaacaucauauguuuucacugauaugugggagcuaagcuaugaggacacaaaugcauaagaaugauacaauggacucuggggacuugagggaaagagugggaggagggcaagggauaaaagacuacgaauauggugcaguguauacaugggugaugggugcaccaaaaucucacaaaucaccacuaaauaacuuacucaugggcugggugcgguggcucacgccuguaaucccagcacuuugggaggccgagguggguggaucacgaggucaggaguucgagaccagccugaccaauauggugaaaccccgucucuacuaaaaauacaaaaauuagccgggcaugguggcacacgccuguaaucccagcuacucaggaggcugaggcaggagaacugcuugaauccaggaggcagagguugcagugagcugagacugcaccacggcacuccagccugggugacagagugagacucugucuuaaaaaaaaaaagaacuuacucauguuaccaaauaccaccuguaccccaauaacuuacagaaauauaaauaaauuuucuucuuuuaguucaccugaauuuucuaaauauauacaaagaacauguuuuaucuuuacacuaaaaaauguuuuuaaacaaguuuauugagauauaauucauauauaacuuacccuuuuaaaauacacaaugguuuuuaguauagucauaucaccacaaucuaauuucagaacauuuuucuuacccaaaaggaaacucuguacucauuagcuaucacuucucauuccccuacuccuaguccuaggcaaccacuaacauacuuucugucgccuugaauuugccuauucuggacauuuuauacgaauggcuuuauaauaauaugaggucuuucugacuggcuucuuucgcuuaccguaauguuuuuaauguuuacccauguuguaguauguacuagaacuucaguuauuuuuauuauuaaagaauauuccauuguauggauauaccacauuuguuauccauuuaucaguugauggauauuuggauuauuuccacuuuuuggcuauaauacugcuacaaauagucauauuuuuuaugguagcacugaaaaugaagacagaauauuaacacagagaugaaugauaggucauuuuaacugucuaaauaagcgauaagaguguuaucauugauugaugggcauuuggguuggaaauagcagugugggccaugaaaagagauauauuugggagguagcaucaucaggucuuggugacuggcugaauauggagaguaagagaaacagagagucaagguuguuucuugaggccucuggccugggcauugaguaacaucauacacugagaucagacauacagaaggaggugaguuuccuucaggcauguggaauugccugaaggaguauugguggagacauguggagcuuggaagagaggccaaccagaaggcauacgaauuacagugguagcuugaugagacuguccaggggagcacgaagauggaaaaccaauagucaggagacagaaaagggaaaaagaagccacagagaaugagagaaugagaagccaaagaaugagaauguucuaugaggaaaccugucucauuguaaaaugcugcaaaguaguaaaauggauuauaagcaaagugcgaaauuauggagucacuuugacaaggugaaacauuagucagagaucaauaacuugaaugacuuggccuaugcucaagaggagauacagagaugggaggggagagaauccaaaaaacagcugcgcacauuucugcaguccugcaaaggacuuggguuaguucaugagaacugaaauacaaacacgcuccauaaacacauggucauugcccuuuuaauaacuuccuuuugaaaaaaauuaauuuuccugacuuaugaauuagcccuuguuguuuccuuaccaccauuucugauacaauuauauaguuguuuuccuguugguucuuucuaucacggggccuuuuuacaaaaguuauauaugucauuuucagaaaauguacaaaauauauggaagagaaagagcaagaggagacucagacaccaccuguaauucuaacacgcagggauaguuaucauuaauacacaccuugguuuauauucuucuggacccaauuuugagaagucuauaacaaaagcucagucuucuguuuauugccucugcuaacuuacauagaaaggccuauccugcuuccauaucaauguauccaccuuuauguccuucugugauuuaugaaauuucuuuuuuugaauuuaaauaccuuauuugucugaaauguauugugugauaugggaugagguagggaaucuauuucuucucuccaaaugguuggccaguuuccaacacuauuuuuaaacuaauucuuguccucuccucauugcuuugaaacgucacauuagcacaugugguuagaguuaagguuaacacauucuaaguuuuuacauauauaauugaggggaagaggguggauccuccugcuuaaggaaguuuuaauuaucccaguugcuauaaucauagaaaagcagaagcauaacacaaagauacacacucaaaaacugaccacuucuaaaauuagucuguacucaaauauccuccugcauuuaacacuagaagaaucucugccugcuaccaacauuuuauugguuaaucccucacugacuguaggaaauuacugcaaauacaacacgaauuggcugcagaggaaaacuauaaauccugcaaauuaugccaaguuuaaugcaguuaaaguguuacuggagaacugugccugucacacgcaaggccagugagcagugaaaaucuggcagucaguucaguugacaauaaagaaaagaaaacugacaacaaugaugacaugauagauguuucugaugaaaauaacuugcauaucaaaggacuaagagagacugcuaggaaaacagaucaugccucggaauauuuuuucuuaaaaggacccuuucuguaaaggugccuguaaggccaaaguugaguaugcacuauugucauucacuuuugcuuaauaaugaauaaucugaaaaggcaaauguuacacacucuuucuuuuuaaaaauuuccuguuauaaggacaauggcugcacugcagucaaguacagcccaagguacacacccggcacagcaugacacagcaggauuggagugcaggugcacaauccugugcauuauauaaucauaucuacguagccauaacaugggagggcucaucaccuggcucugagccacuauugucugggaggugcauaaaugcagcaccaacagugugagugaguugcugaauaaagccaugucccaccuaccuguggucucucaaguguucuuucagcuacccacuaccccaucaauuccccucagaccucagcuugggcuggaaacucacaccuguauaaucuuauaauuuuauucuucuaauugaacucuagaauccuuuugucaaguucucccaaguuccuuugggauuuuacaauaguauucauuauuauuaguaacagaagcucacacuuagugagaauuugcuauaugucagguacuugcuaagcauuuuccauguacuacuauauuuaauuuggccaacaaaucuauagugaaguaucauuauuuuuccuacuuauaguugagaaaacaaagaaguagacagacuaaguaacuuguuccauaucauauaacuggccaaccuagcuauggaacccauauacuucugaugagaaguccacuucacaauagcauuuucccauuuuggaacucacucccuuuuuuuuuuuuaaugucaagauaaaguauuguauucucuguaggaaaaacaggcucagaagccauuuuuguauauuuaagucaucuaaaucuccuuaaagaaugacuucaaacuuauaaaaauucaaaauguaaaaccaacaguuaaaucauacugacaauaugaaaguaaacaccaaaugucuuauugagcaucuaagugagaccuggaagaauuaaauuuaaauucaguugaaaugggccaauuggaaguagcuucaaaauaauaucaaauccuuaaggcaaaaggucauugacucaaguuuuaaauacuaaaaagaauuuaaaaucccucucucaaaaggcuagaauagacaucuuauucacauuuauacucuguauucagauucauacugucuuuucucccauccacuuaauacaauaaagaugcacaaaaugcuaauuccuggguggucccuaccacaucucaaaaugauaacuuuuucaauccauaucuaugaaaauauauggauuauauaagauaccuaaucuuauuuaucaaaucuucuuugcuuccuuuuacucccuccucuuggcuuccuuuuagcccaggaaucuggcagugugaaagaaaauacagcugaagcuacggcccauuaugacaugugaagucauuugaucacauuaagagaauguucacuugaggcaccugaucagccuggauugucuuuacaccccuuuuccuugcccagcuuucuaugccugcccugcuguggugccuacagcauuugcucuccaagcuucuaucugaugggccgucacuuaucuauauuauuucuuaggcaaagcaucaccuaguugaaauuaaguuuaagaaaagcauagaggugacaaaagcuccaguguucaugagguuaaaaugauaagucuucaaauaucaugaguuaggcccacucauguauacauuaaguuuugcauauaugcuugagagguucaaaucuuugcuauaauuagggcuauugaaauauugcccuagauacugagguuauaaaaggaagccuccugcaaaauacagcaagucuuuuaguccuaggcagcugcagggagaagguugggaacauauaugcaugaaaaggccagauagaccacuaaaucacuuacacucagauuuuuaaaaaacacuaaucagguggcccuuugugacuucugcucuaagaguagaaugcauacagcugagacuggaaaauagauauuuaacgaaaguagauuccuuacaagcuauauucaccagcagaaagaugugaacaccagagcuacagaugagagaaauaaauuugauagcucugcaacaacaacaaaaaguucaccagaaaagguuaagggaaaaacugauagagaauugguaaaagucaagcaagagaaauguaaggcaaagaaguucauaagguaauucccacugggaaagauuuucaaacucuggacgccagggaggauguugucaccauggccuucgcuagagcaaaaaaagggcacagccaaggugcugggcucauaaagucaugaggcuagaaaagaccaaagguuuuuuauucugagauguuuauccaucugcaauuuaauagggaacauggcaaaauuacacacacuccugccuuuuaauacugaacacuuauucacuucaccuucuuagaccuucguuaccucagcuguuaagugagggaggugaaccagacgauuuugaaggucccaacuaaaucuuaaaaaaagaucaucucugcaaaaaaaacuuuuaugcuuauucaguaauccaguccuuucuaauaugccacuuuguauauucugauacaacuacuggagcuaaaccaacauuguaaacugcacaauuacaggcuugaagcagaaauaacuccucacaguauuucuuaauaagaaauacucaugauaauguuaucaugucaccuuuggacauaauaaaaauuaagcacaaaacaaauauaagauaaaucuuuaauauauuucucauagcaaagaaaagaaaagagacugugugaaacuauuucugcccuuuuccuuucacacugcuagaccaauuuaagugggguggggggaggcggggggcggggggaaggccgaaucacagaacagcuuacacaggaggaggcucugguuaaaaacaaaucuguaccacuguggucuguguggucuagagggaagcacagugggcugggagauuuggauucuagaucuaacccuuccaguaaccaugaaaccccaaggcaagagauuucaauuuuccugccuccauuuucuauuuguaagacagcaauaauucuacaugucucuucuaccucaaaaguaugccaauacagagauaaagcaugggaaaaaucugaguuauagggaagaaaaguaguauaggcaauaauuaagcauguuaaugacaacaagugcugauuuaacaauuuuuuaaaaccucacuauucugauuagaucaagacaagugggagggagagccacucaaccacagaguggcaagcgggucgucggcaaguaaaggcaaggcauugcgacugugacccugauugcccaugcacacagccugaaucucuccaacagaacgaacucagccaggccaggcauaaaucugacugauggcccgcccuggacugugaacaaacacacuguccaucuuucuucuuuucauuucuuucucccuuccuucuuuuccuucuuucucuguccuuuacuuccauacauuuaaaaacuuugcacagagguuuuaaaauguuccacauccuagauacggacacagcccuuagguuacuuacaaaucuaguuauuuaaacaaaaacgacuaagacagggauuugaggaucccugaacaggaaagcucagacagggaccugagaagagaauuuggggcugcugcagccugaacucacagguaaucagccaaucagaugggccaucccaucccucuucaaauuuuuuuucucucucucucuuuuuuguaaaauuaauguaucugcccuuuucccucaagucuccuuuguuuuuccugugggcaagcagggagggagagucauaaacugauacugauuauaaugaauaguuuucauuuacuaucucauuaagccuaaauaucucuuaggaaaacaauccuguaacaguggacagaagaugaacaaguggaacaguuaagaggguguuacagggcaagauaaagagguucuaaaugaaggcaaacaaugucagaacuauuucucuauagaaaagcauuucuauuauaaaaggccaaauaaaaaauauuauuuggaauaaaguuggcuucuaccuauguauaguugagguaaagauauucaaaucauagaauauagaauccauaaccccaaaccagcuauuuuuccaccucuaaauuuaaaggcugaaucaugcauauauccauaacaacgauaauaauuacagcuuaaauuuuuugagugucucuguuccaagcauugugcuaggugcuugauaaacucauagggccccagcggcagggcaagcguuauuacauucauuuuuuuaggaagacaugaagacucuagaaaagaaaguaacauacucagggucauauaaguaguaauggauaaaaagaggcaggauccaagcauuguucugucugucuccacagucugugccuauuagaucaugcuaugcugucuccauguuuaucuuuuacaauuucacuugcauuccuuuucacuucuaggaaugcugagugagggggaaaaggaagcaacagcaagacuaccagagagggaaugggggcggggaaguaaagaaaaggcauguaagaaggaagaagagaaaaccacaccacuucccacacugugguucuugcuguaggaggaaagagaugcuauagcugcugcaucaauuaauucauugauguaaugcuccuugcugcugccacagagaggcuaggaagagggaaacaggaguugggaacugcugcgccuaagagaccugagggcugcacgacugacugcucagccccuaugaccaugggaaggacagcccugggugcccacgaccaucacugacugcccauggaggggcaaguggaaucucucuccuugcuggcccaugggugccugggcucugaagccugcucacaucucuugauccucaucuuucacuuugucucuucccccuuauucugaugaccacaauccaagcaaacagcagaagagacuggacucaucuggauuacauuaguugcuuguaucaugcuauuuacauuuacgaaauauuguaucgcgagaucacauuuaguaaaacuuuuucuuaaaaauaguuuaucuucuaauccacuuuuuauuaguuagaagcaaaacaaaauggaucauauauuuaaaagcagagagaagaaaaaagacauaccauucuggaaaugucuagcaagcaaauaucucagggauauuuauucaagggguuacccugggaugucagaggggaaacgugaaaucaauuuucuuggcuaucaucacuuuaauaugaaauuuaaaccccaaauacaaccacaggcacauuccucuaauuuaggagaaguacaauugugauuagggagcauggacagagcucuuaccuggcaugaccauggucuguggggcugcugcaucgguacuuaggcagagacggccaccuuuggauaaucuaucgcagagcaaggugauauguuucuucaguuggcuugugucuuuggguauguucagcuggcuguugagguucaaagccugcuccuuagaacucuucgacaggcaagucuucaacaggugggaaauggcggcauccaccguuucuucccagcccuggauacaaaagccaauuuugaauuaauacaaagaugacaauaagaaaagugggcacuugauguauuauacagauuauugaguguuuauguucaaguguugggaaccugugaagagugugguaucuggaauauuccagacuaggcugguuuggaauucuggcucugucaccuguuugaccuugagcaaguuacuuaauuccucuuagccucauccucaucuacaaaugaggauguuaacagucugucccuccaaggguuggagaucuaugagaaggguuuagcucugagccaggcauagaguaaugaguaacaacaaaaagaguaucaggcacacgucuguuuaaugaucugguggguaaagcugcuaggauuauaguuuguuuugccuuaucuuucuuaucuucggcuaaaggaaagcgggccaggagaaggaggaccuuuggauacccugggggaaacuggaauggagggaaaacccuggugucucccucagguacugguuccacagccuugggguuauaggcagaaacaaaggagcuauugcaagaaggaucgugugagacacagggccugccuaguacugcucacuguccaggugacgguaaaugacccacaggaaguaggccauugcccccacuuuuguugggaacaguguggcugcgcugcagugaaaaaccuagaaaagugcagugacagcugcaauucaggaacgucagcacaaggcagggaccucagcauugucauggagagcacuggcaccagcaggacuggcauggggaggcaccacccucagguggguucagcuaacacuggcaacaaggaguaugagguaaagagcaggaggggucaguuuaggagcucccuuuaggcauccccagaggcucccaggaauaacuggguaagaucuuuguggggaucuggagguccuaagaagcagaacaaggaagcaaagcaugagugaaaucuggguguugcugugaaugugacuccaucuguacacaaaggcugguaaggccuagagcaccaugggccugaccauccaauacaauuauaaagaacgacaagaaaugaauuuaugaucauagaauacugcggaacagugcaagucccuuauauuagaaguaagagcccugagacucagagagaagguucaucuggaacccaucauuccauccucaaacuuaucauuugagccaccauucaaauaugcaaaucagauaagguuacucccaagcuucaacuaugauaugguuuggcuguguccccaccgacaucucauuuuguaguucccauaaccccacgugucaugggagggacccagugggagguaacugaaucauggagguggcuacccucaugcuguucucgugauagugaguuuucaugagaucugaugguuuaauaagcaucuggcaucuccccugcuggcacucauucucucuccugcugcccugugaagagguuccuucugcaaugacuguaaguuucccgacaucuccccagccaugcagaacugugagucaauuaaaccucuuuucuuuauaaauuacccaguuucagguauuuccuuauagcugcaugagaacagacuaauacaaacuccuaaauucaaauggucagacuggcauuuaaggaacuuucugcuccagcucuugcuccacuguauucuguucccauccaccugcacccacacugucucucccuuaggccucugcacauggccgucgcucaugcuacaaugcccuaaccucuauucuuuagcuggccaacucccauuuaaugacuugcucaggcauugccauccaaggguugaugggugggcccucuuuggggcucugagacuucacacacccagaugcaucauagcucuugucacccugugacgugggugcuguuugcaugucugguauucccugagagugacuggaguucuccacauccccacacuguucuugguauacagaggauggucaagaaauauguuugcugcacagagauggugagauauaaaaccagggccuuaaaguugggagagcuuuggagaucuuuaugucuagucucguggggguuuucccaggaucauuuauacaacggcaaccaucugccuaggcauagcugucuucaagauccaaaaucacuacuuuuugaggcaguucacuccuuucagggacauguguaaccaacagaaaacuauucccgcacugagccaaagucuaccccauuggcccuucuucuacccuccagaggcaugcagaauaaaucuaaccucucuucuacaugacagcccauuuuaucuguggagacagcaauucuguacccucuccuccagaauaaacauccuaguuccucuaguucuuccuuauauaaacugaguuucaaguuuuuucuccauccugaccacucuucuuugaaugagcuccaauuugaaacacuuaaaaauuuauacagcuaaauagagaaccccagacugaccccaaaacacugggcugcggcuuggaguguagguaucccacagcccucccuccuuuuuucuaggaauucuccugccagccuggccuccaguugccucugcucucuuggcaguuggauuacauucuugauucacauugagugcacugacaccuaagccccaggucuuugccacacuugccacaucucuucuucuagguuuaugaggcucgcucucucugucucccucucucuauugagacagaguuuagcucuuguugcccaggcuagagugcaauggcgugaucucagcucacugcaacuuccuccucccagguucaagugauucuccugucucagccuccugaguagcugggauuacaggcgggugucaccacaucuggcuaauuuuuguauuuuuaguagagaugggguuucacuguguuggccaggcuggucuugaacuccugaccucagaugaucugcuugcuuuggccuccaaaagugcuaggauugcaggcaugagccaccaugucuggcccugcaguugguucuucagaucaaagugcagacucuacauauuuccacuagagaacuucccacugauugccauaauggguuaaucgggacuuuucacucuauuggcccauuucuauugacccaccuguaggugucacuaggcaaguuaggaaacaaguaaaugauuuuaaagucaucuugaaaauccuuucaacagauucaagagaccuaaaagaccauaaaaacagcuuccuaccccaaaucacuaaagaauaauaaacacugguuguuacaaagacaucucuuuacuacuaccaaaaucuaaacuagacuaauaucuagaauugaguuugaauuucaguaauaaugggaagagauaaaugaagacaaaauaguaacccagacaucacuggagagggcauguuuucaauuggagccauugacaaagaccucuggaguaaagaagaaaaaaauccuuugaauauaauuuggcauuuguaugcucugcagucauuucagcauuaaaauaguucauacugucauucauuuaagcaaacuacuguaucauaaauagauuacaguaacauauuagauaauuuaaguagauaugacauuuaguuaauacagaguacuacagaauuuauuuuccugaugccaacuugcagaucaagucaaaaaccaugucauguuuagguauuuggcaugguauauuucuuuaauauagaugaggcaugaugccaguacuuuagaaagauugccacuaaaauacagaguuauuacuuggagggacugaauugcuacauaaauucaaauauaaaacuaaaaggaauaucucugagacaaaaaaagagccuuugagaguuuuguuaaauaaaaauacaaugugauaauucacugaucaaacauguagcauacuuaccuauggaaauaugaaauaaaacuguggaaucuagaaucucaggugugagaaguaccuuaaagguaagcuauuuuaaacaccuuuuugguauuugagcucauuaccuuuauucauagcccuuaaauugguaaggcuaauguucaguuuuaaugucuaaauacauacacauacuacaugcacauaccuaaccuuuaucuuuuaaagauaaauaucaaucauacuaguauuuuugucuuauauugugagaguaaaagaaaaucuuaauuugggaaauauagcacuaaaaauuucuggaagggaauugggcaugugcucuucagugagaaaugauuuuuguuauaguccucaaauccacaauuugcuguaaauuccagguugaccuguguauggcuuuuagaaaacaacagcggugggggagugggaggcaacuggggaagggaaggggaugggagaggaggggagggaagggaagggagaagguguuaguuaaaugugcauguuacacuacuuuaucuuuuccacagcccuugucguuauuggaaauuaacuuauccauuggguuuuguggggauuuuuugguuuacuuugucuagucuagcauugauaacuggguuuuccuuuguuuccagaccuuggcuuuacccaaguccucuaccagagccccugccuuaggagccugcugaaagugucacuccuugauagauagcugccuagcuucugcaagaucccuccaaggaaccggacucaggggccgaggcccugccugcuaccugacuucuccaaugccaaguugccugcuguaugcaucccccaacauggcugcccaguccccuguuuccacaucuuaccagccugugcagaggcuccuacaguccaugcuggucccagaugccuuuguguaccagugugauugcuggugugcccuuuuucugugagccagcucuuuaaauucaaggaccuggccuugccuagucugcuccuccugacugaauucagcugagcuaugcuucuugcuauccagagaccagagagccacagcugaauuucugacugcuuugcuuuacuacccugcuagucuccacuggucaauaggccuaaauaccagaucaagcaaguggcuuauuagaaacaguaagaagcagaaaguuugaccacacuuguaaaguuaauuuccuaggguaucgaccaaaguaaccaaagcacaaaauaaacuaagaaaguauucccaugccaccugugaaucaaaacaguugaguugaugauagcugucccgaggcuccugaguucugacuuaaccucacucaccucaucugccccuucacugugugagcuuagauaacucauuuaaucucucuaggguacacgugaggucuccacaaaacagcaauaacacuauucauuaugccaaacuuauauaagugguacggcacucugaaaucuuaaguggaagagacuaugaaaugagaaaauauauucaauccuacuuuuuuuuaaaaucagaaaauagaaguauguaauugaaaucuaaauuuccaaguaauauccuuaaacuuuuuuucaaacaaauuauaaacuccuacaaaccuauguuuauaauagaaacacuaccacauccuuaacuacagugguauagggaaaaaccacaaaaugccacaguaacauuuauuaccaaauguguacacaguuaaaccuaagagagagagaaaagguuaaaaaacaaaaacaaacaaacaaaaaaccacgagaccuguuaaaagaacaaauggagauuuuguggcaggaguccagauuucaagugaaaagagaagacucucagaaauggcccauguugcauugcauauaugaaggcgaaacaaccuucauaucauauucauuuaucuuaauaacaaacuguauuaaagggaaaaaaauuuccucuucaauagauguaaaggaugcaaaaugaaaaguguuugguauuuauaauugauccacagaagauuaugguuauuacuuuguaucauauuguauggaauuguauuacauuauaucuaaauacuuauuagauuauaucuaaauauuauaucuaaagcuaaucguauaauggguuauuguaaaccccagaacaaauaaaacuugguacuuuaguucuaaauuaaauaucuuggaaaguacagggccuuuucaggaaacaucuagguucagauuauuuccaaauauuauuugcuugacuguaaucagugaaauccccuugucaugcaaagagggcucaaaauguugagcaauucaccuuugaaaaauaaaacagcccgagaggaggagccaagauggccaaauagaaacagcuccggucuacagcucccagcgugagcgacgcagaagacgggugauuucugcauuuccaucugagguaccugguucaucucacuagggagugccagacagugggcgcaggucagugggugugcgcaccgugcgcgagccgaagcagggcgaggcauugccucacuugggaagcgcaaggggucagggaguucccuuuccgagucaaagaaaggggugacggacgcaccuggaaaaucgggucacucccacccgaauauugcgcuuuucagacccgcuuaaaaaacggcgcaccacgagacuauaucccacaccuggcucggaggguccuacgcccacggagucucgcugauugcuagcacagcagucugagaucacacugcaaggcggcagcgaggcugggggaggggcgcccaccauugcccaggcuugcuuagguaaacaaagcagccaggaagcucgaacuggggggagcccaacacaacucaaggaggccugccugcuucuguaggcuccaccucugggggcagggcacagacaaacaaaaagacagcaguaaccucugcagacuuaaaugucccugucugacagcuuugaagagagcagcgguucucccaguacgcagcuggagaucugagaagaggcagacugccuccucaagugggugccugaccccugacccccgagcagccuaacugggaggcaccccccaacaggggcacacugacaccucacacggcaggguauugcaacagaccugcagcugaggguccugucuguuagaaggaaaacuaacaaacagaaaggacauccacaccaaaaacccaucuguacaucaccaucaucaaagaccaaaaguagauaaaaccacaaagauggggaaaaaacagaacagaaaaacuggaaacucuaaaaagcagagggccucuccuccuccaaaggaacgcagcuccucaccagcaacggaacaaagcuggauggagaaugacuuugacgagcugagagaagaaggcuucagacgaucaaauuacucugagcuacgggaggacauucaaaccaaaggcaaagagguugaaaacuuugaaaaaaauuaagaagaauguauaacuagaauaaccaauacagagaagugcuuaaaggagcugauggagcugaaaaccaaggcucgagaacuacgugaagaaugcagaagccucaggagcugaugugaucaacuggaagaaaggguaucagcaauggaagaugaaaugaaugaaaugaagcgagaaggaaguuuagagaaaaaagaauaaaaagaaaugagcaaagccuccaagaaauaugggacuaugugaaaagaccaaaucuacgucugauugguguaucugaaagugauggggagaauggaaccgaguuggaaaacacucuacaggauauuauccaggagaauuuccccaaucuagcaaggcaggccaauguucagauucaggaaauacagagaacgccacaaagauacuccuccagaagagcaacuccaagacacauaauugucagauucaccaaaguugaaauguaggaaaaaauguuaagggcagccagagagaaaggucggguuacccucaaagggaagcccaucagacuaacagcggaucucucagcagaaacccuacaagccagaagagaguggaggccaauauucaacauucuuaaagaaaagaauuuucaacccagaauuucauauccagccacacuaagcuucauaagugaaggagaaauaaaauacuuuacagacaagcaaaugcugagagauuuugucaccaccaggccugcccuaaaagagcuccggaaggaagcgcuaaacauggaaaggaacaaccuguaccagccgcugcaaaaucaugccaaaauguaaagaccaucgagacuaggaagaaacugcaucaacuaacgagcaaaaucaccagcuaacaucauaaugacaggaucaaauucacacauaacaauauuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuacuaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcaccaagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauacuuggaacuaagcucuccucagcaaauguaaaagaacagaauuuauaacaaacuaucucucagaccacagugcaaucaaacuagaacucaggauuaagaaucucacucaaaaccgcucaacuacauggaaacugaacaaccugcuccugaaugacuacuggauacauaacaaaaugaaggcagaaauaaagauguucuuugaaaccaaugagaacaaagacacaacauaccagaaucucugggaugcauucaaagcagugcguacagggaaauuuauagcacuaaaugcccacaagagaaagcaggaaagauccaaaauugacacccuaacaucacaauuaaaagaacuagaaaagcaagagcaaacacauucaaaagcuagaagaaggcaagaaauaacuaaaaucagagcagaacugaaggaaauagagacacaaaaacccuucaaaaaaucaaugaauccaggagcugguuuuuugaaaggaucaacaaaauugauagaccgcuagcaagacuaauaaagaaaaaaagagagaagaaucaaauagacgcaauaaaaaaugauaaaggggauaucaccaccgaucccacagaaaugcaaacuaccaucagagaauacugcaaacaccucuacgcaaauaaacuagaaaaucuagaagaaauggauaaauuccucgacacauacacccucccaagacuaaaccaggaagaaguugaaucucugaauaaaccaauaacaggagcugaaauuguggcaauaaucaauaguuuaccaaccaaaaagaguccaggaccagauggauucacagccgaauacuaucagagguacaaggaggaacugguaccauuccuucugaaacuauuccaaucaacagaaaaagagggaauccucccuaacucauuuuaugaggccagcaucauucugauaccaaagcugggcagagacacaaccaaaaaagagaauuuuagaccaauauccuugaugaacauugaugcaaaaauccucaauaaaauacuggcaaaacgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaacagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagaugacaugauuguauaucuagaaaaccccacugucucagcccaaaaucuccuuaagcugauaagcaacuucagcaaagucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauaugcaaccaaaaaagagcccgcaucaccaaggcaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacagcuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcaucaccauucaggacauaggcaugggcaaggacuucauguccaaaacaccaaaagcaauggcaacaaaagacacaauugacaaaugggaucuaauuaaacuaaagagcuucugcacagcaaaagaaacuaccaucagagugaacaggcaaccuacaaaaugggagaaaauuuucgcaagcuacucaucugacaaagggcuaauauccagaaucuacaaugaacucaaacaaguuuacaagaaaaaaacaaacaaccccaucaaaaagugggcaaaggacaugaacagacacuucucaaaagaagacguuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccaacaauccgauuacuggguauauacccaaaggacuauaaaucuugcugcuauaaagacacaugcacagguauguuuacugcagcauuauucacaauagcaaagaauuggaaccaacccaaauguccaacaaugauagacuggauuaagaaaauguggcacauauacaccauggaauacuaugcagccauaaaaaaugaugaauucauguccuuuguagggacauggaugaaauuggaaaucaucauucucaguaaacuaucgcgagaacaaaaaaccaaacaccgcauauucucacucauaggugggaacugaacaaugagaucacauggacacaggaaggggaauaucacacucuggggacuguggugggguggggggaggggggagggauagcauugggagauauaccuaaugcuagaugaugaguuagugugugcagcgcaccagcauggcacauguauacauauguaacuaaccugcacaaggugcacauguacccuaaaacuuaaaguauaauaaaaaaaaaaagaaaaagaaaacagcccuuugaauguaaaauagaaaauaaaauaacauaaaaaugaaagcaaguuauauggucuauaugccaucuuaaguuuaaaaucauauucauguuuuuauaaaauaaagcacugaaaaaaaucagcuuuaauuuuuucaacucaucauaaaaugaagaaaauuccacauguaaucuacuaacucucauuccccaguaccauuccuuuuuauuuuaaauggaaacaaucuauuggacuuuuggaguucuccguaucuuugucacaacucacaagcugaaaaaacuuaauugagguuucaaccaacgguagagcagugugcaaguuuauccacaccauuuuguggaaaaucaagcacacugccuccuauuggaugaaaaucuaaaaccuccuuaacaaauacaagcuaagagaccuucagaagguucggcugcagugcaagcagaaagcugcugcaaaccaacccacucugaucccuuuuguaaguuuauauuuugccaggaacauuucuauuugaccuguacucccauuccaaccccaaauucuuuagauggaggaacacaaaguagauuaccugaauuauuauaaaacgugauccuggauggagauaaugaguuuuaaaacaaagcaaaauacuaaugaugucugauggagccagucaccuugacuaagcauuaaaguuuaguucaggcaaaagcuuccaguuaccugcacuacucagaagcaacuuacaaaaaaaaauaaagacugguaaaucaaauugauaaugcaaauccaggggaaagcuguuucugguggugguaaauuacaucacuuggaccagauuucccagugagaacaacuggaaaagaacauauaaaaaucauuccuuugaaggcacaggaaagcuaacaagauagugauaaauuaccaggucaagagccaggggacaauggaggcccaagaaagacgaacccugaguuuaaggcugccuuuuccucuguggucauuagcuauguggccugcaacacugagccuucacuuauucaccaucucacacuaugacuugcacuuauuuauauauuuccacauaaggggaaguaugggccaugaaaguacauuggauuacaagucagaagaccuagacuguggcuuuaugucucugagaaaauuuaagcuuuaaacauaagcuuaaugucucugggaaaauuauuuuaguucucuguaucucaguucccucaucaguaaaaaaccaggacaauauuuuccuugccagaugcuuacuaagauuuaaugagacauauuuagcaaauguagguaguuauucccauaccauuauucuuacuugugagaguucucucuaaaguuuaucuuuucugugcggguucacuugaauaacagcagcagaaauagcagcaacagcaacagaaguaaaaacuauuuuggggccgggcacaguggcucacgcauguaaucccagcacuuugggaggccgaggcagguagaucacaaggucaggaguucgagaccagccuggccaagacggugaacccucguuuuguauuuuguaaaacuacaaaaauuaguugggugcagugucaggugccuguaaucccagcuacucaagaggcugaggcaggagaaucgcuuaaaccccagaagcggagguugcggugagcugagaucgcaucacugcacucuagccugggcaacagagcaagacuccauccaaaaaaaaaaaaaaaaccuauuucagaccucuuaugugcugagaaucuuacaaauauuauuucaauuaauucucucgacuacccuaugaguggguauuauaacuuccaacugaggauuuagauguaagguacuucacugaaaaugucauaauuauuaaaagugggagcuguaauauaauccaggacuauauagcuguaaauaccacacuugaccacuguggcccagagcccgucuuucccauuucguuauguuugucuuucaaucuguuaucauuagaucugcuuaggcuccuuuuacuuuacugggcuucagaaaugacuucuuccccuagaagauucauggucauaauuaacauauucgcagaaccaaaauuuaaaucagcuucuuuauccaaaugaauaacuugcauauaauuaaaugagauuuuacugcauaauaaaaaaaaagcacaaugcucugugccaguuugguugggcgaaacuuuuacaagaguccaccaaagcuuuuagcaccuucauagacuacuguaacugacauuaugguuauagccuuuggacaccauggcucucgaaaacauaacaauggucagacaugauucuaaugaaucugaaguacaaacacucauugcaggcacucaucauugagaauacuuggagcagcuacuccuauuaucaagacauacaacacaaggggucacauaagacuccucaggugcccauauauuugacagagucuggggaaaacuuuauugccaccuaggacaagagaagaaccaugugaguaagcuaaagguaccaacuccucuccugacaaugauguguccuuaauaaucucaaagaacaaggaaugacugaacucagggaaaaacgugucuaaaaauacaugaaaccacugauuuaagugaaaagcaguacagguuucuuuucuuucuuuuuuucucuccucucuuuaauuacuuuggauuuuucaggaccacccagaaacuucacuauuuuaagacauggcuauuuauuucucucuugaucaagaccgccaauggauaugaaacaguuccagaagguccauaugcuagauuucuauuucuauuuucuucaaauagaaaucaagucuggagaaaaaaaauauuuagaauugcaucuggaaugacagagcugcacaucauucaauguuagugucaauuuucacagcuaucaagcuaagauaacaguaggggagcagcacaaaucucaaaacuguagaguaauagugaugaaguaguauguuuacccacacauucauccuaauuuuaaauaucauugucuaucaaauaaaguuuaaauuugagucuauacagucauuuauuuuaaaaauauuuauuuagagccaacuagcacaagacacacuaaauacuaugggggguuuuuuucuuccaaaaaggugaaucagauauggauccuaccuugaaguagcugacacucaagugauaauauaagaauauaggccgggcgcgguggcucacgccuguaaucccagcacuuugggaggccgaggcgggcggaucacaaggucaagagaucaagaccauucuggccaacaugaugaaaccccgucucuauuaaaaguacaaaaauuagcugggcguaguggcgcacgccuguaaucccagcuacucgggaggcugaggcaggagaaucguuugaacccgggaggcagagguugcagugagccgggauugugccagugcacuccagccuggcgacagggugggacuccaucucaaaaaaaaaaaaaaaaaaaaaaaagaauauauacaaaaauauaaugauguagaaaauggaauguacuuagagaaguacaguaaagugcuuuaguaauuauuuguuuuagcucucaugcccuagccucauccuagaauaauaugaagaauuauuugucaaauaaaaguuauucaugacagaaagaucuauacaauacuguaaauacaaauaauauaaaacuuccccaacaguuuuguacaaaaauuaauuauauagcuugaguuuguuuuaguguuauaugaagcaagccaugaguugauuaaaugugccagcauuuuucugguauacgcuuaagcacaugcacauauaacuacaaaauauaaaucuacauuuauccuuguuaaauagauuggagaagaguaaaaauucaguaugaucaggcacucaucauugagaauacuuggagcagucacuccuauuauccaaaguuacuccauugagucagacuguucauuuuuguuaggccccuuaguguggguucaaaucuugccucuguuauuuucuagauauguggccuuggacucauuuccucaucuauaaauuggaacuaauaguccugagacaaagauaaaagcccgaguaguugacuugagagcagagccaagaagugccaauggggaguggcaaaacgugaugaaaaguggagaaaaagcaauaaaggguguaugcuguugagcggcaacgggugcucacuccugccagagaacucuggaggaugguguauaacauaacucucacacuuacccugcauaaaggaugagggaaccugggcauuaaucuacuaagucuaucagucauuggcugagcaugguggcuauguagccucugccaaacagggauagcccucaggcaaaaaacugcagguguugagcagguggaagcauucaggaauggugagagguuaagagauaggaaugggacaugcacagcaugugcuaccacugccuacuucaaagggacauggugaggauuaaaugaaauaacauaugaaaaguccuugaucaaugccuagcacauaauaaugcucaauaaaaguuaauuuucuuauauuccuuuggcauaucuuauuuggguguguguuuaacucuucucccauuuucuuuacaaaauagagaaaucuaguuagugaaguucacuggacuuaguucuaagacugcuaaccaauguuuaugaccuugacuucagacccaauagguuagaaaggaacuaacaacugccguuaaacaauacaagcuagauuuuuauuucucaggcagcuggggaguuucaccacuccaaaugcaaaaaaugaaacauauuccuguuaacacuguuagugauuucauccacaaauucuuauucauuguugugggugagaagaucuguguucauucgguucucacaaacuacuuaucagugagaucuaaaccuaaauuuccuauguuaggcaauagaccaaauuuaaaaugauaccaauagagacucagucuugacuacuucucacuguuuauacauggcuuucucuucaaaaagcaacaacugguaagauuuuuccuauuuauuguauaugaaaugugcuucuagucaaaaacaccuacuccaagauaggaagucauggacuugccuuuuucuauaacuuccuguccccaauucaaaccacucauaaauucccucuugauuaaaacaagacuacagugauaauuucuuuacucugugcuuacaaauguguuccaucaacucuuuuuuuuuuuuuuuuuuuuuuuuggagaugaaauugcucugcugcccaggcuggagugcaguggugcaauuuuagcucacugcaaccucugccucccggguuccagugauucuccugccucagccucccaaguagcugggauuacaggugccugccaccgcaccaggccaauuuuuguauuuuuaguaaagaugggguuucaccaucuuggccaggcuggucuugaacuccugaccucaugaucuacccgccacagccucccaaagugcugggauuacaggugugagccaccgcgcccggccuauguuccaucaauuauaggacauuucucccccacaucucagaaguaggguugugucuuauacucaguggcauauaauaacuucuggcuuucagguuccggucaugcuauaguuuucauugccugagcauguacagccuuuaucuuagcaguucauauuaugucacguccacugacuugugugcaauguuaauacuccucaaugaauuaauuaccauuuaaauuaucuuuuaaaaccacaccaugacuuaucauugagcaaaaaaguuacugugugcacagaaagguauggaaauaguguaguuagaaguauaaaguugaacugagugaggcaaacauucaugacugaagaaugacagcaauuucauauuuucucacaaagcaaaagcuaagcugaaagcuuuccaggaugugagacaagaaaauacauccagauagaauaaacuguguuaugcuuuguuacugaaagacacgcacagagaucacuaaccuaugucaaggucaagcaauacaacuaagcucaggaaaaacuggcaaaucccugaaauagaugugguuuaauuaauuaauguaucauguaggacuauugugagagcauuaaacaucaauuugccuaaaauuucuugcugacuuugaacagaggcuucuuaacuucaggcaacguacaguucaacugaggaggaaaaaugaaguuuugaguuuagucgaaaaggaaaguuuuugaaaggauauaagaggcucagaaaaaagaaaucaugaaggcaacaguggcacacccaagaaaugccgcaucaacaaugcucguuauaguacacgggagggacaaugcuacauggaaaaacacagcgaugagcuguaguuuaaugacuugccaugauuuaggggaaucaaacuuugaaugugaagaaguuucagggauaccuuacucaguuuauguugcuuguaucuuucuucuuauucaggcacaagaguaauguaugauaaaauguaugucuaaauaagucuaagagagcucuuucaaaaacaaaaauaaaaguaagggauaaaacuauuacaucauaguuuaauuggcagugucugguuuuuuuuuccugauucguccacaaagcaaugccauaacuuagaguagauggcauuguugucauacaguggcaauaguaacuaccaauucuuggaugccugucacaugccaggcaccauuacuuggaacuucauguacuuuaucucaauuaguccuuacaaagccuuaagauguauauauagaguguccucgugaaacaugcacaccuuugaaaaguagaugccaaauggggucaugcaucuaaugcaguuuuuacagcauuuagcaccacuguauuauuauuguuguuauuauuauugucuuccaaaggauaucaguaauuaagaaccaaaacccugaaucugaaaugauagugaagauaacccagggaaacucaaugugugguuuaauucauugagaccaaacaagcaacgccauuuuuaguuacuuuguguaagcaacauaauuuggauauauauuugcauaucuuauugaagaagaaaaaacuuauucuauauuuuucucacucgauguguuuuauguuacaguaaaucauuuacaguacccaaagcuagcaaaggcuggauucuguuguuuaacuuuuuuaaaguacaggaaacucccuguaacagcucccauccuaacccugugaaaggggugagccugugguucugagcaccucagaaauggccauuuccucacucuguacagacuauguuuuccaucaaacuccagucaccccuugaugagaaaggcacuaaagaaccauauucauuaacuuucuuaauaucauguuccccuucuguacuguuuguuugcugguucaguaagaauauaaaaagaaagcaaccugaaaucaaauccgaauggccacucucaccucuccaaagcagaaccaguccuuggggaauagucuaguucaccaccguacagauaaggaaaccaauacuccgugaguuccaccacuugcuaaggacacagagcuaguuaaguauuuguuccaaaagggauuugaaccccagucugaccuaauucuguucaacugauaugccacaguuuauauuuugcaacuauuagcuuuuagguugcuuucagugcuucauaauucaaauucuaaauguaaacauuaugguaccaaauggauuuuagguuacugcuuuuagugcauuaaguuagaugacugaugccaaguacaagauuaguuuuaugauugacauuuuccuagaggacucucaggaaagaccauaucacaaauaaguggguaugucgauuucaccauaugucugucagcacuauauauuaacaaauuuggcuaaaucaauauaggugaaguguaccuaacaguugcuuucacuuguauauauucaucacugguaagauuggaaauuuuuguguauauugacuugaauuaugaggauaugugaaugaacauguaugugaauauuuauuuauggugguuugacuauaaucuaucuauaucuuuuagcaucuguacaggagagaccagguuuuguucuuauaaaacccaaaaauauuugagguaucuuagaaaaaggggagggguguggaaacagagguaguauacuuccuuuucaaaaaaugauuaaaaacuacacaguuauuggacaagcaucuguaauuaugugagacauuaugaaaauacauggaguaucaagcaauacuuguauacaacuauauguuuaauugcuuuaauucugugggaauguagaauauuuccuuauauuuauuagaauauaggacaaguacauauaauaauuuuagaguacuuaaugagaaauaaauugcaucacaccauccaagugaaauucacaagagaaugggaagccagaauaaagagggaggaaaugaacauugauuuacuucuuaaagagaauagagaauagauggaaggguagacaggagacacaauuuuaagugaagaaaaaauccuucuucgcucuggcuugauggaagaagcuguguacccaugguucacauuucccagaaugaaggggguagccggggagucacauaaaaugagcuuuagaaaugagauaugguagagccaagugacugaagguacucaaugccuggcacuggaguucaaucugaacaggggccaaaagagccauguaaaguauguacacaggugugugaugggagagcacugggcugugaguccagcaaaggugugaggggcacaccaaugcagagacaugggcaaaaaggcuacuucggaugccaacacagaaagucagguggaaaaacagggccugagccaaggggcguuuccagaaagauuuccaaaugaacaacagcgggccagggagaugaacugaacacggagauucagggagacacagagccacauguugugguccacagcacagcgggcgugcugcuuuuaaaggaacgaaggccagcaauuuccauguauauguuucuaaaacaauguacugucacagaaaggucaaaaucaucucuuuguaauuagcagacucaaacuaggucagggaaaaguauuuuaagaaaacuaaacuaauauaaacacaccucuagccaggaauaaaauugguaagcauuaugaaguugaugaugaucacuauuuuccucacugugauuguuugaauuuaauuauuaccuuauucacauuuaaauccuacuuuauuucacagaggauuugaaaaggcauacagagaaagugaugcuucaauuaauucuuuauuuguuuuuuuagucuccuuauuuuaaaaugcauaaauaccaaauguguccauuaaagcaccauucaauauuugauguaaagaaaguuuuuuaaaguacacaucacaacuugugcauuguauucuacuugacuucuauccuauacuauauucuacaguauuucaacuauuucaauuuuucaaaacagcaagaaaaccaucagaaagccucuaagauauaccauauucaacuguagugaggcagaauauuauacaauuaaguaauaucaguugcaucucacuagcagcaacacaggguauguggucauuauaacaugaaacuaguucuuucauguuuaucuugcuggcuaagaucaugggaauuaccaaaauauuuacuuucugcacuguguucccauagacaguuauaauugggaugauacuuuaacagucacaaaggcagacuuaauacugacaccagacuuccucuuuuuguuugccuuuuaagaagaggucauuaauaacggcaaugauuagccaucgcagucaucacucaacccagacagcaagcacaauggcccuuacauuaaaccugaccuaugacguagaagucuuuaaaccuuguaagugagcuuugauaauucccuccacacaauagcauuuccuauuauaaacaucuguuuucucacaugaaccaugcugaacauguuauaaauaaguuucucuuuccauaucaguuuguaaaagggauaaucaaucaaaaaauaaggcugaaggcccaagucuccuucccccacugauguaaauuuccauccuaacuuucccaggggauuuuuaaguucaguacuagggaagguaacuauuaaacccuuaagaacacaguaaagcuuuccuucuucaaauuauagauaauaucuaguaaagacauugaacguacuuuaaaagaaaagaaacaggcauaaugcuauacaaugugcuaauauuccuuccaacucugggauucuaugcaaucagguccccaaaccagugcacuauugcucuuuucauuagagauuccucuggagucaggugagcauaaaugaauauuagaacagacaucugauacaggcaguuuuggaaauaucaaaacugcuccuucuuguucucuugccauaagcuggaugaagaaucuuagucauuuaagcuguuuacuaagauaaugagaaggagauuuguacagagaucaggaagggcaaagaggauucaucuacauaccaacucuaagugacagugaccaccuagaaugcuguauucaaaaggauucugagaccacgugcaggcucaacagaaaaaaauuaaucaugguuacaauguuuaccaaggccacaugggggaauaggaacagcaucacuugugccagcuucuugccucucuuauaugcauacaucuccccagagaaguuucuuguuccuaaaagugucugguuauugcacaucugaacaggcugaaccuaggauaucacaaauagguacugcaaaugcaaacaccaugguauaacuuaaugucaguauccuacccuaauuucauuaguguguuaaaaugugcugagguggucaacucaacugauaagauguuuuuucucuugacgacugauagugcuaugcaacagaacuuucugcaauaacggaaauguccuauaucugggcuauccaaugugguagccacucauucacauguggcuauuggguagcugaaauacagccaguguguucuuauuucuuuuuauuuaaauucacaugacaaggggcuaccauauuaggcagcacaggacuagaauguuugcuugcaauguuaaaguaaauccacaaaggauuggcucuaagucuguuuugcuuagugagguaugcuaugugccuagaacacugccuaagacauaguaugugcuaagaucuucauugaaugaauaaaugaguaaagagauuuguccuaucaggccauccugaaguauggaugguuuugcaucuuuuggcuucugugcagcaugauuagagggagauguguauaauaccacaauucaacacucucucagacucaaaccaguaacacagcccucacugagcuuagcagauaaaguauuuuccauagaacuucaagcagacagagggucaaucgagacauguuuaaauucugcauugagaauucaaauacccugaaauaucuccagccccuaaccugaaagauaugaaaacaauuuauuuuaaaauugcccaaucugauacucugcuagaacauuauuuugggugacacuucuuuaucaucacaggaagaugguagagacaauacuagguuaucaaacggaaccaaguguaagagcuuuuuuaggagacaccaaauagaauacuuaauguucuucugucaugaaaagggguauccccacaaaaacacaucuggcccauauaacuuugagcacuuuuaaaaauuuacauauaccagcauuuauuugccccaaaauaguauugaggagugacaaaaauggaaaggcaucauuaaagagacagaucacagacaacgauuaauucugcuccaaaugaaauggcauuuuaaacaaaauacugacaauauaguguggagaacauuacuuuucaucagcaauagcacauucuaaauauuuuugcauugugaaccugaugucauuagggagaaaacacuccacgguuggcuauugcauuuaggcugccuuuuaacacauaccaucaaaauaacaacaaaucauuacacagugcugucugaaacauaaacaaaacaucuucugagcacuuucuuuuaccucucaauacuuguggggacaugugaccuugagcugagaggcucuucugaaaaugucguccacaugucuaaaguuuucccucucacacauguacucugccauccacccucaaccaaaccaucuaaauuacauucagauuuuugugguaucauaauaacuucaauaugggauauauuuucaacauucugguaagagaguccuuucuucccugccucacccuucuuccaaguuauuucagguuugcauauuucauuuucacaacucagugggauacccaucacauaacauuuauuugugaggucuaaaggcauaaugugggggauugugaacuagcaugucaaaaccacauacugcaugcguaugucuuaaagaaugaaaaagguuuccuuuuuucucaagauguauaagcugucucaacaguauaaguccgaagugaauaccacaaccuaauuaaagaugaagagcauaacaagcaguauuaaaaugucuuuuuugauucauucuucuccaaguuauguuuuuaucaaauguuuugucucauuaaugacuccaaagacauaaugaguauacauaccuucuaaucucaccgaauucagaagagaguugaaagaauuuucuucuacauguuuugggggcuaugacagcagagaauguacaggcaggguagaaaggggcuuucaggagagacuaaguccauucaccugccuacagggauaagcaugcuuacauauucccagauaaauaagacuuuuuaaagaucucucaaguaagaaauaccacaaucucuucuggguaccaauuccuacauuuagaacauuuauuucuaggaaagucuuccuuugagucuaaccaugcuucagggccagcuucaugagcauucaagcucugcagucacaaaggggcucaugcucagaaggacaaccugccagcccugccuggcuuaauguuuuguugucaccaucuugaaauuuuuaauaauuuuaccucugaauuuguguuuccuaagugaacucugauggagcaaugaagcacguguauaaaaagggaagauauaugcaguaugcaugcccccuuucuccuuucugucucauucacauguagccccaugagcucugaauuccuguggccccaugaugaguagggguucagggagacucaaagcaacuacaaggaaggcauguuaugucuagacugauuaaguggggacacugguagcccugagaggcuuuccaugagaaccagacauauuuugaauaaagaaggaaggcaacagaguucaaagcaacaggaaugaccgaagaagcccauuguaucuuuucuuacuccuguuacuuccccuguauuaccuaaucacuuacagugaaaaugauaacauagaaggaaagaaaaagagugauacauaguuccuuuuccuuucaguccuuccuuucucaucaguaagcugaagguagagagcacuggaagauaggcacauaucaagaaaugaaauaaaaaguuaagucuggugauuccacaguucuauaagaacaaaauauauguguaaguacaagcuacaaaauauaaauuguguaauuuuguugauucugcauaugagucuaaugcagucauauuuguauuucaaagaggcacugcacauuacaaagaccaaugguaaaauucacacuaacaauuuaaauuuuuuauuuuucuuacuuagaacauaaaauagcaaauaaaaaacgccaugacaagucaggagagaugcugcagaaggaaaaaagcuuugcuuuuaguacguguuuuaacagcacuuuaucaccucuuccccuacuuuuugaacaaggaaguucaaguauucauuaugcacuaggccuugcaaauuauguagcuggcccugacccgcuuccucaugcuccagauuacauccacugcaucuauucuuugaggucaccauuuguuaguuuucacccuuuccuucauucaucuacccgacaaauacugacugcucugugcucaggcacugugccagguacugaggauauaaaaaggaauaagauauuaucauucuuaaguguaguugugaagauggacaaauaaccaugaaaguuacuaagacugggccagaugugauaguucacgccuuguaaucccagcacuuugggaggccgaggcagaaggaucacuugaggucaagaguucaagaccagccuggccaacacagugaaacucugucucuaugaaaaauacaaaaaaaauuaguuaggcaugguggcacgcaccuguaaucccagcuacucuggaggcugaggcaggagauucgcuugaacccaggaggcagagguugcagugagcugagaucacaccauugcacuccagucugggcaacagagcaagacuccaucucaaaacgaaaaaacaaacaaacaaacaaacaaaaaaacugaucuugcauaacuuuagugaggacaauaaauaauauacauaaaauguacaaaucacuuccaguaaugauugcuaaucuuuagcacucuauguaauuaucucauuuaaucccuauuacaacuuacuggguagguccuacuauuguuuccaucuuacagcuacagaagagagauuuagaacaguuaagaaacugaaccacagugauuuugucaccaagugguggaaccaauaacugaagucacccaaaccuguuugacuacuaaaucugaguucauaagugacagcuaucauucuuauuaauauaauccuaaccauuauuuauuuucuaguauuacaguugugucuccauuucuaguuucucaaaggucaauuuuagucgcaauuuugucaaucaccuuauaauauaucauucaccacuaaacaaaaauguguauucuaacuuuuuccaauuuacuuauuaauaguuugguuagcacauaaaauauagcuucuuuuuuaaaaaaaaaucuggcaauccucugaccuaacuguagaauauucaauucagcugauaaaacugugguuuucaaaauuacauucaugauccuguucacuaaaauauaggcagacagaaagaguuaagaaaaguacuuaacucuuaaagccuaaauuuucccauagguaaaacagggauggaaacaguacuuuaacuaccucacuggcccauguuuaagaguaaauaauucuuacaaaacacuuaacaccugguaccuaauaaccacucaaaaaaauuguucauuuuaauauuacuauuuuuaguucucaaaucuagguuuuaaaauggauuugaaaugauuuccccuugaaauguuuucauccaauacgaagaacuaaguucaacggucucuaauuuccgagauuuguauuuucuuuuguaaauaaaagcacacaaaaagucccccagaacggcccgugguggucauauauaucucuacaauucaaaggaucucagagguuuuaaguuaaauaauccuuuccugaaaaugccaaauacuacccucauuuuuucucuuuucauucuaaacugccuaugcuaggacugaggguaaaagaguuuauaaacuacacauaaagaacucuauaaauguaaggaacuauucacaucaguuauagcaaggcuaucuccauucucucuaaccuuugaagugacacuuaaauuuaagaagguugagcaaauuaaaauggccgaaguguuuucucuggcggaaaaggaaaggauuagcuaaucugaagguuacugcugucaucuagacugucaaaugacuguuucccuggcuucuaagugauugaagaacacauaaaaaguagacuggaccacauaaaaauugacuauauaccuauucuuaaaauagcucuacagaaaaaggccuuuguuugacauuuuuauuaugguuuaaagacaaggaaagcagcauuuuuguaaaaaaucaaacccuuauuugauaccuuagaaaaccugauagccaugugauaucuuccuaaagccgaaacuucaauaaugcuggcuguucccaccacaggcuuucagguccuuaccaauucuugagugucuucuuguagcggcagaaaugccgcuuccagaauagcaaccuggucagcacuaagcuucugccacagcgcgaucagcagaaucaccaaauggguggcacucuucagccuggugaaugacuggaacagauugccuugguuuuccuccacugcaucugcuagagcaauuaccugcagauauuacaaacuucgguuagggauaauuucacaauuauugagcccucaacaaauuaugucuggcacacuuuuguuuuucuucaagacaacuugaugaacuuugucuuccacaaacacaagcuauguuaaguaauaaaagaguuaucauucaucugcucacuuccuucuuuaaaaaaaaaugcccacaguaauuccaaauccauauggccagaaguggaaaauauccacaaaauaagcuuagcagggacaguguucagugucugcuuugccaucuauugacuuucuucaauauaugguaauauaaguaaccucuaauaaaguuaucacagucuuuauuaccagccacauaaauuaaucaauuaaaacauucucagaagaauaauugcauuugccuuguaguucaaaauaacuucauuacacuuuuuucagaacaucgcuuuccucuaauauuagucuuuagaugcuacaugguauugagauaucuaauauuucuuuauuauaucuaaaagguagauaauguucaaacauuugaccaguugaguaaugucauuuuuaacacaaauaucaggcaccagcccacagggaccugaaagaaaaaaaaaaaaaaaguucaggguguguuaacuuuacaaugccaaaucuacuuaggauaaaauuggcaggagugaguagaauugacuuuuuuucaucuuuuugaauaauucuguggaaaaaagaacuaaagcaacaauuggaugaaacauccaaaacuucccauugguguuuuauuuuaguuuaaugucuuggugaauuuugugcucauuaaaaguaaugaacugacugccgcagaggcucaaggcgucugacaguccccagaacagcauuagcaaaagccagggccauaugagcuccuuucuacaagcccccaccagcugggggacuggaguucagaugaguuucagaagucuggugcagaugauccauuuggugauauuucacgguuuauugacacgggcccaaagggcuuuuuaaaaaaucaucauucaaacaaguacaauguacagcuguguggucucccaaauuccauguugggagaggggcuguacagaaacagcccucagagugucucggagauacuggaaaagagauguaggcagagcaacugaagguccuugccugaaauugcuggggcgaccaagauucuuugccacuucgcugagggcuugcaggaguuauaaaaggcaaugacaauucacauuuagcucuacagggaggcauggaaguuuaaacgaagaguagcauaauguaaagugcauugcuugcuaugugccuaguacugugcuacuccccaauuacauucaaaagaacuacacaauaucuuacaguccacaggaucuuauaauuuguuggaaagaaaacauacauacacagccaauuagugggaagaaacauuacuauaauaauguccuaauugugcagaacagaaaguaagugugaaagaaguuagcaaagggacggauuacugugggccagaguuaacaucccuggggccucuuuuacucaaacggagcuuggaacucaucccuuccccauuacuucaagaaguccccucgaaaagauggaaagagcccacuuuccuuaaaccaaaacaccuggaaucguguuccucccccacccccaccaugauuacaacggacuccuguuaaagucugaguuuauacucuuuuucuuccugugaauguuaccaauuaagccucauuguggggccaucacauuaugacacagaugcuuauugucaaaaaguccaaaucauacaaggaucaaggucauaaacacccacugaaugccagauaugugcaagaauuugcgggaaguauuguagggaauucaauggugacagaucuaaucuccaccuucaaagaguuuguaauaggaaaaucagucaaggaggcaaauauugaccacauaaggaagacucuauaggcuauaaaggagaauuccacuaacauugcgauuauuaugugaauaacuaucccuccaauuaauugaacauaggccgcaugccaagcauucugcccugugccauacagguaucagugccuucaauccucacaucuccccugcgacuuaguugauauuuucuuucacagaugagaacucugcggcucagcaaauauaagguauuugcccaggacuguacgcagggugugcaaacugugcucgagcuuugacgggccugaacuuguuuaacgcucugcugucucugccuugaaauucuuaguaauuuuauuuuugagcuugcguuuuguaaguaaaauugauagggcaauggagcaugcacaugcgcagaggagucaugugcacucaugaguuaaaugcucauacuugcauuuaaaacugaauuaauguaacgauuaaugguaaaauucaugcuacuuauuugaaauuuuaguuuuuuucuuacuuagaaagcuacuaaaaagaaaauaagaaaauaccaucagaagcugugaaagagagaguacugaagaaaagaaaaagcuuuuuauuuuagugguuuuaacagcgcuuucuuccugcauuuugaacaagggccccucauuuucauuuugcacugggauccacaaaauaaguagucagccugaccaucaccuaguagaugaaagaacaggauucaaacucuggagugugucucacucuaaauuuuguuugagaccuuaagcauguuguagguucagagaugggcauacuacuacuagcugaguguagggggccuuaggaaggaagagguagagaaagaagcagugguaugccagaacuagcucagucagcuccucccacaucaggagaaagaaccuauuguucaguuuucagaaauuuugcaagccagcugucacacauggccauuacuaacaauuaaaucacauaaacuuaaaacuaaauaaauuacauuuaaaacaaagguaauaaauacucaacauucauuacuuccuacuauuaucuaguuucuugagguuauuuaugccuauuguauccauauguuggaaacacuuugcaaugggcuacgguuuacauuucuucccaacuuugcauucagggaccucacauugguagccugaaaucagccaugguggaaguauuuacuacaugaaaauccacaaauguuacaaaaucaggcuuccuacccuuccccuucuuccccagagagcuauuuacuagcacaccaaugagaagagguaucugaaauguguccuaaagaauagauauugaaggcugggcgugugacucacaccuguaaucccagcacuuugggaggccgaggcgggcagaucacaaggucaggcauucgagagcagccuggccaacauguugaaaacccaucuuuacuaaaaauacaaaaaguagcugggcaugguggcacgugccuguaaucccaguacucgggaggcugaggcaggagaaucacuugaaccagggagucggagguugcagugagccgagauugugccacugcacuccagccuggugacagagugagacuccaucucaaaaaaaaaaagaauagauauugaauaaguccaguuuagggacaguguuugaugacauuaaaaagguaggcugggcacuguuguagaggaaccaaaaugucacagugaaagcauucacuuaacucuguaggcacuggggagccacagaguauucugaguguggguguuacuuaauggaggcugcacucuaagcagcuaucagaucauaacaaauauuuggggcauuuucuggacuuaaaggaugcuuuuacacacguuccucacuaucaagggaaaaauccucacuaagugcaacaacaugucaguucauggacccacccaacuugcuaaacacagcuguuauggaagaaugacuucucagugagacagcaguccaagccacaggaucuuuccugagcaaggcccaaaauauaucaaucggacagaagcaucgucuaagucucagucucauuggauauauuccugugccauuguggaaggagucugcuauccccaaauggucacagaaacuggaaagaaaugggauaaacaauuccuuauguaaauuacccccaaggaaaaucuuccugaccuacuggccagcaugaaauacuaaacagcucuccauguucucaauuuaguuuuacacguaacagccaaguuuacuguguuccccacaagagccaaaugaauuuaacagaauuaacauaguaaaaagacuggaaaaacuacacccaucaagauucagaucucugagaccaaggccuagaagaucucgcugcucaccuggaacugagaaaugaggccaaccagcugcuaggacuuaaauuugagggagagcgauuuuuaagggugcaucacuggcugagcaagauguguguucccuaguguucaacagaacuacagaaagggagggguuuaggaaacaauaaaugcuaacgauuucaagcacaauguguugauggccuuuguuuuguuuuuucaaauugaagguuuccaaauaaaauggagaccccaaaggacaucucuguccaacugacauaucaguugaugccaaaguaaugaggcagaggcccagggagcugcuugcaggaaaacgcucaacucauaaagugagugugaaauuaaucccaaauacuuccagcugccaagauaggcucuaaaauugguuacaggaaagcagcagcagcaacagcagaguagacaugaaucaucauacuaugugaacacggacauguccaauuucuucaccuaaacuuaccauugaaucugccuccauauuucauguguggcacuaccacugccuaaacacuacauugcuguuuagcugucauuuccugaggacugacugugggccaggcacugugugcaaggcugucauacccagauuaucaugugguccucaugacaacccucugagauaggaacugcugacccccuguccccccacuucccgaugaggaaacagaagcuuacaggcaucugaacacacugccuguggucaugaauaagggaagauaagggcuaggauucuaauccugucuucugauuuccuacugggugcccuuucuucuacaccaauauacaaauuauauauucagccccauaauauaaaccaauauacaaauuauacauucagccccauaaaauaauccagugaauuuucaucuugauauuuaagcaaagacacuaaggaagaacacuacuaauacauuacauccacgauaggcauaugugcuuuaguuaugcuuuccuacugucgcagcuuuaaacaugaggucaauucaaauuggcugguuucugcacaaaguugugugguacugcccaaaguuacauuauaaaggaaauuaguucauaacuuguaagaaugggaaguuaacauacuaagguuuuuuucuuaacaaagagaauuuuauuauuuuccauauagcucaaaaauaugaagauuuuagaaaacagacauuuucuaggccugcuccuuuagugaagcuacuuuuuucaaggggaugauucauuuauuuucuauaaaaucucacauuacaacauuuucaguggucugagcagguuaauguuuugugauaauaauugucaacauuuauugaaggguaucuaggagccaggggcugugcuaaccucuuuacagaaauaaucucacuuaauuauaaaaacaauacugugagguauauacuauuauugcucccauuuuaaaaauaagaccagaguacagaaagugucaaacaguaagcaguagagccagaauucauauacaagcaaucugacccaagaaacgucacuaugaagcacugccugcauuaaccuucugccugcauaucagucucaucaugugcaauaugugaaacuaauucuaucaggagcuccccaauugcagguuucagcuucgcuaaucucccaauaccugaaauuuauuacaauaaaccagauagauuuguuguaauaaaaggucagcauagaugaaugaguuaagaaaacgacauuccuaugauauggaugaauuuauacauccccuagggaagaaugcaauaggcugugcuggaacaggcaauguccugggaaccaaggagacagagcuucuaguccugacuuugcuaccaagcagcuuuaugucaguguucaucaauuuacuucccuuuucugggcucuaguuucaucaccuuuaaaauguaggaaacaugaucucuaacauccaacauagcuguaagugucugauucaaaaaguuuuaaacuacuuuuggaugauguguuguuuugaauuauccaugccacuucuuccccucuauuugcacacauaauaggauucuuguugacauggggguuuuaucuauaaaauagcauuaugaauauuuuucuuuggcuaauucauaggauuaugaaaauuaaaugagaggaguaaaaagauggacaauaacaagugcuggcaaggauguggagaaauuggaacccacguacauugcugauggaaauguaauacaguacagcugcuguguuaaauaggcuggcagcuccucaaaaaguuaaacauagaguuaccauaugaccuagaaauuccacuucuagguauacacccaagagaaaugaaaauauauguccauuuaaaaaccugcucacgaauaguuauagcagcauuacuuauaauagccaaaaaguagaaacaacucaaauguccaucaacagacacauggauaaacaaauuguggcauauucauauaauggaauauuauucagccauaaaaagaaaccaaguacuuauacacgcuacaaaaugggugaaucuugaagauguuaugcuaaacaaaagaagccuaugacaaaggaaaacauauuguaugauuccauuuauauaaaauacccagaauagguaaaucuauaaacacagaaaguagauuaauaguugcuuagggcugggggugggugguaaauaggaggaaugggaagugacagcuaauggggguuugguuucuuuuaggagggguuaaaauguucuaaaauuagacuaugguaauuguggcacaauccugugaauaacuaaaaaucauugaauuauacucuuuaaaugacugaauuguaauauauguaaaugauaucucaauaaagcugugaaaauaguaagcgaauaaaagauacuuugcaaguauaauuccuguaagguaaauacauaaacacaaaggcaucuuuacuuaggcaacaauuuugauauauuaauggccauaucauauugaaacuagggcuuaauuaccuuaaggaugauggaauaaccaugugacuggagucaaccacaucuaacuaugacuacuggugaugcuacuuauuaguuguagaacuuuuggcuaguuaccuuaccucccucaaacuuaguuuucucaccuauaaaacaauacucgguaaaagcuagugaacaucccugcuguucauuucuaauugguugggcuccugguuacuauuucuuaaaauuuucuauaguuuagggcucauuucaauuuaguaacaccaggaaaauucugcuuuuucuauuagauuaauaaugacauugaaaaaggaagacucuucuguuugaggcagucuaccaacuacuaccucccaaaguuaggcaggauagcugaucacccugcaccguacccugacccucacucuguggucacucagugaaaacaguguucauuuugcagcuaaguuuaaucaaguuucaaagcuugaugaaaagcuuguaaguuacucaacguuggauuucccuuuauccacuccuuuagcaauacuauuaaaacaagcacacagacauacaacuuugccugguaugacuuguucucuagaaauccucugaggcuuguuacuuggggagccagacauugcuuguucuucuuuuauaccuuacugaaaauguuagaaaauuuggugauuugaauaaaauguuucugaaguucaccacaaaaagccauagaaaaucaaaacucaagcucaaaaagcccagaaaauuccaguguaaaaauaucagcugauaagaccccaacaugcccacaauuuuccaguacgagguacacauugggugucccauaaaugcugggugaauugaugagcuucaaagucaguccaccuaaagauauagugcaacuauauuuuuucugcuucuuaaauccuggacacacugaaucaggcacugucaggcucccaauuugaauggaacccaagugaugucacauggaaacaacagaccuacuucaauauaucugucaucuacuuuuuaaaaaauugcuccaguucaccuuuagccagagcuuccuaaacaccaaacagacagcucuaaugacuguugaaaugaauuuauucuucagauggcagcccuuugguuggaaaggcgcacucucagucuaggagagaacuggaagcagacaagaaauagggcauacuucccucccaacaauguuguuugugauggcauuugcugcaauuccaacauggcaaaggcuuugcaauaaggaaaaaagaaaagauuuuaccagggcuaagcuuuuacuuuggaugaaaugauccaauuuguauccaaaagaauuguucuuuuaccaaaaacaaugaaauagggcucaaaugaaaaagaaacggcauggagaugguuuaaaugccagacaggcauguaagaagcauuuggguagcaagcuuauaacuaauucauucauuaccuacaugcauucauuaccucugugcugaacuuaugacuagauaaaagagaaaucugaggcuuuuacuuugaaggcauagcaagaaucuaauucuuagcuguuuuugcuauuauauuauuuuguauuaauaggacagugaacuggauuucauucuauugcacuucauauuguaaagaaaaccugagacuccccuuuaacaugcauuuagcuuaaauuuguaaaccaaaaccaggaucagaauacuuuuuuuuuuuuuugagauggagucuugcucugucacccaggcuggaaugcaaugucacaauuucagcucacugcaacccccgccuuccagguucaagugauucuccugccucagccuccugaggagcugggauuacaggugcccaccaccacgccuagcuaauuuuuuguaguuuuaauagagacagaguuucaccauguugaucaggcugguuucgaacuccugaccucaugaucugcccaccucggccucucaaagugcugggauuacaggcgagagccaccacgccuggcccagaauacauuuuuaaucauaguaucauuuuggguagccauuaaggcaacugcaaaaguguacccagucaguaaaaaacuucaguuguaaaaaugauuugucuucauaaaaagagaccuccuaaugagcuaaaccaccugauccuucgaaacacuaagguaugaucaugugacucuuggaagucacaaugguuuuucuggucuaugauuacaauuaucccggacaccaauccacacuugcaaaaugccuugagaauucacauaaaaccgguuuuagaaaaacaaauuauuucugagacauuucuuuauaauauauauaaguaugacucugagagagacaauaaaucauuuauuagugacauagagacaaauuuugcuauuucugcaaaguuuauucaccauauagacauguaacuuaaucaguugaaaggaaacgaacuccaaugcuuggcuaauauaaaguuaaaaauacaacugaucucaagccugcuuacuauuuuuaccuuuuuuucccccuggcugaccaaauuuuuaccccuuuccauaaaauuaucuuccuauagccaagugaaaccccaauuuaaaaaauaauaauugauggaaucagguuguaaaaagaagaaugaauguucuccggacuaugguuacucauugaacagaucgcuauuaaagcuggaaucuaugguuggcaaugucagagcucauuuuacaagcccuggagaaugccacaguuaucacucuccaaaaacaacaucuacaaggucugaucugaauaguuucuaaguuuagaauguuucaggccacauuccuacaugcagacaugucaguaauuaugcaaccacccacacugccucgagugccaucuccagugaagggaaaugauggauagaugggcaguuggcgguguccuaagagcauuccuuuagcuaagguagcaagugcuaagacacauuauuacacgugaucagguagggcaugcucccaaaaaggcaaaaagggaggcuggagaccccaacaaugcuggugacacugccaaucauuuccuugguuccagaguuuaagaggugaaagugacauuuucacaauagagugaaauuguugaggcuuuucuaugaauccucuuuuaaaacaucuaguuuuuucagagggccuacuucucuucaguauuuguaguuuuuauguauuuuugcuuuuuuagauaaaauaguuacaccacuacuaucugguaguucuuuggcaaaauauguaaaugucuauauggcucagaccacauggaaauaauacaaaaggcaaugaggagagcugccugguuucacauggagugaaacuaggguaaacuguagguuauuuuuacaaucacaggcuauuggaacauuguaauuggaaguugccuuggugaagauauguuaugcaugauuucuacugugcuauaaacucccccaggucagagacuauuuuauuguuuguuguacccuccuacagccucuggcucacagcaggcauucaaugaauguuuguaauacuaaaguaaauuuaaaauucugaugacucaguagccaagaguauccauuaagaugguaauuuauaggaccacuacuuggguaagggaagucccucccuauacuccagguaaacaagaccaaagccucccauuuuugaaaaguuuuugcaggcuauguuauucauuggguuuaccacagguuguaaauaacugggcucuaaauccauaccuuccacauguauuauauuacaaugaauuccuaaauucauucaagucuuuacugcugaguuuacugcaaguguuaugaagucuguaauuuaacuuuaaaauacaucaucacagagucauaucaugcaagcaugugcgucaguuuuaagugcacucuagagcaggguuucucauccuccucguuaaugacauuuggggccagauaauuuguuguuguuggggcugccccagguacuauaugaaguuuaucugcaccccuguacucuacacacuagaugccaauagcaucucucauuaccaguugugacaaccaaaaaaugucuccggacauugucaaaugucucccugggggcaaaaucacccuggguugagauccaucggucuagagucagugagauugugcucaaaacaguuauccuucucaucagcagcaaaacccacaagccagaggggcuaccacaaggacuuaggcuacuaguaucuccagcaacacuggagacuuuuucauuccauaauaaaugucagaaauggauuuugauuaaugaaguuugaugaucagaaguuugauagucagcauuauagauauuagaauugguucacuggcaaaaauuaaugguauuaaagacauguggauugacugaauauuuuuauacucagacccuccucugcaugaacaggguacacgaauuccagcaagacacucaugggaugggguccaagguguaaaccuaaauguuccugugucuugacuuugggaagcagauuucuagcuacuugacguccauuacgaggggaaaaagacacugccuuggauuauuguccaauccgccccaguggaaccuuuccagaaaggugguagucuacuaccuaaaggacagcugggccuucacccagccugcagaauaagccauaugaauugucccaugcuuauaaauguuuauuuaauaaaugucuucauaugugacaaaauuagguaugagacguacuuucauuagaaucagggagagagguuuggggcaagucacucauucucauuuaccucaagcuuuuugauggcuaucauuacuuacugaaaagaauuucagauuugugugugacuaaauuggcaaaaguagugugccacaucaagugugugcugagugacggggauacauguguuuaagagcuaccugcaaggaaccaacagucucacaacaaaaauaggccaggcgcggugguucacagcuggaaucccagcacuuugggaggccaaggcaggcgaucacuugaggucaggaguuugagaccagccuggccaacauggcaaaacccugucucuacuaaaaauacaaaaauuagccgggcauaguggcucaugccuguaaucucagcuacucaggaggcuaagggacaagaaucacuugaaccugggagguggaggcugcagugagccaagaaugcaccacugcacuccagccuaggcaacagagugagacuucaucugaaaaagaagaaagaagaaagaagaagaagacuaagagcagagggguuaagcaacuuggugaaaaucacacagcaaugccaagauucaaaccagguaucuuuaaaaccuacaaagcccaagcauuuuccacugugccauacuguacccuucaacacauacacacacacacacacacacacacacacacacacacacacacacucacuccuauacuagaugauaagugcuauacaaacggcuaucagguuaagugaguaugagaaauaccuauaaaugacuccuccccaacaacugaucuccuggggugaagggcccacagauuccuuuguuugucccucuuuuaaguaaaccugcauuugaauguuugaaugccuuugguucagaacaacauucaaguccugcacauuacuccuuauuguuucccaucuacaucuguguuaccugccuggcccucuagucauuugaguuuguaaccacuucaguaaucaugaacucuaaacauuaaaaaaucugugacagguauggaaaaacagagaucguccucaucauaagugauuaaacugaaucugggcucugguaauuuaaucccaggagguccucgacgucuuuaagcuucaguuuucuccuuuguaagagacaaguaauuacguggcuugaagauuaaaugagauacaacuuaaaauguauuugucacgguggcuagcacauaggaagcaugcaauaaagguuaacauuauuauuauuauuuauuauucccuggcuaaacacucaaccaaguuuuuuuuuuguuuuuuuuuuguuuuuuuuuucgagguggaaucuugcuuugucacccaggcuggagugcaguggugcgaucuuggcucacuguagccuccaccucccagguucaagcaauucucaugccucagucuccugaguagcugggauuauaggcauucgccaccacgcccagcuaauuuuuuuuguauuuuuaguagagacagaguuucaacauguuggccaggcuggucucaaaccccuggcuucaagugauccacccaccuuagccucccaaagugcugagauaacaggcaugagccaccacacccagcccaacauauccuuuaauaaagcaaaauaaaauucaaaaaaugucauauaccugaagacaauaauaacacucccuuuggccucuucaucucuaguuuauacaaucccaauaauuucaguaccucuucaugggauugauuuuguauauaaaauacuuacauuauuuaccaaaguaugugucauaaucuccacaucuucucucucaaagcacccuguguguccccuucuauuauauccaucacauuuggaaugacuugcuuaauacauguaagcucugugaagacagggacugugucuugucuuauuuacuacuguguccccagcauagagcauagggccuaacacacaguagggcucaacaaauauuuguucaauugaacugaauuaaaucccauuugguacauccuagaaggguagcauauuagcuuaauauuacuagcagaacauucucuuagaaguagagcuaguaccuagaauaccaguugugaggcagagccaauaauagauuuccuuaauuccauaaugcccuuugcuuguuaggcaccucucccacccauacacccauuuuugauaaacacuuuaaugguuuucaaaucaggauacgccacauuuaaugugguagcuuugcuuuuuauccucaaaaguuaucuaaucaauagugugcucuaaaauuaaugucuuagaauucauuaaauguauuuuugugugguauuuuguuuggaguuauaccucccagugucuucauccaguuuccaggaaauaacuauucuaagaauacucccuggcuaccccuuguggggcauucucuccaauauacacaaugaucccucuccccauacuuccuagguaggaccuacuauaggccaagcaugaguuccuucauauggucucuauaaugaaacugugcaguggggcuauuagaucuacuuuggcugugacgaaacuggugguuuaagaugcugacuguccacagucaugcagcaagauucaaacccaggacuggcuacccaacaaagcccauguucugucacuguccacaccgcuuugaaagaacuccacggagcuagaaaauuaacuuccacaaaguuguuacuuauuuucagauuaauuaugcuuaugacuucaaugaaagaaacuaugcauucugggaaaguaauaaaguuuauuucuuauuaauagaauagaagcuaagaucaauuuacccugagaaaaaauaaaauauauguuuauucaaucucuucaaagaguacaaauugagcacccacuggaguguuaggugcugcaugaaccuuaauggaggaagaaauuuggcucaaugagcaacugaaacugggguuaauaaacauuugugagauagugacauuuuucacaguuaugagauaauucuuaaugacuaucuuugaagugauuuucaacuauaaaacuagccaaaagauaguugauauccauguauaauucuaauacagaugagaauuaaacaaaaagggacaugacagcuuugguccuggcauugauauucucauguaaagcuucucuguuaaaacacacaaauaaaaagaaaaucaaaccaggcagaaaaaaacaaaaaagaaaaagaaaaaagauugaucuuuuuaaaacucagcaaauaaagaaaaaucuacaaaccuaaguaaauguguuauguauaaaacagaucuuuucuugaaauguccaaauuuggauuugaauggauaaggggccccucuaaacccauguauuucuuccuucgaaguagcuaaaauagacuauaugaggaugagagcaucuguuaagagagguauggauuacaacuaguuuuaaaaauaacucacuuucuaguucacuuaacaaauuaaacaggugucacaguucaaauuggaauccucuaauagaauccauuuacuagaaaucugaauccauuuucagagaauaagaacaagauuauuaucuuacaaauaacugauucacacagccacuuuuuguuuaaauucuugguaucaauauccaacacugugauaaagagcugaauuuggauaaaauaacaaguaucacacaaaccauccggagaagaaauuuuaauucuggggauagaauaccaucuucauaguggaagcguucaugagugauaggaaauaucacacaauagcacgugaagcuucaggaaagaguucuuuguuucaguucucuaggguuuuauccuguggccaucauuuuaauuccccuaaaaacaccuuagaaaauaguguuuagcaaucuucagaaaaguuaugauuugaugaucaaaaauaauauuaagaaagauuacacagauuauuggggaacuggccaccauaaaacuucugguauaucagaaguugauucuggcagaaucugagaaugguaaguugagcagucuccucuuaguuuaccgauaugcagaauauuuagauuauaucucuaguuuuauaccagcuauugccugaacagagaugaguacacaaggaaggucuuggucaucaacacuacuuugauaaguuauuaaauauccaaguuuuccuucuaccuacuggagaaaacucaauuucagcaaaaaaaaaaaaaaaaaaaaaagccauaagugguuauuuuuguuuaaagaagucuguccuggccgggugcaguggcucacaccuguaauuccagcacuuuaggaggccaaggagaguggaucacuugaagucaggaguuccagaccagccuggccaacauggcgaaaccccaucucuacuaaaaauacaaaaaguuagccaggcgugguggugcacgccuauaaucccagcuacucgggaggcugaggcaggagaauugcuugaauccaggaggcggagguugcagugagccaagaucaugccauugcacuccagccugggugacagagugagacuucaucucaaaaaaaaaaaaaaaaaaaaaagaagucuguccugaauguuaucuggugucucagacaaacacgccacuuacagcuauuaucaaucaccaguaaugcucugcuaaaaaccaaguaaacucuauucccucauaugaaaacuacuuuucuuggugaauuucuuuccucuggacagaaauaagcucuaaaauggaagagacugagaggagauaaguuuugcaaucacagaaucagaauuucagggcuagaacagaagaaauuuacuauaucacacuauggucauuuauuuacaucucuuuuccuuagauuacauguuuuuugagaacaaggacaauguucuuauuuauaguucaugacacuguaaauauucaauauacucaucugaauucaacugauugaaucugaaaagaccuucaaaaucaucuaauccuaaccccauauuuuaauguuaaggaaacagaaaaguucuaaggcccagagagauguggugacuugccuuaaaucacacaggagguuaguacuggaaccagggcuaaccccucacaucaacauccuccuuuaaggauauuaccuacacuaucucauuaaguauucacaacaacuuuacaaauuaaacaggcagagcaccuaagucccccuuuuaugaggaaaaaaugcaaaaugucaaguuacagggaaggcuaauaaggguaucaaacucagaacuucuggucugagauuuuguuccuauagcacagaggauuugaaacaugccacuuauuaccuacaaggcaugagcuugcaaaggggaagugaaucuaguccaagugugcaaguagauggacagcacagaagaaaauggaaacacagauguagcauaaaaaaauuaauaugaggaagcaugaauacaguuggcuggagagaagaggagagcuugaagcuggagugacagcccucuccauaaaaugggaucagaguuuggcuuugucuugauuuucuauuuuuucagaaacuuaguaauuuccuucacugucacaguuuuauaauuuacaaagcugauuucauguacaauuuauagccuaucacaccucggauauugauaauuauuuucccugugauuaagaggcuaugauagugggcuaucaaguugagacagucuuuuuauguuaaaagagacaagaagggcauguggaaagagagcuaugagccucaaccuuacauuucucaguuugggcauaagguguucccugauggcugagaacaacacaguucagaaagggcagucacccagacacauccccugaccauucucaucagaauuacugggaugagaggccccaaaaugugagcauaggguacaagggagaaagaaauggcccagaucucuuccuccagcagcaaagccugccuaaagcuugcuugauaucaugcaaagaacacaggccuuugacucaauaguuugaauugugcuguuuaccucaggcaaaucauuuuacuuuucuagacaauccuccuguuucucuaauguaaaaaguagcaaaguaauauuaacuugccucacagauuuaguuuuuuaggggccaauuuaagugaucuaugugaugaauuuuaguaaacuguuagauacuauauaaaguuagcuaucauuacacuagaagcauaaggaauuuaacaucucuaaauaaucuuaauuaauauucuccaaacugaggccuacuguucagcuaauuuacauggaaagaguauaaaaaccaguagcuuaucuggaaaaaccccauagcauuuggaacaaauuacaguuuaaaaaauggagaaaccaacgaauuacaaugaauccuaagcuuacgucuuuaaacaaagaaugcuauuuaagaguaaagauuggccagauuauacaggguagaggggacauuuaguagucacaaggugaggaucaaaggacuuccaauaucacaaaacuuuauagaaagaauuuuugcuuuccuucauacuggcauugaauuccaauuuauaaaauaaaacaucauuaguucagcacauacaaauuacgaagauaccccagugggguaagacacuacccaacaaaucacaaauucaacuugugcuuaugaaagacauuauuggcuaggacaaugaauuauguuucauuugcuguguaucagcacuggucugaagcagcuguagagaauuagaaaaaaagacuuccccugagaauuccccuuuucaccugaauggcuaccagggucaccucuaaacagcaacuggcuugcugccuacagagagaaguuacuggaaagaauccugggauuuuuuagcaucuauccaaacaacaacacuaacaagaagaagaagcugacuuccaguuugggucaggaaagaauaggaguuugacuuugucccccaaaucucucauugcugaaauaaaccuauaccuuaaaaucuacauacccaaaaguuagcaaggaucucugaauauguaaaaauaugaaaugauacaauuuugaagggauuuauucacuuuaaagaguaauucuuaacaggauccauuuagguuuagcaacuacuuaagugcacugaaaauacaauuugauuuaaacaaauuuaauuucuuuacagcuuuuucucagaagcacaacugugauacaacugaacaggagauugucugacugcuggcuucucacuuccaguacuuccucuccgaggagauuucccuggggcuguuccugacccacacauccaucaggaggccauugacagcccacuugaauguuaugaauuugagaagcugucacagcaccuauuuauuccaagaggguucaguauuguaagcugaaaaaugaauuuagccuggauuguuuagacugagggaaaaaaaaacugugccuuagacucaacucuggcagagggucuugaacaauaaggcuaaauugugccccugaauuuuggggaagauggaggcugcuucgguuuuucuacuuucccccuacucccacaccgccaacaagaacacacgaaagauuaauuuccaaaguuaggaaaucaggcuucaacccaccauuguguagucauaagaauuacaccuaacuacucaugagucaucaggcacuggauucaaucagugaaugaauucaucuuuuuuccucuuuaauugaggugaccagcuaucuccauuccagcaaagaacuggcaaaaaugaacaauuugguuaaagugauccaauagccuucuuaagguucacaccuaaucaauuauuuaauuuuggauuugagugucaacuaauuugaccauaucuugucauaauuuggccuacuauugucaaggcuguuauucauuauaucacccaaugucuaccuuauaaagacucagaagaaaaauuucucucaaaccucauuauuaggaaaaugccuuuuuuuaaaacaacuuuuggccaagcgcaguggcucaggccuguaaucccagcacuuugggaagccgaggcagguggaucacgaggucaggagaucgagaccauccuggcuaacacggugaaaccccaucucuacuaaaaauacaaaaaauuagccaggcgugguggcgggcgccuguagucccagcuacucgggaggcugaggcaggagaauggcaugaacccgggaggcggagcuugcaaugagccgagaucgcgccacugcacuccagccugggcaacagagcgagacuccaucucaaaaaaaaaaaaaaaaaaacuuuuauguuaaguuccaggguacaugcaugggaugugcagauuuguuacauagguaaauaaaugugugccauggugguuuguugcacagauaaacccaucaccaagguauuaagcccagcacccauuagcuguucuuccugauucucucccuccgcuauccccacgacaggucccaguguguguugccccccaacaauguguccauguguucucaucguucagcucccacuuauaagugagaacaugagguguuugguuuucuguucuugcauuaguuugcugaggauaacggcuucuagccccauccaugucccugcaaaggaaaugaucucauuccuuuuuauggcugcauaguauucuaugguguauauauacaacauuuuauuuauccaugcuaucauugacaggcauuugcgcugauuccaugucuuugcuguugugaauagugcugcaaugaauauauguaugcuuguaucuuuauaacagaaggaguuauauuccuuuggguauauacccaguaaugggauugcucagucaaaugguauuucugccucuagaucuuugaggaauugccacacugucuuccacaaugguugaacuaauuuacacuccuaccaucaguguaaaagcauuccuuuuuccuucuccacaaccucgccagcaucuguuguuuauugacuuuuuaauaaucaccacucugacuggcaugagaugguaucucauugugguuuugacuugcauuucucuaaugaccagugauguugagcuuuuuuccuguuuguuggcugcagucaaaaugcuguugaaaaaccaaccaacaaaaaacaaaaaagcaaacacaaaaacaaaccacaacaacaagaaaaauaaguauguguucuguuucuuuaaaacauuaagaauauuuuaaauggcuaugauuccaacuuuguauugauuagagaggucauauucuacaucuggcaacacagaaauauauacauaugcuguauacauaauauaaaauauauauuuuuucauccagacugcuugaggcuuuugagaaaucuacuuugauguaaccuuuuuuguagauuuuccugauuacucaugagcugacucuauugauuaacauguauaacuucugcugaauuugauuuaaguggcuuaugccaggaagagaagaauaaaaaugaucucaauucagaucaaucaauauuaacaaguauuuaggucucagcucaauaagucacauuucagaacuuuuucuccacauugccuuaauacuaauaccaaagaauuauuuagcauuuacuauauucccaauacugugucucaaaaagaaaauucuuugaaagcuugaagauaaaacucaguaaaggucuguugaggucagcgcaguggcucacaucuguaaaucccaacauuuugggagucaaagguaggagaaucacuugaggcaaggaguuugagaccagccuggguaacaaagcaagacccuaucucuacagaaaauaaauaaauaaauaaaaauuagcugggcauggcguguagauguagucucaacuacucaggaggcugaggugggaggauugcuugaguccaggaauucaaagcugcagugaggcaugaucacgccacugcacugaagcaggcaauagagugagauucuggcucaaaaaaaaaaaaucuguugagaucaaacucgaaucuauuaaaccaaagcaaauauaaaauaucacgugauacugaauucagugguaaacaucaaaauguuuccuagauaugaccuugaugggauuaaaaaaugaaggcugaaguuguuagaaaagacuaauuggagguugaagaaccuaaauuagaucuguugaaggaaaaaggugauucuaggcaagguauauaugccagugaaggcacuaagguaaaauagacaccauuaucauugaacagagccacgugaaaaaagcaaaaguuacagcauagaaaguuccggaaaauuuacuuaugaaaggacuuagugacuagaacaaagauuugaguguaaugaguacaaaguccaagaaggguuccuuguuuuuccaucuugggccaggucaauauacagggucacuauuuucuuuacagaguacaaggauuuucugcucaaggucuaggaccaaauuauagcaagacaggauacacuuaugaaacauuucagucuguuuuaaagcuauuccccccgccccccaaagaaaagguguuuauucuucauuuagaauucaugaguuauucaagcuaugagauuaaaauguaaaauugccccuuuuaaaaauuucuauccagaaucuaguuuacuaauccacucuuaaaauagacauaacuaacauacuuauauucauaggacaguucccauuucccauucauaguaaauggaaaaugauucccauucauaguaaauggaaaaugauucccauucacaggacucaaucccauuucuaucccagaauagcccagaaacagaaauaguaagguaugaauggccagaacaacaggaggaccuuuccucugaaaaucacugaagcaccaauccuuuaaacccauuucugccagucuauagaaccuggaaaguuacagauuuaauaccauauaauuucaacugaacuggaaauaugugguuucuaacauaguuucaggagacaaauuuaaggcuaacucuuaaauugaaagaaaugcuuucuaaaauuaguaauuaggggagagaaaauacccgcauaauuagaagcucuacaacuuacuaaccuaacauaauauuauuuccaggauauccuuuuuugucucaauuauacaacuguauuuccuauuuugagccauccuucauggcaucuccccuauguuaccaguuaaaccuaaaaaacaggccaugacagacuuuggaaacaaagccuuuuuuaaauucagauuaaaaaauaagagaagaguugcaaccagagaaccaaucacagugggauacaggagcagcagugauggauguguucccccauccaaggcaacaugguagucaaccagcaggaaggcccucccucugccacucagugagcaccugaacauaacuguccuuuucuccauuuuccuaauucuugcuuuaucagucucuaaaaugagaacaaacaguauguucccauucuccuaaagaauaugugagaguugaguaacugucugacuuuucaugaauguugaguucugugguagaaaaaaaaaaucacacuuuaguaccacccucugauuacuccaaucuuuacccgaucagagacaccguuaacuacuaguccaguugcugcuauauguguuuacauaauaguucaagauguggacauuaauaagccaauuuucccaugaaaaacgucccaaacuacaggacgacaucccucccaauuugcuauuaauuaugccaauuggcuugaaaccuuaaaaucagaccuaaaaauucuacuuuuauccccuuuauuaagaccccauguccuuucaauucugcccuuaaaauaucucccuauauuuauuucuuccucuccacuccaaacaagagcauccucuacaaaucaccccuagguuacagaaacagacuucagcuaaauuuaaaaagggcauaaaagauuacuuaaaauuauuuacuacuuagagagagccuuuacaguauuaauauuuugggaaacaccuuuucagacaauucucucuaaaacuaccuacacauauauggacauguauacaaauuuacauuguauuucauauucaucacauuguaucacauaagcauauuuauguaaauuuguacacugcuuuguucaugcaacauuauauaauaucauauuacauaauuuaauucugaaauaucauuuucuuuaguuguauuucuucacugaccuuuuccuacccuuauuuuauagagaaauacaugucaaaguuauaggucuuaccuaugcuauggaguaauuuaauaacaauauucaaugucuucccaaucuugcaaguguuuaucuuguccaaugucaaccuauacuacucuccuauauuagccucuucaucaaaacaaacuuggaucacucaucaccuauccauacucugaguauucccacuaccauacauuaacuuguauuuuuccuucugccaauaaguccuuccuaucuccuugugugcccuuccuucaagguuaaauacaaguuccaccucuucauucauguaucccuuauucauucugucuuaguccauuuucacacuacuauagaaaacucccugagacuggauaauuuauaaacaaaagaggcuuaauugacucacaguuccacauggcuggggaggccucaggaaacuuacaaucacggcagaaggugaaggggaagcaaggcauuucuuacauggcuguggggggcuggggguggggaacugccaaacacuuuuaaaccaucagcucuccugagaacucacuaucaugagaacaucaugagaaacugccuccaugauccaaucacuucccaccaggucccucccucaacauguggguaaauacaauucaagaugagauuuggguggggacacaaagccuaaccauaugacauucauucaacauauauugcuauacaucuaugaaucaaugcuaaagauuuagaguugaacaauauacacaccagcccugccccuaagcaacuuaccaacuaauugccaagaaugacaccuaagcaagugauaacacaaaaauaagauuaacauuaggucaagauacaugacagaaaccuauggggcacccaucaugagaacuuccuuugugaagcuuugacaagacauucuugcccauaaugucuacucccagaucagaauuccucugccauuuauuuauuaccuacgcuauucauuucaaaacuuacucuaugcuuucuugcacuguaauuaacucuaggggacacgucuuucucccccauuuaaugguuauguuccuuacaaauaaaaacccucuuuauccuucuucuguauugcuagaaacuaguauagagccuugcacaaaauaaauaauuuauuguuacugcugcugcuguuguuaacacugggaaauaagaauuugacuaucacuaguaauuucaagcuucugauaagaauguagaagaauguuuuaaucauuacaacuguuccucauaucucuaaguuguuuccacuuaccuaaaaccuuuauugagacuuuccuccuuacugagcauugcuauaugaaaacaaugcugugauuccuccugaucaguuuagcaguauuaggcaaaaagucaacaagcuugauacccaauguucugaaauccuuugaaaaagacagaaaauauuugcaaacuaugcauccaacaaaggucuaauauccagaaucuauaaggaacuuaaucaacaagcaaaaaacaaacaaccucauuaaaaaaugggcaaagaacaugaacagacacuucucagaagcagaaauaccugcagccaacaaauauauaaaaaaacacucaacaucacugauacacaaaucaaaaccaaaaugaagauaccaugucacaccagucagaauggcuaguauuuaaaaguguggagaaaaggaacgcuuauauacugguggugaaaauguaaauuaguucagccacuguggagagcaguuuggagauuucucaaagaacugagaguugaacuaccauucaacccagcuauuccauuacuggguauauacccaaaggaaaauauaucauucuacaacacauuuacccauauauucacugcaaugcuauucacaauagcaaagacauggaaucaaugcaggugccccugaacaauggauuguacaaagaaaauguugcacauauacaccauggaauacuaugcagccauaaaaaaacaauaaaauaauguccuuggcagcaacauggauguagcuagagaccauuauccuaagugaauuagaaacagaacagaaauuagaaauuagaacagaaaacuaaauaccauauguucuuauuuaucaacaggagcuaaacacugacacauggacacaaagaugggaaaaauagauacuguggacuacuaaaggugggagggaaggaggcauggguugaaaaacuaccuagcggguacuaugcucacuaccugggugaugggaucauucauaccccaaaccucagggacacacaauuuacccacguagaaaaucugcacauguacacccugaaccuaaaauuaaaguuggaagaaaaagaaaaaaagaaauauucagccuugaaaagacagaacugcuugcuacuuucuauagccauaccuugaauuaagccuagcuugcuugcuaauuuuuauuucaggaaugacagcuaucaguaaaugaacaguaaaguaacauuaucaaucaaauauaaauuguguucaaggaaaacaaaagcaccauauuuaaauugcuaaaaaaaaaaaaaaaaaaacccacuaacaucauauuuacuucuccugccuauuugggagaacaaacuauauugacuguuuugcagacaugucaagaguaucuaaaugaagguucacaaacaguuagaaaauaaaauaucuggcucuaaugaguuauguucugauuuaugugaaauaaaaagaaaaacaaacaaaaaaccuggcaccaccucucaaguaaaaaaaaaaauuacaaacaaauugcuaacaaauauuccugauuguuuugacuagagcaaagcucuugauaagaacaccuuucauucugaaauaaaauuacacuuaaugugcuuuuuuguauuuaucuagaugaauauuugaaaugccuacuuuuuucaguuaguuuuaacucuacugcaccuuacaucagccacuaacagaaguauucuauaagaaauguaagaauuaccauggccaugccaauuccacaaucagaaaacuagaguggcucccaauugcuucccaaaugaauaauaaaauuacauauauuggcauguuccuaaaaccccuagcuuuuccuuuagcuuagagguuuauaaccugggcccaagaaugggccccagguguugguaaaccccuugaaacugaaacuaacauuuugcauguuuuuaugcauuuuucuagaggaaagagcccaacauuuucagaaucccacuggagucuuugaccucaaaaaaagguucacaacuauaauuuuaauauuccccuuucaucaccucuuucauauuuaauggcccacaaccauuauuauuucacagaucuggaauuucuagcagagucaagaaaaacuaccuacuuccuuguagcaagagacauacaauuuccuucccuuuauauguccuaacccucucaguaagucauauuuaacacuuucuggcuuuucauuucucucugaaaaccuuucacuucuuccaaaaaacccaacaaacaauaccaaacaaaagaugacacaacccaaaaguuucaaaugauacuucuuccccauuucugauggcuauuccaccuaauggcaccacacaacuaguggucagcacacauauuuuaaugaauuaguuaaccccuucuagaagcucacugcgucuauuccaugauuaaaugccuauggucaauaauauaucuauggugaacaaccuaaugcuauacuuacuuaaucguggugcuucaggacacugaagaacaacuaguaggaaaguuaagucagaacugaacuucuaauucugaacuucuaaaaguucuagcugagccaguacuugccacuggcuaaucaaauccaugugauugggagagccuuccuuauucucuuaaaauugaaguccuuacauucacacaagcuuuaaaaaaaauaauaaccucuauuaugagauauuaagguaugcaucucuguguuaauuuauguaugcuuugaaguagccagaugcacaguaaacaaacuagaaggaaaaaagaaguguuugggggaggauacauucaaauggacuuuucucuuugacguacauuuucacccuuauuuccuauagaaaacucauuuuuaggggcuauaguucuucaaagugacugccuggcucaaucaguuauggcuagaauauaaggguaacaacaaugaugacgaugauggcuaauauuuauuggguacuuaugauaugccaauuacuucucaaagugcauuuaguguauuauucccuuaaucuucccaacaaucacuuugagaccuaauaguuaccuuuauuaucaccaucuuauggaugagaaaucugagguacaaagaaguuagaucuuuugcucaaggccacaaggcuaguaaguggaagggcccacuugaaccugggcaguucagcuucagaacuaguguucuuugucacuaggcuauaauagguccccaggugaaauaauuuaccaacuuuuaaacuucuuuuuauguuuauaggaaucagacacuaacaagauaucugauaucaagccaucaagauauauauuacaauauaaauuacuacugacaaucuauauacauacuuaauuuacacuuuauuuuaaaaacaacaucucuuaacaagauagaaaucuuuuagguuuauaugacaagacaguugggguugacaguuucacaucagcaugaguuuaaucaagaaaacaaaccauuuugaguauguacaauugagggacuuugauguggaguuuaguagguaaugagggagcugagaaguaagacgggauggaugaugggcuaauuuagagauuagcaacagcaggaagccaauaccacccccucaggcuggagggauacugggaggagacaaagcuaucacagcccagggguccagguuuguuuaaaggugguuggagccaaggaggaaaugcagccauggccaagaugcugcccaaggcagacagggcaauggagcaacaccgacuucaaaauuccuacugcccuggagucuccucccagugccucccagcugacguggauccugagaaaugccugcaucccucuaagauauagagcagagccaaagaagggugaggaauggcucagaguaacugcacagguuuccaccauggcuuuauuacccauauaaauaguccaaguggaauccaacacuauccaagauuuaaaaccucccuaagccaaaaaaaaaguccauaaauucaccagauuugucauauuucacuuauguaaaauagaaaaccaauuguauucuauuaauguucuuuuugaaagacuaacagaauuuuacaaaauguuauaaauuuuguaaaaaaauuauuuuacuaccuuugcaugaaaaacauucuaaaagacccaaauacagaugucaccuuuaacugaagcuuuaccugauaggauauuuuacuuaucaauugaccgccucucuguauuuauugcaccagacucuaaacuuucuucaauuuugcgauuagauucuagucucagaaaauguuagcagguggguauucuuguuccauuuucuggaacauuuuggcagugaagucuuuuguucucaggaauuaugaugugauugucaguagacacugcugguugccuguccaacaaucauuccucucgcucuuucuuuacaucauagugauuuuguauacacuccuuccccaaaugcuacaaggaaaagugaaccucuucccagacccagggaauauaucugaaaagucuaugucuaagggagagggagaaaucagagaguuuguccccuagggaacauuugggaacaucuggcaauauuucaaacuuuuuuuuuuuucucgucauacuagaggagaggcaggguggcuacuggcaucuaguggguagaggccagggaugcugugaaacauccuacaaugcacaggauagccccacaauagagaaauauauuuaagugagguucuugaauucacagccucagcauuaccugggaaauuauuagaaaugcaaauucacuggcucuaucccaaauaugcugaaccagcaaccaggaugggaucuuguauuuuaacaaguccccaguugauucuaacaaaugcuaauguuucagaguuacuggucuaagguuccagggguuagcaaacuauggcccaugggcuuaccaccugcuucuguaaauuaaguuuuacaaaaauacagccacauccauuuauuuauuuauuuauuuauugucuauuguugcuauuacagcagaguugaauaguugcaacagagaccagauagacugcaaagcauaaaauauuuacugucuugcccuuuaagaaaaaguuugccaaccccuagagccaaucaugguaaucuuauuuuucuugccaguuauugguuuaggaauggauugcuuaggaaggcaaagacuauuaggaucaauaggauggaagacaaauguugcuggacaugaagaugggacauuagggaaagcauuccuuuuuguuuguuuguuugagacggagucucacugucaccaggcuggagugcaauggcgcaaucucagcucacugcaaccuccaccucccagguucaagcaauucucugccucagccucccaaguaacugggauuauagaugccugccaccacacccagcuaauuuuuguauuuuuaguagaaaugggauuucaccaucuugaccaggcuggucuucaacuucugaccucgugaaccaccugccucagccucccaaagugcugcgauuacaggagugagccaucacgcccagccagcauuccuuauuucuaagguauuucuaaggagcauagacagaaagagauguacuccuuuuuccucuggauauuacaucaucuggaugugauacuagaacugcagcagccaucucgcaauuacaaggaaagccagguuaaagcaaaaacaauauuccaaagauaagaaaagugagacauggaaagaaccugauauuuauauguuaaaaauuuuucccauagugaagcuguauuacuugaguaauaagaaaaaaauuaaaguuaaggggcaaaaagacuggauaagaagacaagucggggaagcugaauccaaauaaccacagaaguuuuuaauugccuuaagucuguuuuaguguauguauguuuggauccauaauccauacaaauguuaaaguaaaacaauucugguuugaagcaaauuaaauuuccccccaacaacagugaagaguaacuacuucuucuugcauuguaaccagagcaauuuaaacuaacaggccacauggcagaaauauaaucaaagguucaccacagggaacacacagcacaagcucaguauacuugaaaucauuuucuccaagaaaucaacagcaacuaaagagaccacaauuuggauuuuaaucauuugaauuugugauauaacaaauccaaauagauauuuaaaaucuucaaaguguaaacaaccucauuuuccacagaauacagcccagcauauauuuacguaguauacaaugcaacaucauaauauaaaaugaaccuggcauuggacuagguucuagagacaaaaaaauaaauaagauaugauucccugccuuugagcagcuuaugucugguggggaaagugauaaauauacacagagaauuguaagacaaggaaacauagcauagaaguuuguagaguuuuauggaaaugcagaggagagacagauaaucuaguuagaaucaaagucaagaguaugaaaauauuauggaaacuguaauuuaccaugcaaauacaaugauuuuauaagcugcugugugaaaaacuaguauuuauuaaaauguuggcugagcgugguagcucaagccuguaaucccagcagcacuuugggaggccaaggaaggcggaccaugaggucaggaauucgagaccagccuggccaacauggugaaacuccgucucuacuaaaaauacaaaaauuagcuggguguggugucgggucccuguaaucccagcuaguugggaggcugaggcaggagaacugcuugaacccaggaggcggaaguugcagugagccaagauugugccacuacacuccagcccgggugacagagcaagacucugccucggggcgggggggugaggggguggggugagggagggggaauuguugcaugcagauacuuguacagccaauuaauuugaaugauauuauuuaaaauacuuuagucuguaggcaacauuuuuguuuuucaaaauacuauucuuccuaaaaguucaucgcacuuggagauuuaucuucauuaauuucuaacugguaggggaagacauaaucuuucaaaacuaacauuccaaggaugguuccaauuucaugaaugacaaaaucuucccaaguucaaagaagaauccaucccagagcuggagcucggcagggccauccagggcccaccuggucaacuuagggccugagguaagguagagguuggauccaggaacuagaucaauacccagccaagucaccaugaagaagaguucuugggaugaaucauuuuauuacauauuugaccaaguggaaaagcaauuuguucugugauuauggucacugacacuguugacaauguuuaucauguggcaaguuccacaaacaauaaaguauacguguucacuacaggaaaaaaguaagggugguugagagaguggggguaaugcuaccguauguuaggauccaagaacuacaagauaaaaagaagccauuuggcccaaauagcuuacacaauuaaauaugccauuaauuucaacuauaaacucugcuugucgauguauucuacaauuaccucuuugcuaaagaaucucucaagcaguuaacuaaugccaggccugcuagggacagccugucuauaaacacuaccuaaccuccauguuaucuaccaucaugcccucaucuaauuagaucugagcagucacccggcuucaagcuuacuuauuacauuuggcccauuuacuagaauuagauacagaaucuucucugagagauauuuucucaaguauugcauaagaaaucagugcuacauauuuuucuggaaaaugauccuccuuaugaauuuugcuuugcuauuauccacuauaauaucaaaaaacaaauaaaauccuccaugaucaaggucuaggccuuuauccaagauucucauuugcuccucaucuacuucuuuucccucagaacuuaauaaacuuaccuggacaucuucacagugcuuuagauaugccuauugccucugaagaaauaaaaauaucauuucucugcaagagucacuauuuauccuugagcaaucacuccuacacccucuggcuuacuucgcuaguucucagucagagccuacagaaagauuagaugaauaaauguuccucuagaaguuucucugucagucaaaagguccuaagaggaaagugggguuuuuuuugcccuaagaaaugacuaggagaacaaucccuagugaguaauuuuaggcacuuguggucagaggcaaucuggccugaagaaauccucagccugagccaccauuaccagucugcucuaccagcugugcggaacccuggcuucccauaaaaucaacuucagugaccugguggcaguucaugguuuugaaaauuccacuuuaaauggaaauuuucaaaaaugguucuguugcucugguuugcugacaaccaaccuuuacaaauuuggcaagaacccucuguugcccagcugccucugauuuacugucccugggcacagucuccagcguggcuguugggcucuauacagcuaacacugccauugccucuggcaauguggugugguggaaagcacaguggacagcuaaggagaccugggaucaguccugcuucugucacuaaugagaaugcccuucuagaucuuaguuucugcauuucuaagcucccuucuaggucuagucauacuguuguuccaccugcaguuaugagcaccuacuauggacuauacguguagcaagggauacaagucacaaaccccagccucagggaguucuaaugauacucugacucuaugaacagccaacuugccauuuuuuaugcuaagacaagaaauacuaaugaaugauaaagccaaaaucaauuccaacaucucauuuuggccaacucuuuuuaaacuucaccaacuucuuuacaaacaaauagguaacaauuuuagaauaaaugaaagaccaucacuugcagcauuucuucccccaucccacuaugacuguacauuuaaaaaucaaguaaaaggaggaugaaacaggagaaacagcuuggauaagucagcaauuagauaacuagccacuggaacaaccaagaguuacccaaguugaugcugaaggaaaacauacuuuuuagugauaccagcuaaaagugucagauuauuccacaugugaagaugucacauugaagacugguuaaugaauaauccgcaggaaaaugaaccuguaucaguauguggcacgauggcauuauagaaucuacuauguaucagcaguaucuauuucucagccguuuucuaucccucccaucuuuugaaaagccuacucaaaacucaucaucuauccucuaaccccaggacaccccccugaaugaguguccuucaggauguccauuuagcugcccaggucuccacagaacacagcuggcccaaggauucucuuacauuauucauguguugcuuugugaacuugugugugauuguucuucuacaguggacuuuaaauccuccagagguaguauauuauaacccacggugagcaggcacuaaguauuuucugccucccuggcuuugcaucuucuaaagucuauuaugcuaagauauaaauccaguacagcuuugaaaauagagaauucaucacugaucguuggcaucguacauaucaauagaggaacaaagcuugcuauuuucacggaaaauuggaggauaaucuacaagagaacaauaaauaggggugguaaaaaagugaagggguagaaauggaaucuacguuagaagauuagggagagaagcugaauagcaauagaaaaaaauauauauuuuagaagguccagaagugauuuuuuuaaaaaauaaaaaaccuagauucuagcuuccccuauaauugagugaccuguaucaaaucauuuuaucugagaaaaaaaaagaaugcugguguucaauguuuacaaaaaucuaggaaacuaauaugaaaauaaauguaaaaaucuggaaaaaauauucuuguaauucuauauuguuaugaaaaggcaaaguaguaccacaguuggauuuaguacaauaagcacuucuugaggaccugccaugaccccaggcauuguaguaaguccucaauuccaaagaugagcaagacauggccucuacccucgaagagcuuacauucuaguuccaagcccaacaaaggcuuucucagaacaaauucaauuuaacacagcaacaucugcuauuaauaguuauaguaauuaaaauaaagaaaacuuaaaugugcucauaaguauauacucuagagaaaaagaagauauuauuuuaagaaaaucaagacaacagagccagcugguuuguucaaggucauaucaugagguaaaguggaagcaaagaaaacacccuagggcgcuuugaguuacaaaccagguuuacaugcuuucuggaaccaaaaagggccaggcagcuuucuuuuucuuucuuuucuuuguucuccucuuuuuuuaacagcugggaaaguuguggggugaggugcuugaugcaaaaaaguuacuuuuuuggcuuugcuuaguuuugcaaaacuaaaaagcauuucaaauagauauugcauuguugcaguucauuuaacccuccagauauuuucccacuucgucaaccauuucauucugcaucuuaguuaaaaaauaucuuccccuacuccuuaucaauuucuauaccauuuuccaucuuauuuaguaaugauaucccuccugucuacagaaagauaggacuuuguaauauuacaguauauuccacagauauuuagccaaauaaaauugauguggaugaagaaaauggcuauaaaguccaugaacucauuguccaaauauagagauaucugugcacacugauuuuacugacuacuucaugggucuuuucuuccuagauagggggaaaagacaucaugggcuacaauuuauggcaucccagacauggacaaucuuuuaucucauugcacuugguacagauauacuacucauccauucugggcuaaagugguuuggcaaacaaugcauuccucagucucuuuauucucccucagauucgaccaauauacugaauggggugaugaccagucugacacuacuuaccaaugcacagucaaucuacucuacuguaaaagugguuauuaauaaaaccuccaaaagagcagaugacuucucaaaaaaguagucucucacaaaaaaaaaaaaaaggaaucaguagauugaagagaaaucuguaugccuguuuaaagcagcacuauucacaagagccaaaauauggaaccaaccuaaguguccaccaauggaugaauggauaaagaaaauaugauauauauacacaaugaaauacuauucagucacaaaaaagaaugaaauucugucauuugcagcagcauagcugaggcuggggggacauuaaauugaaauaagccaggcacagaaagacaaacauugcauguucucauucauaugugggaacuaaaaaaguugaucugauggagguagagaguagaaugaugguuaucagaggcuggaaagcauaguggggagcagggcaggcagagagguugguuaacgggaacaaaaauaaguuagaaggaauacauucuagugcuugauagcacaguaggaugauuauaguuuguuauauauuucaagauagcuagaagauuucaaauguuuucaacacaaagaaaugauaaauauuugagaugauggauaccccaauuacccugguuugaucauuaauacauuguauacauguaucaaaauaucacauguaucccauaaauauguacaauuauucuauauuaauaaaaacagaguggucucugaaugcagaucagaaaugaaggacucaagcacuuaucacuguguaauagggucagccuucauugcagaauauaaaaugaagccauuagaacaguuuucuaauaaguauugaaaaauauuugggcuugagacaacuugauuugacucacuguguccacacggccuucauuaauucuaggagagucuucuuccucacuacuuuaccuagcuauuuuaucuacccccgaucucucucuuuucaucuucuuccuccuacuauuuucuagaacacuagaguaaaagaacauauauaucuuccaguagcuaaauuuuucccuaaaaaauaaauaaucacuucaacuuuuagaucacagagcacauggcaggcuggaucaauuaucagcaaagugaugaacaaaauuaucuuaaaggugaccaugugaucuucugccaggguccaggccaacucagugaauuaacuccauauuuagauuucagcuucagcacuguguugauuucucuuaucacuugcuuccucccccacaugaacaaaaagugucacauuuucuccucaccaguguuucaccuaggcaccccaacuacucagaaucuguuagaauuucuacacacuaaaagauccauaucauuuauuaucuuucaguacaagaaauaucuauuuuuuucacugcuaauucugauucucaauuuaauuucuaccaccuaaggaugaucuaauguuaugugcaauuuguguccuuagguaaggacagaagauuaacacauuauauaaagaguaguuauaaaacaacuacaauaguggagguggcggaguugggggguucccacagcacuggugaauuagugaaaaaggagagggcauuagcgaaaaacaggccaauuaggucaaagugcaaaaaauauacaaaugaacuaacagacuuauuuguguaaacuaggaauaggaaaucacaaaugaauuaaaguuaaaucuugucuagccucauagaaaaucgauggagauaacacagggucugggaucucuaaugguuuuaaauagagcuggaaggugauauaaacaaacaaggauauagcaugucauucugggucuaguaaacaaacuagaacuaaaagagauguuuugguaauaucaguaacugagcaagcagacaaccuagagauacuacaugcaauguuuccccccagaaucaaguccccaucucuaaggaugggugcaauaaaugucuucagaccaucuuuaaucacagccuccgcccccacugaaaagguaacccauauucucuuuaaagaucaacaguccuugaauguuuguuauucaguugucauaguaaggaguuugguugucauaagagagagagagagagagagaaugaaugaaugaaugaaugaauaugaaugaauguguauugugggaggaagggguccugauacuugggaagcuacaucagaaaccggcucacccuugaccucuguguauaccacucucucccuccaagauuuccacacugaggcagagccucuaauaaacccaugcuugugacaaagucccuuggucaaauacaugccacuggacuucccucuguauccgccucugacuuaucaacacuuggcauuguccuauucuuuacugguuacaaaaugacucuucaacugccauuuauccuucuuuuuuuccaguguuuuucugacuuuuaaggaucugaaaugugaugucaugauucuuacucuuccacucaguaauuaauugguguuuuucaagacuaucauuacuccagccaagauauggaaacaaccgaagugucugcagacagaugaaugaauaaagaauaaaugguauguaaacacacacacauauauauacacacacauacacaaaagauuauuauucagcuuuaaagaaguuagcccugccauuugcaagaacguggauaaacucagaggaucuuauguuaagugaaauaaaccgggcgggcccagaaagacaaauacugcaugaccucacauauaugcagaaucuaaagaagccaaaguagaauggugguugucaagggcuggaaggugggggaagugagagaauguuggucaaagaguacaaaaguuuagcacuuauucauggaggaugaauaaguucugaacaucuaauguacagcauggugacuauaguuaauaauacuguauuguacgcuugaaauuugcuaagagaguugaucuuaaguuuuccacuacacacaaaaaaaucuaacugugaguugaugcauauguuaacuaguuugauggugguaaccauuucacaauguguguauauauauauauaucucucucucaaaaaauguuauauacuuuaaauauauacaacuuuuauuugucagguacacuucaauaaagcugggggacaaagacuaccacuacugcuaguuaaaugaucuuccuugauuuauaucaacuugauucauuuuuauaguucaucaaauauaguaagaaaugaaauccuuuuuauugcuagaaaggguauuuuuucaaguuaauaguccaguuaacugucagcaacaaagcaagaaaauaauaauauauagugauagcagcugacauuuauugagcauuuaguaugugccaugcacuguucuaaguaaacauguauccauauguauuaacucaauccauacaauaaccuuacaaaaugaggcuauugucaccacacuuuacagaugagaaaacugagauauaggcaguaacauguccaaggacauacaacuaauaggugagagacaggauucaaacccagauaggucacagaaagggauuuauaauucaaaaccagacacuuuugagagaauaagagugcacugaaauccguuaauauuuauagaguguucauuuuaucuuuuuaauauaagaaacugccaaagaaggaacaauccuucacuguauuaacuaaaguacuuugggcaaaauaacauucauguuuccccugcuggcauuccucugcaggugugcaguucacagugccccacccaccacaacuccaccccaagaagagaucugcauugggaaauuuuacacgaucauaaaauaaauaugccucaugaaagcauuaaugagaggaagcugaaaaaaaaaaagaauaaaucauguuuuuuuuuuuccuuacagacacuagcuuucuagcaccaaaaaaguauuaccuccaaagcaaaauuaacaggaauuaccacagaucccaucucuacaugcugcaaaacaacugagacacguacaggaacucuggcuuuuauggaagaaccaacaaaauuauuaaagaacaacauaaucagcaauuaaauuauaauaucugauuaacugacguaccaucaguagcaccugggguuggcagaaaaaacaguaaauaguuaaaaagaaugaugguggcacgcgucuguagucccagcuacucgggaagcugagaugagagaaucgauugagcccaggauaucaaggcugcagugagccaugaugacaccacuguacuccagccugggugacaguggaagaccuuaucucaaaauuaaauuaaauuuaaaaggaaguguuucuaagucucgauuuccucaucuguaaaauguucauuauaauaauaguuauguaauagacucaugagaauauaauaaaauuaacugauaaaugugcuuuauaauaucaaauauuaauuaaauauauaauauaaaaacugagaaugaaaucacuagcacuuuuuauuuacaaccuaacagaacaaucugaaaaaaucaguguaucuuccuauacuccaguaggaaaaaaauuauugaacagauguuauuacauuuucauuuggaucaucuaaauggagaccuuuaaaaauucuggugaaaaacugaaguuuaaagcaaacuaguccucacucccuccccaaaagucuuuacauaauuguaaagaaguuuuccaguuucauauccauuacauauuuauuauucucauucugucuacugugaagaaaagagauauuacuccuauuuuacagaagagaaaauaaagccagggaguaaguagaaaaccaggaaaucccaaaucuucugaucuacaacccuuaguuuuuaaaauuaccccagguuaccaaaaaauaguucccucauuuucguaaggcucauguuuguuuuaucuugaccuagcuuuucugauaaugucugucuuuaguuaaauaaagcuaauguuuuucaaguauauuagcauuuuaagcaauccuauuaaccaaaccagacagucaaauuuauaaaaugaauuucaguaagcauuacacaaauuuggauauauuauaaaugauguaugauuuuaacuuaacaaaaaauuuagaauugccauuuaaaagcacaaaauacacuguauuuuaaaauuagcacaucuaaaaauacuuaaggacauuauacuguaagauuugucuaccucacugaacaacaggcaauggauacauccagaaaaauauuacauuauuuuaaaguuuucauauacccacauaaaacauaaaugucaacucagaauuucagaaagggguggguugauaggagaucaaauuuaaauuuuaaguuuaauauuuccauaagugaauguaggaacuuuacauuuguuuaauauuuggugggucucauucucuucugcuuuggaaaacagaauagcuuaacugucuaaaauacuuaaaaaacaugauuuuaaaauuuuguuuacaaucugguugcuauaaacccgauuguacuagcugaaacuuguuccaguguagaggaaucugauuagcuuuauuucagacaaaaauaagagacuaagagaaguguaaaagcacauccuggcucacagagauacuguauaaacucacaguccagaaucacagaauuuuuaagacuggaagggaucauuguaacaaggaaauauuuugggacccauuucucccacuaaucuaaacaagacaacuauuuuuuuuuucuuucacaaguuuccuaacugaaacuggaucuacagagcaagaugcaggcauucccccuaucaaaaaguuaauguagaaacucccuuugcuauuucacuucugcauacacaaugccagcacaauugguuacaaaaggaaaaucuaagcuguugccugucuguguuuuggucuacgugacgcuaagcaaggauuuugguuugguuuugucaauugucugucuguucagcugcacaauagccucaauccucuggcagugauaacuaaauacaaagagagccugggaauaccacucccuuuaaaaagucuuggcaaaucucaucaaacuacaggucuauuacuuuuuaggcagacccuccaggccuccccagaucuauuuagcugagcacacacccuuauuucacccauucacccauuuucuccuagcuugucccuacuguccuaaguccuaaaauguuuaacgugcaaagugauuguaguuaaucuacucacucagguuuccuuuaaauauuuccuaacuuuaaauauccauuuuuuaaaaaguggacagaguauggcuucaugacugcuucuugagaagaccacucucauuuugcaaaaagagcugcccauccaacauguguccuuuugcccuuccuggguaaccugaauuugacuuauucugaguaauaucccucauuuguauggaguagguuuggaagaacccacucagaauauuuaaauauuuuccauaagcaugugccuaaguucauuuuuuuaaacuucauuuaaccgcaaguagaacuuaccaccacuuuuucugucacugccagaaauaaugugaacuacauacauuaggaacguuuacaguuucaaauucagcuacugugauuuuccaagucaaucuacuguaauauuuuuuacagucacccuagaguguuuucagaaauaugcagccauucaugggggaacauuucugauaucuaauaauuguggcaacuuaagaguuaaauuuacucugugccaucuuccaaugccacgucucaacuauauuacugcauuuacaaacugacauuauauuucuugucaaaaaaacuuuacauauuuccucaaucaaugaaaugauuacaaggaaagccugaccaacuucaaauguaaauauaucugggauacaaaagacagucauggcuaaugauccaaauuuggaauauuuuauauguuuaacacaaggagaacauuucauaauaggagaagcuaacaaggaacaaguauuaucccaauaaaacauucuuguguaaucaaacuagagucaagguuuuagauuuugauuuaguuuauuauuuaauaauuaaccuaguguuccuacccuacaaaaaaacuauacaucuucauguuugaauaucauaaagaugucaaauaaagaaaugaaauuaaaacgaccuuagauaugggaagaauuagcuucaccagcacuuagaaagcaauacaaacugacugcugguugcuaaaauuaaaaacugcagaauucaaacacuauuucugaauguacuugguaaugagauaugucaugugaaguuaaaaggguccaaacuaaaagacuaucuuuuuaggcaaaucuucaaaaaccccagcaacaugacaaagaagaaaaaaauuaauucuauuucauagguaacugucaaaugcagaucucuuuucuucccauucagaguaaauauuuauuaacuccauaaauaaaguguuauugaacacucagccuaauuuuuuaauuuuuguuucauuuucaugaagucauauggaaaauagauacugugcccgaacauuuaaauugacuucugcuaucuuagggaagagcuaguugucuuagagcggaagacuagaaauuaaaagccuggaaucuuuuucugagagucuuacaaacucuccugagaugaauauggaaauuauccaaaguuuuuuuuuuuuaaguaacuuuggaaaaagugguggauauguuaaagaauaaucuauuuuuaauaacaaaaaucaaagcauugaggaaaguauguuuccaaauugagcauuuugauuuugauaaugaacauaaaguuaggaauagcuuuuaaaaaucauuccacugcuguggaagaccacuuggcuguuccucaaaaaguuaaacauagaauuaccauaugaucccacaacccuacuucuagguauauacccaaaagaacugaauacagguacucaaacacauacacacauguucauagcagcucuauucacaauaaccaaaagguggaaauagcccaaauauccaucaauaaaugaguggaaaaacaaagcaugguacagccacauaauggacuauuauacagccauaaaaaggaauaaaguacugcuacaugcuacaaaguggauaaaccuucagcacauuaugcuaaguaaaagaagucagaugcaaagaucacauauuguauaauuccaauuauaugaaauauccagaaaagauaaauccauagagagagaacucagacugguaguugccagggucuagggaaauggguuaaugaaagaaacugcuuauuggguaaggcguuuuacuuuggagugauggaaaugguuuagaacuagauagguguagagaucauacaacauugugaaugcauuaaaugucaaugaauucuucgcuuuaaaaugaucaauuuuaugucaugugaauuucaucucaaauuauuuuuuuaaaugcuacaucaccaaaacuucugaugauauagaggacaguaauguuuggaaaaauacagacauugacaauucuauguuuaaaagugaucccaaauagacucugaaugugaaaaaaaaauuaagaauaccuugaacaaauuauuuugcuuguauuuuucuuuauaugucuauuuaagugugauaaaacauaaaauuuugucuaaaucuuaagaguuuuucaguacauaaaaaauauuuaauaagagaaaauauucauuuuaaaaucaaaauuauuuucccuuguaccuaaaaugguuuaaaaaucaacaaugcuacuuaaagagaaaacccugacagguuacgucaaucaauuaugggcauagaagacaguuuuugaaauaaacaaagcaguuaaagauaaagccaagaaauuccagaaacuaucuuaggagaauuuaaaccuuaaauuucuacagagauaugaacauuacccaaaugaaggacuaucaguuuaacguaaaucacaauagaacucuuuuagccagguucaucauuaugcagauuuucacacacuucagaacaaauuaucgauuuguagacaaggcaggauuaagugccuuucagcuguaggaggcuaugaaauaaaacuaaauaaaacuacauaugguaaaaaguguacaauaacaaagucgcuuuaaaguaacaguagucucaaacaccaucaguauauuauaaaagcaauacauuuuacaauccauguuauugcagguuucauuuaacuuauaaagauucauuuugaauuucaauauuacuuggguaauuagaauguuccauguaagcucaaacauaagaaaagaauuuuuaaaguacacuuauauaauauaugguaaagaccaaguuuuaaaaacuggucucauuaacaaauuaagcuuagauuuuggaguuuaaaaaacuaagugccaauaagcacaccuaaugcccagaucuugguuucuucaauaaaaagaccagggcuccuuggagaaauggcugauuccagcagggggcaagagauauauaagacaaaccuggagcagcauguagugccagagaguaaggaagugcucaaaacaaaaacucauuuucagugcaaaggcacugaaaugagauauuuugaauaucugcuugcacaaacuggcuaugaauuuguagagacgggccacuucuuuuaaaugccuuuuaauuucuuccuauagagcagagcuucucaaccucagcccuguggacauuuugggcuggauacuuguuugcugugagggcugcucugcccucuguaggaaguuuagcaacaucacuggccucuacuuacuagaugccaaugguauccucucccuucuccccagcuguuacaaucaaaaaugcccccagacuuugccaaaugucccggagucucgaucaucccacucccaauugagaaccacagcucuagagaaauuuccaaaaugcugagcaaaauaaaacaugauaguuaaaacaagcagaacaauaccgcaagauucuggcuggcguuaaagaacaagcaaagggaagagggaucucaauggaaaggaguucguuuugucuucuugaguguuuauuuucuucuuuccucuucaguaauuggcaauaaggcccuuuuaauaacugguuuaacacuguacuccugauccccuaacuucauucccacugcugccaacaagccucauggcagaaaagaaaaaagcccuaguguuugacacauuucacaaaagcuguccuucaaagacacuugguugagaaguaauuuaauuaaagacaaggacaacagccugccaguuaaacucagaaacaccaaauaaggagggugcuacaguuucuggaaucccaucuuuucugcuacuaauaaaacucacugagcccagaguacuaaaagaauugucauaauguauucggggugugaaacugagaaauguucaccuauuccagugaaucacucuuccauaacauuugaaaagaagugcaguguacuccccuugggcaaacaccuguuuacaaacaggaacauacaauuaacagagacuaguuccuuuuacacccugugccaaauucacuguaacucauuuggcuucugccagaauuggauucuaauccuuuguucuagaccauuagcuauaaucuuuagcuucuuguuuguuacuuauuuuagcaaaaagcagagaaagauuuuccgcaaagaaaaacuggcacagaauaguuaauauaaacacuccccaaagugguaagguaauccacaaauggacuagaaauuuaaaugaaagucuaauuauauauacugauaccauauacucucaaagaagaaaucuauggaacaaaugaacaaacagguacauugggaugcuguucugaaaacuuuauucucaaaaauacuaaaagaagccuguuuuuaucuuuuacauuuuuucucucauucaaaaaaucaacuuuuuacauuuuucagauguguuccauucagccuuuccucggaugacuuucacauuucuucuuaaagagugauauaaacaguuuugcuaaaucagacauuuucuauaauaagcauuauucaaaaaacaaaaaagugcacagagucauccaggccagacaacugucucuuuuugucucuuuuaaaagcacaccugaggacuccauuuaaauuggauagugcugaucucagagcagaaccagcuaauugucucagagcuaaaagacuagaaauuaaaagccucaaaccuuuuccugauccugccacuugcuguguuacuugaacgucacuuaaccucuucggacuuuuauugaucuauaaauggcaacuauuuggcaaacgauagggugauuuauggaaugggcacuuuaagagcauugacuaaaagugguuaaauuaaaaguuaaguuguauuuuuaaacucuaaauagagauauugaggucuuuaacacucuuuucagacacaauuuccugaaaguuucuuuuuuacagauaaauauaucaugcuuccagacaaacuaaccuugaguucaaaaucaucagcuagcuaaggaaaauucaaaagacuuuucauccuaagauaccauacauguuuuccauauauucugugaaguauuuuaguguaaauuauaucuuauuccaucaacaaguaaguuucagaagguaucugaucucucaacauacagaaaugaauacggugacauuucucauugagugacuauagugacagugcuuauuaaaacaauaacaugaccaagacccaagaguccuuuuucuuugguacagagaaagucuuaaaaucuuacccucaggacagguggaauaaagguccugaaaucuuccuauccuauuucucaauauuaagagacuaguuuuguagaagcggaaacuccucuacauaagcauaagcuaauuuauuucauucuugacguuguucuuguaccucaggaaaauauguggucucuugccaauaacacacaguauuauaaggcugauugcuuccgugacucauuaaucagcaugucccaugcaucuuccagaaagaugacccucgguguaaacaaugucuaaagagacccacagaagccagagaagagggcaaaaggguaaacccuaaucucucucccaaaggacuagcuuuaaaauagucugacguacacguauggcccccucuuaggggccaaguagacauuuuccaccuugcaccauggugaccaaaucucacccccacuuacuccuugucccacuuaauuaauccucaucccacuuaauuaacagugcuacucauuuguucuacagauguuuucuauuuaggaaaaccaacuaaugaucagaaucaguuauaagaaguuaaucaauaauccuucuauuuaugacugauuuguucuauuuuaaaacuugaacuguuuggagauguuacaucuugucacuuuuuaaucaaaguuccaucugacacucuguaagagauguagggauauuauuuaguagcauccuacaacauucauggcuuuguuauccaugacagcaagccugaacuuuccauucuaucugaaagagacacuuauuuacccauaucuaggauauagaaaaaaaaauacuuaggggagaggggaaaaaaugaagaaaguccucguuuaaauucagguuuuguuuuuuuaacucaaaaacaaccauaaaacccaccuagaacaaagcaaaagagaguuuucuaauuaccacuuaaaaauaacuuuguauuagacuaauauaaauuaguacaggcacagguuuaagaggaaagacugaagugaagacagcaucuuauuucuuuuauuaucuaccuuuccuugcauucauuacaaguauuacagcaacacagccgccacauuguaaaugauguuuucuuaauuaaaugcacauuuuuuccuucauuauggaacaaauucuagaauuuacauucaaauucaaagccuaugggaaauucaacauuaccuagcaguuuaaaggauuucaaauuacagcucaaauuuguuuaaauguacauuauucccaaaucaguuccaagacacucaguccccaucccucuguguacuauaaaaauaucuguuauuucuaugauuaaacaaaaauuguucaccaaaggacacaaauauuacauaacacucacaucuuggcugaugggcuuuaugugugugcacaugcguguaggaccccaugccucugcuuugagagcuaauuuuuccccagcacaauaauuucauuaucuccacauauuccagauauuucugaaauugcuuguuaucaaauauaaaaggcaggcauagugacuuacucaauggcacuaauaaacaauuucuucuuuuuuaauaucguaacaauauguugggccaaauaagcaaccacuuaucauuaacagcucuguuaaaaagaaacacaagaaaggccaacccagauuuuucuuauuaauacaauccucuguaguucugaucuuugguuagcuggggacccaauucagacacggccuuuuuaaagaaaaucaguacccuaauuaccacaccacauggggguguuuucaccauugaugguuuuccagccucuaaugccauagucaccuguuaaucauuggugcggggauaguuuuggugaaguaaagccuaggaaaagccagaccaacuuugucagauugccuugaguagugggacaugaaggcaauauuuugaaauaggaaaaacgaaaaacaaaaaagaagaagggauaacuugucaagaauuucuuucuggguuaguaagcugacuuucuauaaaauaugaacaaauuuucuagucagaggaagauuuuaccuggaaaauuuucccuaaaaaauuaugaaggacagcaguagcccagaaucgcuaucucaucucagaaacugagguuuccugacagcaaagacaacuacagaggguggacuuugugucuuacguguucccucccacuacaguaccaacagcucugagguaccaccaucacguccauauuuuacagaugaggaacugaagucugaggaggucaagugauuugccaagguuuucucaucagggagugacagagccagggaacaacuguguaccaaguacucaagaacaauaaaagcagcuagcauuuauugaauacucugcauauaucaccucaaccucacaacaugauaaacuggauauaacugggauugcuccuccuuuacaaaagaaaaaugaauuguaggggaauugucacuugccaguggucuuacagcucauuggaacugcucuuacaccagaaagauaaacguuugccuugggcucugacuuuugagaggccagaaugggguccacuccuggccaaacuccuccccacagggaaaguugucuauaaaaccaaggggauguacaaagagacugcaccuucccuucuaaauauguucuuuuuagcacagaauucccugcccaaacugccccaagucuaccuuccagggccacuccugaaauccuuccccaggacucacuauauagcaggugugcacaagccuacauccaucuaccuaacagugcaguagccauuaugauugaggugucuugaccccaggucucgaaaugaaucaugauuugucugagccaaucaugauaaucccauccucuuggcagugaccuguuaaggaacuuggccuaagccacuuaauccuucuccaguaucaaagauuauuuccaaaauggacaagugauaaaauacaggccagagagaaauaaggaaaugucugcugggagcuucuuggaguuuauuuccucuaagaguaagccuuuggauagugugugcagcugugagguccagcacugccauagacaucucacuacuaccagccugagggagaaaccaaaacacagaggaagucaaagccaagugagugauagggcaacagaauagaaacuacuggauuaaaaacaacucugaauccucuggacuugcaguuauaugaacucauacauuucuuuauuguuuaagccaaucuaaguuggguuucaguuauuuaaagcccaaagcaucccaaauuaguagauucucaaagcccauguaugauauugccucccaugcagggcaggagaugggggaggaccagaggcagcacucacccccagggaagagaccccaaaggcuacuaagccauguuccauccagaguaacauguauaguugacacuugaacaaugaggggauuaaaggugugacccccacaccccgccaugcagucagaaauccauauacaacuuuugacucccccaaauuuaacuacuaauugcuuacucuugaccugaagacuucccaauaacauaaacagucaauuaacacauauuuaauauauguauuauauacuguauucuuacaauaaagcuaaagaaaagaaaauguuaagaaagacauaagguggcucaugccuguaaucccagcacuuugggaggccgaggcaggcagaucaccugaggucgggaguuggagaucagccuggccaacauggugaaacccugucucuacuaacauacaaaauuagccgggcaugguggugcaugccuguaauccuagcuacucgggaggcugagguagcagaauugcuugaaccugggaggcagagguugcaaugagccaagaucgugccauugaauugcagccugggcaacaagagcaaaacuccaucucagaaaaaaaaaaaaaaaagucacaaggaagagaaaauacuguucauuuaguggaaguagaucaucauaaaggucuuuauccucauggucuucauguugagcaggcugaggaggaggaagaggagcugguuuuacugucucugagguggcagaggcacaagaaaaugaacauauaaguggaucuguguaguucaagcccaugugguucaagggucaacuguauuuacauccagccugacacuaucagcagagcaaaggccauuuaguaccuucuucccuuuaacucagcugcuuugcugagugggguuaaaaaaaucugaauccuccacaacauaagaccaugcaaagagcaaaaagaaugugucuuaaugauaucaccacucuuaacccauaaccauaguuaagaccuagcaugauuuccaguacuucaaaauuucagucauauggaagauuuuggaagagaugaauguuuguauagcuagcaguaaaacauauuauuuugaaggaaaaccuuucuaaauuguacugccaacuccacugccuucuuaaauaaagugcacagucauguaacuuaaucuuuucuugaugacucagaagucaccauuaugaacaucaauugcuauauuugauuauaaauuuauucagccagaagaaauuacagacaggcagaaagcucuuuugaucccauacuacauggcuauaacuuuugcguuauuaucacuuuuauauuuauaguuuuuguucucuuucuucugauuacacuaucagugguuacuucccacuguugcuacaguguguucccauaauaaccuuuuuacccucaaaauuuaugacaucuacucuacuguaauuuuggaaauccacuaaacauauaaguagguauuuuaacaaauauuuaauaauagauauuuagugaacacuuaguauguuucccgaauuaugcucagagcuuuguguccauuaccuuauuuaauauucaaacaaccccauaagggacauaugaucuucuccacuagagaaaauaagaacgcugaggcuagaaagacauuaaaggcaaaguuccaagugaggauauacagcacuuuccuacaaguaaagugcaagaggcuuugugaacauuguuuugacuauucaaaaagcuguaguucuuggugagggaaaagaagggcugaauuucagaaaaagagagugucauuguggaaggacaaacuuggaaaugaacucaauucuauaagcuaauguuaaagagguaguucucagaaucaaacacuuaguaauaaacuuaaccaagguaguagaagacuuguacacuaaaaacuauaaaacauugcuaaaaaaaaaaaagauaaaaauaaaugagaagauauccuguguugguaagaucccuauaucaaaauuccacugguggccaggugcaguggcucacgccuguaauuccagcacuuggggaggcugaggcaggugaauugcuugagguuaggaguucaagaccagccuggccagcauggcaaaacccccucucuacuaaaaauacaaaaauuagcugggcauggugcugcacaccuguaaucccaguuucuugggagccugaagcacaagaauugcuugaacccaagagguaaagauugcagugagcugagaccacacaacugcacuccagccugggugacagagcaagacucuguuucaaaagaaaaaaaaaauguucccaauggcauauucugcaaaaacagaaaacaaaaauuguuaaaauguccacaguaccaaaagcaaucucagaguuacuaaaaucccuaucaaaaucccaauggcauguuaugcaaaaacaggaagaaaauucuaaauuucauauguaaccucagagaauccagaagaacaaaaacagugagacagaacaaagcuggagacuucacacuuacugauuucaaaacccaucacaaagcugcaguaauuaaaacaguaugguacuggcauaaagacagauauguagaccaaugggacagaacagagagcccagaaauaaaccucaaauauauggucaaauuaucuucaacaagggugccaagacuacauagugggugaaaauauagucucuucuacaaauaauauugagaaaacuagauaaccacacauaaaagagggaaauagggccuguauuuaacacuauauuaaaaauuuacuuaaaauggauuaaaggcugaaacauaagaccugaaacuauaauuuuuagaagaaaacauaggggaaaagcuuuauaacacugcauuuggcaaggacuuauuggcuaugacaccaaaagcacaggcaacaaaagcaaaaguagaacuauauaaaacuuuauuaaaacuucugggcugggcacgguggcucacaccuguaaucccagcacuuugggaggccgaggcaggcagaucacgaggucaggagaucgagaccauccuggcuaacaugaugaaaccccgucucuacuaaaaauacaaaaaauuagccgggcaugguggcgggcgccuguagucccagcuacucgggaggcugaggcaggagaauggcaugaacccaggaggcggagcuugcagugagccgagaucgcgccacugcacuccagccugggcaacagagcaagacuccaucucacaaacaaaaaaacaaaaaaacaaaaaaacaaaaaaaaaaaacuucugaacagcaaaggaaacaauuaacaaaaugaaauggcaaccuauaaaaugggagaaaauauuuucaaaccauguaugugacaaagaauuaauauccagaauauauaaagaauuccuacaacccaauaacaacaaaaaaacuaaucugauuuuaaaaugagcaaagaauuugaauagagauuucuccaaagaaaacaugcaaauggccaagacgcauaggaaaagaugcucaacaucaguaaucauccagaaaaugcaaaucaaaaccacaaagagcuaucaccucacccccauuaggacagccacuauuaaacacacacacacaucaguguuagugaagauguggagaaacuggaauccuugugcacuguugguaagaauguaaaagagugcaacugcuaugaaaaacaguauggaguuuccucagaaaacuaacaauagaacuacaacaugaucuagcaaucccaccucuggguauauauccaaaagaaucaaaaacaagaucucaaagagauauuggcacauucauguucauugcggcauuauucgcaauugccaaggggaagaagcaacauaaauguccauccaaagaugaauaaagaaacuaggguauggcauauauaugaauaucauucagccuuuaaaaagaaagaaauccugucauguguuauacagcauagacgaauacugaggaccuuaugcuaagagaaauaaaccagucacaaaaagacaugauuccacugcacgauucuacuuaugagguaucuaaaguggucaaaaugaaagaaauagaaaguagaauggugguugucaggggccgaccugacagggagugggagguagagaguuguuguuuaauguauguaggguuucagucauguggggaaugggugggucugagaucuguugcacaacaauguauaugugguggacaauauuguacuauacacuuggaaacaggaaggugaauuuuaugucgugugugucuuuuuuaauaucuuuaugcguuuguuugccacaauaaaaagggagggcgggauggaagaguaucucuguuauuggccaagaaugauacaauuuguuuccuuaauuccuaugguaaaaucacaagcauaagaaauacaguugguugaguucguuuauuucauuuaaauguuuuguuuccagguuacauacagaaagauauguccugaaaaugucuuuguacucuaacacagauacaugcugaccauuccaauaaugugaaaacuuacucauuaaacuuggcuuauaugaaucucucaaaaauaguaaaccuucaggccaucccaagcccucacggcuggcuuccuguccacacaggaagucaucuguccacccagcccccaagccucuccagggcuccgggccguaagaacuauuccaguuacucuagggguuaacuuagcuauuuauuggugaagcaugcugaguuccaaacagugaaauuacaaauuugggaaacaaaucuguccauaaauugggaauugccuguagccaguaccauucuguuagugauguauugucuauggcugguaauucacguacccccuccuuuacuacugcccuuacagaagccccagggaauaaacagggcauugcaguucuccccaaagucauccauucagggcugacaccccagcuaaaguagcagcaaaaaaacgaauuccacagcacaacuaccacgauugaugcccagcacaaggacucaggaccuggguuucuuccuuuucucucccuuucuucccuuguucaucucaauauuuauugacaggcagugaaacucuggaaccagacuacuggcauucuucucagccagcuaagagcugugugaccuugugcaaguuacauaaauucucugaguuugaguuuaacugcaaaaugcagguaauaauaccuacucuuguccucugggaggaaaugagucaauauauguaaagcacuuagaaaaaauugauacaaauuaagugcucacuaaauguuaacuauuuuucuuauuaugugccagggccuucaugccagggccuaugucaaauacuagggagacagcagugaaugagaccaacaugguuacugcucagggaacauuuagauuugcagauuuggcaccaguucugauacuuuaugaauaaacugucucagauuccuauucuuuagaaaggaaaaaacaauccuauucaaugcuuguuguugguuuagcauaaucaucauuaacauaucauuucaaugguacugaaugcuuacauuacagguauugggccaauugcuucacaagcuuuaccucauuuaauucucacaucaaaguccugagcuauacuaucauccucuuuuacaguucaagaaacugaggaacagggagauuaaguauaauaagauucaaauccaggucugucugacuuuguucuggaguccuaccccaugccgccuucagaauaguaaaugagagcccuugaaguggaaaacugccaaggcaaagggaaugcacucagacuacaucacagacaggaaaagacacgaucuggaaaaccaacccaagcccaauagaauauacaucagaaaggcuaggaaacaagggagggagagaggccugaacuggggcaauuucuagaggucugaacagagcugaaaucagaaaaaguccuugguuucccacacaggaaaccaaggcaacgcugcagcuaucaggacaagcagaguccggaaaacuagcggccaagaaucagaguggcagaacaucaaagaaggcaggaagccuucaacuuccaacuuacuggccagaacugcggaacacauccacucuaagcugaaaaagagccuagaaaauagauuggguguuuuuguuuuguuuuuuuacaaacuagguaucaguaaaacuuuugcucacccaauccccucuccacuagccucccuacuucucaaacaaaaguggaguccugcuaguaaugaaauuagauaacauguaggcaacccacagaaccugaacaacauauauccaucuuuccuuauucauugaaaucagcucuaauucuuuaauuguuuggaacuuuccaaaaauaaccugcuauauaccaagggcaaaagccaucaaaagucagcauuugugugauuuuaaaaucacaggaauucuguaacagauacacgacccauagcagccuucucagaucauuaaccuaaucauuccgcaggcaucaaauaaauauuuaacacccugauaguaaacuucucuaaaucaacacuaaauauuucuaguagcagauacguauuuuaaaaagucuuuuuggaaacaguuggaugacuaaccuaacaagcauuaaaucagaucuaaaacuucuauaugcaaauuuuuuaaugucaggacaauauucaaagccuauucaaaguccacugaagccaugacuccuaaaaaggcugauuauuuguuauuacuuaauguauuaaguacugcaaaugcucaguguaaugaguuuguccucugaaauccuaggucuaaccaaacugucuuccucugacaucuauuucuuugagaggugcccacuaugauugcuuccccgcagcuuccguaauuaauuguggaucucaagccucuuguugugauaucaaucuggggccaucuggccuagaagugaagggagaacacuaccaaucaggaaaaagugguauauucugguuuguuucuucuugcacaucuuuaacaaacuuuguuuuccuauuucuuccuccaugauaauguguaagaaacacaauccuaaaaauacuugcauggccuuuggauggaugcuucuaaggccugauccuucaauaauguaacauacuucuuugauuaucauauaaauucauuaguuucuuucccaccuaucuaaacuauuaaaccuucucuugguggcagaacuugccaccuuuagccaaucuagggugaaaugagccuagcagucaacucagacugaaucuguucuccacauauucaggcuuuguccagaugccagccggaagcccucugaagugcucaacaucagaaucgaauuggggauuggugugcuucagacaaaggaaauggaaaagcaaacaacccaauuucuuucgcuaauauugcucacuacucacuccauagcauguuagugaauaggcugaccaugaaaaauguugucucaucuuugaugaaugaaagaacugcagauaagacaaugaaaauggcaagaauuaagcugcuuucucauuuaaucacuuucuaccuuuucuggggcaaauaccaagcuuccaacuuuaaauaaaccuuaaaugaaggccucauucucuuuuagauagguuguuugaucauggcaauaggcaggugugaaauugauaccucauguuugccugcuuuuagacuugauauaaugaaguuaugacaucuuacauuguaagggaauuucaagcuuuuucaaaaaaaacagauuuaacauuugguuuaauuaauaauauugcuuaauaauuaaauguuaacuuaauauuuacuaucaagauauuaaccaaauggcaauacuauggacuaagaauuguaccuuaauauuagacauagaagcacaggaacuuuuggcucuaguaaauuauucucuuugcucucaaagacugaauuuuuaaggccuccuuuacucaccuguaaaguguugugacuaugauuccaugaugaaagaguuuuguuguugcuguugcuauuuuaaucuuaaggaaccauauuuuagaucucucacucucaaaucaaauaaauuuaagcuuggaguuuuuguucuuaauauauuacuugaaagaaugauaauacaauuauacauuuucugcuucaaaaaucuauuaauaucuguauuaguccguuuucacacugcucuaaugauacuacuugagacaggguaauuuauaaagaaagguauaacugacuuacaguuccacauggcuggggaagcccuaggaaacuuaaaaucaugguggaaggugaaagggaagcaaaaccuucuucacaugguggcaggaaaaaaagaagugcaaguaggagaaaugccagaugcuuauaaaaccaccagauuucaugagaacuuacuaucacgagaacagcaugggggaacugcccccaugauccaaucaccucccaccaggucccucccucaacacauggggauuauggggauuacaauucaagaugagauuugggcggagacacagccaaaccauaucaauaucauuuagauggauuaaaauaguuucaacaaugugauaagcaguuuaauaaacagagaacauuccaacuaauggaggacaacacaaacuuuuuauaccucaauuucucaaucuggucacugaggucuuauuauaaaauuuaacuuuaugcaucaacauacaaguaguuuacuaaguagauauuuaccaugauguacuggcauuucugacauaaaugcaauacauguguuccugcaaaacuucauguuuugcaaaauugcuaugaaaauaacagggcuuaugagggaaaagggauuaugagcagagcacucaaaacuuaugcaauucuguaaucagagcauuagcuaaaauaauaacaguucuaauaggaauauuagcacaguucaaucuccgcuagcauuugcauucagcaguuagucaaugcuuaaaggccugaaaacccaggcucugcuuccuccuacaggauguagguccuuacacagauucuccaagagagaccgguuccaucaaaauuuaaaaugugaccuagggauguaacuuauuguacagccuuguuccucuucuucuuccucuccuuucuccacucacuuccccucaacauacauguacuauuuuucuaaaugcggggaaagaugcacucugcccucccaacuucccuagacagcugaaaauuauggacaauccagccauuuuggaagcaacuaaaccagccacuacuugcccuaaaauaagagcuuucgcaaaauuuucaacuguauuuuaaggucugcauauauugauaaggcuuugucuucaguugugagcagggagaauagauuauacugggcauguccucuccaccagcgacagacuccaaagcaugagcuagagcuccuagaauaaaaagcaguuaguugaccucccaucaugcgauguucugggcucuuacuuaagaucacuaagccuugacccuggcauaaauccaagcagcacucauuuaguacacguucuuuggagccaagacaucuguguguuguaauaacaugcuacaaaagaguguuuauaucucauuuuaguauaaugugaacauuuaacuauugcaaaucagcuuucuauaaugacuaguccuuacuuaaaagauuuauuauauuuccaauuaaaguccuuagcaguacacaacaaauuuauaugaacugauuaagcuguucauuauggcagcuccagaagugcuuaauacaguaguuaaccacauuggaaaacagaaaaauuuaaaauaaucuauaucauguaaaauaacuaaucauauuuagugacuacuuccaaauaacuuuuuucauuuuuaucucccuaauagaguuaccguucuucaaaacugacaauaaagaaacaguuuaagaauagagaaugauccuugagguaucaagaugcagaaugauuuggauuuggggaagcacuucucuaagcccccaucuaagacagcaacaguggugggcaucucuauucugagggucuagugaaauacagaugugcaaggucauauccugacccaauaugcugcaccacagguaucacccuucaaaaggcaaaguugaaauucuggcuaggguugccucagggggaaagaagaggagagcaauuauccuucaaaccugaggagguaaugggaaaggucauuucagaggucagaggaccaauucaaacagcucaucaauucaaacaccuucacugauuuuuaaaacuauucuacuguggugagcacaguuugagcucccuguuucgguaacucauaaacucccacugaugacuucuuuucucaggcauucacuuuauugccuuaaacuugucucaaguaaaguaauuuuuuaaaaguuauaauucauggucacacagaaggggucuggugucauauguaacccauuuuggcgugauuacaaauccaugcuugcuaagacuacaagagaaugccaagaugaacuucuuacagguacaauagaagaucaacaaguuauuuucaucuuuuuuauuacaaaaacugcacgcuuauguguaauagggauuccaaaguaaagcaaaaugucaagucucuuuguagcaauuauuucacacugaucaaacaauuuuacaugcaguucuaugcaguauuaauaaaagcauguacaauugauauauuguccuugagagacaauuuuuaaagcauggaguccauagggaagaaaaauauagggguuucccggugggagugaagggcaugaaagacagcauaucuggauuuaagagaaucccagugacaaaauuaguccuccacuagcuacgucucagaauaugaaggaauuaacuuuuccagauuucucuuuaugaacaagcagacauaaugacaagcaagucuccuuuuccauuuccaucuuucuaucaaacaaaaaucaagucauucucaugaacaguuaggauugaaggguuuggguuuuaagauauuuggcuuaaaacaaguuccauuuuuaccaaaaucaaucuccaauucauaaauucuugguaauggugccaguucuacuacaaaguagucauaauuuuucacagaaaugaguacaugaucuacccauuuagccauauacaaggugugacaguacaauaaugagaccgauuccauaagccagucauaaaaaccaaguccauuaacuuuucauacaugacauauaagaugccaaauaugcuuuauguuuccaauagacuuccucaguuuucaaagcuauuucuaaggaguguuuuuuucuuucugucuauauuuacacagugugaaaauuggacaaggaccaaugcagguaauggcugcuuauaacuauaagcagaccuggguuaacuaaagaaaucugauaaacaccaagcuaaugagaccaaaaaaaaggugaucacauuaugcuuaaugcauacaccuucuuugaggaacaauaauccuuauacuuggcacauuuauaguggagcuucccaucaucacuguugauuugugaggugcuaauuagcuuuucuuucucaaucagaagaaaguaauaauuugucagaucagaaugcacuugcuuccauuuuaaucaauuguaaaacuuuagcuuacuauuuuaaaaaacacuuucuaacauuauuaauguucaccccucaauuccacuacaaacguaauaauuugaugaaauguuuccaaaguacuucaaauacaugccacugauacuuucuugagaacauuuauuuuuaaaaguucauaucuguauucuacaaacaacuuacacaccacaaaccacacugcucauucucuaugauuuauuuuacagccugaauuaugcaaaauauuguuaucuaaaucucuuuccuggucuuuggcaaacauaauaugauaauuaguaucaagggcguuuagaccaaguguucauggauucaacugucaaacugacugaaaguggaaauuucuuagaagcauacgccagcagucaggcacgguggcucacaccuauaaucccagcacuuugggaggccaacgugagcggaucaccuaaggucaggaguuugagaccagccugcccaacauggugaaacccugucucuacuaaaaauacaaaaauuagccaggcaugguggcgggugccuguagucccagcuacuggggaggcugaggcaaaagaacggcuugaacccaggagguggaggcugcagugagccaggaucaugccauugcacucuggccugggugacaaaguaagacucugucucgggaaaaaaaaaaaaaaaaguauaugccagggaugguugaaaacauugcuguaauugaugggcaaucuuugagauaaccuauaaaaggaauuccuuuaacacauccuaaacuuucugagcuccacaagaguccaaguccucauaauggauucuuaggaaagaaaucaaaucaaaaagguaaugagauaaaacaaaagucaugaaagcauacauuaguugcaauuaaauggguuaacaaccaugcaaacauuaacuuccugauuuaauagagauauuauaaauauaagugcaaauguggguuuucaagcuucauguguuauuaaccagaaugcucaagaucucagaaagaacauucuaaagaaauagacauaauuuauguaguaauaauccaaaauaucauuaaaugaugaauuaaguuuccacaagguauuauugugauuuucauuuuaugaauagaugaauuaaaacaaugaacauaaaaaaugaauauuaaauauuuuuugcaaaucaaucuagcgucucgccucaguuugcauccugcucugucugagcccuuggggauaugguuuccaagauuugaaagauugaaagaccuuucuccccacccuuuuauuuuauuuuuuuuuuuuggccaucuacagcucauccuuuccccaaaacccagcucauacacacaaauagggagcauuccuggauugacuccacuccagccuauguugaugauucuuuuacucugcuuucucucacaauuagauauucuacuuguuauauaacaaucuauauccacucgauuauugcuuucaugcuuaguaauuuuuuccauuuaaacauuuuucuuauuuuauuauuucuguugaaguguucggaaaaugcacagauuuuaaguucucaguucaaugaauucugacaaauauaucuaccuguauaaccaauaccccacuaaaaauauggaauauuucuaucacccuucaaaguucucacauuucuuuuucuaguuaaugccucucccuccccaaaagcaaccauucuucuaacuucuauugcuguugaucaugcccauuuauuaaauuauaaauuauaucacugcuaaauggcauacaccaugcacuagaucuuaugcuucauaugagcuugggcuaccucgugcaaugguauacugauggacucugaaauuuuuccauauucaaaaauucccuauguccaacaucaacuaacuuaaugugcugugauucaguacguuuuuagguucuuaauaaaugacuuguuuaggaaugaaauucaaaauucuggcagcuucccuuucuugaccucaaaccuuuaagcacugccucaauaaaccugagugcagccccucaaaauuguaagcuguggcccaugaccuuccaugugcuacacaguagcauccccaccaagcaccauugcauauuuaauaaauuuuaucuguuaaaaggaaugcccccagcugucaugcauuuaugaauauuuaaaacuacccuuucuuuagaaaacaaaagccaguaagaaaauagggaugacuguuacucugugcugaacuaagaacauauaccauguacugaugagggcaaaagagaccaaaagaauguuaggcaucauuuagaaaaauauugauaacacuaauaucucaaauuuguaugguacguuauaacuuacaaugcaccuucaaauaaguuaaauuacacaacucuaugagauaagcuuuauuauuuccaaccuucaauggauggaacuauggcuuagaauuuuuaugagucuuuuccaagaucaagaguuuucauaagugucuuuuccaugaucacaaagcuggaaaaccgccagcccuaacgucuaagccuuuuugcaucacacugcaaggaaacauuaccuuauuucauaucaaauuucuccugguauacaguguacugcucuagacaagcaucucacgcaaaacccaaacacuaagguugacucacuugccuugccuaccucacagucaaguccuugugcccuacccuagguaucagaaaagacagauuuaucuuuucuuccucuagagagaaagguuuuccuuuaacaauugauaaaaggccgggcgcaguggcucacgccuguaaucccaacacuuugggaggccgaagcagguggaccacgaggucaggagaucgagaccauccuggucaacauggugaaacccugucucuacuaaaaauacaaaaauuagcugggcgugguggcacacaccuguaaucccagcuacuugggaagcugaggcaggagaaucgcuugaaccugggagacggagguugcaguuagccaagacugcgccacugcacuccagccuggcaacaaagcaaggcuccaucccaaaaaaaaaaaaaaggugauaaaaaagagaaaaaguggaaaaaguggaugugggcgcaggcuuauggagacaggaaugcuucagucugaaauaaugaaagcugagaagagaaauguagaaaucuaugaaaucaugggucacaucagaaagacaauagcauuucucccaaauuaauauaguaaaauggaauucuuuaaaacucagagaaauccauuugauacaugcaaaaaguaguaagagcucacauaaucacuaaaaaaucacaauaccccaugagauaauucuugcaagaaauaaacugauuccaaaaggagagagcaaauauaggaauagcagggccaugugagcagcaguaagaaaaggugagauaguccuucccagcuggcccagggaaaaaaacuagggcccggccuagcaugucacucagaccugagcuggccccaggcuuuagggcugaaggguccauaaagcuugaccaagaauacaggcauuuuuggcuguuuguaaaucagcccaaagcuugaacacucuguguucacucuuggugacuuaccuaccaaagcacugguaaagugauaaaaauccuguggguaccuaccaauuaugauaaacuaagguuguaagagacuccuucaucagcuuuagucaugauaacuugcugaacuaacuguuccaauggaagaagagaauagcagcauaugagaacauucgccagcuuugugaaaugaauauccuguguucuuucuuucucagcauuguguuuuugagacugcguuaaauauuagcauguauauagcccaaguucuuucauuuaacugcucuccaaauacuguaucuaauugugcuccuacaaguaguguaugggaauuugucauugcuccauguauuugccaacacuucauccuaucagaaauuucccuuuuucuucaguuugauauguaugaaauggauuuucccuauggguuuuaauuucuacuucucugauuacuaccaagguuaagcaucuuucaaugucuuuuggcagcuuacauuuucuccuucagaauuuucuacacauauccauugccuaauuuuucuacuggacccguuauucuuaauuaugucggauucuuuacauacuccuuuccugguagaaugaauuaaaaauaucuuaucuuaauuuuguaccugguuuccuuuguuauacaaaaguuauauuucaauuuagucaaauuuaucaaucuuugauuuuaaagguuggcugugcuuuuuauaacuugcuuaggaaguccuucccuacccugagguuaaaaauauaagcuucucccuuuucuuuuaaaagguauauguuucccauuuaggcauuuaauuuacuugagauuuauuuuuguuuaugguaugagguaaggauccaauugcauuuuuuauauauagauagccaauugguuuaguucugugguauuuuaaauaaaaacaccacaauauguucauuauggcccuuaucaccagguguuacaauaugcuuuucugcauuuuguugacagugaguuagaauuacgaaagagagccuauguguuuuucauuucuauauuucaaaacuuaacaccauguccagcaaaaauguugaaaaaguugcaaaagcuguucaaaacagcuguacaaaagcugugggguuuuuauuuguuuuguuuuugcaacggagucucacucuguugcccaggcuggagugcaguggcaggaucuuggcucagugcaaccucugccucccggguucaagcaauucuccugccucggccucuugaguagcugggauuacagguaugcaacacaguguccggcuaauuuuuuuuuauuuuuaguagagacggaguuucaccauguuggccaggcuggucucaaacuccugaccucaggugauccgcccaccucggcaucccaaagugcugggauuacaggcaugaggcacugcccaaaaacuguucuuaaagauaugcuggacauauacacaguuaucuaagaagcuaugacuucuuguguaguaguaaucuucaauauaaaucaaucuguauuuccagguaaagaauuuaugugaaauucaaaagaauuuuccccucagaauuggaaaugugucugacagauaacacucugaugcuucucuauauauccauuaaaaauacccuggaguuaaccugauauagcacuuggcucuauuugaugaucacucucaggucgcuguuuggaaagaagacuggugugggagcagagaggucagcugcguggccuuucacaaagggugagccaugcucugacuccaaagagguuaaaugccaaggcaaguuucaguuaucuuaacucaauuuaccucaauagaaauaaccuaaauuagaugguuucuaauuacccuucuagacaaggauuaaaugucugagauggggcuaaagcagagacaagcuugugauggacagauagauuccaaaagacugguccaauugacacuuaaaagcuguagaugguuucuuuuuccuuuauucaaucccugauauuuuaaaucauauauuaaauuuccucacucauguacaaaucucaccaccaaaguucauguuaaauaaacuaugucacaguuacaagucaaguuacacagaaauuaucucagauggcuaaugcuuuauaacuuauguguuuuauacaguauuccaugcuuaaguaaauucaagauaaucuggaaaacauuuaucuggcaucuauuaacaaugagaacacuuacuaacauuuagggauaucagugaagaagacacguccccuuccguuaaucagcucacagcuuuguuaacaaaacagauguguagucaaguaauugcaacacagcguuaucaaugccauggucaagguggaucuaaaaaguugauggcagagagaacagcuugacuucaaagggaguuaccaauggaggugagucuuaacaaauaaauucauuuuaaauaauuucaacaaauucagaaccuuugguuugaacuugaaaaacaaaauguuuuuauucauuauuucuaauaugaguuugagauuauaaauaauguaauuacaaguaucaauuauauaauccuuaggaaacuaacuuucugaggaaugaucaccugaaguuagaagacagaugauucaaaguuggggcagugaucaaggggcuauuacauuaaucauuaauaauaacaaaguaaagauuuuaaccgaugagcaucuuucaucaaguacacuacaacacacuuauuucacaaugcaaaaacaugaucuaaguucacaucaccagcaauagcaaugguguauguuuugcuacagggcucccacaucucuaggauucagggaguccuuaaguagcagaaacacaguagguaauggcaaaccaacaacuccugcuuaaguagggcagcccaaacuguguuggcuccagcuuuaguacagcaaccuacuuggaaguuagcgagcugaccugucuuaaaguugcacuugcacggcacuuuacaaaaaagacuacaaauacguuaauucucuaucucaaagaauuggggaaggcugcuaaaggucaugggaagaccaaagccaccucccccaaguaaacacuuggugauaccucuagcccaaggaauccacugguaauucuucagaguacucuugcuucacugugaggaguggcuaauauucagcacugauaauaaugaacacaaaaguuuucacauaucugaagcacaagggaccaaaaacucagugucacaagagaacacaacaaacccuccuggaaccaacugaauggccuuuacggaaaauauaucuccauaaaauaugcacugcuauuuugugaauauuaucuucauuauugugauuccugcaaauggggcaaacugguuccaacaguugcaaacacaggauauugccaacccacauacuaugcuugguauuuaauucaguaucuauugaugcaucuauauugcaaggagaagacaaaaacauuuuugaaggcauuacuuuucugagugcugcauacuuaauagaguccuuggucuagccuuaaccuuccacauauuuuacauacaaggauaagaaauuaacacacuuuuauuaaggaacaucuacaaaagggauauuuuacucauuauucaauucaaucuuugagguaaugucauuccucauuaacagacaagaaauuguacucacaaaguaucaaagauuuaacaaauccuugauauuaacaaaguucauauagccaguaaacauuuuaaaaggucauauagccaguaaauuuuauacauagaauuuuugaugacuccaaguauucugauaaucccuaugcuuccuuuuuccucccuuuuaccaucaguaagacaucgaccaaugcagaaccuacagagaaguguucaacuaaaaagaccaccaaucaacugaccuucucaacaugcgguauuuauuauaccuaaauuuuaggguuaguuuauaauucaauacaauuguauuucaggcaaauugggcagaggaacagaaaucauuauucauuuuauguagucuuuauaaaggagaugagauuuccuaguauugcauaaaaugccuuaugauagaaggcuaaaaugaaguaauggagucacaauacuuuaauuuaaacauuuucuuugaacuuagcacuuucugcauauuucaugaggucaaagccgcaauauuacauuaaauucauauaauaucaugucaugaccaucauuguacauuuuagacuccauucuucaagaugcaaauaagcauaugagcagcaguauguuauuucaaacauaacuuguuuugauuagauuaccuagacuuuguacuaauuuugaaauaauuguaaauacaaaauuaagucacuaaaugguucuaugaauggcuaaaaacacaggugaaacacaaugagaucucaguuauuacugaugaaguagcagauagcagcucucauuuuuccacagcagacuuacagaacuguuguuaucugucugaaugcucagaccccuacaccauauuuccguucaaauauuuagcuacaggaucuagcaauauaaaucaucaaaaauuacacacuaagaaaagauagcccaccaaaaugucagguggcuuuuagcacuagaaggcuaucuauugaguugcuuugguuguuuagcaaucuaaugauguccuaacuugucuauuuuaaugaauauauuacuaaaaagacagauacacauuaaauaaaaaaaaugacuuuacagcaacauaagcuaaaacggaguuuuuuuuuuuuuuuagcaaacaggaaauuagaauucaguguuuuuagaaaguuguuuggcaauauguaucaagaguuuuuuaaaggcuaauauucuuggcccauaauuucacuuccagaaaucuauccuauggaaauaaccagagauauggucaaagauuuauaaaugaagauauccaucauuauugauaaaaaaacuaugaaaaaauauuugaaaauuaagaaugguugaaaaugauacaauaauauaaacaauuauauguucaccaaaaaucaacuuuuaaaaauguuauacggcaaaauaugcaucauauaaugcuaaaaaucaguauucaaaacugcauauacaacaugaacuuuauuauuuaagaaauaagacuagaaaguaaaaucaacuugucaauaggaugaugaaaauacagaugaauuuauuucccuacuuauacaguucuaaguuuuacacauuccaaauuuuucaaauuuuacauaaugauuaucuguaaaauaaaaauauauaagguuauauuuacaucagccucauauuaaucucuuauuucauuccaguuggcaccaacaaaauaaaaaagaucuacucuacaaagaagucucuucuaugaaugugaaacaaaugcaaaacaagacuagcugauccagaggguucuugacauaauugugucucucagacugaauacuaaugccgauggcacuaauggaaugaaaccagaauggcaugaauaauacauuacuugcacuaaucaauauuaugauguuauaagcugauggaaaaaaauacucagaauaaaaacagaggaagaacuuucaaaugcaaguacagucuagaaaucuaucugauaucucugcuggaucacgguaugggaaaauuauugcaacucugccaaaacaaugcaaaaucaguaacaauuguugcuuucucauugccaaauuguccucuaccaaugauguauuggaggaaaggcauuauacagaugacugugauugaagguaaauuauugauuaauauacauguguuuucauguaacuauguauacccauuaacgaaagacuugugauaccagcaaaugcaaaauuuuaauugccuaucucugcaauuaguauaaaauuauaugccauauguuaaagaacagaaauaaaauauauaaaagaguuaauuauagcccacauuacccauauuccuaaaucaagugccuccuagcaugugguacuggaggaaaugauucacaguuuucagccuuuagguaaaguggcuaggugauugauggaccaugccucaaggaauacauaaacccucucuuagucacauauaugucaguuccuuuucaacugagggucugaauuauagacuagaucagugccccaggagagaaugagggagagaagaaacuagcagguaaaaggauucuuaacucuaaaaucauguaggggaaccuuuuagggcauaacguuccaaauaugauacaaaugagggaaaauaccuugaaaaaaaaaaggaaaagcaugcuuaucauaaaaacuugccuagaaauauuuguaaauaacucuucuauaggccuaauaaaagcgauauaguuuggauuucaaauuaucuuccauuucgaauaacaacauagacaacuuuucuuuucuaggugcauuuuuuaucugcuaaauuauuucuucuaaaacaacaaagagauaaaguugucuuaaugauuuaauacuuuaaccuaauggccaaaaagaacaccuuaaauuggaugauauuagcuaguuuucuauggaacccuuuagguuugucauaaaagaaacagaagauguauauaaucacauuauaauguaauuacacugcaaaauaaagaguuuugagaguaauuuaagaaaaaaaaucagcugggcgcgguggcucaugccuguaaucccagcacuuugggaggccgaggugggcggaucacgaggucaggagaucgagacuauccuggcuaacacggugaaaccccgucucuacuaaaaaaaaaaaaaaauuagccgggcaugguggcgggcaccuguagucccagcuacucgggaggcugaggcaagagaacggcgugaaccugggaggcgaagcuugcagugagacgagaucgcaccauugcagugagacgagaucgcaccacugcacuccagccugugcgacagagugagacucugucucaaaaaaaaaaaaagaaagaaagaaagaaaaaaaauccuggcaaaaauguuuaacaaacuagaaugaguuucuuagggauauuauaaaauacucuuucauugcugcucauuaaaaggacaaauauaagggacuuuucaauugacaugguaacuaucaaguggugcuugauuugcucuuuucuccuauuucaauguucauucccucaaaagcauauauuauaaaaagaugcccaguuacaaagcagugcaaaguaugaacauucaugguguauuaugucgaccacacaucaggaguaauuuccauuaaacauauggcucucuuucugucuuaguccauuugggcugcuauagcaaaacaucaaaaacaaaauaucacauaaaucugugacuuauaaacaacagaaaucuauuucucacaguacggguggcuggaaauuccaagaucaaagugcuaacaauucaaugucugaugacagcccuauuucuaguccauagauggcaccuucuagcuguguucccacaugguaaaaggggcaaggcaaccucuggggccuccuuauggaggcacugauccuauuugugauagcaccacccucaugaucuaaucaccucccuaaggcuccaccuucuaauaccauuacaucggucauuaaguuucaauauaugaauuugggguuggugggaagggcacaaacauucagaucacagcggacucugacuaggauagccacauuuagcagagaaggcuggaaguucaaaaaagaguuccaccaaaauccacugccuuccccuagucaaaaaucuacaucaacccaaacccagaaugcuauuagucacuucuuuauuggacaagaacagcuuucuuagguaaccaguaccauuuuuuuuuuuuuuuugagacagggucuuacucuuauuccacacucccaggcugguuggaaugugcaguggcaugaucuuggcucaacgcaaccucugccucccaggcucaaguuauccuaccaccucagccucccaaguagcugguauuacaggcacacagcaccaugccugucuaaguuuuuuuuuuuuuuuucucacagagacaggguuucaccaugcugcccagguuagucugaaacuccugaguucaagcgauccacccgccucagccucccaaaaugcugagauuauaggcgugagccaccaugccaggccaguaccauugucaaaucuuucucuucucccucacaaacaccuacggccaacucuuuucauauucauugaagacugcaaaucccaagugugcaaacagccaacaagggagaggcagacaugcccuauuucuuaugaucgaaacacucauuuauuaaauguuuauucaauuuccacuguccauuggccacugguggguaagaaaaacauugucccagauuuuaucauauuuuaaauccacaugagauugauagaggaaagaagcagagauaaggaaaaacaugaaggauaaauucuagaauuuggacuuuuauccacugcuuucgauaaacaaggaacuagaguucccuccacauaagugacuaggccacaaaguaaaacaagacuuuguauucucccagaagaguacccaaguuuccucuauacaacaaacacuuacugagauacuauaacauaccaacuauuuucuagaugcuagggauacaguagagaacaagaaaaaagcugcugaguccauggaauuuauaucuagugagaacaaacauaauuauuaacaaauaaauaagaaaaauguuuaguagaaccuaaguccuaugaagucugggaucuucuuuuuguugacugaaaaauccaaagugccuaaauacuacuugacagagcagacucucaacaucuuuugaguaagugagugaauacacgaauuucaguuaauugguuguagggagaccauaucuagcuuuuuucacugcugcuuuuuaauugcuacacaucuguguuagucugcuuauugguaacagaacuaaccuuauauggccaccagccugagcauguaguccagguuggacccauccuaguagcacucucccugguaccaguaagacccauagaccaauuuuuuuaaaucgaccugacuucauggggaaaagacccuuuccucaugggccacaagcuaaugcaggcuuagaacuuccuaaaggcaacucucccuucccauagagaagcuggucucagaaaaaaaugaaauucaaacaguuaacaaaacuauagguuuuuuaauuuugcuauuuggcaaguaaaguuauucuccuaaacagcuacuaugaaaccacugcgacaaaacuaaaucaauauugaaauuacagaguaucuauaaaaacauaaaauuaauaaaggcauucauuagucaaccaucuaccuuuuagguacugugcuaugaacucuacagaaaaaaauaaauaaauaaauuuauuuuuuucaauucugaaaaguaaguauuauuaaccccauuuuauaaugcagaaacugaggcucaagauuauggaauccauggcaggauccuaguaaagaucuagcuguuuccuaaaccaaugcuauuuucaccaagccauacugcaacaucaccacacuuaaaugugguauguuggcaaagccauacucaaacacaaauucauagccuuaaaugcuuucaguguucuuaaagaauaaaaauaaaugauguaaacauuaaaguaaaaaguuugaaaaaggagcaaagcaaaucaugguaggcaggcaaaaggagauucagaguacaaugaauuagaguaacugauaacuaacacuucuggcugaauuuuuuuuuuuuuuauuucaaggcaaaagcuacgcaaaaaaggggagagaguggcaacacaaaauuauaaaauaaaaggagauauagcaacaaauagagguggccuuuuuugaaaaagaaaacugcuacacauaugccaauguguuccaaagugugcuuccacagaaaguuaauacaugcuccacuaaaaaaagcacucagugucuaaguuugggaaaugcuggacuaaacaaagugagcaagcuauuucuagcacucuaggacuuuaccuagucuuuaacaugcuuauaaguguauuguuaaucuccaaaagauauaucauuugaccacagaaucauuucauagaauauacucuucaaaaauauuucaauauggaaaaaugcacaaaauguauuuacaaagcuagccuaacaccaaugucaaaaaauuucuaacaaguagcacaacaacaaaaaaucaaugcaaaacuaccauaguagccuguagaggcuaauuaaacaauuauguauaaaccacaagaaaacuaucauaguuauuauagaucuguauauuaauuauuauucucucuuuguuagaacucucacugaaaaggaugucaaggaaagcaaaguuuaaguaucuuauccuuugucaguugacaucaggaggacaagauaguguugcaauuuuccauccucagcuggguuucauuuagaugaggaauguguacccuauaaagccaagucaaucauguucuucaguuugaggggguggaggaagagagaaaagaauaauuaucuccuguuuugcuuuuuaaaaugucauaaauacucccuuuacuuuggacugcacuaaguucuggaaacccauaaaacacugaggugugagaaaaggaugugcaguaauccauuuuaucuauauuggaacugucaauaagggugggucuaccuuggcaauaaaauacuuuuaaaagcacaauaaaauauuuaaaacuauuugaauucggcauauugacucaaugggagauaauauccuagaaccacaccugucaaaaaucaauugcacaaaugugacuaaaaucuauccuacuauuuacuuggguauuucauuugcacaguagaaugaacacacacccuguuuuucuaugacagucuggacuauaccuguuguucuggugcaauuauuaauauuguuccccuuuccucuccaaaaugucuaguuuggauuauaacuacauggucacccucagcucaagccaaauaaugccauaaaacuuuaauuuggcagacgguggaggggaacagagaaaacuggauauugaagucauacauacauacguguauuuaaaucacagcucuaauuaccuggccugggggugaucacuuccucucugguuaucaguuuccucaugcauaaaauaaggauaauaauaguaacuaguuagggucauuaugaggauuaaauaagaaaauauccuacgcuuagcuacacaguagcugguguuuaguaagcacuccauaaaugauagcaaugaauauuauaagaaccaccucgaagagcaucaaauuucuucacauguaaauuucagaauaaaauaccaaaauccugaauaauaugaaugauuacaucagaaaacccguguaaacugccaagcagaguaaauugccuagucuuucuuucccuaaauguacaagaacuguaaaacuaauaauccagcaccauuugguauuucauuauauaaacaaauucuacaccuggaaaaaucaagcacagaaaagaacaguagcaaaacauaauugauaucuagucaauaaaaccuaaaaggaaaucuauaggaacugagauuaauuggcucaaaggagcaacauugccaggaaagucaauaguccagacuguuuggaagaugcuuaacuuugcaguccuguguuuucuccauucuucacaguuuugccccagccacucuauucuuaucucucacccuacuccacccaacccuucaggaauugugaaaggucuaagauuuuacuguaauugcaaauuaacaaguuuaucugccaugguuucacggaugcuugcaaaagauucaagacugcuaggucagaagcaaaagauuuuacuacuuaaagcaacaagaguacccagaacaucagcauuugugccaguucccugagcccagauucccacagguaaugugaaaagggccaagaaggugacaucugcacaugcggagggguuguguuacaggagaagaacccugagcuuagggaacccaaaucuuuuauaauggucaguaaucaugcuuaaaccuuguucuggaaggauuaauuguguuuguuguacuagauaguaaacaaccuacccucugcucugcagggagauacuaccucuguugucuaaggguauucucuauaaaauauccuuuuugaaaauauaguacagaauauaguacagaacaaaggcacugacuagucccuccgcucacaagaugcacagaaacaaaagacacccagcagaauugucucccaauaccaacuaggcacucauggaauguucuccaauccucucucccugaccgcuccucucaagguguucuguaguuaaauuaaggaaauaguaaacauaguuuuuuaaaaaacuccguuuuuuuuuuuaaagcagaacuucucagauccuuuaacaaccgaauguggcuuagugaauccccagcagaaggacacagaaugcagugcuucaaaacccauuuuuuacagaacaucuauuaauaucucccagaagaauauuccuuggaucacaguuugggaaaucuggggagaguuuauagcauaugcccaacaccaucauucucucuuguacaagguuagcuaauauuuucccauuuauuuccuagaaucccaaauccacggggaaguguuuacauaaagaaaugcucuuuaaaagcauuaaguuauugaaggcaaaacauuacagagucccucuguacaacagaacccuuuaaaauaauugagauaauguagguaaagugcuuagcaauagcuggcacucaguaagugcucaaaaaauagcagcuauuauaaguauuugccauuuuuaucauggugcauuuacagaacccucuuuguuguaacacacugaauuccuauuauaaguaagcugguguggcuguaguaacaucgggucaugacuagugauuuuuccuucucuaauucuacucccguacauuuuccuacaugcaauguuuccguucucuucaugccaauauuuuacuccacaaacuggaccuuauaaacuucuugguuuauuuuagucuaaauuugauaaauguuaccuaaagucagccuuccuuuugguuuuauuuuaauguaaaaaauuagauccacauuuguuuagaacuaauucuaaguuucuguuugugcuuacuuuaguuuguucucuuuuaacaugauugccacuguaaggucaagcuggaucucauaagugagcagcaaaagacacuggcuuagguaucugaagcucaacacuaaaauaaaauacagcaaggcccacuugguauuucaaaaguaagacaauagcaucucugcuuaacuaggucccaaaagaagucucuuaauuccccacuucuuccaacuccucucauaacagcgccuuuaguuucugagccuuuuaaggaggaaagaccagacacgcaagcugcuguccauuucgacacagcauccaucaccugacuagacugucucucaaaaaugugccuguuuaugagaacacauggacacagggaggggaacaacacacacuggggccucuggagggggcugugggggagggagagcauuaggaaauacagcuaaugcaugcugggcuuaauaccuaggugaugggcugauaagugcagcaaaccaccguggcacacguuuaccuauguaacaaacgugcacauccugcauauguacccuggaacuuaaaauuaaaauaaaaaauuuuuuuaaagugugccuguuuguauuaucaucauacuuuaaaauaaguaaugauaaaaauuaauaauaauaauugagcuccacuggauaaaguggggucuaaguagaaagacuaacaaugggaucuauaacuagacuguaaguuuagacauaggguugggaagggaggagaacuucuccauuuauguagaaugguagauaacaaaauggcacaggaaucaaaauaacccaauacucuucuauguguuuacuguagauuagaauguccuuagauaagugguuuuccuccucacugcucaguuucuugucuguaaaauagaaugugaucacuuccccuuuauuucauacuuuaggggaagaagaggucaauaaacauuuuuaaaauauuaauuuauauccaaaaaaucauaaacuuuuuaaauuuuuuuaccauaacaugauggugaguaucuacuugcacaucuguuacucugagugaucaaaucucuuaaguuauaacaggaacuucaguuacuccauauucuagauccuucuuaaauagcagcuaaacaaggaaguacauuuccauuuccauuaaaaaaaaucuuauaauuauacggccaucaguauaaaagaagaaacccccaaauaagaaauuucauuacacuauggucugcauauuaaaauuuccuacaaaauucuguuaaacccucugcuuaaagucuuauuacaugugcuuuuuuuagauauuuuuaaauaccuguuucugguaacaggaacuuuuuuaaaaguucauuuugagauauucucuuacuaguguaguucucacacauuacaagagagaaggcugccaggcauuuuccuggacccugccucagaaucaccagggaaccuuuuaaaaaaaacaucucuucucguuugaaauuuggugagucuaaggguggagcucaggaaucuguauuuuuuaauguuccccuccagacugaacccaaagcaaauuucagaacuacuaaagugucaaauguauacauuucaagcagcaucuagcuggcagcagaaaacuguucuuuggaaaaggaagaguucucuccuuuuauaagaauagaaaguaaucuucucucuauucucuggaaaugauaagccaaguuuuccuauauucuuccauaaucaccuugcuggaaccacuuguucuucaagcaugaaaucaaaaagauagaauuuuuuuaaauauacaauacacauaguguauguguguguuuuuccagcuacaaggugaugagaaaagcaaaguucaucauuaguuaaugucaaguuugagacagacuguauugcugguggccggagcaaaaaaaugccacugaguagcugaaaacucaaaaaguguccuuuaaaccaaucaagaaauuaauugaaaguuuaguaaaauuuacugaacuuucuuuucauuuuauuugcuucacuucaaaaaggaaucaaagugguccuuucacuuucccaccugggaaaaagcuuuacuagucagacuuguaauuuuaaccaaaucauggcuacccccugguggcugcuuaccccaauuacaagguuuuuagagagguuuaaauuaacauacugaaagaagacuucaaguuuugucuuugaagaaggaacagaaacuaaauuuggucucgaaauguccugguaugcucauucuuguaaaguaaugaucccaggccuuuaauuuauuuccuggggcaccuauaauuucugaaguuuacugacucugaauuguguugcugaaacaaugcaagauuuuuaaauacuuuuuuuuuuuugcuuucuacauuuauauauucuucacacaucauaugaaaggcccucuuaauccuagacccugcuaccagaagcacagugugcacacccgugggcccugacucaaaaaccuuuguuuuucucauccccuuauagcuagaaacacacacacacacacacacccccaagguauacauuuucauuuuaaaauucuaucuuuuugauuuugugcuugaagaaccagugguuacagcaaggugauacaugccuccccugcuguauucccacaggcuccaggcugcuccugaccccagcagcagaggcagauguucucugcuauggaaucggguccgcacuugugcuuuuguggucaaucuuaucacguagccaggccuguuaaugucucagccccucagcagguagcuucuguaguaucuuuaacauggcuacagcuuccaauuuggcugacuuucuaccuccuaaaucagcaaaguguuccgaucccuggcacucaugaucacuguccuggccuguuuggaaagcggcauucaguucugauagaagggucauugaccuagucaccccaaguucucuuccagccaguauuccuucagggacauucaugugccagacauaauucaaacagaugugcucauauauaaacuaaggccaggcacggauggcucaugccuguaaucccagcacuuuaggaggaaaaggcgagaggauugcuugaggccaagaguuugagaccagccugggaaacacagcaagacccugucuuuauuuuuaaaaaauaaaaauaaaaaauaaacugaacauucgcauuuauuaauuauacuuuucuuuaaaaaucugauagcucuguuucucugguaauuagcugucuucucauuguugagagccaaauauaaucuuuugugcuucuauucuuaaauuaucacauuauaaacagaagacauaauuauuauaaaguaggaauuuaaagcaggacaaucaaaaguaauugaauugugguagcuagaaagcaggaaaaguugggcaacuauuuuacuacuuagccaauauucuuaaaaacaccaacacaauuaaaguaucaucacuauguaaucacaaaccacuaaaaaauaucacuuucucucuaaaaaugggcuagaaguuagaaagagaagcuucuuaaaguaaaucaccaacaguaagaaaaaucagcuaauucugcuaugguaaauauuuauucuuugugguacacaucaaauauacaguggucugcaucagaauaauauuuauucacaaaguaaaaugaauuacuuacauguuacugugaaguaauaugucacacauuuuuuaaaagacaggagcauaccauacaaacauaacugaaacuagcaaccagaguuaacuauauuuacgaaaagcuauagcagcuauaaccguacauacaauuuauauuuacaagaaaaagcacuuuccaaacaguauguaccuuaugacccaauuuaaaaauauuucuauuucuuauuuauauuuauacauaauccaacacauucauaaaucuggaaggcuauauacuaaauuuaaacuaugauuuucuggguggugcaauuaggguauuguuuauuuuuauucccuucccuuuucuguauuuucugacaaagaauucugauauuuaguacuuguguacuuuuuuaaaaaguuauauugaaaagaaaagcaaguaaaauacaccaugcuaauuuucaaguguuaucuggagguaccaaccauguccuuucuuuaagaaagaucaguguuacuuaguaaauuagagaaugcuuuucuuguuugaggccuucucagaggauggggagcaggagugcacauagaacauuguuccaagaucucuacuguuuguuuccaucauuuuuaaaaucuuaaaucccucuauaucucaacauuccagacugacuaagaaaagacaagaguauguuuugcaauaacuagcuuuugcugcacucugcuggaacauucccuaauguucuguacaaaaugaucaauaaaguaugccuaggucuuugcuacaucugguuaaaacguucucauggagguuuauacauuucuaugaauaauuaagaauauuuucaacuaacaaaauggauauaguuuacaaacauacacaccaaguaucaucaugcucacauauuaauaaauggcuacacaugcaauaguugauuaugauguaugacagggaguauuuuuaaaugguguauguuuugcacucccucacgacuagaucuuuuuucuucuaaacaaauucaaaguucuaucuucaaucauguaaaagucgcuguaaauuccuuggacguaccuacuuggacucacaguuuguagaaucauuuguuuacaguaaaaaaaaaaaaaauuaaaaauccucaccaaauuaaagcaggcaguucuacaguuuaaauagccaaaugacuuaaaccugcuuuaucuaaugaucaauccuuccauuucuacuccuuuacugccuccuccaaaacacaccugcagucaacauucugcaugaaguucuuucgcugaaaagcaaaucaauuuguguuggcccaagaugccacaaaacagugucuagagaggccucgaugauacggaugcaauggaaaagaauaguggccggcuuguuucaacaaucuuccaaggguagugaagaaaaacuuucaccuuagcaaugucuugggaguugcaaacacagagccuggcaagaaucccagcauacacaaaauacuucucaauuuuuacuaauaccugcuaaaauuauguuuuggccugucugccuggaaagaaaagucuggaaugaccgcuucuuuugacuuuauaaucugcauaaaucucucaaagaggguucacaggaaaaguuuccauggaacauuucuuuuccaagaaaaaaaagcagugggcuccucagcaucaucucugucucuguggauuucucggcuaugcuaucaaacaagaguagggaaaugcaggagucccgaggccacagaaccaaagcaccugcugcauggcuucagcauggauuccugcccaaaccucguaacaguaucaucauaagccaggugcauacuaguguccccgugucuggugcuggucaggcagcaaacccagaccucauugccaaaauagucagggucuuguuuggcauaagugacuugcuacaauacacaacacuguguuguagagaagacacugaccuagcaaagggaagggagccagcacugauaagccauuuggaagggucagaaccgaagcucagucuucaaauccauuaucucaugaaaucacacaauggaauaucauccccauuuuacagaagauaaaaaugagguucagagcacuucaauaaucugccagagcuuacaaagguagucaggguugaaaaccagauuugucugaccccaaaaucucuuucaaaaccaacaaauugucucagaaacccugguucuugucccaucucaguuauuaauaacgcagaacuuugggcaggucauugaauauuugaggcuucuuuuuauucuccugugaaaugagguaacugaaccuaauuuccaaaacuucuucaaauuaaaaacuccauuauucucaggaucuguucauaucuuucuuccaccaucugcccccaccaccaccaauuuuuuguuuucuuuuuucucuuugaugugacauaaagauguaaacucucuaggcuaaaaaaaauucaagguaauuuuaagggcuuuguaugccagacagucucuacugcuaagaauuaaguuugcaauuaucaguaaucucucugaaccugaugauuuuuaaugaaguauacagauuaucaaauaaaaacaggccaaacaaagcaccaaaugcucuuaagauauuuagcuuaguuucaggaaauuucauuuccuacuuauuauuuauucacuauaaguuugaaaaauacaaaaaaaguuaucuaauauauuuggaaucaagaaauaugaggcauuuuugccacaccaccauuaggaucugguuccacgacauuuuauuauuauaagacaaucucuaagcauauuuauauaaggugacaaugaauguaauuagaaaaccauuacauuuaaaaagcaaauguuuuaauacuuuaaaauggaaacaagcuccccauuuccaucaacagcuuaaucaaucauuuggccuuaaccaaggaaugguuauuucaaaaagaaagaaagcaauauuuuaaaauauauuuucaucaaaaaagguacauuuuauuucauuauugauauacaauuuuaauuaaaacuucaaguccauauauuucuuaagugacagauauuuucauuaacuagcaaauaguuaacccauugucacaauccugaaauaaugugugugaugaagaauaauuaagguagcaagggcaaaagguuacucaagaccuuacuacaguuugagcuuaaauuauagguuuuaaacaagauguaaggaccaauucacaugaaaaaaaaaagcaauuuuaauggaaugcagaacaaauuaacuuuuuaacauuuaauacuacccaauugcauaaugggauuuugcuaagugcuacagggagcagaaaauaaaaguaacacugaaagguaugcuuguuaacuacuucaagcuaaagguauuauugaucuacuaaaugcuguaguaaauggacacauugugacaugaaagacucuggguucugccaucugauuggcauguuuuguguguuguuucuuuuuuaaaaaaggaaauggaucaaaaaacuuuuaaggaguuuuguuagcauauucccagaaugucuucucaacacuacgcuagacugggaaaggcuucuccugcaggguuaccuucuucccuauuaagucaaccagcaagguggcuacaagaugcuuucaaacccagcccucuccaugggggugaagccaccacagcauuccugucuccagcgaccuagggagccugcaauucaaucugagccucuagcuuguaaagcaauaaccacagggcauggggcagccuuuguuuucauccaacuaauugagcgaaaaugguuuccacugugaaaagacccuucaugaccuagccccaaagguuggcaaaaaagaaauagaacacgagucugagcuucagaauuccacugcaagaagucacccugccaaacacuggccacacacucagucucccaagggagagagguuuccuagucaucagggguuaaaauacaucaucaaucuuccgcugaccagaagccuuaccacagaaaugucacacuguauguccggaacacacugcaaaucucaacggaaguaucacaaccacaaccagcaacaaaugaacacauggaucuguccauuaacacacauuuguaaucaaaaaccuaauuacacaaccagagaaaccaauacaaugcugcuugagagcacugagagcucauuuuaaauuuccucccaagaugccaagggcuguaguaauucauucuauaaacuuagagacaccuacccuauacuaggcaugcuguacgcaaggcacugugcuugguagagugaacaagauggauauggucccuguccucaaagaaccuaggaccuaguggcugcacacugcaccagaauauagucucaaucaccaggcuuaacccuugguaaaaaagaagagugcccaaacucaaaaagugaacguagcaagucaguagaaaccuuuguuguuucuaucucuccucauuaccugauuuauuuucuguucuuuaaucuuuuggugagguucccaaugaacuuggcugaauggaagacuggccauuugauagagaaaaugguacuaagacuucuguuaaccaaaagcugacaugaaaacucacucugauuagcuagaaaaucuccuuucuuauaguuaggcauauacuaaaacauucuuaauucccaugaucuuaacagacuccacuaaacaguuauggcaaccuuugucuuagagccuggauaaaccuaagaauccuucuuaacucagcauuuucgguagucacuacaaauuguucaaaaucaucauaggagaugaaaauuauuugccaauguaaucuuagauugcauugaaugacagaguuuuuauacccaguagaagguugggcuauaugacuaaggucaguugcaaugccccaaaucuaggaauaugaaauucuaaaaagaggaaguauccaacuuaaaugaauuauaacauuccaaaaguaugucuauuaguagaguauucaagcccacagaaggaauuuccccagugagacaaugcuauaaacuguguuuauuucacaaacccauccacaaagacccuuagcccaugauguacuaaaauagaacugaaucagaacacauuucaaauaaaaaacuagaaaaauagauugauaagggccuaagauaauauucacaauaaaaguuuaaaacaacuuuguagaccagacccaaaaucuaacaacuauuguuaaaacguagugucuauuguagcuauuggggugcauaucucaucuuccuaacuagacuggaaacuacuugaggagagaaaccauuucaauuacauuuuguauacuuuucugacugucucaccuauggucccuaauaaauaucuauugagcaaguguagauaaaugaaagauuuucauagaaagaaaccuaggagcaucaaggagcaaaugucccugugcuuuucuauccacauaaaagaaaagggaacaauggagcuucagagucauuuuuugcucacuaaaaggagacaacuggcugccuccuccacugccuccaugugacuucgaauggccacuuacaccugugagaugcucauaagcuauggauuuggaauaacguggaaaaccccauagauuauagacuccuuaauauuggggaccacggcugucacaugcacuguugaggcuucaauggccaggcaugguggccaucacugugcaucacagcuuaguggucuggcacacaacaggcacucacauaacauuuguugcauaaaugaaugaauaaauuaguaacuaucgucuccaugcaauagagcccccuugggaucuguacuggucauuauaguguccugaacccuaaaauauacaaaaccucucagccugccguucauuuuucuaauuuuuacaaauguggguaaaagaacaauuucucuuucuuuuuauaguuuuacaaaaacuacaaaaagcaacaccaacuugaugauacaagauagcagaaccucaggcugugucaggagacaauaccaguggugaaggcugucaagcagaagaaggcaggacccaugugaagggggcagccuguucucaccaugaggaaaugcaggucccguauggccagggcuacugauuuuucaagagaaauuuuuaaaagucuucuagauuuuaauuuuggcaaauaauaaauguuuugauagaaacacuaugugaagccagccaugguggcucacaccuauaaucccagaacuuugauaggcugagguaggcagauugcuugagcccaggaauuugagaccagccugggcaacacggcaaaaccccaacucuacaaaaacuacaaaaguuaaccagauguggugggaugcaccuguuguuccagcaacucaggaggcugagguggcaggauccuaagcccagggaggucgaggcugcagcgagccaagauugcaucacuauacuccagccuggguggcagaaugagacccuaucucaaaaaauuuuuuuucuuaauuaaaaaaauguuuuaaaaaccacuaggugagccaauuauaaugucugaucaagaagaugaagcuggcuuauuccuaugcuguuccuaaaggcaaaagagggagagagcacuacgcuuucuugggaguguuuaaguaaagcuaagaagacuacagaucaaggauacaacaagcaggagguugaacuuagcagccucaaagccccuucuaaacuggaaaguccacuucuugauaucucugucaacacugggaauuauuaaaaaacauauuugccaguuuuauagaugaaauggugucuuacuguuuuacugugaauuuauagugugguuaggcuuuggucccuaucuuuguugauaucugggaugagcuacuucuucuuucaggcccuaauguugguuauggagacugaagugcagagcucucaauccaagaccaaguuuuuaaguauuuucaucuaguuugucuccaggucucuuagaggcaucuucucuuauacaugcuuuccaaacucaaggaauauggggaaaacuauaguucucaguuuguauuucuauuagcuuucucccuaacuuggggucuuacccacaguacuuuauacuggaacauuuuacaagacacacugacauacuuuuacuucagauugugacucuaaguccaucucccuucuuuaauuugccauagacuuugcauccuuuccuccuaccccaagaagcccaccaugaaggucauugguuuuuccaaaaugggacuuaaggaaccccaggaauucaguagagccucuacaaccaucaagauaaaggguaggaagguauuucgauccaaauaacucagguuuuuauuguuguuguuuuagguauuaggcuucaauuugaaguugugauuucaauuuuuaaaaaaaugugaaaaccacuacccuaguuauuauaauuuuuccaaauagucgacgguaaacugauaucaucucucugaagugaacauuuguauuaggaacacuuacaaauauacacagaaccuggcccaacaucuccacaucuaaaaauuuauucuaagaaaauagucaugaauguuucaagcuuuaccuccagaaguguucacugcagcauuguucauaguaauaaaguggucaaaacaaucaaauuauucaauacuaggaaacugauuaaauugauuuuuacauggcuacacuauauagcauugguauuauaauauuuauaaugacaugaaaacucaucuugagaugaaauuaagaggaauaaauaggauuccaacagauuuuuauaugaugaucccaauuuuuaaaauaaugcaugcauguauacacacaaagagacaggagaauguucacagggaacuaugggugcuuuuccauuuucauuuuuguguuuauuuuuaucugaauuuuauaaauuuucuacaaugauaauauuuaauguaauuauuuuaaaaagcuuuguuuaaaaguacauaaugugaaaguauuucugauuauucugaaaggggccuuuguaaaaauuuucuuuguaaaguagaauuuaaacucauuuaaucuaaucaaaagucaaucauuguuuagcccccuuuugaucauuuccccuuuucucucuuuuuucuuuuagaaaaaugaagauauguguaggccugaagggaaauuacuacuaacugaucuaaaucccaaaacaagauaacacuacaggagcacucaugugcuggcugccuccuucucagucuccucugggaagcuggguucuucuucaguuugguuuuugguuuuuuguuuguuuucguuuuuuguuuuguuuuguuuuguuuugagagggaguuuugcuuuuauuguccaggcuggagugcaauggcgcauuaucagcucaccgcaaccucugacucccagguucaagagauucuccugccucagccuccugaguagcugggauuacaggcaugcaccaccaugcccggcuaauuuuuuuguauuuuuaguagaaaugggguuuuuccauguuggucaggcuggucucaaacuccugaccucaggugaucugccugccucggccucccaaaaugcugggauuacaggcgugagccacugcgcccggccuggucuggcuuuaauucacuauaaacaaggggccaauagccagucccugucuuuagcuccucauauccacauucuguuuuuuuuuuacacgcaacuguuggcucucuccagcugugcuagguggucuuguaagacaagaccaugaaggaaggcacauucuguuggcaaaccccauaagaugcucugaaaacagugauauugauguacuuacuaaugaagacagugugagggaauacuuaaagaaucgccugcacauuuucuaugccgcaucaacucauaaaauuaguaauaaucagcuaauuuauauuaaggccuuaaaauacuccuauucuuugacuuuguaauuaccauuguagaaaccuaucuuaagaaaauaaucuuuauuuaaaaagaauagucaaaagaaaaaauuaaacucagccugucuuaauaaaggaauguuaauuaaauuaucauucauggucccagugguuucuccaccuaaauaaaacugauaguuaaaacagcugacaguaggagugagacugcaaggauuuuuagauacugagaguuguaggaaugccugcuucuccaccuuuacuauugaaacuguauuuucucugagucaguucuugauugaaggcuaucagaacuaccaucuaacucauuacccaguguuaacuaagaggaguccagaaaaauuaacucauaguaaaaaaugacucuuuuucuaggucgugaguauccaauuguuccauaacauucccuacuaaacuauaucaaacauuguagucaacagcuuucaaaauuuuacauaaaaucauuuuuuauuuuaagaauaaaaggcuaacucaaggaagaaugguaucaagcuagaaagcaaaauuugaaaagaugaaguacuuuauaaugucacuucuaguccuaugauucaggcucaugaaaaacaugcuuuaaaaagaacuguauaccuaauugggauauagcaaguaauuuaccucaaaugauauaagcguaaacuuucaaagguuugcaacuuaacaccagaaagaugaugagaccuauucuucuuccaagaugacaauugcuuuuuaagcaaaaaaggaucuuaaaaauuccauagugacaaaacugggagucccaaaacaacuugauaguuaaaacacagucaaagcaaaggaguacuuuccacagcagcugcaaugacugcugaacuccaggaauaggaaugauaagcauaggcaugcaaguuguaaagugcauaucucauuagcaaaauaauuuccuggucccagggaaauuacuggcagaaacagaaggcauaccuucagaaacucacugaagaaaugccaguugcccuugggacaggaccagagagcucaacaaauguguacugagcaccuagaaugcaucacaccaggcucuauguuaagcacuguggcacaggagugaacguuaggucuggcaguuaguccuacucuggagaugaacuaaaaacagacugaaaauccaauucaacuaaauugugcaguauuuaccugcuaaauaguuugacgucuuggaagaaaaaaugacauagaagcauggcuaugaauuuuuuucuaacaaaauggguucuauuacaaaaauacauuagaauaaucuauuguugagcuauacaguuccuauuagucacuagugauuucaaccaaaaugauuuucacauaauacauuuuaguuuaaaaaaaaaguaugaugcaucugcucauauuucacuuaagcaccauuuuauuuuuucagauauuuaaauaaucauccucaaugguaaaugacuaccauaaggaguaacauuuguccaugcuuauaauuauuaucuguauaaaacaucgugcuccuugaggcuauacaccauauuauaaacaucuuuauauaccuccucuaaucauaaagaccccuacacagaguagcugcuugauaaauauuugauagcacaauccuuuaaauugaaucucuuaaucccuaaauuuuaaugaucaaauaauauucauucuaagagguuuuuucccuaguauccccaaauauucuuacauauuacauugaacauuuguagacugaauaacacuuuuaagacucaaaacuaccauaaaauguauuuccuaggaugaaucaauagaaguuuaauuaaguacauauauaaguuuauauaaaaagcaauaaaaauacacaauuuuugcguuguuucuugaaaucugaucaaaaucuaaguuuaaauuuacauguauaggaaaaaggaauaaaugugguuuacuucaagaagacagucuugcaaaguuuuuaaaauagcuccacaaaacacaaagauugcaucuguauugaguguguuuaacaauagguuuguggacaagcaagaguguugaaaccuugucaagaaauauuuuaauauuaaaaaacuaugucaacccuuguucuacucaugacugaacuugauacaaucaagaaaaauuaguuucggaugugggauacuucagggauuugaaguaguuugcuaaauaggaagcuaaauccaauuacuuuuaugaagauuuggcaucugcaacugaaaaccaacauuccaauuaacauuagacaaauauccaagcuuauccacauguuccaggcauccuuuccggcuaaaagaaggcugcauuucugcauauaauuauucccguaugcauauacagggucugcacuauauuggagauauauaaagcaaaaaaaaaaaaaaaaaaaacaccaacauuuuaaguucuucuguggucuguggccaagauuauauauauauauauauuagacggauacaugaaauaagaggugagaaagcaaaaaaauaaaaguacuauggaucuuacgagacgugugugaaaaggagaaaaagguugcaucuagaagagaaacacaaagaaaaguuguaggaggcaggucuauguugggauaaaccucaacauguuuuuaggcuauaagaaagcaaaagagcaagggacagaucaaaaauauaacagccagacaaacuggcuuuuauauaaaucaguauuccagaagcuagcagaaggucaaagggaucaagggaaggguugaucuuaaagagaaauaacguaccugauccuuugagacaagaaggacagcaggaaaguugggaauagauguagacaaguuucuagaaggguuggugagacaaugagggagacauagcugagagucucaaucuuucugacaagacagaauauaagguugucuccugggagagugacagagagggggcugagucacuacuuagccugcugacuaccugggagaaaugggagaggugacugaccaagaugaaacuaagauuuuaggcaaaugaguagggagguaugaauuucaagcaacaacaggaaaagagacaguguucugaugaggcuaagcuuccuaaagaaaaguaagauauaaagcaagggacucaugggugcagagaagaaaacauuugagaugaucaguacuggauuccacgcccuaaagagaacagggaacaugaaaauaaauugaagaauaagccaucucuucuuuaacacacauuuuucucugaggucuuugucaaacagucaugaauuauuucaauuauguuacuguucugugcacuggugggcaagcaaagaaauggccccaguuguccaggcucaccaggagaaaagauggaaguacccaagaaaccauaacauaagacagaauaauauaaguaaauuucacaacagagguuuaaucauagcacuccuaagguuuaaaggcagaagagaucacagauaacuggaaaaggcauggugaaauaggaaaagcuugaaagacaagaggguaucuauaggaagcuuccauaaaggaagaugagggaaaaaaagggaaauacauguagcaaaaauaacaucagcaaaugcacgguggcagaaauguauaugguaaauuugaucaaaaaauaauagucuaauaaacauauuuuuaaaaguucaacaucguuaggaaaaugcaaaauaaaaccacaaugagcuaccacuacacaccuacuagaaugacuauaauuuuuaaaaaauaaacagacaacaauaagugauguaaggauguaaagaaacagaauccucauacacugcugguaggaaaaauaaaauagggcaaccuggaggcaacacauuacccaaguucaaacuauacuacaaggcuacaguaaccaaaacagcaggguacugguacaaaaacagacacauagaccaauagaagauaauacagaacccagaaauagagcugcacaccuauaaccaucaaucuuuaacacauuaacaaaaauaagcauggggaagagacucccuauucaaugaauggugcugggauagcuggcuauccauauggagaagaaugaaacuggaucccuaccuaucaucauguaauaaaauuaacucaagauggaucaaagacuuaaaauguaagaucucaaacuauaaaaauccuagaagaaaagauaggaaauacacuucucaauaucagcuguggcaacgaauuuaugccuaaguccucaaacacaauugcaacaaaaacaaaaaugggcaagugggacccaauuaaacuaaagaccaucugcacggcaauagaaauuaucaacagaagaaacauacaaccuaaagaaugagauaaaggaauguaaacgaaucaacaagcaaaaaacaaccucauuaaaaaaugggcaauggacaugaacagacaguucucaaaagaagacauauaauuagccaacaaacauaugaauaaauguucaucaucacuaaucaucagauaaaugcaaaugaaaaccacaaugagauaccaucucacacuggucagaauggcuuuuguuaaaaagucaaaaaauaacagauacuugugagacugcagagaaaagggaacacuuccacuacuggggaaauguaaauuaguucauccacuguggggagcaguauggagauuucucagagaacugagaguugaacuaucauucaacccaacaaucccauuacagaguacagacccaaaggaaaauaaauuguucuaccaaaaagacaugcacccauauguucaucaccacauuauucacaauaggaaagacauggaaucaacucagguacccaucaacagugaacuacauaaagaaaaugugggaggagccaagauggccgaauaggaacagcuccagucuacagcucccagcgugagcgacgcagaagacaggugauuucugcauuuccaucugagguacuggguucaucucacuagggagugccagauagugggcgcaggagagugggugcagcacaccgugcaccagcgaaagcagggugaggcauugccucacucgggaagugcaaggggucagggaguucccuuuccuggucaaggaaaggggugacagacggcaccuggaaaaucaggccacucccacccuaauacugcacuuuuccgacgggcuuaggaaacggcgcaccaggagauuauaucccgcaccuggcucagaggguccuacacccauggagucucgcugauugcuagcacagcagucugagaucaaacugcaagguggcagcgaggcugggggaggggcgcccgccauugcccaggcucccuuagguaaacaaagcagccaggaagcucgaacuggguggagcccaccacagcuccaggaggccugccugccucuguaggcuccaccucugggggcagggcacagacaaacaaaaagacagcaguaaccucugcagacuuaaaugucccugucugacagcuuugaggagagcagugguucucccagcaugcagcuggagaucugagaaagggcagacugccuccucuagugggucccugaccccugacccacgagcagccuaacugggaggcacagcccaguaggggcagacugacaccucacauggccggguacuccucugagacaaaacuuccagaggaacagucagacagcagcauuggcggaucacaaaaauccgugguucugcagacaccgcugcugauacccaggcaaacagggucuggaguggaccucuagcaaacuccaacagaccugcagcugaggguccugucuguuagaaggaaaacaaacaaacagaaaggacauccacacgaaaaacccaucuguacaucaccaucaucaaagaccaaaaguagauaaaaccacaaagauggggaaaaaacagagcagaaaaacuggaaacucuaaaaagcagagcgccucuccuccuccaaaggaaugcaguuccucaccagcaacggaacaaagcuggauggagaaugacuuugacgaguugagagaagaaggcuucagacgaucaaacuacuccgagcuacaggaggaaauucaaaccaaaggcaaagaaguugaaaacuuugaaaaaaauuuagacgaauguauaacuagaauaaccaauacagagaagugcuuaaaggagcugauggagcugaaagccaaggcuugagaacuaagugaagaaugcagaagccucaggagccaaugcaaucaacaggaagaaaggguaucagugauggaagaugaaaugaacgaaaugaagcgagaagggaaguuuagagaaaaaagaauaaaaagaaaugagcaaagccuccaagaaauaugggacuaugugaaaagaccaaaucuacgucugauugguguaucugaaagugauggggagaauggaaccaacuuggaaaacaucugcaggauauuauccaggagaacuuccccaaucuagcaaggcaggccaacauucagauucaggaaauacagagaauuccacaaagacacuccucgagaagagcaacuccaagacacauaauugucagauucaccaaaguugaaacgaaggaaaaaauguuaagggcagucagagagaaaggucggguuacccacaaagggaagcccaucagacuaacagcggaucucuuggcggaaacucuacaagccagaagagagugggggccaauauucaacauucuuaaagaaaagaacugucaacccagaauuucauauccagccaaacuaagcuucauaagugaaggagaaauaaaauacuuuacagacaaacaaaugcugagagauuuugucaccaccaggccugcccuaaaagagcuccugaaggaagcacuaaacauggaaaggcacaaccgguacuagccgcugcaaaaucaugccaaaauguaaagaccaucgagacuaggaagaaacugcaucaacuaacgagcaaaauaaccagcuaacaucauaaugacaggaucaaauucacacauaacacuauuaacuuuaaauguaaauggacuaaaugcuccaauuaaaagacacagacuagcaaauuggauaaagaccucagcucugcaccaagcagaccuaauagacaucuacagaacucuccaccccaaaucaacagaauauauauuuucuucagcaccacaccacaccuguuccaaaauugaccacauacuuggaaguaaagcucuccccagcaaauguaaaagaacagaaauuauaacaaacugucucucagaccacagugcaaucaaacuagaacucaggauuaagaaacucacucaaaaccacucaacuacauggaaacugaacaaccugcuccugaaugacuacuggguacauaacgaaaugaaggcagaaauaaaguucuuugaaaccaacgagaacaaagacacaacauaccagaaucucugggacgcauucaaagcaguguguagagggaaauuuauagcacuaaaugcccacaagagaaagcaggaaagauccaaaauugacacccuaauaucacaauuaaaagaacuagaaaagcaauagcaaacacauucaaaagcuagcagaaggcaagaaauaacuaaaaucagagcagaacugaaggaaauagagacacaaaaaacccuucaaaaaauuaaugaauccaggagcugguuuuuugaaaagaucaacaaaauugauagaccgcuagcaagacuaauaaagaagaaaagagagaagaaucaaauagaugcaauaaaaaaugauaaaagggauaccaccaccgaucccacagaaauacaaacuaccaucagagaauacuacaaacaccucuacgcaaauaaacuagaaaaucuagaagaaauggauaaauuccuugacacacacauccucccaacacuaaacgaggaagaaguugaaucucugaauagaccaauaacaggcucugaaauuguggcaauaaucaauagcuuaccaaccaaaaagaguccacgaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauauccuugaugaacauugaugcaaaaaccucaauaaaauacuggcaaaccgaauacagcagcacaucaaaaagcuuauccaccaugaucaagugggcuucaucccugggaugcaaggcugguucaauauacgcaaaucaauaaauguaguccagcauacaaacagaaccaaagacaaaaaacacaugauuaucucaauagaugcagaaaaggccuuugacaaaauucaacaacacuucaugcuaaaaacucucaauaaguucgguauugaugggacauaucucaaaauaauaagagcuaucuaugacaaacccacagccaauaucauacugaaugggcaaaaacuggaagcauucccuuugaaaacuggcacaagacagggaugcccucucucacuacuccuauucaacauaguguuggaaguucuggccagggcaauuaggcaggagaaugaaauaaaggguauucaauuaggaaaagaggaagucaaauugucccuguuugcagacgacaugacuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucacauucacaauugcuucaaagagaauaaaauacuuaggaauccaacuuacaagggaugugaaggaccucuucaaggaggacuacaaaccacugcucaaugaaauaaaagaggauacaaacaaauggaagaacauuccaugcucauggguaggaagaaucaauaccgugaaaauggccauacugcccaagguaauuuauagauucaaugccauccccaucaagcuaccaaugacuuucuucacagaauuggaaaaaacuacuucaaaguucauauggaaccaaaaaggagcccacaucgccaagucaauccuaagccaaaagaacaaagcuggaggcaucaugcuaccugacuucaaacuauacuacaaggcuacaguaaccaaaacagcaugguacugguaccaaaacagagauauagaucaauggaacagaacagagcccucagaaauaacgccgcauaucuacaaccaucugaucuuugacaaaccugagaaaaacaagcaauggggaaaggauucccuauuuaauaaauggugcugggaaaacuggcuagccauauguagaaagcucaaacaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccacuguggaagucgguguggcgauuccucagggaucuagaacuagaaauaccauuugacccagccaucccauuacuggguauauacccaaaggacuauaaaucaugcugcuauaaagacacaugcacacguaugucuauugcggcacuagucacaauagcaaagacuuggaacuaacccaaauguccaacaaugauagacuggauuaagaaaauguggcacauauacaccauggaauacuacgcagccauaaaaaaugaugaguucauguccuuuguagggacauggaugaaauuggaaaucaucauucucaguaaacuaucgcaaggacaaaaaaccaaacaccacauguucucacucauagaugggaauugaacaaugagaacacauggacacaggaaggggaauaucacacucuggcgacuguugugggguggggggaggggggagggauagcauuaggagacauaacuaaugcuaaaugacgaguuaaugggugcagcacaccagcauggcacauguauacauauguaacuaaccugcacauugugcacauguacccuaaaacuuaaaguauaauaauaauaaaauaaaaaaaaauaaaguaaaacucaaaaaaaaaaaaagaaaaugugguacugggaguauuagaguggggagagagggaggugugaguugaaaaacuaccuacuggguaccauguucacuaccugggugacaggauccauaccccaaaccucagcaucacucaauauacccauguaacaaaucugcacaucuacucccugaaucuaaaauaaaaguugaaauuauuuuuuuaaaaaauuuuaaaggaauuaugguauauaaacaccauggaauacuaugcagucauaaacaaagaaugaaaucauaucuuugcagcaacauggauguagcuggaagccauuauacuuaacucacacaaacagaaaaccaaauauugcauguucucacuuauaaguaggaacuaaacauuggguacauauggacauaaaguuaggaacaacagacacuggagcgauauaagaguggggaggaaggaagagagguaagaguugaaaaacuaccucucggguacuaugcucacuaccugggugacagguucauucauacuccaaaccucagcaucaugcaauauaccuuuguaacaagccugcacagguacugccugauucuaagauaaaaguugaggaaauaaaauaaaaaggagcaaccacugaggaaaacugauagaugaaccucaaaaacaugauauuagguaaaagaugcuaaagacuacauauuguaugauuccauuuauaugaaauauccagaaaagaccaaccuaugaagacagaaaguagauuaguaguuucuuguaguuggagugggagugaggauuagguguaacuggacacaagggggcuuuugggggaauggugauguuuaaaauuggauugugguaguggugcacaacucuacaaauuuacuaaaaauccuuaaaugguacacuacaacgcaugaauuuugguaugcaaauuauauaucaauaaagcugcguucuuuuucagaggauaggguagcuugaccagcauguaguuucugcagaaauaggagaugagauuagaagaaauugggugcaacucuucagaauuuuugaaugucagagugagaaauuucaauguaaucuaauaggcaacagggauccccuugaaggucuuggaauaagacaaauacaaacaaauaaaaaccacagauaauuacauucauaaaauuaaccucaucuaaugaggcaauuuguugacacauuugaccauaaggaccaggaccugugggcuuccuugggaccauggccuggauuuagcaagggcgugaggagacacacucuacaaaccauaaaguaucaucagagagguuuuauuuaacucuauauaacaugacuuacuuuccaaccugacucuggcauaacaucacaugauauuauauaaggaaggaaaucaaaauauuuuaccccaaauauguuucuuugucaaaucuugaaauagcccugcaaagcugucucuugugggggaaaaaaaucuacauucuguagaauccccuucccuuuccaggccuuuuuucuagacagaaucaacugggaaucugauaaacauuugcagucuguucucugaagccugcugccugaagguuuaaucugcaucaagggaaccuuggucuccaggaucucuugucuuaacccagauauuccuucuauugauucuaggucuuuagacagcaauuuaacucuuucaaccaauugccaauuagaaaauccuugaauucaccuaugaccuggaagcccugccccccaccccuucaaguugucccaccuuuccagaccaaaccaacaucuuacauguauugguugaugucuaugucuccuuaaauuguauaauuccaagcuguagcccaaccaccuuaggcacauguucuuaggaccuccugagacugugccccaggccacuggucgcucacacuuggcucagaauaaaucucuucaaauauucuacaguuugauucuuuuugucaacaggcagauccucucaaauacuuuuaccuugaaucacaaaagugggaaaaaagauggagggaaauggucccaugaaaaucuaucacuuccacaggaaaaacaucuccaagaauauggcuucuggcuuaucauucuaacugggaaucaacugaaaaagaauauuaagugaugggcuagaagccaguccuagaugagaugggguggaguaaaguggggaaaucaauauuuggcugagggccuaauucucugaaauuuaauauccugcuauaagagauauggaaaucauauaaaaaggaaguuaaaaacaaaaauacagguggcccaucugggagcaugguaaaguuggauagguauugaucuuacugcaugacauucuaucaaugauucucagguagugugacaaauauauuuaaauccacuuaaggucaaauguucaaaguacauuuauuuuaauuacauuaaaucacuuuuccuacugcuagauuguuccaggcuauacagcugggccucauaaaaguaacuuuuuaggaaguacagcaccuuaauuuauccuuaguuauauuugguacuuucaagcaacacucugagcacuauuagcucucuguguauuaauauacagagaaacauaucgggguugauauaacugcucagcuguucauagauaugcuuauaaaaacaguacaucuuuuucuuuugcugagaaagaucacaaaauaaucucucaaggaaacuggcuuuguuuuccucuacuuaaagagagagagaaaaugacgguaagggaaggaagguggacgggaggauugugaggguuauaaggguuguaauaaucgcuaauucacaauucaaacuguucagaacuccuuuacaaaaaacuaauacaaaaagaauaauugugccagaugggauuaaacaggaagauagauaacagaaaugaaagaaauccucauacaauuacagauaauuggaggccacuuauguauuuuucugucaucacugacacaaaaagauaagauuuucauuuccacauaaugagcccauuaauaguuuuauuguaauauuagaaacaucuuguuucugaguauaucucaaaggacuauuuuuuuuuuaaagaucaaacaacaaacagaacaaaauuuuagcagaagaggggacacacugauuacuucugacucagaauaguuuauuucagaaaagugaucaaauuucugaaucugauaaacuuaccaagauaaaauccuaauauuaaauuuacaauacagccaguuguucaagcuaacacuagcaagcagaaaacucaaaugcugauugaagaacaugaagauaaagaagcaugcauucaauuuauaaaaagugaacacgccccagggaaguaaagcauaccagaugguuauuaaaaggagaauguuuucauacgauaauaggucuguucuccccuugaaguauguacaacccccauuaaugucaauuagcauuacauaccuaaauccagggaaccauaacuccaauguuauaauacuuugcacuuacauaucuuuucugaaacuaauucaguugcacaaagcccuauaacuuacaucauugucauuacaguauaccuaacaaaugcugacugggcaacaaccucaccccaguuuaggagcuggcacuagaugaucccuaaguccccauugauuucugaaauuccgaauugaugaaaauuuaagauucuaagucccuuuucauaacaauuaugcagguacaauaaacauuuauugagaauuuuacuggaaaauaagcaccaugcaagaugcuacacagacaaguucuaucuacaggguccacagauuaaagugaagaaggugaagcucagagagaugacgugauaugcccaaagucaaagcaccagaaagaacugggacuaggacucaagucuguugacauaaaauuugaugacauuguuuuaaacaauauuugaauguauaguuuuuacgagcuaauguuucuggugauucucuaaccaccuaagagugcuucacaacugccugcuauucacauccagugagugaaaaucauuggcucagugauagucuauucaugaauaagaauuuaaaaagacuaauggaaagaaaaaaaaauaaagaaaaaagacaucacaagaaacaauauaaaaugaggaacugacaauucucuaugccugguacggcacuaucuaauagauagccacauauagcuaauucacacuugaaaugugcugcacauauaaaauaaaccagauuuuugaagacauacuaugaaauauaaaauaccucauuaauaauuuuaauuuuacuacauguugaaaugauauauugaauauauagaguuaaauaaaacacauuguugggcugagcacaguggcucacgccuguaaucucagcauuuugggaggccaaggcggaugggucacaugaguuugugaccugccuggccaacauggugaaagccugucucuacuaaagauacaaagauuagccagguuugguggcgcgugccuguagucccagcagugaaccaagauaaugccaccguacucuagccugggugauggggcgagacucugucucaaaaaauaaauuaauuaauuaaauaaaauacaugguuaaaauuacuuuaacuuguuucacuuuacucuuuuaaucuucuaggaaauuaaaaauaauacauguggcucacauuugugacuugaacaaauuucugucagacaguuuggcuagacucuauacccacacacagauagugaauacaucagggacauacuuauaacaaacacucuuuggagauuacucugacccgaauaaagaaaaauuuacaaaauuuugaaagagcuuuguauauugcucuuguuuggcugagaaacuagcaagggucagacagaguaagagaacauccaccuuuacauucacucaagcauaccauucaguuaucuaacugcucucuuuucagugaacaggaauaaacuaacucauauauggaauaauucaaaacucuaaacauucugagaccagagaaacaaguucauaggguauagacaggaaagagaaaacggcucccucagaaauaccaaugaagaacaggaguuccaugacuacaacccaguuuucaaaaaguuguuaucugugguaauauaucugguaaaacacacauaacauaaaauucacauuucaagugugaauuagcuauauguggcuaucuauuagauagugccguaccaggcauagagaauugucagcuccucauuuucaaguguacgauucaguauauuaaugcauucacauugcuuugaaaaagcuauuuuugugcucaucaauuuuuuuaauuuuuauuuuuuuuucuucaacuauuauuuuaaguucaaggguacaugugcaggaugugcagguuuguuacacagguaaacaugugccacagugguuuguugcacagaucaauccaucaccuagauauuaaucccagcacccauuagcuauuccuccugaugcucucccuccccugaccccacucccacaggccccaguguguguaguuuccccucacaauguguccauguguucucaucauucagcucccacuuauaagugagaacaugcaguguuugguuuucuguuucugcauuaguuugcugagaauaauggcuuccagcuccacccaugauccugcaaagggcaugaucucguuccuuuuuacagcugcauaguauuccauggugcauauguaccacauuuucuuuaucuacucuaucauugaugggcauuuggguugauuccauguuuuugcuauugugaacugugcugcaaugaacauaugcauacauguauuuuuauaauugaagauuuauauucuuuuggguauauacucaguaaugggauugcucggucaaaugguauuucugccucuaggucuuugagaaaucaccacacugucuuccacaaggcugaacuaaauuacacucccaccaacguauaaaaguguuccuuuuucucuucaaccucaucaguaucuguuguuuuuugaugcuuuaauuauacccauucugacuggugugugagaugguaucucauuguaguuuugauuuacauuucucuaaugaucagugaugccgagcuuuuucaaauauuuucuggccacguguaugucuucuuuugaaaagugucuguucauguccuuugcccacuuuuuaaugggauuuuuuuucuuguaaauuuguuuaaguuccuuguagacucuagauauuagaccuuugucagauggagagacugcaaauauuuucucccauucuguagguugucuguucacucugaugauagucuugaucuaucuugaguuaguuuugguauuugguguaaggaagagguccaguuucaauuuuugcauauggcuagcuagcucucccagcaccauuuauuaaauagggaauucuuucccacugauuguuuuugucagguuugucaaagaucagaugguuguaggugugcggucuuauuucugaguucucuauucuguuacauuggucuuuguguguguucuuguaccaguaccaugcuguuuugguuacuguagucuugcaggauaguuugaagucagguggggugaugccuccagcuuuguucucuuugcuuacaauugucuuggcuauucaggcucuuuuuugguuccauacgaauuuuaaaauaguuuuucuaauucugugaagaaugucaaugguaguuuaaugggaauagcguuaaucuauaaauuaccuugggcaauauggccaugugcacaauacugauucuuccuauccaugcauucaacaaauuauaauauuuuuaaaaauugcauaaaaauguaaagucaucuaaaauaaacauacaccauuuucaauuuuuugcaaauguaucuauuauagacacaucuauuucauuauuuguaacuuauuauauacuauuucauaaucugcuuuuuucaguuauauaaaauguuuuauaucauuccgguuuugaaaauaaugaaacacaauaaugauaugaaauaucacuucaaauaguaguacuaugauaaaccuaaucacuuuccaacuagaaagcugguuacaauuuccugcaaagauaauuaauaauauaaaugaauaccuugaugaauguauuuuuuucuuugugaacuauuuccuugccuaaauauucaagaguaaaauuauaggguaaaaauguacaaauuccauuuuuuuuacugacaucucaguuuuuuuguuuuguuuuguuuuguuuuuacuuaccaccccuguucauccacaaacauacgauugcaaauuucugcuuccuccuccuuucucaccuauuuacucuaucaccuucugagaaagaauuuccuuuuagcucuuaagugguuauaugaaaaacaagcccagcaacaucaccacauccaugaaagcuccuucuuagucucucagcauguuauuuuuacuuguccaugacaaugaggaaagugggccucugaaugguuucauuauauauuccucuguguuaucagccaaaaucaugcucauuuaaaaacccauggaccaaaaagcucuuaggcuucugcgugacuuaaaaugauuuuuauauaucaauaccauacaaauaaacagaguggaaggaaguuuaaaguacagaaaaaguaacaaauagcaaacuccaaaccacaggaucucuauuuaaaauuaugccuaauacagccucuuuuguagaagagaaaagucagccaucugccucucuagaacauuaaugacuacuagucauuacaucacacauaugucaucugacaccaacuuuuagaucaguaaacauuuucccucugcuacaacagaggguuaguguugaagugaggagaaaaaccucagcacauguaauagcaucaaaacauaagccaagucauaggguaagucuaauuucuuccauuucaauuuacucaaccaaucagucuugcuuugacuaacaaauuuaugugaaaauguuauaauaaaauagagaauuuauuuggcaaagcuuuucugccaaucagcauuagcauuugaaggcaaagaagcuaaacuuagguauaagugaaaucaacaaagucacacacccaaaaaaaguccucugauacuuguuucagauauaauuucagaauugagggaacucuccaaaagauuuuguuaccugucuaauagguguguauacaaugacuauuagaugaucaugaauauacauauacguagcaugaacauguacaaacaguucgcacacauuuccuuuuucuuuacccugaccauaauuuugcuaaagaaaaucuaggcugucuaugucccaccugacaaugauuaaaguaaaauugccacuugauauucuaaagccuggacuuuggaauacaaugcuuaauaucuguguaacacugagcaaguuucuuaacucuacucagagucucagguucuuccucuauaaacaauaaugccacccucacaugaugauucuaaguauuaaaugaaguaauaaauaaaauuuacuucaaacucagcagacacccaacaaauaagaauuuccuuucuuuucuccuacuuuauuucuuagguccuccaaaaauacauucaguugauugagaaggcaguauuccaauuuuacaaaugaggaaauuuagguuucuaacuacugaaaagaagacauucucaacaugguuacauucuuucaacauuauaccuccaaagcuagaaguaaagaugaaaauucuuucaaaaagaaugauauuuuucccaaaauuuuauuaguuuuaacuuguauuuuaaguucagggguacaugugcagguuuguuacauagguaaacuugugucauggggguuuauuguacagauuauuucaccacccacauacugggccuaguacccaguaguuacuuuuccugauccuccccuccuccuacccuccacccuccaguaggccccaguguguguuguuccccucuaugucuucauguguucccaccaguuagcucccacuuuuaagugagaauaucuaguauuugguuuucuguuccuguguuaguuugcuagggauaauggccuccagcuccauccaugucccuggaaaggacauaaucuuguucuuuuuuauggcugcauaaauacaacauaauuacugaaacugugguggacaacugaaaaauauuuauucacuagaggccaaauccuuccccuguaagaaucaugcucugcuuuucccagauugauaaucccagguccccucuccuugcuucaaccuuagguuggccuccauaagggugcuuguuguauguuccuaguggaguaugaugcaguaguagacacuauguaggcaaggcaugcuagcaaaaauaagauggggauguggcuuugaggguuccuauacaggauacaggaaauaaccugcauuugaaaauagggagggaagugguuggcuuuugcaccaaaacucaaaacuauuaaugaugcaccuugaagccagugacccaccuguuagaaauauaauaagaggcugccacccacaauaggccaagagagggcuaacugcaggaugaugguccuaaaugagauaacccuucguggaugguugccucauugccgauuaaccaauauguuugucccaaaaagaugcacuugagcuauccagaagagcuaccacugauguccauugcauccuguuuucuucaucuuuggaaaggccuacaugugauuuggggguagggguaauaaggcuguucucuauuugaacuuugcucugcaucugaacucccaggugucuuguucuacucaucagaaaguuguuauuauccuaacagggccaggaccagcuacguuauuugaggugcccagagcaaaauaaaaauacaggacccuuuguucuaaaaguauuaagaaauccaguauggcuacuauagagcauuaaaccaaaaacagggcucugugugacugugcaggugacaugcccaugaagccaguacuggacaaagcuaaggugaagaccuauuuaaaaaacuggauaauagauuccauccuucaaagaacugaccauaacuaagaacaugggcaaauauucagacaguuuuauucgccuaaaaacaacacugaugcucuguuugcauuauuuuuuauuuauuuauuuuuuguuuguuuguuuguuuguuuguuuugagacagggucucacacuguugcccaggcuagaauacaaaggcacaaucauggcucauugcagccucaaccucccgggcuaaagcaauccucccaccucagccuccugaguagcugaggccacaggugagcaccaccucuaucagcuaauuuucaaauuuuauguagagacagggucucuuuauguugcucauagggaucucaaacuccugggcucaagggaucuuucugccuuagccucccaaagugccaggauuacaggcgugagucaccauacccagccugcucuguuugcuuuaaacaacucuugacaaaccuaauuaauuuucagauaaauuaucuucagaguccauagacuacaacugcuuaugagugaauaagauuuuaaugacaacaaaaauuuaaguuuaaaugucaaaaguauagaagaaaagacaucucuaaguauagaaaaacuaaauugaaggguuagaaaaguuucaaaaagaacuguucguuuaaaauaguuugcuaauuuaauauauguugaaagaaggaggauagauuauaaaaaaguacacaauucuccacuccuucaacaaagaggcaaagucuauauccccaccucuuugaucugaauugaccaaagccaauggaacacuagaaacaugacacaaacagaugcuugaaaagugcuugugcauugggacauauagucaccaugugaacaagcccagccuagccugcugggccaugagagacaaguggcccaauuauuucagcuaacugcaagccaucugccaaauacaugaguaaauacauccuagcuauccagucccgagcugagccaccagcugaccagagacacaugagugagcccaaucaagaucagccaagcaugacccagaucaacagaacuaccaagcuaauccagagacucaugaacaauaaauaaugaauuauuguuguuuuaagccacuaagguuugggaugguuuacuauacaguaaaauuguuaaaugauucagguaauauuuuagcucaguagaagaauggaauaugcgauaagcaggggcugagacacuaagcucaccagggagcagggagauuagauucucacuaaauugcacaauaaauuccagauggagugaaaaaaguacauuuaaagaaucauagcauagaaguguuagaauaauuuauaaauugauauucauauacucuuggcauacauaaggaaggauuuccuaggcagagaaaccuaaacgaaaaagauggacagauuuuacuacacaaacguuuuuuuaaaccucaugugucaaaaauacauuacaaauaaaaaauaacaggcaaaugauaaauugguaaaacuuuuuuauguaugagagauuacauacauaaauagguaccaaguauuuucaugcaugaugaaaguaugaccaaagauuaucccucaauauacacaaaaugguaagacaaagaugaacaugauagaauauuaaacaaaauguguacauacgcaagucauaaaaaagaaauacaaauggccaauuaacaugugaaaaauaugcagcaucucugguaagcaacaaaagagguaagaaguaaaacaacaaucaaauuacuguuucaguuaaaaauuguaaagaugaaaauaaguaauaauaccuaggaaagcaggcauuuucauacacuauugguugagcuacaaucugguacaacauaccuguaagguaguguguauguauggguaugcugguguaugugugcauguguguaugugugucucauagagaacauuuugcugaaaaauuaaaagaucccaucacaggaggaaaaaaaacgcuaaacagguagcagaucuaauuuuaaagcgguacguugggaaaagacuuuaaaaaucuaguaaagucaugcaguggaguuaugccacagggacaggaauggacucuagcauggcuuguuauuucaugagcuugacuaauccaucaaguaaaucaugcucccuaccuaggcaaagcauaaagauaagaaaaacacugaacagaagguaugugauaauaagguaggugguaugcuuguucgaucccaggagaguugucgaaaaaggauuucucaauguuagacucaacauuaaaacuauuauuaagauuuguccuuuaauaaacugugauuguccauacuacagacuguccauaucauaaacuauuauguaaccauuacaaauagagaaguacaucuaugcacuaauaugcaaagaguuccaguacauacuuuagaagaaaaagaaaaaagagagcuagauuaauacauaucauaugauacucuuuauggaguuuuucuuuagccuggugaaacaauauuucauuucuaugugccaaaaaaagagguguggaaagaaacaaaaacaguaagaaugauuacauuucugagcagaugauaaggaaccaagaugggaaauuuagcauuacguauaauguuauaauuuucuuugggaaauuauauucauguguuaaguaugucauuaaaaaacugacuaaacggaauuaaaauagacuuuauuaugcucaugaaacuuauugaacaaucaacaccucacccucauuuauuacaaauauauacauauaauaaaauugaauggcaagguacauaaaaauuaagucaaaauccuuauaguacucauauuuuuccuucaaauguuuauucauucuuuucauuaaucuaaaaggaaugggacuuaacaauauacauucaagugaaaagccaugguuuugaucgucuugucuguaauauuacaaaucauggaaaaccucaaccuugaggcuaagcagaaaaaaauaaaaaccucugcacuuuaaauguauaaaagacgaagucuuacuauauagaaaaucuggaaagcauuaaaucaagcauccucuucaaguuccuuuaaaugcccuuccaccauugugucuacaaaaagauacagcaucauuaaauacaagguugaccauaccuucagccucaaguauggcaggcagggaugacgguagaccccagaaugagaaagaaaagugaacaaagaaaugggaaaaaggaaaaggaaaagaaggaaggaaauagaaaacaaaacaaaacaaaaagaguacuaaagaggaaaagagguguggaacagacagggcauuggugccuacugacugaagaaucauauaauuaccccagcacacacacacgaaauuggcagucuauauuuguggaacaaauuuuguaaauuccauacauuauggaauauaaucuuuguaacaaaagaguagucaucucauuuuauggaacaaaacagaaguucugggaggguaagggaauugccaaaaaccauacaucuaauaagcaacaacacugcgguguuugaauuccaagcccaguguucuuuccaauauuccacugcuacuauagacuguccuuuaaauugcugcuaauuuucaaauaaccaugaauuuuuuuuuuuuuuuuuuuuuuuuuuuuagauggagucuugcucugucacccaggcuggagugcaauggcgcgaucucggcucacugcaaccuccaccucccggguucaaccgauuccccugccucagccucccgaguagcugggauuaugggugccugccaccaugcccggcuaauuguuugaauuuuuaguagagacaggguuucacuguauuaaccaggauggucuugaucuccugaccucgugauccgcccgccuaggccucccaaagugcugggauuacaggcgugagccaccaugcccagccuaaccaagaaaauuuuaagaaacaaauguauuaugagcaaaaacauaguaagcuauuuuucuguccccuaggaaaauuaauucugaaaacaaaaaucugauuuguccuuucaaaaucaacagaauggaguggggcaggggagaagggcagaaauguugugauaaaggaccacaugaaggaguccuguggugaagcgucuagaaugugguggcggaugcugaaucuacacaggugauaaaauuguauacaacuuaauacacgcacccacauaaaugaguacaaguaagucagaauaagaccuguggauuuuauuaauaucaauauacugcuuaugauauuauaccauaguuuugcaaaauguuaccauuggaagaaagcaguuaaaggagacaugagaucucucugcauuauuuguuacaacugcacagaaauauagaauuaucucaauuaaaaaacucaauucaaaaaaucaacagacuauucauaccagcaacacugacuuugaaacaggagaguaacauugugaagaaauauaggaauacacaauauagucauucaaagucuucauuauaaccauucaaagacauuauaacagaacugguagaagccuucucaugauuuuuuaaaauuauuuuaaaauuuaaaaaauaauuuuuaagugagagauguuuugaauaguuuuuggagagacagugccuuaagagugacagccagaucaccuagccaugcaaaugauaaacuauggauggaaggugaucaagaagaaaaaauauauuuugaacuagaacuuuuugaacuaugaugcuuaagaauuccaucucaaaauaucaacugacauaauacuagaaguaugagccaguugcuugguaagacaauuggagaauuaugguaauaauuauggaaugcaccaagaauugucucauaauacuaaucauaauagcuacuauuuaucaagcacauauuacgugccuggcauuguucuuguugcuuuacauaaaagauuaaaaauccucacaacaacuccgggagguaauauguggaaacugagggcgcucauguaauuuacccaaggucacacaauuagaaagcagcagaguuugacuuugaaccuagguuuuucugacucuaaagcuugugcacuguucacuguuccuuaaagcacuggaaaugaguaccuuaucuuggauauucugguacaugacucuagggugacaaaaaaaaguauagccaguaauagaaaacuguuacugauauuauacugaccugcuuguagguuccaucuaacaagguguccagguguugaagaggggcaggaguuuuaucuuugaaucuugcuaguagccggcguugaauggcccgaaauuguacagcucucucagauaagaguucuucuaauuuuucaccauuuauccguagcugcaaugaauaauuucuuaaauugagauuaaauggacacaaaaaacaucuuuaaagaaaaaauacacacaaugauaauaaaaguaaaagaguaaugaagaaauuuaaaugcauuauagaguuaagggaauuaaaacaaugugguauuugguacaugaaucacuaauucacagauaauacaguggaacagaucaaauggaaaauuguaaaaguuaaccaguaucacuggaggaaaaacagaucauuuaauaaguguuuuucaauaauugguuacaugggaaaaaauagaaaucuuuucucauucuuuacagcaaaaucaaugcagagauuaaaaguuuagacacaauaaaagcaccagaaaaaucagaauuuuuaaaaugaucuugguauaggaaaggccuuuauuaguguaagucaaaagcuaaaagccacacccacaaacaaacacacaaacacaccccugauaaauuacuaacuaaaaaaaacaaaaacauuuaauuccacaugauuuuaaaaaauuauaaagaaaauaggacaaauagcaaacugcaaaaaauaacagcaauaacuacagagacaaagucaugcccauaucuagaaagcaucuacaaaucaaugagaaaaagaccacaaccuaacagaaaucaguaggaaaucagcaacaauccaauagaaaaaugggcaaaguuuuacauaaaaguuaauacaaauaccucuuaaacauacgccuuugaccuaacaaucccacuucuagaaauguauccuagagauaugcuugccaaaaguaauguauauaucaggauacccauuacaaaauuguuugaucuauuguuaucauaguaagacauuauuaauaaucaaaauucccaucaauaggggaacugguuaaauaaggaagacuauucugcaagacuacuaugugcugauaugcaaugcugugcaaauaugauaaaugaaacaaagcaaaacaauacaaaauaguauguauaaugugcuaccauuauuuuuuauuuaaaaaaaagaaaccuauauauuaacauaguugugacugcauaggauauuucuagaaagauauacaagaaacuggacaccaaacacugccuccaaagaagagauugaguggcuggggaauuagaauccuaaaugacucucuucacuguaacccaucucauuuaaauuaauauuguuaaaagaaagcggccgggcacgguggcucacgccuguaaucccagaacuuugggaggccgaggcgggcggaucacgaggucaggagaucgagaccauccuggcuaacacagugaaaccccgucucuacuaaaaaaaaauacaaaaaauuagcugggcgugguggugggcaccuguagucccagcuacucaggaggcugaggcaggagaauggcgugaacccaggaggccaagcuugcagugagccgagaucgugccacugcaccccagccugggcgacagagcgagaccccgucucaaaauaaauaaauaaauaaauaaauaaauaaauaaauaaauaaauaaauaaaugaaagcaagcuagucaaagucacaggguaaaagggacacuucauaagauuaggucaugugaaucacuaacucaacuuuacaaaacaguaauaaacuagcugaaauaaacaucauauucaaaaugcucagaagucaaacauaucguagucuacauuucuaguaacaaaccaaauuccuuacccuuucagugcaugcauucuacaauuacauaugaaauaaaaguaacuugaaauuuuaacuuuuuuaaaguguauucauguauuuugucuuuauuuacccuucaguuuugagagacauuuucuucuuuuuauuuuuuuauuuuuuuauuauacuuuaauuucuaggguacaugugcacaacgugcagguuuguuacauauguauacaugugccaugucggugcgcugcacccauuaacuugucauuuacguuagguauaucuccuaaugcuaucccucuccgcuccccccaccccacaacaggccccggugugugauguuccccuuccuguguccaaguguucucuuuagaagcacucaguagcuaauuaaaucaaagaauauucccuugagcaaaaaaauaccaaaaauuaaguaauaaaaauauuuuuaaauaaaguuuuuaaaagaacauuaaccuaauuaucaauaauucauucuucuaauuguauaauuuacugcuauaauuuauuuccuguaauaaaaauauuuuaaaauaaaguuuuuaaaaggacauuaaccuaauuaucaauaauucauucuuuuaauuguauaauuuacugcuguaauaauuuauuuccuaaauucuugauacacuaaaaaauuaaaaagauguucucaauacucagacuaucaaccagguuaucauuccuuugaauguguaacaaagcagcagugauugaaauguuuucacaugucagaauuucaaugcuuaacaaauaucuguugaucucagagccaaacccugguccaggcacuagaaauuaaagcaaugaauaauacagacaaaaauuucugccuucaugaaauuuacacuccaaggcacacuuggauuccaaaacccaacuguauucaaaguuuaaaaucuuacuaauggcugaaagcagagaaaggagauagagaacaaaggaagcauaacaacgccccccuuaauuuauguguguaacaaaugaaagugccugucauucaccauauucucuaagucccuccucagaaaagacacuccccugauguagaagcuccaaggaguuacuuacuagccagaaaguauaaagggaaaauuauaugucaaacuuauuagucaauaguaucuaguauucucuauuucaaauauuacaaauauauaauugguauagucuuuccauggacccuuucacaaaucacuacacuuaaguuuccaacagcgaagcaagaauuucuuaaaauauaucccaaggaauugcaaagauucucauuccauacgauaccuaaacauacucuuacagacugugucaauuuuggugcuacaauuugaccaaaggcaugcguuccuagaaaauauugucaucacagauccucaucauagaugaggaauuaugacauaauuauucauaauucgauuguauacaccugaaauuuucuuuuuauguucacacuacauuaaagaagucuucauagcugaaagucaaugcucuuagaauguucaaugguuggcugaaaaauuauaugacugguaauucucucucucucucucucucucucucacacacacacacacacagacacaugcacacacacuccuaaacugaaauguagucccaagaaccaaugcuuacuuggauaauguucaaaauucucucaaaauuccccucuuguauugucuguagaguguuuauagacuauguaaguggagccugaugacuggaauacaugggacuuuuaaaaaaacuaugacugucacugucaaauccacucacaaaacaaauauuuggcuagucccaaucaucaaaucaaucuucaaaagaugaagacaugucaccauugaaauacucaagagaaucuaacauaggcucugaaggcacuuccaaagaagaaaugcaaaauauucagagcaacaaaguuacuguuagaacacauuuauucauauauguaaucauucagcauuuaguaagcacccacugugccagauacuggggaauauuuuaaguguuaacccucauucagaugcagaaguucugguaugcuuguuaaaaaagaaaaagaaaaaucacuuuacuuuauaaucacaccucauuuauggccugcuagaauuaguuagccaaauggccuccgauaagcucaaauaguuuuaacacuggguuauuggggucaagggcuaagucuccaugugggagaauuaaaucagcucuguuccagggccagacgacaugguuagcuccaggcagccauucuguaaaugucuguaauugaucacaaacugggcaagugggcaggaauggauucacgaaauccaccauccacauaagaaaaacaacuagaagcacauagccuaauggcaugcauacagaauccuucuauagcaucuauuucucuuucauauauuuaaggauuauagaugauguggguuaugaucauacauaccucaaaaugaugaucaaucaacucaaaauauucuugaagggguauagaucccgaaaaagaacaugcaaaaucuuugacucccuguuuuucaaaauauucuugaaggcgaagaauaagcucauugguuaugagccaaagaucuucaaauuguucacucugaaugcgauaucguucugagagaaaaaaauuaaggaaaaaugcuuaguaacacagaauuacuagauaaagcuacaugaacuaucacuaauccugacuuuaaaaguucaaagauuucauuuuuguaacaaagauaugauuacacuggcuuuauaaaaauacuuucacuguuucauugcucccugcaucaaccacuuaacacuuucaaaucuaauuccaaagguagguggucacaguggcaaaguguaaagcaugguccuuuuuguuauauaucuuauaauaggcuucaguacaauaaaaacacccaaauuuggguccuuuaaaaaggccuguacuuaaaaagaaaagagccauugcaagaauacaauuuguuaucauuaguaucauuucaaaauacugaaguaaaauugauucuauauaaaauucaauacccuggauacugcaaucagcauaauucacuguaaucaugaucaaagcuuucuauuuuucuaauaguuauuuaauuugaagagagauuuugcagucagacccuuuucuaaauauaaaucuuguuucccuuuauucccugagaccucagcuccacuacuccaagaugaccaauuucuagcuauucucuacccugaaaaugaugacaacaauggugacaaugaugguaagagaggugguaauaacaccuaugauaagaacagcuauuauuuguugggcauaaacuguguaccaagaacugugauuacaauagccccuuuuuuauacaaaggaaaauaaagcacagagaguuucacagacuugccaaagaucaaaagcaauuaaaugccagugcuagaauuaauaguucauauccuucugccuaaaucguacuucuucaucaggaccuggcuuuaaucucaucuacucaaaucuugauuucucugauauccaugggagcucaaucugcaccagccacauuuuaagcacuuuacauucacuuucucauuuaaacccuaacagcccuaugagagaaauaguguuacuagccaguuaguaagagagcaggcacuggaacacuagauauuaaucuuaacugccucauaacauugugucuuccugaauuuauauagagacuuacuaugucuacaguucacuaggcacuuaacuacguaaaaccaugcauucuuauauaacuuccaagauuauuacauuugcucccuuuaaaggaauuuauacacuuuuuuuuuuuuuuuuuugagacagggucucacucugucacccaggcuggagugcaguggcaugaucucaguucacuguaaccucagccucccugguccaagugauucucaugccucagccucccaaacaacugggauuauagguaccugcaaugacacacagccaauuuuuguauuuuuaguagagaugggguuucaccauguuggucaggcuggucucaaacuccugaccucgugauccacccaccucggccucccaaagugcugggacuacagacaugagcugccacacugggucaggaauuauacacuuuuuugagaucuaggacuaaguccucuauuccauuuaauucaacacuuauugaccaucuauuaugcagaugucauaaagagacacacugggaguacaaagaugaacucagucuucuugcuuagggaaucuaagaucuagcuagaguagcaugauacauggacauauaaaauauuucuuuauguuccccaugguaacugugguaaauuuuauaaaugcaauuacuucuucggauugguuauuaggacuucaauuugucaucuccauccagaauucaauaguauaucuccucucaucccuagucauucccuuucacaaugauaaagaauaaaauauacuggguaugccugucacaauccaugcaaacacacuggucuuugcugcugaagucauaccccauucuccuugaagcuucaccaccccucccuucaccccagucuuauucuggaugcugaguucugcccauaaugcugauuagguguuuuccuuaaucaaagauaauacuuuuuaaaauaaaugccaccaaauauuuacuuuuguaaauaaaugacacugaaguuuuaauguuuuagagauaguacaguuguggcggggcagggguagagagguagaugggagaauaaugaugauaaaguaccguauaagaaccuuuuaaaucuagucuuauccacacuaagcuugagauccaacauauuaacucuagauuguauuuauuuacuuucauucauuuacguaacucagugcaagacacuggggauaaaaucaggaauaagggaagaagagcuucugcccucaaggagcucccaggagacuuggaaagagagccugauagcagaagacugaauacugcuucugccaucacucuucugccaucacugauucaggaccaaucauuagggcugaccuugccacaggggugccaggaccuccccgcaagaagauacacuaccauuuucaaguauaggaaggccuaucacauaacagaagaauuagacaacagcuagagagaugcaaagggcacaauacaugauaagaacuauauuaacaaugauagaugcucauggcugccucaggaaaaacugccauuaaaaguguuuuucaggcucugaacccccuggucuuugguauuuucuugaaaguccaccugugaguugcagaacucggugugaaagaaagaucauuucaugagguacagaccugucucagaucuuguaccaggauccuuauuuuuaugugugucuguccauccuaggcagcccacaucuaggcccagguaacacccuaggcuucuagggggagcugaguuuggccagcuguaucucuuuucacagcuuugugaucucccagaacacuggcuucaaauccugucgcaccaggccuuguggauguagcagauauagaugaaaaaguugcacacugcagugauccuggccugagaagacagugagaugugguaguggcucgcaaagucacaaagccagaugugguggugguggcagguaugggccaaauugcucaagacacauauauuggcacugccacaauugaccacaguuacccucacuauaggcagcuucugcagagccacaggcuugauagugaguguggugucccccauagaggccuacaccuguggcaagagauucugcacugugaaguccaggcagggguccauauccucccacuacacccuuugcagcaaggaacaggucuuguccaagguagguaauuccuuccaggcuuggaacucugccaauagugucacauccaccuccuuguccaaggugagggcaugucucacaguggggcacaaggccaaggagagggcacugcuggugcucuuagguuggcagugggccuugcagggcccacccuuaguggggcucagcaggugcagguggagcuuguaguugggagaggcugguguggacaugaugaccagugucuucaagcugucaccucugccugcagcaugucuaucuuuccccaugccuccgcauucagcugcuuuucugacacugccugcuguaugcuggcuucccacaccaucuugugggcuuccucaaacaggcuagucaucagcuccuccagcucccgugcagcugcuccugcacuaggaacagcugcucacagucuucgcccuucagcugcagcuccuugugagcuuugugcagcuucuccuucaggagcucagagcccuucuugugaauuccuauggagauccugcaggaauaccugccaaaagcauuagagagcuuccaccagguucguaagguugaacacgauccuuuacaacucccagauucugaaauuucugcuuuaauaugcucauuuccuuucacguauauguaccuuuaaauaaaacacuuaaaacaaugcuugacauauuaagcacucaauaaauguuacuuauugucauuauuguuuucauuacuuuccccaauuuauuauaaaauaaagggcagagauaucauaaauuucuuuggaccuacacagcacccagcuaaucaaguaacuuucacauagcagauacaaaacaacuaucuuuaauaaaauauguuuucuuuagcauacgauuuacugucauuucaaauauagcuguaaauuuuuacagaaauuucacagugcuaauuuuucaaagaaaauucaauucauucaguuucuagaaggauucugaauaagcuuccacaugcagauagaaaaaacuugggguuagccuaaauauauacaaagaauaaaauucuuuauauaugaaauaaaauagagcuguagagaggaauuuauuccauucaacuauaaauuuucagugaaaauguauuacaaucuuaaaaaagauaaacauaaacaacuaggauuauuaucacacguuuaaagaacuguaucaucuggccccagaaguaaaaagacacauauauaauucaagguaccugaaugaaguaaaggagcaagccauggggaaaucuauggaaagagcauugcaagccaaaagaacuguagggacaaaggcacugaggcagaaauguguuuauaaaacacagacgaggaacguaguacgucugaagugcaguaagcaguuuuuauguugcacuauaacaagacauuauaccagcuucuguuaaaucacccauguagguauugcaaaaacaucuggaaacaaagcauguucagguacguccaggcaagccuauccgccauaaguuacugugaaaauugaucagaauuuaucacuggggaaaaaacauggacaugauucucagcagaacaccaauagcaugcccaagcucagcuggccagagcugaguucuugaugaggaaagacaaacccaauuaggaccuacuccaauaccucagugaaacugcuaggcugagucuucacucauagcuuacacugggcauguguguuguaugaaagaaaaugggggaugcugugggcuaaccaagaaaggcagcagugccccaaacucuuccuccagcgaagucaagugucugccucagcugccuauggagcuccuuccuuuuacuguccugacaaacaaaaaaaucucugacaaaaugaaaugugaauaagucuaagcuuuucucuucuccuuuuauaaaaauuuggauuaccucaacaggggccuaugagcucuccgaaaggcccaucucaauccccccauauugggcaaagacuucccucucuaaagauaaaguaacagagaaacaucacaugcaguagguucaaaggaaagagacaaaucaaagggacgaaauucucuuuauaaaagagagguaauagaagauaauucuuguuuauaguuuaaauaagacucaagguaacacugcaucuauucauuuauucaaaaaauauugcugagugauaagugcuagggagauaauagugaacaacacauacaugauccuaguccucauucuagugagaagggcagaaaauaaacaagugaauaacauaugaaacagaccuaugaaaauacugugaugcagaaacaaaggugcugugauaaagacaaauggguggccuuucuugagaugcuauggucgggaaaggccacauugagaaggugacgucaguggauaguacuaaugguaauaaggaugaaaauaauacaagcagccaaaauuuaccuagcacuuacaaugcaucaggaaauuauuaugugcuuuuuagggguuauuucauuugauucauauauaauacuacaguacuauuuuagggccauuuaauaaauuuuuuaaugguuauuuaauuuuuccaaagucauucagaagaauuuuaagcuagagcugggaucuaaacuaucaauuugagucuacaccucacauuccuaaugauuuuguacauaaagccaagagccgaaucaggaacacaaucccauucauaauuaccacaaaaagaauaaaauaucuagaaauauaauuaacaagggaggugaaagaucucuacaauaagaaucuacaaaaacacuacucagauaaaucagagaugacacaaacaaauggaaaaaacauucugugcucaugaacaggaagaaucaauaucaucgaaauggccauacuacccaaagcaguuuacagauucuauacuauuccaauuaaacuaccaaugacagucuucaagagcuagaaaaaauuauuuuaaaauccacaugaaacaaaaaaaauauaacaaauagccaagguaagccuaggcaaaaugaacaaaauuggaagcaucacauugcccuacuucagacuauacuacagggcuacaguaaacaaaacagcaugauacugguacaaaaccagacaaaucgaccaacagaacagaagagagagcccagaaauaaugcugaacaccuucaaccaucuaaucuucaacaaagcugacaaaaacacgcaaauggugcuggaauaacuggcuagcaauaugcaaaagauugaaacuggaccucuuccuuacaccacauacaaaaaucaacucaagauggguuaaagacuuaaauguaaaacccagaucuauaaaaacccuggaagacaaccuagaaaauaucauucugggcauaggaauugguaaagauuucaugacaaagacaccaaaagcaauugcaacaaaagcaaguaugacaaaugggaucuaauuaaacuaaagagcgucugcacagcaaaagaaacuaucaacagaguauacagaugaccuacaaaauaagagaaaauauuuguaaacuaugcacuggaaaaaggucuaauauccagaaucuauaaggaacuuacacaaauuuaccagaaaaaaaaagcaaccccauuaaaaagugagcaaaggauacgaacagacacuuuucaaaagaagacauacauauggccaacaagcacaugaaauaauacucaauaucacugaucauuagagaaauucaagucaaagccaaaaugagauaccaugucacaccagucagaaauguuaauauuaaaaauaagucaaaaaauaacagaggcuagcaagauugcagagaagaaagaaugcuuauacacugcugguggggguguaaauuaaguucaacccuuguggaaagcaguguggcaauuccucaaaaaacuaaaacauaacugccauucaagccagcagucccauuacuggguauauaccaaaaggaauauaaaucguucuaccauaaagauacaugcacucauaugcucauuguagcacuauucacaauagcaaagacaaagaaucaaccuaaauguccauugacaauagacuagauaauggaaaugugguagggauacaucauagaauacugugcagcaauaauaaagaacacgaucauguccuuugcagaaacauggaugaagcugguggccaauauuccuagcaaacuaaugcaggaacaauaacaacaacaaaaaaaaauacugcauauucucacuuauaaguaggagcuaaauaaugagaacacauggauacaagcagagaaacaagagacacuggggccuaccucagaguggagggugggaggaaggagaaaaucaggaaaaaauaauuuucagguacuacacuuaguaccugggugagaaaaguaaucuguacagcaaacccucauuacacaaguuuacuuauauaacaaaccugcacauguaccccugaaccuaaaaguuuuuuuaauguaaaacucauaauaaacauuuaaaaaggugugauauuuucaguaacuuuaaauuuuuaguuucuguuucuuucuuaauuuuucaucaacauauacagaagaaaaauaaaaaacaauuuuucuggaauaaaaaauuuaccauuaggaugggcacaguggcucacaccuguaaucccagcacuuugggaagcuaaggaaggcagauugccugagcucaggaguucaagaccagccugggcgugaaaucccaucuuuacuaauauacaaaauaauuagcugggugugguggugcacaccuguaagucccagcuacucaggaggcugaggcaagagaaucaguugaacugggaggcagagggugcacuaagccaagauugugacugcacuccagccugggugacagaguaagacucugucucaaaaaaaaaaaaaaaagaaagaaagaaagaaagaaauuugcaauuagucuuggaauuuauaaacacaacaacauuuuuugcuuuuuuuagauuaccaaaaauccaaagaaucaaugaguccaagauuuauaaaguauuauuuugauuacuaaacauuuucucaguguuaguacuccaagaugguuaauacuaucccuggagacuuuccagaguuuauauuucauggagggagaaaugaauuuuucuauuuauaauauaacauaaaagaaccuguauuuuaaaacgugcccuugaaauauuaguaaucaaaauagcugucaaaaugaacacucaauuuguuuaucucuuuucuuuuguaucuugcaauaguagcucaguggaaauaaccacuucaguuuccagauaaaauaaauuuagaugaucaaagccuagacaauuuccauaacacucuauuacaaauggagaaaagaauauauuuaauuaaggaagguaaaaaaaugcaucacaucagucuuuaugugugucagaacaucuucucaaguucaucaguauaaugcuuguauucguaucauaaacagugaacuauacaauucaugcuauuuggaaauuuugaaaugagagacagaaaagcagaugaaugcuuuuuaaaccaaaauguugaggaaauaacauaaacuauuucaauagguuuuuuuuuuuuuuuuuuuuuugagacggaguuucacucuugucgcccaggcuggagugcaauggcaugaccucggcucacugcaaccuccgucuggcagguucaagcgauucuccugcuucaaccucccaaguaggugggauuauaggcagguaucaccaugcccagcuaauuuuguauuuuuaguagagaugagguuucuccauguuggucaggcuggucucuaacucccgaccuuaggugauccacccaccucgaccucccaaaguccugggauuacaggcgugagccaccacgcccggccuuuugguagguuuaacauuuuaaauauacaaccucuucaauauuagcaacuaaggauuguuucucaacgcuuacuuuucaacaggcuuuuuccaagcuagauuuauauaauauucucauugucacuugauaauauugcuaagaaauuuuaaaauaaauauuaacaguaauauauugcugaaucacuguauaaguuaaacuauucucggggcaugaggugggcaucaguugaccuuagauuugguuauuauacuugucccuaaguuuccugaccucauuaaaggacugucacagagcccuuaccacaugaacuuucagcacacaagaaaauucacuaauccuuugaaaccucaugcuuuaucaagcaucaggauauacuuuccccucuuccuagaaugaccuccacuugauagucuccuacuccuuccucaagacccucuacaaacaaaauuucuaucgaguuucaauccuuugggauauaacagcacuaaaaaacaugcuucuauaagcacaucaagcauucuauuauugguucucuuuaccuguuugucucucccauuaguguaggagcuccacaagagccacaacaguguuuauaccuaacaugucugcugaaugaaaagggaauaaauguauugucuaccaagaugaaguaaaauaauacucccacuuccuuuuucuccagguacuuuguauaacacaguucaagaugacauaugauuucuuuuggaagaugcaaaagaaauccuauuucaaggcccaaccauuuuucacauaugugacuacaauccuucuauuauaccugaaagcaaaauaaucaaaauggaccaaaaaaaggauuuuuaaacuugaccuuauucaauucaaucacucuuccuagcauguuaaaaaucuuucaggauauugaaacauccgauguauuaguuaccuuuuccauuuuucaaacaccuaccuaaggcuauaccaauuugcuacacauuagguauacuuuauccaaaaugcucaggaccggaaguguucuggauuucagauuuuuucagauuuggggauauuuguauuauauacuuaagcaguuuggcauuccaaauccaaaaauccaaaauccaaaaugcuccaaacuuccaaacuuuuugagcacuuuggauuuugaauuaucagauuugggaugcuugaccuguauuugcaauuugucagugucacuuugugacacugagaguaugugucuauucagcauucuuugcagauuaucaacuuagcaagacacagcauucuaaguugaaaacucccuccaaucuuggagaaaacuucugcguugucuucuaucaucgaauuauuuugaugaaaagcuaaaugccaucuugauucauaucuugaguaacuuguuuuuuuucuuucuaaucuuuaagaauacgcuccucagugcucuaaaauuccacaaugcuuugucugagagggagagagaaagagagagugugcguguacuuucucauucauugugcuaagcaucaaaacaauacaaaagaucaacaaaacaaagagcugguuuuuugaaaagauaaagaaaauugaacaaaccuuuggacuaaaaaaaaagaaggaagacucaaauaaaagaaaaaguagaaauuacaucugauacuacagaaauacaaggaaucauuaaacuguuaugaacaacuauaugccaacaaacuggauaacuuacaagaaaugauaaauuccuggauacauaaaccuaccaagauugaacuaggaagaaauagaaaaucugaacagagcaauaacgaguaagaagauugaaucaguuauacaaagucuccuaccaaagaaaagcccaggacuugagggcuucacugcugaauuccaucaaacauuuaaagaagaacuaauaacaauucuacucaaacuauuccaaaauaucaaagagaauggaauacuuucaaauuucaaucuaugaggccaacauuauccugauaacaaaaucagauaaggacauaacaaaagaagaaaacuacaggccaguaucccugaugaacaaagaugcaaaaauccucaacaaaauacuagcaaaccaaauucaacacagcacauuaaaaagaucauucaccaugaucaagugggauugauuccagggaugcaaggaugguuuaacauaagcaaaucaauaagcaugauacaucauauuaacagaaugaagggcaaaaaccauaugaucauuucaauagaugcagaaaaagcauuugacaaauucaacauccuuucaugauuuuaaaaaaacucaauaaauuagguacacaaggaauguaccucaauacaaacaggccuuuucaauauccacaacugugauaccucauuuucuugaaaucuuuguccccauuggucuucucuccacuuuagcaauccagucccccagugaugagcuugccauuaucagaaucugcaaucucucugaacucuuguucucaauaucugauccauucucugaccacuaccuuuuuuuucccuuuuauuuuuuaaccuaguucacuugcucuauaacuccuacuacuuuacuuccucaaacuuucaagaauuuugaucaggugaacccauuaauuuuucaccauguaucaguuuucucuaaucgucaccgauuuccuuaccaucucagauuugguaguccauuaugauaaucagucucauuaaaaacauuuuaucuguaauucuguuuuaaaaucugagcccuguuuuuaguugcuuagaugcugauaaacaaaucacuuccagggaaaaucaccuaaaaaggauggcugguuucaauucaaaauguaggaucucaaacucuagauggaaauuccacaaugccuauuucccucaugaguuugcuuucuuauuuucucacuauuuuuuuucagauuuauacauuaucaaagcuccuuuaucucuccacuaacaaaucuacaaagucucccuagguguacauacgaucccuccuguuacagagaaguuacaaaggccuauuccucaaacccucccgcaagcuucugcaucccauccccucucucuucuucacggacuuaugauccacuucucuuuccugaucaucaaccucucccacugaacucaaucauuuaaauuaauguucaaacauguucuaauauugcucauuuaaaaacaaaauacacaccuccuucauccuacaucucaauucugaguuacugaaauugguugcucaauccuuauugaaaacacuagauacugaaaacuugcaaaacuagauacucaaaauuuauccuuggaucaggcugcagcuuagaccacacugauuugggcucagggagaauuauauuuaauaaauggaguuuuaucauuauuuucuaaaguucugugaaauuuguuucucauaauuacuuaagcauaaucuuuauaauuauauaaacuauagagauauuauuaaaggaacugucuuuuugaauauucauaagcgaaauuucaucuuugacucagcaucaguaaagggugugcaucuccucaacaaaagguuuaauauuuugaacacucugaaaauggaaacaaaaugauuucuuauuauuuuaggugacuagcaccuuuuugaucauacaguauguauuucugaguauuaaucuuauuucuaccuuuauuaguuuccugcucugauuuucucuuucugauuucuugaaauacuuauuuucucuuuucauauuuuggauacuuuuaaacucuucuaaauucuuuaagaagcaaguagaacaaggcaauguacaaauagagacaaaagauaaaaacagaaccagagagaggcaagaccaagaaaaguacagaaacagaaaggggcaggagagacuggggagagagagcuagcaguguuuguuguauaugguaauaagucacuauguggaucuggaccuuaggaaagcagcguaagaauauacacguauuuacauaauagcauauuuuucugaaaucccauuauacugaaucacucgaaauuauagacauccacgcagaaauauuuugcaauauuaauuauaaaaacauuugaucucacaaaaguagaacuuucccguuauuuuuaauuuaggacugugauaacaguuuucagaaauguugcuagcauauuuuucccaaauuuaagcacuacuuuuuuuuuugagacagggucucacucuguugcgcagguuggagugcaguagugcaaucucagcucacugcagccucaaccuccugggcuuaagugauccucccaccucagcuuccagaauagcugggacuacauucaugugccaccacaacuggcuaauuuuucuuuucuuuuuuuuuuuuuaaauagggacuaggucucacuauguugcccaggcuggucuugaacugcuaggcuuaagcgauccucccaccuuggccucccaaaguguugggauuaaagggguaagcugcuacacccagcuacuauucugcuuucuaaaaauauaauccuacucaguuccccagggaauuugguuuggugucugagacaaugagcuacaccuuacuuuucucuuguuugcuuugacuggucuauacugaaucagaaaaaggaacuaaaaucgccauacagcauacaugaaggcuugguugauuaccaagcagguuuuaaaaagagaugaauacacggaacccacagaaaauacuauccaagagucaaggacaauucuaugugacuuaugaaucauuugacuguuuacuauggaagaaauacuagguucuuucauuuguaggauuuuucuguaaagcagauugcuggacuacaauuaauacuagguaccuuucaaaaaaugaaaaaugucaaacacagauuggguacaaauuacuucauuccuuucuuaggaaugaauacucugauaaagcaguaggagcaccaacaucugccucaaucucagaaaaguacacucuccuuauaccuaucucucuccaucaccauaggcaucuccuagguaggauucugugugucacuguagccaaaaaccaucauagaauuguaaugacuauuauucagguuucaauuuacacaguuuauuuggcuccuuguuuaaaagguccuguccuauuccauuauuugauuuuguguaccuacacuaugcuaagucagggaauugccauacauucagacaaagagaauaaaucagauauauaauugauuuuugguaaaauuuagauagcaguaagguaaucgugggcaacaucaggguucuacuuguuacuuuauauuaaaaguuauaaauaaaauacauuaggauauaaauauauucauuugcaaaaauuuuugccuuuuuuaauggucucauuugcagauucauuauauggcaccaucaacugcagucaaacaaauguguacaauuucccaaagaaauguuggcauaacuuuuuuaguuuaaccaaggauaacuguuaaacuaagagaaaugcaccaaaaugguucuaccauccaacuggagauuaaagcuaaucaaagcaaaauggugcuauguacuuacaguuagcaauauugaacuauacauuugaaauuuuaaguggauagaucucauguuaagucuucuuaucaaaauaaaaugauuuguuuuuuaaaaaaugaugccaauguaaagaauacugcaaucaugaccaaucagaaaaaucaugaaaauaaagaaucuccucuuucuucucagaguuguuauuucugugaccuauuauugagucuucaauaguaucugagucuauuuuaccagucaccaauugacauauuccagaaacuauuaugauuuuagccauaaaaacauuguuacaguuucuaaaugggaugucuguuccuccugcuaauacuuuucuuuuucaaaaacagauggccuuauuguacucuuauuauuagaaaagcaauaaccaacuacaacugcaaaugcauggguagaaagugaaagcucaccagaaaaacuagaguuuuuuuuuuaauuggaauguccugagccagacuauuucaaggggguauggguguguguguguguguguguguguguguguguguguguguacuuuuuucucucaauacagauucguuaaauacuuccuuucuuaauaucuuacuuuauucccaugaagguguguauaacucaguaagcucaguagcuucaguauacuacauaugucaagagcuaguuuuacauugacuaguuucgacuauuauucucgcauacauaaagcaaccaaaucaauaaagcauauuuaaauucaaacuugacuauauaguuacuacaccuuucugccuacugaaauuacacucagcaaaagcuauccacuuucacugucaucuuugccaauguccaaaaugaauaaacaagaauauaugcaaacaaaaaaauuccaaguucuaggaguucccaaaucuaguucaccauauaccuaccucaaaaauauuuuucauuucuuuaaauuccucucuuagacucuucuuagcuccaagacaaaaauuacauacacucugauaaagugaauauaucaguuacauaucugauuuuuggugaaauuuagaucaugguaagguaaucuugggcaacaucaguguucucuaauaaaacacaauccucacuucauaacuuucacauccuaucuacuuaauaucauggcuuuuaguuacugaaaucuaaaugaacaucacccuuugcaggaauuauugaugugaguauccucugugaugugguauccuuagaaaaaaauuuaaaaagcaaugauaacaugguuuuacuuacgagaaguuuuggaagcaagaacaguaauucgagcaccuccuaagaagugaaaacccauuacauucaccugaucaucaucugacugacuggcaaaaccuacaaagaaaagagagaaaucaccuuauguaaccagaaggcaaaaugaacacauuugaaauaggaaccuuaguugaaugaugcguguuuuuuaugucacuagucauguauaaacuccaugugugagcuauaauauauucaccuugauuuccauaguagcuuccaauuaaugaaauuucugccuuacacuaaaacucuggagucauuuaauuucauuuauucuaaugguugauuccacauaugagacagaacacgugcaagaugaacuuagaauaucuuuucaugccagauagcaaggaagcuauuaccgagccaguaggguuuuaugaaaacaacuugaaagccagcuuaaagagacuacuacuggccagagauaaaaauauuagaguaucaaagaaaauaauaauugcaauggaguaaaacacaucaaauauguuuaaaggcaugaguucauacagagacuuaaaaacaaaauaaaaacaaauggucacuauuggaugauccuagagaaucaauacuauuuauuuuaagcucuauuuauuuaaaauauuuuaaaaauuaguaauaaagggaaagaaccaagcauuuauccugaaaacccuacucaaacugcaccauauaacaacuacuaaaggaaagguucucucuguagaaauaauccagcuaaaaaaugaagaaagugugaaagaaacaaaauaucuauuuuucagccuguagugaacuaauggaucucagcauuggauaucaauggcuguuaccaucacacacaaaaaaagacaaacaaauauuaugugcccucuguuugcugaaagucuauacuaccauccaugaagaacuccggccagaauagucaaucuugacucugcuagcuguagauccaacuuaccaauuuacagacaaagugacagagaaaagaaauauuaggccaggcgugguggcucaugacuguaaucccagcacuuugggaggccgaggugggcagaucaugagguaaggagaucgagaccauccuggcuaacacagugaaaccccaucucuacuaaaaauacaaaauauuagccgggugugguggcaugcgccuguagucccagcuacccaggaggcugaggcaggagaaucgcuugaacccaggagguggaggcugcagggagccgagaucgugccacugcacuccagccugggcaacagagugagacuccaucucaaaaaaaaaaaaaaaaaaagaaagaaaagaaaaaaaaaaagaaacauuaaacaucaucacggggguaaaggaugucaccaagaugguaaaguaggggacacuagucuucauccccagcaaaaaaauuagagagagagaaagacagcuauucaaacaccauaauagcccugugggagcucaagggcccauguaagaagcugcagcaaaacggaacaaauggcugguuauaucggcauaccuaagaugccuacagauggcuagugacaaagaauaaaggcaacagccuauuggugacagccguggagugggaacuuccaugguucccagcagccugcuucacagaagacaccagcaucuuuugccacugagguaaccaauagccauuuccaccagggaaccccagagaggaaggcauggcuccauauucccuugcucaagaaguagcugcuguuguaccaccccagaaccaaaaccaccaccucuccaaaccuugcacauuccccuaacccccaggucacagucacuucaugaaugugcauacuucagacacuggcucuguggcugcacuaugcccauccaugucucagauaccagagcuaccaccagagugagccagcucacacccgagguccuacagcuaaggucucucugcguauuccuaugguucagucauuacaucaccugccauagaggacaaggucccauccuguaacccagagccagaguaacugcacacauccaugcucccaucucgggcuccccggcuguuucauaaacacuaaugccucacauaccaucaccaacacagcaguggggguuccugugccccaggcacuggugccauuaccacccaaagcccagaaccaaagucccuuuacacauacccaugcuucaggacuuggcuccauggcaucuccauagguaccacucaucaggcacuggaaacuggcccacaagccagauagagugccaagagggauccccuuggccaugauuucccuggugggagaaaaagagauugggaguacccuagcauccacugccauuaaagaucccaauagcccucacuauugcugagaacacucacagaguuggcaacugaggauaccagcaaucuuaaccaacaccaaccacagcuaagagagcugcaaacaguuuacauugcuaugcccuugccagggccagaaccucuacaucucauacugccagcacccuugaccuucccauagaagaaggucuuucguaccaaaaucagcacacgaaguuggaaaaaggagacugauccaccaaaugugccggcaucaaaguauggcaacaagaaacacgaaaaacaaagaagacauaucccuaccaaaagaacacaaugauuucccaguagcugaccccaaagaaauggacaucuacagguuaacaaagaauucaaaauaauuguuuucaggaagcucaacaaaccaggaaaaaaaagaaaaaagaaaaaaaaagagaaacaaaacccagaagaauaacaaguuuuggagcugaaaaaauacaaugaaugaaaugaaaacagcugggcgcaguaagucuagcacucugggaggccgaggcaggcacaucauuugagcucagcaguucgagaucagccuggguaacaaagugaaaccuugucucuacaaaaaauaagaaaauuagccaggugugauggcaugcaccuguagucccagcuacuugggaggcugaggucggaggauugcuugagcccaggaugucaaggcugcagugggccaugaucaugccacugcacuccagccuggaugacagagcaagacccugagagaggaggggaggugagaggagggggaggaggacaggaugggagaaaagggcggagggggaggggggaaaggaugggagggggaaggggaguggagaggagggggaaggggaggggagaggagggggaagggggaaaauauaaggaagaacaucaaaaauagaacugauuaagcagaagaaagaaucugugaacucaaagucagauuauuagaaaauacagugagaggaggaaaaaaaugaaaggaaagaagaaaggcugcaagauuuagggaacagaaucaagcaaaacaauaagagaaaaccuuccaaaucuggagagaaguauaaauauccagauauaagaaacucaugacaucaaaacauaaaauguggggggauggaguaaaaauuauucacauaacuguagaaaaaaacuaaauuacaaaucaauuucucucaugaacauagauacaaaaauucuaaaauacaguuuggcaaauuaaaucuaaaaauauagugaaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaauaaaaaauaaaaaaaaaaauaaaaauauagugaaaagauaauauaucaugaccaucuauaauuuaucucaagaaugcacgguugggcuaacauuaaaaauuaaucaauguaauccaccauauuuaaucaaauaaagaagaaaacgauaagaaugucucagcugauguagaaguagucuugaaaaaauccaauauccauuccugauuacagucucagcgaccuaggaauagaagggaacuuccucaaccugguuaaaaaaaaaaaaaaaaucuaaaaaauacuuauagcuaaaacauacuuaauggugaaagacaaugucuguucucaccauuucuauucaacauuaucccagagguucuagccaaggcaaaaagcaagcaaaaacaaacaauccaguuggaauggaagaaguaaaacuguuuugauuugcauguaacaugaucaucuauguagaaaaucugacugauuaaaucuacaaaaaugcuaauagagcccacaagugguuuaacaauguugcaugauacaagauugauauaagaaaaucaauuguaagccaagugggguggcucacgccuguaaucccagcacucggggaggccaagacagguggaucaccugaggucaggaguucgagaccacccugaccaauauggugaaacuccaucucuacuaaaaauacaaaaauuagccaggcaugguggcgugugccuguagucccaacuacuugggaggcugagacaggagaauugcuugaaccugggaggcgaagggugcagugagacgagauuguaccacugcacuccagccuagacaacagagugagacuccauaucaaaagaaaauaaaauaaauuguauuucuauguauuagcaaagaacaaucugaaauugaaauaaaacacaauagcauaaaaauauaugaaauagggauauaucugacaaaagaucuguaaaaccuguacaugaaaaacuaccaacccucacagagagaaacaaaauagacccuaaauaaaugaacgauggucugcauuuucaucuuaaaaaaacuagaauacagagagaaaauuauaccauguucaauauuguuaagauauugguucucuccaaauugauauauggaaucaauacaaucacaaucccaaucaaaaucccaacagccaguuuuauuuaauuuacaagaugauucuaagauucauaugaaaaugcaaaggaccuaaaauauccaaaacaaaauugagaagaauaaaguuggagaaauuauacuaccugacuucaagacuuauuauaaauauacagucaucaaaacacaauguuauugguauauagcaauagacaaaaauaucaauggaacaaaauuaagaaagcagaaauacacccacauaaauguggucagaugauuuucaacaaaguugaaaaggcaauucaguggaaaaggauagucugaaaaauagugcuguaacaauuagacacccagaugcaaaaacaugaauuucauccaucccucacaucacacauaaauaucagcacaaaauggggaagagacuuaaauguaaaguuuaaaacuagaaaacuucuaucaaaaaaaaagagagagaaacuuugcaaccuuggauuaggaaauaucucuuagauguaacaguaaauuuaugaaccauuaagaaauugauaaacggggggguuuaugaagauuaagaacuucugcuuuuccaaagauucuguuaagacaaucaaaauacauaucacaggcugggagaaauuauuugcaaaucacauaucaaauaaaggagcaaaagaagacaaaugaaaaagaacauauacuauauaguuccauuuuauaaaauucuagaaaaugcaaauuaaucucuaguaacagaaagcagaucagugguugcuugggaugcaggauaaggaauuacuaauagacaaaaggaaacuuuuggcagugauggauauguucagcaacuuaaccguugagaugguugcacagauaaauacagaaaucaaacuuuucaaaauuauacgcuucaaaugugugauuuaugguacaaaagucauacuucaauuuaagcuuuuuuaaaagcacaaaaauaugcacugaagcuguguuugagaacaaaaguguauaaaaauguaccagaaaaaauaaguaaguauuuuauaaucuuagaauagagaucauugcaggcauaacaugaaaaccugaaacuacgaagaaaguaauuaagaaauuuuacuaccuaaaaauauaaaccuuaaaagaaggaauuaaaagaagaaaugcaaguaguuaagaaaaauuaaacauauuggaaauucaaguuaaaaaugaaaugucauuuuuuaccuaauaauaucaaaaauuuuaaaagauuuaaugaauccagcugcuaucaugcgcaugaaccuugaugcugggaguauaacgugauacaauuuuucaaaaaggcagcugguauuugaauaaaguuuucaaauaugcauacccauuaacucaagcauuugucuccaaagaauuucuccuaagagaaauagagaaguacaaaaaaucuguauguacaugacaccuccaaacaauggaauauuauguaacuauuaaaauauaaauguauugacaagcaaauguagaaacauacuugagcaacauaaaagacuauuaucaaaugacauuuuaucuguuauuacauuuaaguaaaauuuuuguauaaaacuacugguauugugacauacauugauggucagguaauuuaacacauguucccaacccccuuuucucuagcccauuuaguuuucagccucuuguacugcuaaaggaagccaugugacaaaaauuauggcuauugaaaccuaagcagaaauuuccuagggaaucuugugaaaaaauccuuuucugauaaaaguuaucaucauuacuauauagcuauuucuucccccuaccuccuaccuuguaguaagauaugaugccugaagcugaagcaaauaucuuauugucguggaacaagucaacacacuaaagaugguagauuacaaaaaaagaaaaaaugcuagguauuucauaacagucauaaacuacugccacagcuuccacugcccacuucuggauuccucuuuauaugagauaaagaaaugucuuggccaggcacaguagcucacaccuguaauuccaacauuuuaggagcccaagaugggaagaccacuugagccuaggaguucaaaaccagccugggcaacacagugggacccuaucucuacaaaauaauuuuuuuuuaauuagcuaggcauggugguauaugccuguagucucagcuacucuagaggcuaaggugggaggauugcuugagcccaggaaguagaggcugcaguaagccaugauugugccaccgcacuccaaccucagugacagaaugagacccugucucaaaaaaaaaaaaaagguauuuauugcuuaauucacuuuucuggggugccagaagcaccccagauagcuauuuauauauguaaauaaauguuuucuauauaauuauuaagcauauuaaaagguuuuucuuauaagauucucuauuggcaagguuugggguacuggacgccuuuauucaaacauuguuguuaggguuaacugguauuccuuaaggaagucaauuucacacuauauuucagaaguuuuaaaaacauucugauucucugucucacccagcaauuccacuuuuaaauauucaucaaauaaacuauaauaaauuugaagaaguauuguuacaacaguguucaucacagguauauuuacaauauuaauaaacuaaaaacaacguaaauaucuaaaaguauaaugcuggucaaaugauuuuauaguauggauuuaugagagaauacuauguaaucauuaaaaucauauaucaaaaauaucuaaugguguaaaaagaugucucaaaacagaaugacaagugaaauucuuuuuggggauaaaugcuuagaaaaaauauuuauuuaaagauuagaaaaauguaaugaaacagaaaaagguauugcuggauaguagaauuacuaguaacauucacuuuuuuccuuuugguuauccacauuuucuaaauuucacauuucuuuuguaauaagaaaaauuaaagcuauuuuaaauauaccuauauuuguucacagaaagagaacuggaauaaacaaaugggaagacauguagaguaaaaguuguuuuauuucuucucuauaaagcucauuaauuuugcuucuuucaguuaaaaaaaacagacacagaagauuugcaauggcaacuuuaucuaagucuuacuuuuaucagagugaagugauacuuauuuuaaacaagcacaugauuccauccagcauguuuaacauuaauacaaauccaggaauuuuuuaaaaaccacucuauaucauauauauuggaucccagaagaaauuuuuaaaaauuugucauugugucccauuccuaaagugaguaagaagcaaauauaugcugaugagcauaaugacaucaaaacaauugagcccaaaaucaggaggaaaauggauaagucaucuaagcuuucuuuaguacacacuauacaauucguaucuuauggacuuuaccuuucugcucaaaggcauguguuuuuauucaauucuaauuggguugcauuuaucuacaguaaagaucaacccuuccucagaagucagguguuuaaacguuuuucaaagccaccaauaaauuugguguucaacauauaauuuccaacuauguuccuaagguaguauaggagacccaagaaacuaauaaguuuauacaagauguuacaaaagguagugagucuguuuuuuucauaauccaaguuuguuacaagaaaacugacuaaaaaauaaggagguaaaagaagagaugggagaaagaacccaaaagguaaaaaauauuuugcuaacaauauauacauauauaucuccaaacucaauucacacuuaagaauagaauaauuguaguaaaauauuuaaucuuggagauuuuucagaguuauauauaaauaaaauuuuugaaauacugcaaauuaauaaaaaauaaauuuuaagcacuuuaaguaguuaauaacacaaaaguugacuuaccauaaauuucuaaaccuugugagaaguauuguuuguauccuaaaucuuauccacuaaugcaaaggugaagaugcaucuccuagccaacagugcugauuuuuaaugaaggauuuaaaaggguugauuuaauuccaagauuuuauucuucaauucuaccccaccaucaagaaaauuaaugacaugacacacuaaaaaccuugguuacuaaggauguuugauccaaaaaagcuucuuuaguuucuaagccacucagaaagaaaaacugacacuucucuccaagucauaccaucacaaauuaccccaaauguucacugugauauugaagcauuaaauaugaaacccuucuaaacaaccagaagcacaggaugcacacccucuagcugcuguagacagcagaauaaaacaguacaaagagcaucuacuuauaagauuacuuuucagagacauaagaauauacuuuaaaagguacacauacaaaagccuacaaugaaaauaauaaauauuuauacacuuagaagacagauauauccaaaaaccuaccauaaagaugaauaauaaauauuuacauuccaagccaaaaaaauucagucuaaagagaaacacuugauuuuuauuucugaauaccauagcaaaauaauuauuaugauaauuuuaaucaaacuuaaaaggaauaccuuauuaccuuguugauauaagcuauucaccuuugaacaggcaaaggagggaaaaauccuugaggcauuuuuauacucuuacuuaacaauuaucugauaauuaccccaucauuaucugcugaugaaggauuccauucuaaauucuuagcauuuuugaugcugcaggcauguuauuucaacagucuuaccugggaagagacuaagaagacugacuggagauuuguugguaucaauaguaauuuuguggcuugcaguuuuugaaggcugaccugguaggcaaauuaacuuuaggggaagucuaaauuuacauuggauaacucgcggaaugccuaaaauaaaagagagauauguagauucauagacuugacaaauaauuuggcaaaaaaaaauuguacuacuaauaguuugagcagcaauauaucuugguuugcuuguugccugccuauuuugcuuaacaaagcugaaauaacuguaaauuauuaucaugauucauauuucauuacuauuuucaaaagguacaaggcaaaaauaaaauuuuaaaagaagcauagacaugagaucugucuuuaauaguaucauauuuuuaaaaucaucacauuuggauacuauauaaaacauuauagucacuuacauucaauuacugaacuaagucuuuaagaccuucagagcucuagcccuaauccaagacuaucagcaaacaugagcaaagaauaugaaguuucuaucauaucuuuaagacuguauauuaccauaucuaaaaauuucucuacucaaaaacauuuuaaaucuuuagcuuuuuuuacuugaugaagauucagauuaugaacaugaaagcaagauuugcucuucugaaguucuauugaaguccauguucauuuuacacauuaauauguagaauauuaccuuuauaugaauuauacuuuucucaagccauuuaacuuuacauaucacuuuaagugacauuuuagacauuuagacagucauucaauuguuaaaugauuuuaauacucauacaugcauacugaaauagguagcugaauauacgacaaugaagaguuucauauuagaauuuguauaaagcuuuucaaaaucauuuucaauauuuuuacagaaaaugaaauugaaaccaaagcaaauuaggcucucuacuuauaaaucuagaaaagcaauacuaaaauccuaguuuucucuccuuuuuucuagaacucuguuuuugacugguuaagaugaaagauaauauauagaagccuaugccgugccauagugcuguagaaaaacugaacacucaaaauguucuaacucuacuugaugaauccacacauuaauuccuuuauuucuuuauagaggagucagggagcugcuuaaaaauagcaaaagcagaagcaguuaguuuggagacaugaucccaaagcaggaucccuggaauuagcaauauauuuugcuaaagucaauuggaauuguaugucuuacuccacauccaagcugggaguacacuuuccaguacuacuuauucacuaggauagugagaaaucaucaacaauggcaagcauauugauauaugaggucaauuaaauacuuuuucagagcauguggagcauauuugucauucucuucaauauaaucuauuauccaucaaguuuuacguagcucauuuuuugcucauaaccaacagauguuaaauucacuucuccuggaauccuagaugcgaauuacaacuggugucucuuaagaaaagucccaggguauuauuucaugacauucugugagguuuuuagaggcauguguauuuguacuuuacaaugaugagauguuuugacucaaaauauuaugguaacaugaucuaagauacugcacaaagcacgacugucaauaucaccacaaaacaauuacaaagcacuacuuucuccaacuucaaggaaauuuccauauacucuauauauccucaaauuauggaaauacacccacugaguauguuuccucuacaauaaguaaacuguagagaaaauuucagauuguaucaauuaauagauacagucuggaaagaacaaggaaacuuaaacuuguuuccaucuucuucauuuuuaaugacuaguacaacaaaaacaaaugcuuccuuuucugacaauucuguacaggcacaaaaagaaacuaucuucuauacacuuucaaccaaauucugagcuaauuacucaaaccagaauuuggcugugaauguuccuccaaaacuauacugcuaaaacuguagccacuacuuuacuuggaccagguacugacugaauucacaguuaaaaaaaauuaaauauaaucaacaacacugccuauaagugacugagccuauauauuugaagauuauuacccuacaucuccacgaacccagagcuaaagaaacugguaguguauauguuuucagaaaucgaaacaaauggauugcaagcacuaauaaacccaagaaggaaaauacauuguaacucaauuuacaguucaguuaggucaguuaaugacaauaucacacacuagggcaaugguuugcaguugcuaagauuuguagagccccuccagaauaucuuuucucugcaggaauuauaagccuguuucauaggacauuuggaaaacauuacuuugaaaaaugaugacacucauacuuaauaaaaugauuauggcuauuuuuuaaaugauggcagcuugaaaaguuuuaccauuagggagaaaaaguuaugaaauccuuuaaaaaaaccagucuacagaaaccaucccuuaaaagaaaaauuagaaugucacuauuuuauaacacuaucaaauuaaaauccaaggauuuuacaauacaaucucuaguuuuuagacaugagguucaucagaggcacauuucuacugggauuuacaccuucuuaggaaaccugaaguguaaauuuggcuaccaauuacucuucaggcuguaauuaugucuaagaaccugaagccaaagacucauagaggcauguguggguguauguguuuguaauagagaaggaaaagaauuacauguauuuaaagacuuuucacaguugcuagcagaacagcuuucaacuuaguugaaagagacuaauugguccuaacuuugccuaccaucagcaguauuuucucucuauaguuggcaaaguagucuccauaucuggcuuacugaauucucuaaguguuacgcugagagaaaagaaacuuuugucauuuauuuuacuccaauauuggccuagucauuuaucacacugacuguucuguaguucuuuuuaccagauauaaucaccucuccuucaaacauuucccuuccuaaccuacuagaggaaauggauagucguaacuacuauggugcaauuaaucacaaaauuauuuaacacucagagagaauauucucaucaaaacuaccucuaacagaacauuuuacuuccaggaagagacuucuaauuacaucuggcacaccccaaaagcccaguaucacugucaaauuggaagccaaaaugugcuuuaaagaaauaaaggaaaaaagaacauagaaaaaaaauaaguauauaugaauaaaauaaccauaccuauauauuauacaucuauauaaugccuuuagaacucuuuccaggggccugcuagaguaauuucauauugaaaacaaggaaccccaaagcaguagcaaugucugguagccagaacuuccuugauuccuuccuguuaugucuggcuacguacugugcuucaucugcauucauguuuuacacugcucacgccauguaacuuuaaugcagaaauaauggagacuaacccuuaugggacaacauaaaaccucguuugccucucuuuuuccacauauaaaagcagaacugcuuaucugcauugcagcccgaacagaucaagacaauaaaauggaucagucuuugaaauaugaagccuuguguguaaguaagaucuaaguggcaacauauuauuuucuugccuacuaggugccgcugaauauuucaacuccacucccuaaagcuuaauuauaauuuuaaaauauaucaaagagauuauuaaaaccagcuuucacuuuguauugaaacacuaccauuucuauaaauuguggguuuuuuccucauaguuugggcugaauuuacaguaagaaggaauaaauuucuuugaacaauaaccuuaacugauuuuuuuaaacuuaaaacuaaucauuuaaauaauaacaugauauuuuacaaaauuugguccaaaaucuuaaaaauuacaggcaaucuagcuaauuaaaauguaaauauucauuauuaauaucagguuauuuuuuaaugacccaaauucuaauuugacaaguauacuuuguguuauuaagcuaaucguuuacuucuauuaaaacacuucucauauaaauauauauauaacuuccagauaucaagaugacaugugcuaugcaacucagauuguuggcaucacccaaacggcauuaguaaauauugccacaaucuuuaagucauuucauuauauuuauuuaauuauuacuaauuaauauugcuaucuaaaauguaucuuaaaauaacuuauaaagauaaacuaccacauuaagucuauaucuaagagggaaaaauaaucagagauacuuguagugccugcuauguacucuguuaguaugcaauucaaagaugagugcuugaccccugcccucaaaaagcucaaaaccuaaaaggagaaccuaaggaacaaacuuaauuaaguucauauugugaucagaaucauagcagagucaaacaaaagauuuggggaaaacaaagugaguaacaacacugacccaagcaaguuagagggagucagauguuugauaacauuccccuacaaauucuaaacaagacaaggaauaugcccacagagcgaacacacacaccauucuuaucacagagaggugaaucucuuggaggauguagaaaaacacaacuuagaauucagugacaaacacuuuuuuuaaacucuuucuuucuuuuagguaaaauaacagagcaugcagcuaaauaaccaaugacuugcaguaauaaguugucaauaacaccuuuaauauuuuucaaaaaagacauucuauuuuuacuccuaauuucauucuuucucaugacuccgaaacaacuaauaaugacaagucucuguggaaacaucuacuaugcucuccauagcagaaucaaggcacuguaucauccuaaagaacuucuucuaguuaaaagagcaguccauaaaaagaguucauucaugguauaauaccaauucaauucaucaaauuucaguucugaaauucauuuuuuucuaaauuaucuuuacacuuaccaucaggauuucgaucuguccaucacaggcaaugcaaaaauggguagggggaaaagaaggcaacaaauuaucugugguaaaguuacaacacaaauuugacacauaucugcuuaaaauacaaauuaaaauuucaagauucucacagaugacuuaaaugacucuccaaacacaagucaauccacaauugagaguauaacacaaauaaaugaaacccaacaauacauuuauuuauauuuccauucucagaagucuaugagaauguguuauuccacuguaaaugugggaaaaaaacaaguaaagauauaugaucuagccaaacagcaaaaaagacucaauaaaggggaaaauacauaauauuaauauuuccaguuacuuuuugaauuuauuuucuuuuaacuuuccccuuuaaagucaauccaguuccucuuuuuuauaauaauuuaaguaaauaauacuauugauaacgucucuuuuugcuucucuuggcauucugcagacucucucaauguuaauuucuaauucacuuucaaccaauaccaaugauuaguaaucuucuaaauucugucuuucaaauugcagaaaagcauaauggccaaaaaugguugaaaaaugcagacuaaguuuuaaaagaucuguucuuaaguauuuuaacacauaagaugcuaaagaguuuuauuuagucacuaaaacagugucuaaaacucugauuacugcccuaauguuggaguaauccauaauauuauuuucuacuaauucauacugauagagguaggaggcagacaaacgccuaagcaaauacggaaaggucccaggugaaaucuuaccuucaggcuuaaaacagccugagggcugaaagaccguacugcugguccuggaugaaacccagaacccagaagaacuucugucccugugugccugcccuuucccaauugauucuuucugaauaaugucuuuuagccaaucgaaugcugccuuuucaaauacuaccuauggcuugccuggacaugcccgcgagcgcacuggggaaaugggguggggccacaaggaauaagugccuuacgcaggggaggagccuggccucaucagcucaggugugggagcccugguauucaauuugugagguggaaacccgcuuuaaaaauuccacccuccucacucacuguguccgcaugccuaauucuuccuggucaugaaauaagaacgcagauauggcugaacuaaggagcaaaaauccugcaucaauacuagccuuugguucaaauaaaugaagucugacuagauaacauucuucuauuaggaauaaaaauguaucagauuugcuauuaacugaaaagagggaaccaaacauuacauauggaaaucagcuaaauagccuuaucacgaacuacucauaacacauaaaaguaaugaaaacaugauuuuacuuaacaguagaaaauaacauuuucucauuuaaugauauuucacaguauguuuucucaucuuaaaugcauaagcauuuuacucauaacuccaacaacuuaaaguaaugauuaagccuguauguuuaccuguuggucuggaauaagaaacaacagcauuuccuuccaauucugaugguguauaacuucuuuucagauaaacagaaaagcuuacuguucuagucaaaucuggugcuauaagcaauguaaaaauaauauaaauuacauaauuuggggcaacuguuauuaacaacaguuaaaauuuaauaagcacucaccacaugccagguacugucauaagcacuuacaugaaguaacucuuuaaaucuucacaacaaaccugugagguugauacuauuauuguccucauuuauuaugaugagaaaacugaaauacagagagauuaagaagcuugccuaagaccgggcacaguggcucacgccuguaaucccaacacuuugggaggccuaggugggcggaucacgugaggccagaaguucaagaccagccuagccaacaugagaaaaccacaucuuuacuaaaaauacaaaaaaauuagcugggcguggugacaccuggaagguggaguuugcagugaaccgagauugcuccacugcacuccaguccaggcaacagagugagacucugucucaaaaacagaaacaaaaacaaaaaaagaagcuugccuaagguaacacagcuacuaggaauuaacuccagaacaagguacaaagaaacuggcauucuacaccacugcuguucuuuacuucgaggaacagacagcaugaacagagaaaacgguacacaaaagggcaagagaauuugggaggaaaauagcaauuuaucauggguagaacauagacugaaggagaaaauggaugaggaguguuacacaguagccacuuaacagauugugcgugcucaucuauguuaacauaucuggcccccaaccuguauuagagagccauaauaaauggaaaaaauaaauuauuuagaauguauuuuagaaagacaaauuggaaguguuauacaaaaucagaaaugcaagcaaaaguucaauggcuggguaucaccuaugagguuacuucacucaaucguuuauucauucauucugcaaagauuuguugaauuccuacuaacggcaggcacucagcuauggguugguuauguggaggcaaaaaaagaaagauauguucuugacuucgugaauaagagauagaagccuuagcagaaaagcuauaguaaacuaaaaaaagaaaaaagacuugaaagguaguucagauuaucuuaacaggacuaaugacaauuuggauauaaaugguugggaguaagagauucuauacaaagaaaccuuacuaagaguugccauuaaugacaugucuacuauuuuaagcauuauuauggauaucuuuuauagauuuacuuuuuaaucaaauccucaaaacaaccuuguaaaacaaauaucauuacccccuuuuugcagauuaaaauaaaugaggcuccaagugauuacuaauguaguuuuugccuaagguuacacaucaagugaguguuagagcuggauucaaacucaggccaaacuccaaaguccauauuaauucuucaaacauuaccgauucaauaaauagaucacuaaagaaacaccaauaaagaaagccuucuaaauuuuaguaucuaaaaacaggccaggagugguggcucacgcuuguaaucuuaguacucugggaggccgagauaggcaaauugcuugagcccaggaguucaagaccagccuggauaacauggcgaaaccccgucucuacuaaaaauacaaaaaauuagucaggugguguuuuccuguagucccagcuacucaggaggcugaggugggaggaucacuugagcccaggaagucgaagcugcagugagccaugauggugccacugcacuccagucugggccaaugagaaugagacccugucucaaaaauaaauaaauaaaucaaaaacaauuauagguccaacaaguucagaaaagcaccuagaaaucuguaaucguaaaagauuaauuugacccaacaaucauugauugaacguucaugcugaugcuaagagggaaaauauaagcaaaacaacacaaucauugauuuugggacgaucccaaucucaccauucagacaugaaauaauagccauuaaaugaacaaacuaguauuuuuaaaaaauucacaccaugguagacuuucagccaaaacaaaaaacuuacucauaaauucaaaggugaacugaucacaagucaauucuaauggugguugcacguagacugauaauuuggcuuuuugcaauaucacucuguucugcagugugaccuaaggaaacagaaauuguuaucaauagaaaauuacauuuuauucaaacugauagacuaucguaacuacuuaaacauaacuagcaaauaauuagaaaauauuaccugaggaaaaaaugaguagucacaaaacauaauacaguaaguaauagauuaaaauauucuaucaaguagaaacugugcacaaaagcuaaacagacuuuacucaaaagaauaaagauuggcaauauguacaugcaaagaugcucaauauccuuaguuaugaaggagauacaaacuaaaaaccacaaugagauacuacuacguacccaauaaaauggcuauaaucgaaaggacagacaauaacauguguuagcaaugauguggagaaacuagaacccucauauauugccagugaaaauguaaauugguacagcuacucuaagaaaaguuuggcaguuucuucaaagguuaaacauaaauuuaacauauaacuucacaauucuauaccaagagaaacgaaaacauagguccacccaaaaucuuauacacaaauguucacagcaacaauaugcuaauagccaaaaagcagaaauaauccaaauucccaucaugaugaaugaauaaacaaaaugugacauauucauacaaugaaauauuguucagcaauaaaagaaaugaaauacauuaugaauaacauuaaugauaaaaaccauuagcaauuuucuauauccauggaaccaugcuaacaaauuuaugugcauuauuucauuuacaugccacaacaugggugaaccuugaaaacaugaugcuaagugaaaaaaucuagccacaaagaaccacauauuguaugauccauuuauaugaaauguauagaauaggcaaucuauagagaaauaaaguagauuaggaguugcuuagggaugagagagauggggaauggcagcuaauggguauggcauuucuuuuaggugggauaaaauguucuaaaauuaaauuguggugauaguugcaaaauucuguaaauacacuauacuaaaagucaucggauuguaacuuuaacuaagugaauaauauaguaucuaaauuauaucuaaguaaagcuauuuuaaaauguucuaucauggugacucguaugucaugagaaaaaaaauuaaauaaaauaaaccaccauucuauaugguaccuuuucuauacggcaguucagucuaguuauuagacuuuguuauaugagacagauacauacauuaacauaauucaaggaccauucuuauuguuaagaaaaguaguuuugaaguuucuuuucaauaaaaagcauguauuaccucuuucuugauuaaauauauauaauauuuuuauauauacaagaauauacaaguggcccacaaacauuaugaacacauaauuagauucaguaaauguauuaauuuuaagugaugugaguauucugcacaacuuaaaaauaaguuaaaaacauaaaaauuuugacuugcaaaggaaaauuuuuaagacaacuaucgaugcaauuaaauaugauaaacaccaugaacaaugaauccucaauuuuuacuuuguaaauccugggaauacacagggaaucaucaugccacaaacuaaacuuccucaaugaugucuggccauuguaaacauaauaccuuuuuaguaaaacccugaugguuauuauggcaggaagacaccaugcaagugcuacaaacaacuuucuuucaacuagcuaguccauuaaacaaacaagacacaauuuaaauauucuacuauuauaauaauauaauacuagucuguacauauauuuuuaaauaaaaugaauaauauuaaugauaaaaaauauuagcaauuuucuauauucauggaaccaugcuaacaaauuauuuacgugccauuauuuaauuuacucuuuacaaaaauguuugacagguaccaucauaaaccauuuuacaaaagacuguggcucagagaugcuaaguaauuugcccaaggccacuuugauugcaaguggcagaaccacaauuuaacugcuaucugccagaauccugagcccaugccuuuaaccaacugugguuaagacucaaaauaacuuugcagaugaaaaaguaucccuauuuuacaguuuaaaaaauagagguucagagaagguaaauaaccugugcaaagccaucaauccaaguagagaguugaaaauagugaccaggaaagucuuaugagaacucaguuuuaaguaaaaaugaaaauuccuuuaaguaguaauaagccauuugaaaaagagcagucuggcuuuuccuggcacaacgaugucuacuuagacaauaaucacagaauuuuacauuguaacaagaaggguuugcauuugguuuaguugcacaaucaugauagcucucaugcacauauuuauugaaccccaacaaugggcuaggcccuuucaaaauacaaaucaaggagauagguaaugaaaauaacaacaguaacaaagaauaguuguguuugagccaaaaaagaguuaaagacuuggcuagaucacaagucuuauauuuuaacaggaaaauaauuauagaauauuaaggagaaaauauaaaacauugauacaagaauuuuccaugcuauuuucugccucuuaugaaauauaacccuuaggaaauauaauaccaaauuuuuauccuagauauauaaauacaacaccagaggccagguaugaacaaccacucgccuaguugccuggaauagauggucacgcaucaugcacacauacucaagguagccacaucuucauucacuuggaacggauggaaaaauuuucucaauuaacaggauuuauuaugauggaaacuugcaugguuguauaucuuggcugcuguuguuauaaaaggucauaaggagagauuuauaguagaaauuuguauagaaacugucagacaggaucaggaagacauugugucugcugugugagucccaccaauuuucugcaccccuugccuguugcauucuuucucaugcuuuuauaauggcaaugagaaagacaguugugacuuagguauucucaaauauaguaaguuccacgaacagaaggagaauuuuccaguagugucaugccaucauuuuaagguggcuacuacacaugaaagcuuaagaacugcaugggagggaaagguauguuuacuuacggugcuaauuccugguuggcuggggguacaauuagcaugagcaauguuaucuaguuaaggcacaagaucucuuauugcaauuaacagugcacuccuaaauuauuacauguaugugucugaacguuaucaguagauagauuuaaaagaggugucccuauacaaaaguacaaaucauuccuggaacucgacaguuauuucuuuuucuuaaguguuugauuucuugccacuaaugccuuuccagauucggaaguauuaaugagauagagccuuugauuggacugggggaaaggagguuggggaaagaccacccuuguuuccaguggcaagaauccaaaaaacuuagcuuaggaaacuguuguaagauucagcucccuucaaguucgaccaaagaucuccacauuugggccacccgcugguuccaguguaagcgaacacaauugguaaagcuuggugcccugucaagcuccuccaaggagagcaacccauaaucuaagaaaauauaaagccccauccaaguuuugacuaagugaauugccaaaauccacaaccuucccuugcuuccaaggucugggcaugauaaauauuuucagcuuaauaaugugcugacugauuaccauauuuuaaucuaaaugcuuuaagaagguucuacauuuaaguucuaguucuaaaauucuacaaugacaggacuaaaaaucuuaaccaaaaccacauccuuaauauucuauuuuccagacuaucaauuuguuaccauucuaacuuuguggcaucuucauucaauauuuucuugcuguaaauacauccacuuaaaguuaaggcagagagauggcuggaaauucuuuucaaacaccacauaaucauagguagaagaaagauauuaccauccccgugcuucuccaauaucaauucacaguauacuauguaugaugcuacuugauuguucuauuaugaauggugaugacacaauuccuuuagcagauuuaaaauguuaacuuuauuuccaaagaaaaaagccuggaucaugcuacacauuuaaauaaugguaacaguacuucauaauaguuauuuauauuauauacauauugcuauaaaugcaauuaccaguuuuauauuugcaaguaacaguaaagguuuucuauucacuacucaaggcuggggaaaaaucuacaaaugccaaguguuuauuuuacauuucuguaagcuacuuacaaguucucaacagugacagauguaaugaaauaaaucauauuguuugcacauuacagucuaaaaucugguacaauaccuucaccgugacagaagggacaaggucaguucccaccucaacaucggucgcuugcuguaaacacagaauugagaaggcaagaaagaaugaugucaauauuacacagcagugagugaacacaaugagugcaauguauauuuccuacuaucaaaauaggaaacuauaaaagauuuauuacucuaaugacagacuaaaagagacaaucuggcuuuuuugaugccuucguccagaaagucauaagcuaauauuuaaaaacucauccccugggccgggcacgguggcucacgccuguaaucccagcacuuugggaggccgagguggguggauuaugaggucaggagaucgagaccaccgugaaaccccgucucuacuaaaaauacaaaaaauuagccgggcccgguggcgggcgccuguagucccagcuacucgggaggcugaggcaggagaauggcaugaacccgggaggcggagcuugcagugagccgagaucacgccacugcacuccagccugggcgacagagacucugccucaaaaaaaaaaaaaaaaaaaaaaaaacucauccccuaaaaaggaaagaaaaggucacauauuuuaucaaaccacuccauucccagauuuacuuaaauauugaaaguauuaauucuauuaacuuguuauuuauauugcauagaagaagaccucccuguaugucccagaaaaauauuaugccauucuuucaggucccuguauuuucacccuguguaagguauguguuauucugauuaacaacauguaucuaagacaugcagcuaaugauauaaagauugaguggccuuacacccauaaaauaaaaguaggccaugugcgguggcucaugccuguaauccuagcacuuugggaggccgaagcagguggaucaccugaggucaggaguucgagaccagccuggccaacaugaugaaaccccgucucuacuaaaaauacaaaaauuagcugggcaugguggcaggcaccuguaaucccagcuacuccggaggcugagacaggagaauugcuugaacccgggaggcggagguugcagugagcccagaucacgccacuucacuccagccugggugaaagagcgagacucugucucaaaaauaaaggggcggggaggggaggggaauggaaggaagggaagggaaacuuuuuuuuaaccagugcauaucauaaacuaauucaauaggcauucuuugagcgucaccucguguuaccugcuccuuccucuuaaagaauacauaguauaauauaauacauaaaacacuucccuuaucacuuauaacuuauuuuuuagagugauacauugguaggggaaaaugcucuaugauagaauaagacuaaggggugacauauuuucuaauaauaccguuaugaauucuggggaccaauuaaaauuaugucucuauccaaccaaugaauaugauccauugcguuuuuuuacuugaaguauuuuuaacuaagaaaaacuaagccacuucuaagcaauggggauucuaugauguaaugagcaucagcagaauucaaaguuaagagauucauauucuacuuauggcuccacaggaaaccauauuuaaacuaugaucuugcuucucaguaaggaagaugggauagcaaugcuuaucuccucuaagaaagacuccauucuaauauaaauuauauuacuuuuuugagaugugugcuuucauaauaaugauucaaaguaaaauauuaauccaggcuuugugcucuaauaccuaaaauccaggaaauauuuuacauuuagcuauccacagaucuagaagagaaaccaacaucuccuguuuccugcucauaucaauccaugacuaaacaccuagauacuucaaggacagcaguccuuugggaacauaaaacuauagcaagaaagaaauggcuauaagaagacgucauggcaccaaagccacauaaauuguagggcuaauguuuuccaaugagaugaauaugauacucucaagaaaucucuuaagaaagaaaaaauaguaacacagggaaaaugaagcuggaaagagacaccuacuuaagaggaaauagcauucaggguuaccaauagggaaauauacauuauaacacagugcuacuacauaaggaauuuuccuacaaagacuaaaaguuccuaaaaaacagaaagggaauuccucauuccaaauagccuauguugaagagaaccuagaaaaacuuauauaaguugcccaaaggaaaaaaaagucauuuccacagcaagaaaauauguguacauuugucagcuaacuaagcagaaauguuccacuuagacuacacccuucagguagaaugaaaaauggugugugcugaauggccaauauuuaaaacagugccucuacuaugugacucagcugggugaauguuucuuucauauauaguccuacuuuuuuguguacccaauuuacuauaauauaguaauguuaaugugauuuuuaucacaaauuggauuggcuguuuauacuaaaauuaaucuuuugacacucaugauauacguuuuaaaguauguucugauaccuaaauaaugaagacacuucccaagcagaauuauaugauaugaacuccaaauauuguaaaaugagugaauucaaccacuucccuaaauugaucaucuguuggugaucaauuucuacacagauuucuacacagaucaauuucuacaccaauuucuguuggugaucaucuguuucuacacagauaaacugcagucagugagauauaaucaaucacauccuaacaagugcuuauagaaaacuuaagugaggagaugaaguaauauaaucaagaauaguccuccuuucauccuuucuauuucucaguuguauuaauucacuuauucauagagcaaauauauauugagcacccauuauuuggcaagcacuaaggauacagcagugaacaagacaacucauggacauagaugguugugauaaucauaaugauuaugaugauguugauuauuauaauguagaaagaaguaaaauguaauuugaugauaaugacaaucauaacaauuaucauaacauucaacaaaguagauucuauuauuauucccauuuuguggaugagaaaauugagacuaagaaaauuaaguaccuugccuugugucacacagauagaaacaggggaaaaauuaaguauuggaccaacuauauacucuuaagcuacccuaccaccaccaccaccauaauguauuaaagacuagaaaucaucaaacuuugagcuaggccacucacaaaccuuaucuaacugaaucuccaacaaaaaucugguagggucaguauuauucagcuacauuaguauuacgucaaugcuaugguacuaagaaaguuugaaaaaaaauuuuuuuaaguaggauuagaacuagggcaagaagcccuccuacugcucucucuuccccuacaaccccacuucuuuuuaaaacagaaauccugcccaaggagcuccuuacuggcacuaaggggcuacuaauguuuuuaucuagaaaauaacaaggccuacaauuuguuauccucccugaagugucuacuuggaggaccaaacuuuaaaccaaugcauuuugguccuaauucaucagaguuuaccacucuuauaaaccccuuuaaaaucugcaaguacaccuacagaaacugaaucaaaguuaggagaaaccacgacagaaacguucaagucaucuucucucucagucaugggccaaacaccugugauuuaaaaaaagaaaaauuauuuaaucauaaaguaaaacuuucuauauauaguuuuucuuuaaagguuugucuauaccacauauaaaaaaaaccccauaaacauacucacaaguugaaaaaacuaaugcauuacaguauuagaagcuugaugcuaauucuuucccucuauaauaugguaaaaaauauugucuuuuucugcagauauuugcuaagaugugagccauugacugaccagcauuaggaaucucaaugcccucucuguaacuacuaguggaagcccaaauuaguacagcccuugugaagguaaguuggcuagaacuagcaaaauguaaaauguacauauccugugacuuaauucuacucccaagaauguauccaauacccauaaccaugcccaaggaggucucuaauguuaguaguuauuuuuucagaaaugaaaacaaccuaaauaucuauauaucuauuaauaggcuaauuauuaaauaaaucaugguauaucuguacuaugcaaugucccaaagucauaaauaagggugcuguccaucuuuacauacugauauuuuaaaaacuccaaaauauaucuauuaacuuuuaaaaagcaagauguaguacaaugugucuaauaugcacauauuugugucaaaacaauuacauaaacaugaauauuuucuagacaaauacacaaaagcucuugauaaggauugccuuuaaggagugaaacuaggaucuuggguugaacaaagauucaccuuucauuauuuauccuuuuaguacugaauuauuuuuaccauacacauguuauuuucauaauuuuaaacauguuuauguugcauaaugagauauuuauucauaguaucaacaaagaucuuaaacaaaaaacauuuuuaaauuauauauauucauauauauaauauauauacauaucaaacuauuggcuaccuacuuaacauccauucuucccuccucccucuguguauuggaacccuaauuuuguggagcuauucaccuucaucucagagaaagucaccccuuccaggcuccacggucaaauccaaucaucaugauuuccuuccacugaccauuuguuguuuuagccaugaacaugggacuuaauccuggcagauggaagguaagggaaguugggaguggagagagcuggcacauguuucugggaaagcuauuccucccuaauaagaggagagacucaggagaaauagccugaugauucuucccuggaaaucauaucugcacauaacaccuagaauugcugagaucacccugugacccugagaggaaacauuccccacacucugaggauggcugacugaaaauaugaaucagcuaucucacaaaaaaaggaacugccuacaacugcuaucaggcauucccaccaaacugcacgauuuggaaugggaauuuccauaacuuaaugagaguacaaauggcuguucauugcccaucccaauaaccauucuucaauucuucuuuacuuaaagcccaacuuuauucuaagcaacaaaauacucagcuaagucauguaauuccccagccaguuuugcagcuuggaguggcuggugagauuuaaguaggagccauucaggguguggcuuccaagaaagcuccuuaagggggcugacucagcagcagaugcgagggcaggaguuccaaaagccaugcaggaccaauauaugacuccgagauagaaggaaucaagagucucugaugacuguggaacugccaagccaacccuggacugcccaucacuagguuucuuuugcaagagaaagaaagaaaccucuaucuuauuuggguaucuugugacauguagccagacagaauccuaaaugaacaaugucacaaaauacaaaugauucuacuacucaguguuaucaucagcuuaguuauccuggacauuucaaauggagugcagacuuucauuuauauccccacgucuuacugcucucugucccuuucugaagacacagcuguaugggcaccuaucucaauguugcacccaguccuucauacucaugccagguagacaacaugaucaacuaucuaaaucauaaauaaaauucugucuucgaaaguuccuacgaguagauguuguugacuacugguaacaaaaauacuaggcaggauucacauuaaugaguugaguaugaaaagcuucagaauccaugagccauacagaaauuauuacuaugauuucaugcuuacaacauacauuccucuuauaacuuacacacauaaaaucagcuucaaaaacacuuuuauuacgguagauaauauacaccauguguacaacaaaauguacucuuuaaacuggcuuuaaauuuugcugcaacucuuccuuugaaaacacuuuuaaaagcuuuaaguacugaacauaacccacaaggcuaugaacauuuuuuguaaguuaaagcccccaaacuaaaauaagugacauuaaaaugaauaauggggucaucaaaaaguucagcauuuuaacuucucauaauaaagagaagcuaaaacuguaauaaaacaauuuugugcuuuuauuaauuacagguauuuuaauaaacaaacauaccaugguuuuauaaggguacaaguuacuaaauuuuuuuccauaucuagaaauaaaauguuuuaaauaccucucaguuuaaaaaguuucccuuuguuucuuucccagaaauaaaacuaaaugaugguggcauagaaggggcaaggaacuucaaacauuaauuaaaaauugagguuauguaaaucaugcacuuuacaccuaagucuguggguguaucccuaucuuaauuagcgguuauuuuaagacauacugaaggaucaagguaaugacaaguaaaacagccuaaacuuucucacccaaggucaucacuauaaccaccaagaaauaacuuuuagcuguaagggauuuucugagaaauuucauauucaauuaauguuaaucaaaauauuauuggaacauuacuauggaaagggcaaaaucucaggacaaaauuugaaaugaaagccauauuauuuaaugaacucuggaaauuucauguuucaugccuaugccacccuuccccaauuauauuuuuaaaugacaaaacaagacuuauaauucuauuauucccaaaaaugcuaguaacaaaaauugaaacaaaaaauuauauacugcgauaugacacaucccauuuuaaccacucucuauuugacauggcagcgcugacaacaaauagauuuuuaaguaauuggagguacuugaaagaccugaacuucacugguuuacuuucaaaacuuucuaaaagaaugugugaaaccaaagcauaauaacuuuauuuuaauauuuguauuuuaaaaauauauuaucucaauuccucaggaccagaggaauacaauguugguaacauagacucaaaaguacauaaaucuaguaaaaugauuggaucaggauuaagauuggcucuguuguuuugguuggcuuuugaugcucugcuucuuuuauuauuccuacuuguuuuaacauuucuuuuaugugaaaauaguccauauuuuuucacauuaaaaaaauacuuuuaccugacccugaaaagggaacuugaaguaaugcuuuucacauguccaacucaaacugcaggauugguguuuuguuucuccuuuuaauuuacaaaaaaaaauuauacccuuuugagucccaaaguaagauaauauugaguuauucaaaacucgggaacugaaaauaucaucagccucugagucauuagaaaucagcauaccgcaagcuacacaccauuuggaugguuaauuaacuacaaacauaaauuaugucacuaagcugcaaaugacuacauuuuuaguagcaaaaugguagcucaugugcuuugguuucuuuuaaaagaagaacuaaaguuguuucaggaguauaagaaguuaauaaaugaccacucuaaauuuuaaugcucuucucaaggccuaaaaccaccacccaaagaaguacuucuuccuuucuuagcauguaaagaaaaaaacuagauagugcuguccaugaaacauuaacaacaaaagcacuuucuuaaauaaaauacguuuucagaagccauaacauacaaaguagacauaaagaccuugugugcuaaagagcaauacuguuuuuacaaauaugauuuuaauuaagccuagaggagaaaauuaacaaauacacaaaauaauaucuaucuacaagauaauaugaauuucauaaugaauacuaaaauaauaaaaagcugcaaaugagauaccuugugauuuguuaacaucuuugaugauuuucugaaguucuuucauuucuacaucaaguucaucauaguuuaguucucgagauugaacguuuggagcuuggaacagagaaggaucuguccccagguaugaacacugcaagugaccaucaucacucagagugacuaucacucccuuuaaaucacuacaauaaggaagagaaaaugagacauaauuuuaaauuucaguagaguuagucuugaccaacuacauuuuuacucaauucagcaucaacacaccauuaagaaaauaacuauauaucuauuucuaaaguuuuacuucaaagacucaauucaaauguuucaaacacgauuuguauuuacagaaguauucccaauguuaagguccacuaaggccgggaaaaaagcuuaauuauuauaauagcuaccacuuuuggggaccuaacuacaaagcaaauccugcucuaagagcauuuuaaguacuguuuuuaauccuccuuccagcuacuacuuggcauuuccguaauaagcaugugaacaacacuuuggagguacaauggaccaagagauggagcggggcugcuggcuggcugaagaccaggaaggaggcacaggagugaagacaggacaacccaggggacagaaaaccaacgaaguugaugugggaagccaucggaggucuugcgaaaaaaaaagugcccccggucuuuccucauccuuuucccucucuacccuuaggauucauguuugcccucuuucccagguccucccaucacagcuuccuucacacgcucuccuauucaaguggcccucugguuuguucucucuuucucuucacuuuuagcuagaagcagccaauugucccauuuacuagcucuuucucuaucacucuucucauccucauuaucuuuuuuauuccccauucuuucacucuuccuucucucuuaggcucccugaggucuguuuuacucuagaaacuagccauaauauauaaauuaaggauaauuuuagcacacaauuuuuuuaaaguuguuuuugugaacaugucauaaaaaguagcugagaugaauacuguauuugcuuccucccuaaguuugccauaaaaacaaaaaaauucaacaucgugauaagccauuuugaguugauacauaauggauuuguuugacucacuuuuguuuguuagguuuucuacagaaacuuuugauuuuuuuuuaaaguauuuucuacuugguucuaaagguuagauauuaaucaaaaauaauaaauugggcacaguagcacaagccuguacucccagcuacuugaagaggcaaagaaucacuuaagcccaggaguuugaauccagcuugggcaacauagcaagaccuugucucuaaaaguaaacaaaaauagaaaaauugugagagaaaagaagauguuuaaauguugcuauucaucugaagaagagaaaaggacauaaaguauauaacagauaaggcauguaagagucuaggauuauuuagaaugaacaaaaauguuuaaaacuccccaacaguggaucauggcagguagucauuucauuaaucuaaaagcucaacuggguugggaguagauacuaccauugcucaguucugcccauaagauggucaccagcauccacuucaccaccugccuuaaacacaacauuccaauacacaucaucuccaggacucaggcauagucagugacaugcaacccugucauauuacuugagaggaauaaaaaauagauuguugucacugguucaacagcuaaagaacuagacuaggacgcaggagacuugagucuggcucugaugcugcuccuguagagcucagucaacuugggaaagcuuuccuaaauauucuuuauauguaaaaugagaagguaagacuagauaauccucaaaaacuuuaaguuuuaucaauugcuucugccaucuaccccucagaaaacaaauaguccaaaaauggaaugaucuucuuaaaguaugaaaagcaaccccagaguaccuuuggguuugaaccuuucuuugcagguaacugaagccaucuaguggccauggaaaucccaacuuucagcucugacaagcccauuucaagagagcaaaucuucccuucccucugaguugugacuguagucuguuccgcauucuagcuagccccacuaagcccuacgaacccaaugaguccucaggcaacucuagggugcuaaagcgcagaccucuggggggggcuucucagagaaugugagauucaucaguucuuugaauucaaacaggcauuuccauuucaucuucauccuuugaacaguccaucauacagaaaagcuagcauuacccaauacaaguauuccuccuuaucuaaauugaguuggucuuugaguugaaagguuuauuacuaaaucaguuuuauuccaucaauuuagauagcaaauggcaacaauuuagauacaagccauuuaucuaaaaaauuaucugaaccuauuaaguuucugaguucaaauaggaagaguuuggauaauagagaauacauauauuucuucagacucucuaaaaacacuuuuuacugguauuucacguguucaagugguaaagagaguagccagggucuucccucaccaaaagaacaaauuucaccagaaugucuugacagcuaagguaauuauagaacuuaagcaauuuacuuuuuaaaaaaucaauugcaaaagacauuauaggcuggggaugguggcucacgccuguaaucucagcauuuuggaaagccgaggcagguggaucgcuugaggucagaaguucaaaaccagccuggccaauguggugaaaucccaucuccacuaaaaauacaaaaauuagccagguguggguggcaggcaccuacaaucccagcuacucaggagacugaggcaggagaauaacuuaaacccaggagacagagguugcagugagccgagaccacugcacuccagccugggcaacacagcaagacucggucucaaaaaaaaaaagacauuauagcuuaguuuguuuauuuuuauggcugaguagcauucccugaugauuagugaugucgagcacuuuuuuauauguuuguuggcugaagaaaaaaaaaucuucuuuugagaauugucuauucaugucauuugcaaagauaugaaaccaaccuaagugcccaucaaccaaugaguggauaaagaaaauguguauacacaccauggaacacaacucagccauaaaaaggaaugaaacaauguauuuugcagcaacuuggauagagcaggaggccauuauucuaagugaaguaacuuagacaaccaaauaugguauguucucacuuauaagugagagcuaagcuaugaagaugcaaaagcauaagaaugaugacauggacuuuggggacuggcaggaggggaugguugggagaggggugagggacaaaaggcuauauauuggguacaguauauacuucucgaugacaggugcaccaaaaucacagaaaucaccacuaaagaacuuauccauguaagcaaaaaccacguguacucuaaaaacuauucuuuuuagaugagauuccuagaguagucagauuuguagagacccaaaguugaauggugguuuccaggggcugggggaggggguugagagauacagucuuguaaagaugaaaaaguucuggagauggauaguggugaugauugcacagcaguaugaauguaccuaaugccacagaacuguacauuuuaaaaugcuuaaaaugguaaauuuuauguuauguguauuuuaccacaauuuaaaaaaacacauagcaccaaaacaagggugaaugaauaaauuucaaaaagcuguaucaagaaugauaauauaguauguaauuuguuuagggacauuaaagccuucaaucuuguuuuucuuuuuuguuuuuguuguuguuguuguuguuguuguuguuguuuugacauggagccuugcucuguugcccaggcuggaaugcaguggcgugaucucagcucacugcaaccucugccucccggguucaagcgauucuccugccucagccuccugaguagcugggauuacaggcgccugccaccacacccagcuaauuuuuauauuuuuaguacagacgggguuuugccauuuuggccaggcuggucucgaacuccugaccucgugauccaccugccucagccucccaaagugcugggauuacaggcgugagccccacaccuggccucuuguuuuuaauuguuuuuaauucaauaguuuuugggguacagguggcuuuugguuaugacuucagguuuuagauuuaagucuuugauucaucuugaguugauuuuuguauaaggugggagauaagaaucuaguuuuauucuucuacauguggcuugccaguuuucccagcuccauuuauugaauagggugucuuuuacugaauuuauguuuuuguaugcuuugucaaagaucaguucgcucgaagucuggcuuuauuucuggguucucuauccuguuccauuggucuaugugcccguuuuuauaccacuaccaugcuguuuggguaacuacagccuuguaguauaauuugaaguuggguaaugugaugccucuagauuuguucuuuuugcuuaguauugcuuuggcuaugcgagcucuuuuuugguuccauaagaauuucaggauuguuuuuucuaguucugcgaagaaugaugacgguauuuugaugggaauugcauugaaucuauagauugcuuugggcauuauggucauuuucacaauauugauucuucccauccuugagcuugggauuuguuuccauuuguuugugucaucuaugguuucuuccagcaguguuuugcaguuuuccuuauagagcucuuucaccucauugguuaaguauauuccuaagauuuuuuguugguggugguuuuuuggggggaguugugugugugugugguuuuuuuuuuuuuuuggcaguuguaaaagggacugaguucuucauuugauugucaguuuuguuguuguuaguguauagcagugcuacugaucuacguacauugauuuuguauccugagacuuuacugaauuugaucuaagagcuuuuuggaugagucuuuaggguuuucuaggcauacaaucauacuaucagcaaauagugacaauuugacuuccucuuuucuaauuuggauuauuucuuucuuuugucugauugcucuggcuaggacuuccaguacuauguugaauaaaagugguggaaguggacauccuugucuuaucccaauucucaagggaaaugauuucaacuuuuccccauucagcaugaugcuggcuguggguuugucauauacggcuuuuauuacuuugagguaagccccuucuaugccuauuuuauugagaguuuuuaucauaaagccaugcuggauuuuauaaaaugcuuuuucugugucuauugaaauaaucauaugauuuucguuuuuaauucuguuuaugugauauaucacauuuguugacuuauauauguuaaaucaucccugcaucccuggaaugaaacccacuugaucauaauguacugucuuuuugaugugcuguuagauucgguuagcuaguauuuuguugaggauuuuugcaucuaaugaaaauuuuaacaauauuguucauguggguuaauaaguaagguucuaugaaugacagaauguuaugcugaacagaaccaucaauuaaauccaauaccguguacccuauugcuucugucuuaaaagcaucauuaacauugacaaaaucaaggucucugaauuauuaucggucugugaagugcaucgacugagcuaagucacuagaauaauguacuuuaugaagaaucagggucaaagauauuacauuccuaggacguuugguaauuuuguaauuucagcaauggggcaugaaauuaaacaacagaauuuugcucaggaaucuguaaauaaugauucuaucacucaguaaacagauuccugccuuaacaacacauuaaaacaaaauuccagauggauuuuuaaaguucaauuuaaaaauaugaaacuacaaaaauauuuaucucccuuugagaugguaagaaaacuuuugcuauaagaacgcaacagaggaagcuacaaaggaagggaucucuaaauuaaacuacauuaaaauuuuaaacuuguuauaggcuuaagaauaugacauaauaagaacaaaggacaaacucagaaaacauuggcaaccaauauaaaauacaacauuuuaaguuaaaccaugugaaguuccugauauucaacugguuuugaccuauaaaaacaauuuuauagaccaggcgcgguggcuuaugccuguaauccuagcauuuugggaggcugaggugggcagauugccugagcucaggaguuugaggucagccugggcaacacgguaaaaccccaucucuacuaaaauacaaaaaauuuagccgggugugguggcaugcaucuguagucccagcuacuugggaggcugaggcaggagaauuacuugaacuggagaggcggagguugcagugagccgagaucaugccacugcacuccagcccaggcgacagagcgagacucugucuccaaaaaaaaaacacaauuuuauauguuaaaucuaauauguaaagaacucuuauaaaucaaugaaaaugauacuauacccaacagaaaaagguuaaauaaaggccaucuacagacaauucacacauaaaaauaauacagucaauaaauaaauggaaaaauuuucaaaaucaaaaaauguacauuuuaaaacuuuuuaaaaagguauauuugauuaacaccucaaacuagcaaaaagauuguauuuaauaauguguccagcuguuagagaagguacacggagacauacucucauauacuuuugauaccaauguaaauuuguuauaauccuuuuagagaacauuuuagaaaaauauaucaaaaaccauaaaaauacuauugucuuuuaugcaguaaucuacuuucaugguuauuuuaaaaauuuagaaacaacccaaaugauagggggggaauauuuuuuaauugugguguaucuauaauagaaugucuagaaaccauuaaaaaucauaucuuaucaaauaucuguuaucagaaaaaauaauaaauguaaaaguaaaacauaauacugcauguacauuuuauucuguuuauaaauauauauguauaaaacaugaauuaggaaaaauaccuaaauguuaauaggaugugacuaucccuaacuagugaaaugaugaauuauuuucauuuugucuuauaguuacaaaauaagauuagggccaggcacgguggcucacaccuguaaucccagcacuuugggaggccaagguggguggaucaccugaggccaggaguucgagaccagucugcccaacauggugaaaccccaucucuacuaaaaauacaaaaauuugcugggaguggugaugugcaccuguaaucccagauaggcaggaggcugaggcaggacaaucacuugaauccgggaggcggagguugcagugagcugagaucgcgccacugcacuccagccugggacacaagagcgaaacuccguuucuaaauaaacaaauaaauaaauaaauaaauaaauaaauaaauaaaagaaggaaaaccuuauccuuuuuuaagaaaaaaaaaguucuauuuuccauucccagugaccaaauuucaaucagugacuuaaaaauuaaauauuugugggauuaaaaacauuuaacuaguuuuauuuuuccaacaaagccaaucuauaaaauguguaacaugaaauuauuugaaauauagcucaauagauagaaaauaaaugguuucuuucauuuccuaauacacuaaaacaaaagaauacuaguuuuaaaaacaaauaaaaagaacaugcauuggaccuaauguucucuuguuuggcuucauuuuaugcaaaauaggaacauuguagguuaucacauugucaaagucugguuuuuacuacuauauauagauaccaaggaaaucuuaaaacccuaaauaguauuuauugcaccccaaauuuuauucuaccucaguaaggagcauaugauugaaaggcauuucccuucaagugcagucagccacacucaguucacacagcucuuccucaguccaaaaguacuggacgugggcacuugaacauauuuuaaucaauccaccauuaaucauuucagacauuuuuauugagcaucugcuauacaacagaagcuauaaaggcaaagaagacaugaggcuugcuguauaaaaaucuuuggucuaauugggaggacuucaaacuuacuuuaaauaaaagcaauugcaauccaauguaguagauagagcacaguaagaagagagugcaaugggccugcaugagagagcagagcaaggcuucacagggcagaggaugcagaagguggaucuugaccuacaaguagauccccacagaugaaaaacaauggacaaaauaaaggcaaaggauuccagccuuggugaccucauucagucuuaaugacuuuaaauacuuucuucacgccagcucccaccucuauaucuccagccagacauguacauccagcccccuacuugacagcuacacuuagaaggccaauagacaucuaaagcucaacauggcuacccaugaguuccugauuuuggccccaccucuccaacucaaagcuacccuccugcaucuuucauauuucugcuauugguaacuccauucuuuaagcugcucauccagaaagaaccuuagagccauccuugacucccccucccuuuucuuuuucuugcaaccacauaaauuccaucagcaaauauugccagccuuacuuuuuaaauauguccagaauccaaccacuucucaccaaguacacuacugcaugcaugaaacaaauauuuguuuuuuaguguuucuucuuuagagacagacucucacucugucacucaggcuggagugcagugguaugauaauggcucacuguaacucaaacuccagggcucaagugaccugccucagcuuccgaaguagcugggacuauagaugcaugccaacauaccaagcuaauuuuuuuguuguuguuagauauagggucuugcuauguugcaggucuggucaugaauuccuggccucaggugauccuccugcuucaaccucccaaagcacugggaauauaggugugaaccaccacaccaagccuaacaaacacccuuuaaucugcccuugauaacugcuauuaaccagccucuccacuucuauacaugugccucuauaguaacuuuccaacaaagcaguaaaaauauucauguuaccuuauaauccuccgguggcuccucuggcacucauaacaaaagcucaaauccuuacaagagucuucaaggcccuacauaauauguuccuccaccucauuuucauuuucuauucugccagaauaaaaaaugaaauuguccauccaagugguaggaaacugaguuccaggaaaccuugccacugcagguaaaguguucuguggucccaaauaaauuugaaagucuaggccacaagaaccacaauuccugggcaaguccuagugcuucacugggcucagugccaguggacauggagggcaaaagacuuaauaagacaccagauugggcagccaagggagugcuugcaccaccuuuccccgaacgcccagcaaaguagugcacagcucuggaaaagaccccuuccuucugcuugaagagaggagagaggagaguaaagaguacuuugucuuguaacuuggaugccagcucauccacaguagaauaaggcacugagcagagaccucggguacccauuccaagcccuagcuccuagaugacauuucuaaacauacccugggccagaagggaacccacugccuuuaagugaaagauccacucaaggcaaguuucauuaccuacugauuaaagagcccuugggcccugaauagucaacagugguagccaggcaguacucgucauuggccuugaguggaauucagagaagugcuggcuuccggucagcacauucccaacugcaaaggccaugggggagacucauuuugcuucagaaaaggagagagaagaguaaaggggacuuugucuuacagcuuagguaccagcugggcugcaguggaguagagcaccaagcaagcucuucagguccccaauucuaauccuuggcucucggacagcaagcauuuuaggaccugcccugagaggggaacccacugcucaagccuggcagcauucaucacaagcugacugaagagccuggggcuugagugaacaucagcgguagccagauaguacucacugcaagccuagaggugguaguaauagggagagauucaagggagaagaggggagggggaggggaggggagggaaaagaguaggaaggacauugucuuguggcuugaguaccagcucacuguacuaaaacagagcaccagguagauuccuaaguuucugauuccagacccuggcucccagagagcaucucuggacccgccuggggccacaggaaauucauggcccaaaagggaaggacacaagccuggcuagcuuuaccacuugaugauuguagagcccuagggacuugaccacacguaagugguagccaggcagugguuaugagaggccuuggaugagacccaguacauucuggauucagcucuuacccagcauacucccauuggugguggccaugggaguccuugugucacuacucccccagcuccaggaaacacagcagagagagagagagacucuuuuuguuggggaaaagguaagggaagaaagcaagagucucucccuaguaauccagagaauuauucuggaucucaaccaaguccaccaaggugauaccacuguaagagccacaguguuacugggcuucaggugcccccuaaugcagauauggcugcagugacccaaaaucuagauuguaacacccaagucccccugaauaccuggaaagccuucagaaaaaaggacagguacaaacaaacccagauugcaaaggcuacaauaaauaccuaacccuucaaugcccagacacugaugaauauccacaagcacccaggcuauccaggaaaacaugaccuuaccaaacaaacuaaauaaggcacaaggaucuaaucccagagagacagagauaugugaccuuucagagaaaucaaaauagcuguuuugaggaaacacaaagaaauucaagauaacacagagaagacauugagaauccuaucagauaaauuuaacaaagacauugaaauaauuuaaaagaaucaagcagaaauucuggaauugaaaaaugcaacugacauaaugaagaaugcaucagagugccucaccaacagaacuaaucaaguagaagaauuaguaagcuugaagacaggcuauuugaaaauauacagucagaggagacaaaagaaaaaauaauuuaaaaacaauaaagcauaccuacaagaucuagaaaauagccucaaaaagguaaaucuaaaaggcauuagccuuaaagagcagguagagacaaagauagagguagaaaguuuauucaaagagauaauaacagaacuucacaaaccuagagaaagauaucaauauucaaguacaaggagguuacagaacagcaagccaauuugacacaaauaagacuacugcaagaucauuaauaaucaaacuccaaaaggcaaggauaaagaaaggauccuaaaagcaggaagagaaaagaaacaaaugcccuacaauggagcuccaguaugucuggcagaaaacuucucaaugggaacuuuacaagccaggagagaguagcaugauauauuuaaagcacugaaagaaaaaaaagacuuuuuccuagaauaguauauccagcaaaaguauccaucaaacgugaaggagaaauaaagauuaucccagacaaacaaaagcugauagauuucaucaacacuagaccugcccuacaagaaaugcuaaagggaguucuucaaucuggaaaaaaaaaaaaaaaauggauguuaacuagcaauaagaaaucaucugaagguacaaaacuuacuguaauagcaaggacacagaaaaacauagaauaguacaacacuguaacugugguguguaaacuaucuugaguaagaagacuaaaagaugaacugaaucaaaaauaagagcuacaacaacuuuuuaauacauaguacaauaagauauaaagagaaacaauaaaaguuaaaaagcagagggacaaaguuaacuguagaguuuuuauuagucuucucuuuguuucuuugauuuguuugcuuguuuaugaaaucaguguuaaguguucaucaguuuaaaauaauggguuguaagaucauauuugcaagccucaugguaaacucaaaucaaaacacauacaacagggacacaaaaaauaaagaguaagaaauuaaaauguaccaccagagaaagauaacuuucacuaaaaggaagacagggguccaagcgugguggcucaugccuguaaucccaacacuuugggaucccaaggcagguggauuacuugaggucaagaguucaagauuagccuggccaacauggugaaacuccgucucuacuaaaaauacaaaaauuagccaggugugguggcaccugccuguaaucucagcugcucgagaggcugacgcaggagaauugcuugaacccgugaggcagagguugcagugagcugagaucaugccacugcacuccagccugggugacagagcaagacccugucucaaaaaaaaaaaaaaaaaaaaaaggaagacaggaaugaagaaaagaaggaagagaagaccagaaaccacagaacaaaauggcaggaguaaguccuuaauuauuaauaaugaaaacugaacauaaaaguacuaaacuguacaaucaaaagacauacaguggcuuaaugaauuuuuuuaaaaaaagacccaaugaucagcugccuacaagaaacacacuucacauauaaagacacaaauagacuaacaauaaaagaaugauaaaauauauuccaugccaguggaaacuaaagaagacaaagaguagcuauacuuauaucagacaaaauagauuucaugacaaaaacuauaaaaagagacgaaggaagucauuauauaaugauuuaaaaaaaacucaauucaaccagaagauauaaaaauuguaaauauauaugcacccaauacuguagcauccaaauaaaugaagcaaauuauuacuagagcaaaagacaaagguagaacccuguaaaauaauagcuauagacuucagcacaucacuuucaauauugaacagaucuuucagacacaaaauaaacaaagaaacaucggauuaaccagcauuacaaaccaaauagaaguaacagauauuuguggaauauuucaucuaacggcugcagaauacacauuuucuucagcacauggaucauucucaaaaacagacaaaauguuaggccacaaaacaaguccuaaaacauucaaaaaaaacugaaacaacaucaagaauauucucugaccaaaauggaauaaaacuagaaaucaauaacaagaggaauuuuggaaacuauguaaacacauggaaauuaaacaauaugcuccuuaaugaacaguggaucaaugaagaaguuaaaaggaaauugaaaauuuucuugaaauaaacgauaauggaaauguaauauuccaaaaccuaugggauacagcaaaagcaguacuagaagggaacuuuacugcuauaagcaucuacaguuaaaaaguagaaaaacuucaaauaaacaaccuaaugaugcaucuuaaagaaucugaaaagcaaaagcaaaucaaacccaagauuacuaaaagagaaaaauaauaaacaucacagaagaaauaaaugacauugaaauaaagaaaacaauacaaaaaucaaugaaagaaaagguuauuuuuugagaugauaaacaaaaugaacaaaccuuucgccagacuaagaaaaaaagacagaaggcccaaauaaguaaaaucagagauuaaaagggagacaguacaacugauauugcaaaaauucaaaggaucauuaguggcuacuaugagcaacuauaugccaauaaauugguaaaccuagaagaaauggauaaauuccuagacacauacaaauauaccaagauugaaccaugaggaaauccaaaaccuaaacagaccaaaaacaaguaaugagauugaugccauaauaaaaaguuucccagucaaaaaaaaaaaaaaaaaaaaaaagccugagacccagugauuucacugcugaauuauaccaaauauuuuuuuaaaaacuaacaccaauucuacuuaaauuauuacaaaaaaacagagagggagggaauacuuuccaacucauucuacaaaaccaguauuauccugacaccaaaauaaagcaaaaacacaucaaaaacagaaaauuacaggccaauaaaacugaugaacauugaugcaaagacccucaacaaaauacuaguaaagcaacuucaaaacacauuaaaaagaucauucauuaggaccaagugggauauaucccuaggaugcugguauaguucaacauaugcaaaucaaucauugugauacaucaaaucaacacaaugaaggacaaaaaccauaugaucauuucgauugaugcugaaaaaaguauuugauaaaauucaacauccuuucaugauaaaaaaaaacccucaaaaaacuggguauagaaggaauauaccucaacacaacaaaagccauguaagacagacccauagcuaauaucauacugaaugggaaaaaccgaaagccuuuccucuaagaucuggaacaugacaaggaugcccacuuucaccacuguuauucaccauaguacuaaaaguccuaccuaccaauucaacaagacaaagaaauaaaguucauccaaaauuggaagagaagaagguaaauugcccuuguuugcagacaauaugauacuacauuuggaaagaacuaaagacuccaccaaaaaaacuaaaaaacaaauuccguaaauuugcaagauacaaaaucaacauacaaaaaucaguagcauuucuauauaccaauagugaacaaucugaaaaagacaccaagaaaguaaucccauuuacaaaagcuacaaagaaaauuaaauaccuaggaauuaaccaaggaaauaaaaggucucuacaaugaaaacuauaaaacacuuuugaaacaaauugaagaggacagaaaaaaacggaaagauauuccauguucaugaauuagaagaaucaauauuguuaaaauguccauacuacccaaagcaaucuauacacucaaucccuaucaaaauacuacugacauucuucagauaaauacaaaaaaaaauccagugauuuauauggaagcacaaaagacccaguauagccaaagcuauccugagcaagaaaaacaaaacuggaaggaucacauuacccgacuucaaauuaaacuacagagcuauggugaccaaaacagcaugguacuggcauaaaaacagacacaaagaccaauggaacagaagagagaacccagaaacaucacuguagaugaauguauuuacagugaaauaauuuuugauaaggcugucaagaacauauauuggggaaaggacagucucuucaauaagugggucugggaauacuggauaucuauauguacaagaaugaaacuagaccccucuccccauguacaaaaaucaaaucaaaauggauuaaagacugaaaucuuuuaucucaaacuaugaaacuacuacaaaaaaaaacauugaggaaacucuucaggacuacaacgagauauaaucccaccucaguuaaaauggcuuuuaucuaaaagucacgcaauaacaaaugcugaggaaaauauggagaaaagggaacacucauacauuguuguuagaaaugaaaauuaguacaaccacuaugaagagcaguuucaaaguuccucaaaaaacuaaaaauagagcuaccauaugaucuagcaaucccacucccuguuauauacucaaaagaaaggaaaucaguagauuggagagauauccagucucauguuuauugcagcacuauucacaauagccaagauuuggaagcaaccuaaguguccaucaacagacgaauggauaaagcaaauguuguuauacauacacaauggaauacuauucagccauaaaaagaaugagauccugucauuugcaacaacaaggauggaacugcaggucauuauauuaagugaaauaagccaggcacagaaagacaaaguuugcauguucuugcuuauuugugggugcuaaaaauuaaaacgauugaauucaugaagauaaagaguagaacaaugauuaccagaggcugggaaggguagugggagaaggauggauaauggguacaaaaauauagauaggaagaaugaauaagaucuaguauuugcuagcacaacagggugacuaaagucaacaauaauuuuuuguauauuuagcuaaagaguauaacugaacuguuuguaauacaaagaagggauaaguacuugaagugaagaaacccccauugccuugaugugauuauuaagcauuguaugccuguaucaaaacaucuccuguaccccauaaaaauauaaugcuacagugugcccacaaaaauuaaaaauacuuuuuuauauguuuguggccauuuguauaucuucuuuugagaacugucuauucgugcccuuggcccacuuuuugauaggauaguuugguuuuuuucuugcuaauuuguuugaguuccuuguaaauucuggauauuaguccuuugucagauacauggauugugaagauuuucucccacucuguggguugucuguuuacucugcugacuguuccuuuugcggugcagaagcucuuuaguuuaauuaagucucaccaaucuaucuuuguuuuuguugcauuugcuuuuggguucuuggucaugaaaaaauauucaacaucacuaaugaucaaggaaaugcaaaucaaaaccacaauguaauaccaccuuacuccugcaaaaaaauggucauaauaaaaaaaaauagauguuggcauauacggggugaaaagggaacacuucuauacugcuggugggaauguaaacuaguacaaccacuguggaaaccagugcagagauuccuuaaagaacuuaaaguagaacuaccauuugauccagcaaucccacuacuagguaucuacccagaggaaaagaagucaguuuaugaaaaagaugcuuacacaugcauguuuauagcagcacaauuugcaauuacaaaaauauggaaccagcccaaaugcccaucaaucaaugaguggauaaagaaacugugguacauauauacaauggaauacuacucagccauaaaaaggaaugaauuaauggcauuugcagcaaccuggauggaacuagagacuauuauucuuuuuuuuuuuuuuugacauagagucuugcucugucacccaggcuggagggcaguggcgcgaucuuggcucacugcaaccucugccucucagguucaagcgauucuccugccucagccucccaaguagcugggauuacaggugcccaccaccauacccagcuaacuuuuguauuuuuaguagagacgggguuucaucauguuggccaggcuggucucaaacuccugaccucgugauccgcccacacuggccucccaaagugcugagauuacaggagugagccacugugcccagcucucgagacuauuauucuaagugaaguaacucaggaauggaaaaccaaacaucauauguugucacucuuaagugggagcuaagcuaugaggaugcaaaggcauaagaaugauacaauggacuuuggggacuggggaagggaaggagaggaaggggggugagggauaaaagacuacaaauuggguucaguguauacugcucagauuauaggugcuccaaaaucucacaaaucaccacuaaagaacuuacucauguaaccaaauaccgccguuccccaaaaaccuauggaaauuaaaauauuuuuuaaaaaauaauaauuuuuauuuaaaaaguaaaguagccagacuagauauagauacauaaauagagaucucaaaggaacuugaaccaggcagugagaauaugggauugaaggguagggacaaugguuacaagagaccucacugucugaaaaagugacauuuaagccaaaauacaaagaagagagacuugggaaaggaggagcagagcuauaagaggacaaauguuguaaaagcuucuuucaagaaggaccaauauauguaaagacuccaaaagaagcaaauacaugaaacauccagugaaauaaagaagccaagaguggcaagagcaaagaaaauucagagggcaauuaagucaagauugggccaaggaaucacaaaagguuaaauuauucaggcucuuuagacuccauuaaagguggugaauuuuaucuucaagcaaugggaaguuaugcaaggggguuuugcuuuuguuaucuuguuuuguuuuguuugagacagaguuuuguuuuguucuguuuuguauuguuuuguuugagacagucuugcucuguugcccaggcuggagugcaguggugugaucucgacucacugcaacuucugccuccuggguucaagcaauucucaugccuaagccucgcaaguagcuggaauuacagauggacacaccaccauccccagcuaauuuuuguguuuuuauuagacgggguuucgccagguuggccaaacuggucuuaaguuccuagcuucaugugauaugcccucuuuguccucccaaagugcugagcuuacaggcgugagccacugcgccuggcccaugcaaggguuuuaaguacaggagugacaugaucagauucaucuuugacaaagaucucuucugauuucaaugugaagagaccacuuuggauagaguuaacacaguaaauccaggaaagaaaagaugguagcccaggcaagauggaugggaagagagaggagacaaacucaaacaucuuuagggggugaaaccacauuaucucauuuaaucccccaauagccuuauggacgaaaagguguugccucuacuuuauuugaacagaaauaugcuuuaaaaagauacacccuuaaagacuuaauauuguuaaaaaaaaagauguugauucucaccagugaucuacagaugcaacauaauccagaugaaaaucccagccagcuuuuuuuuuuaaguaacaaguugauuucuacacuuucuacaaaaaugcaaaaaaacccaaaauagcaaaacaaccuugaaaaaagaggaauagauauggagggguuucacgagugaacucaagauacacuauaaaucuacauacaguaaucaagacaaugugguauuggcaugagacuaaacagaucaauggaacagaauaaagacuccagaaacaaacccaugcucauaugcucaauugguuuucaacaaagaugccaaaguaauucaaagaggaaaggaaagucuuuucaauaaauaguguuggagcaauuggauauccauuuggaaaaaaauaagccucacauuauacacaaaaauuaauuugagauggaucacagaccuaaaaaagagcuaaacuuauaaagcucucuaaagaaaauauaagacaauauccugaugaccuguaauagauaaagauuucuuaggaugcagaaagcaaaaaccuuaaaggaaaaaugauaaacuagaccucuucaaguuucaaaacuucugcucaucaaaagucacugugaaaaaaugaauagccaugccaaggacugggagaaaauauucacuaaacaaauuuucaucaaaggacuugcguccuucuauauaaagaacuacuauaacaaccaaaaaaaaauuuaacugggcaaaagacaugaauauacauuucacagagcgaaguauaaaaauggccaauaagccacgaaaaaaaugcucaucauuaguuaucagggaaaugcuaauuaaaaucacaaguagcuagcaccauacacacauuagaauaucuaaauuaaaaagacugauaguacuaaauguuggagaggauguugagcaaccagaacugucauaucacuaguaggaauguaaaauagucuaacuacuuugcaaaaaguuuuggcaguuucuuaaagaauaaauauauaacaacccuuuaacucagcaaaucuucuccucaucauuuagccaagauaaaugaaaacauaaauccacaaaaagauuuacacagaagagauuuuuuaauuaugguauauucauugaauggaacacuacucagcaauagaaaaauaaauugccacuguuacaugcaacaacacagaugaauguuaaaaaauaguacguugaacaaaauaagacaaauauuaaaacauaccuacuguaugaucccacuuacauaaaguuuuagaauaggcaacuuaaaccuauugugaaaaagagaauaugaacagcaguuaccugggugcaggcaagaggggauuauuaacagagaaagcacacaaggaaacuuucuaggugauggaaauguucuauaacuugagagacguguggaugagacagauacaaccauuugucaaaagugcauaguuaagguuuguaucuuucaauguauguaaauuuuaccuuacaaaaagccauaaaaaauaagaguagauggaaguauagaaaaagcaagcacaccagaagguugauaauuguuuaagcuuagugcugugugcacaggaguuuauuauacuauuuacuuuguaugcauuugaacuuuuccauaauaaaaaaacugaugguuuaaaaaaaucacaaauaaaauuaauacauguauacacauauauauccacauaaaaugacaccaccaacacaccuagaaagaugauacauaaaaucuacccugacaugaccuaggacugccuaacauuuuaacucuauauuaugcuacaaauguucucuuccaccccuauuuaacccuccccuucauccuccccauuucucuuuaucagugugguagacugcaaauaugaccaaaauggucuccucuagguauucgcuguccuuguaaugagacuuuacagcucguuucaucaagggaaauuacggaggaaucauuuuauuccuccgcuccuugaaucuggacugacuuuguggcuugcuuuggguaagagaaugaugagaucauuccgaauuaagacaagcuguaaauccaaugauguguauccuuguaagagacagaaaaggaaaagacagagaaacacaggggagagagccuugugaagacagaggaagagacugcaaugaugagucuacuagccaaggaacaccaaggguugccagcagcuagcaaagacuaagagagaggcauggaacagauucucccugacagccuucagaggaaaccagcccuguugacaccuugauuuuggagucuguccuccagaaccgugagagaauaaauuucuguuguuuuaagucaccaacuucguuguaauuuguuacagcagcccuaggaaaccaauacaccagccaagagcagaaaaaucauccaacuaaguccagcccaaaauuaacccauagaaucaugaccuaaauaaaucauuguuguaagcuacuacauuugugaugguuuguuacacagcaaagcuaauuggcacaaucaaccuagcaaauacccacuccucuuuuaaaaauucucucucccaaagccagucuuacuaucuucagauaaaauacaucacuccuaccuuuauaaccucacuauccccacaaaauaguuuuucuauaauagcaucuauaaaauguuauugcauuuuugugcaugugugucaacuuugaauagacuguacgcucucucaaggcaaagacuaugugagauugaauuuguguaugucaaugccagacaggaugacauuauccacaugaaauuuuccccaaaauauccacucuuuaugaaguuuaucuuuaucuauaauacuuauuuauaagcaaauacaaacacacuacaacacuccagauaccaaucaacuaacaaagaaauguaaaacucuuuaauugcccauaauaguucaaauggaacccuugaagucaacauaaaauauaaccaacucuuuuacagucauguaauauuccuucccuauuccuucuaauugucaaauaauaugguaaugccaaaagugggcaauaccaaaagacuaugcaaauaauagcucuaaucuagcacugagcuuugaauguauaaaugccaagaaggcaaguauucagauauauccucucccaaagaaaaggagaaacuucauuuuucuaaaguggaagaucgaggcaacaaaugcuuccauaaagaaaaucuguaagaaaaaaaaaaaaagaaaggaaauuaaaauuagauauugaaguccuuaccuaacacauaaaagaagacaugauucuaggccagaauuuuccacuguauuaaccccuuccuggaaauaagucaagcauuuagcaaauuaccugcauauguuuagcaaauaugugcuggggagcuacuuuugcuauuuuuaaaaauaaucaugucuuguugguccuuucuuacauaaccaucuuucaggaaaagcuucguaauaauacauuuccacauacacagcucauucugaacacaaaaacccaggagccaggaagaaucaaaccuagaaccucaguuuccugauuuauacugagguauguuuugcucucuaugccaugcugacuucucaagaguagacauuuuuaaauaauuuuuaaggugcaauuugagguuuauguaaauggcuuucaguuguuauugcuauucaccauuagccucaauaaucaagagcuggauuacuuaaugagagggacaugguaauuaaaaugcccaagaaaaggacaaguaaaauggaggagccaaggccagccuucaaagauaucaaagcagcaagaauucugcacaaaaagaaguugucaccgaaaacugcaaaaauuacagagguuauagaagggagacugaacaaaauaccuuuuguaguaaagaaauguuuguguaucaagaacucagagguuacccuguucuuuugaaacuaacucuuauuagacuuacuagaaagucaacacaagacuguuaaaucuaauuauguucacagacuaaacaauugcuaaccagaaaaaaagaaaaugauguaacuuucagacgugccuauuucguacuccagaagcaaaauauguuuauaaauauuugacgcaacuucuuucauuaaugaaaaaauauuuauuuagcaccuacaauguucaggcaccacgcuagaggcuaaagaugggcaaguuacacuggucauuccccucaaggaacuuaaaaguaaagagaguaauauagagauauauaagauaaauaaacaaaggagaagaccaaaaaaaucagacagugagggaaaagaaugcuuccuagaagaaaugaccuaagcaagaauucaauaagggaagaaguagggcauuucaacaaaguguuauccacaaagcacacaaauacaaauacgugccugugcgcgcacacacacacacacacacacacacacaccacagaguacagcacauuuauagaaaaguauuuuacuaaggccagaaccacucauuuaaaaaauacauauugaauaccaaugauguuucaagcauaguucucagaauuagacuauaaaugaagaaacaacccaaaaaucucuguccugaaaaaguucauucaaauuuuagaggggugagaaaaauaaugaacaaaagaaauaaauguaguacauucaaagaugacaggugcuaugaaggaaaauuaagcagauaaauuaagagucaaauugaacccagaagaacaaguauaauuuguaaagguguuaaggcuagggaggucauucugaaaaaguggaacagcacaagcauaauauuaaaauacauguguuccuaccagccagagaagucuauuucuccccaagaggcuugaaauggaaaaauuaugauaaaaaugaaaggugcauaaggccuuugaaugucuggcaagauguuguaggccuuaccccacuaccaaugagaagcuauggaaagacuccaguggaggaaaucaauauauuuucucaguccuccucaauaucuaugcggcauuugaaaauauuaaucacaccccucccauucccucauucaauaagcauucacugcgcagcuacacgaugcuguguuaaaaacaauauuuuuaaugcaacacuauuacaugucaucaugucauaaagguuacagaaguauauucauuuccagucacuaaggaagacagaugccuauaucccgcucuagcuaacacaagacgcuaugugcuaaauaauaucauggaugcacaaaauucagucauaacacagaaaagaacauuauaaaauguuaaucuugugaaaccaagaaagguuucauggaggauuugaaaaacaaguagaauguaaucaaaaaaaugguggacagaaaaaagguauuucugguggaggagcagcaggaacagagguuuaaggguacacaauuguaugucauugcaagugcaguguggcuaaagcauuggcaagaaaccuuguauuacaaaaugcaaauguuucuuggaugaacuauuuuucuuucaaaauuaaaauugcuuuuaauaugccauaugggggaaagcagguuucuuacaauuuagauuaacauucuauugcacagaggaaugucagucagaaaaaaaauagccauugcuuuuaugccacuggaagguuaauauauagacacuuuuuuuuuuuugagauggagucucacucuguugcccaggcuggagugcaguggugcgaucuuggcucacugcaaccuccgccucucagguucaagcgauuauccugucucaaccucccaaguagcugggauuacaggcacaugccaccacacccggcuaaucuuuguauuuucaguagagacgggguuuucucauguuggccaggcuggucucgaacuccugaccucaagugaucugccugccucggaauauguagacauuuuugaggagaaaaagcaaggcagcuuucuaacaguaagcaagguggguauaugagaagaauauacagagugagagauaagucacaaaugcaaaugggucuagcuaggacagaucucaaaugcugugagcacucagucucuuuaaagcaagauaguaaaaaagguagugacacaauuagauaauauuucagaaaugcagccuucuauaaaaugcaaaucugaucauucccuugaucagaaaccuccaaugguuuccuguuuagaaaucaaaacccuuugaacagaccccuggaucaccucagcagccuccucucaucaccuaccucccauccccuacccuaagucccucuaccacucuggcccucuuccacuuaucugaaguggucaucuuccaugccccuuuggcaccugguacacucuuccucaccucuucuuagaaaggaucuuugucugguucaggucugcuuagccauuggauuucaauaugucagaaaaacuuucccucacuucacauucuaggccagguccccuguuauaugcucccaaagugccagcuacuauuccuucacaguacuucucacuguuggaaugauauguuuauuugagcaauuauauauuuaaucuuggucucucccacuacaaguuccaugaauucagugaccaugacugcuuugcucaugaauauauccccagaaucuagcacaguggcuggcauagagaaggggguuaaauaagcacuugcugaauuaauuaaaugcaaaaagccaaauaagucuuucuuguggggacugucucauguaucacaggauguuuagcagcauuccaggccucuaccaguaaauacaaaaaacaaacaacacuuccugcuccgguuaugacauucaaaaauguccccaggcauugccaaauguccccugggguagggaacugcucccaguugggaaccagggagcuaguauagccauauauccugguugcacaaggcagucccuuuuaaugccuguuauccugguaaaauuauuaacagaauccccuuuuacucucagaaauaucccaauuuggaugaauauuauauugucauccuauccauggcccaucuggauguguuuuggcucuugcccagaaugagugaauuguuauacacauaaugaccaugguuucacuuccaacauagaagaaauuauaacauuuccaacaaguguguuuuuuuuaaaaaucuauauaguaggcuuuggaauuaguagaaauaguguaaugacaaugaacagaaaaaacaagacaaagauagaaaaaauaauacuacaugacgauuaaauguagaaaaacaaugacagaaagaaaucaaagaugauuccuaaguguuagccugggaaagcuggguaugaagccaucuaucaagauuaaacacacuguaggaggagggcugaauuuuguggggugauugaggaggcaaggcaagcaagcuuggauuuugagacagcuacucaacacuaaggugauacccagcagacacuggaaaguacaggucuugcagacacacagauauuuguugugauaugugccccuuuuuuggcuccgaugccacuggacuuaacucucuugcuucucuaccuucucuaguuucuuuuaagaucucuucauccugccuccuaauuaugagaaucccuaaauauucuacucagaccuuucuucuucccaugcuccacuaacucccugagaauucaaugcuauauuagcuacuaauucugcacugacaggugccagccuaaccccuagucuguaaccuccaauaccacauggccggauccuucuaaguauuuccacuugaauuauauuaacuuacaugaguaugaguauuuucaguuuaaaagggacuuucauauacauuuauuuccaucuauguaccucggucaccauacauucaacaggcuggaaaccaagcuuuucuuucucaaaaaccuggucccuuuuccuaccuucuuauuucuuauaauaucacuauaauuaacccaucaccucuguuccaaagaauaacaauaauucuuuuucugcuucaugccccuauauaaaaagucaccaaaucaauuuauguacuugcuucuugaguuuccucauuucuaaaaugaagcaguuaaacuacuucuagcucaaauguguuauaauucaaagucuuggaaaucuuggguucauucaccagucaaacguguuauaauuugaagucuuggaaaucuuggguccauccuucacucaaacguguuauaauuugaaguguuggaaaccuuggguucauucaccacuaccuuagucuaggcuagugauucucaauccuauugcauauuagaaucaccuaagaaucuucuuuuaacuacuucuauguaauccuccugcaauccaggcaucaguuuuauuuaaagacccccuacuccagugauucuaaugucaucaagacugagaaccauagaucuaagcccucauuacugucaccuacauuuugcagaugagaaaacucaggcucagagaagugacagauuggcucaaaauuucauaacuaauaaaugaaccaagcucacucugauuccaaaguccauauucuuuccuugugccaaaaagcaacugguacuuaaaaauacaaucuauaccaauugauauaauauuuguuuuuacguugcuuuaaaaaugcuucauuuucuuucauauguguauaguugguggcuccuaagaggccauaagugagagguggagucuucucauuugccccauagaagcuacgucaggauugaggaacaauaaguacaaagucuauuuuuaaaacacuguucauaaaguacugauguggguuugcauuuucaaaauuccaaggagagaucuauucaucucuugaaaacugccacaaucauuuaaguaagcugucaacugacugagauggagaaucauuaugguacaaaguucaguagggaaauacaaauccuagguacagaacugugauggauagugcucuccuauaccucuacaaacacaagcugccaaacaucagaccguuagugaauaaccagaucuucugaacagacaccuuagcaaugauaacauguuaguacacuccaguaaaagcaaugaauuucagaaacucuguaauuucuaauuucucaucuacuucacuccuacaugaaaaguuaggcuaaucuugauaaaucaacuuuuuucuaaauuugcuuucacacccuuugggcagucuaucccuuaauucuggccuuauuuuguucucuaaagagagaagcggggucuggaaugagcuguguccuccaaauccaguccuuccuaacaugauuccacauuucucagcagaugcugcagacccuuuauugcuaugcuuccuacuaaugaugucuucaugaggcauacauucagcuagcugccugagccucugagaauaucaaacuaacaacaugcugcuuaccugccuuuuaccagucagaagaugacaucuauucauuugcacaaugaaaucccaaucccagccccacuauacacauacacaccaaugagcacgugucacuucacucccaccugguuuucgacuuaggccacuuuggagaugugcuaacaauaccuagcaauugguuuguguuagaacugcacuuuuggagaguauaaagugacaacauuucaauaaaugacuaccagguccuacagccgaggaauuaauuaguaacaaauaccaucagcccucuauauucauagguucugcauccaugaauucaaccaaccauggaucaaaaauacuaaaaaaaaaaaaaagauggcugcaucugcacugaacacgcaaagacuuuuuucuugucauuaugcccuaaaaaauacaguauaacaacuauuuacauagcauucacauuguauucaauuuuauaaauaaucuagagaugacauuaaauaauacaggaagauguacauagguuauaagcaaacacuaugccacuuuauauaagagacuuuaguauucauagguuuuggaucugcaggaauuccuguaaccaaucucccacacauacuaagggaugaguguuuacaaaaaaaaaaaaugcaauaguuaaggcaaagauuauacuucuaaacuggacaagccaauuuuguaaacacaugucacugcuaauaagaaacuuuuuugaaauucuagaugguuuaugauaaaccaucaauaauaacagaccacaacaaacacaugcucuucaaaaugagaaacaagaauuggccuucuuuaugauuacuaauuacuucugcuaccacuauuacaacaggcugaaaagucccuuuggguucaaaugacuucagaauguugccaacauuuaauauccaauaaacucagaccacaaguaggaaagaaaaucuuauuuuuguuacuguauauacacaacuaagugauacuuuaaaggcaaauauagguuacaaauugaaaauugaaaagaaugcuauauugcauuuaccagugaauugugauucaaauugcuuuguguucuugcuuuuuaaaauuuugagguuuaagacaaaagucuugcauuuaauagcugagaagauuccucacagauaccgcguacauacaauguuccugcaaauauccuuauuucauucaagagauugcuuauagaauguguuacuucaauuauuugccaagauauuuuauucugugcuauuucuaacauauaucaugcuagagucacagggauacuaaauuugaaggggcauuucuaugcuuaaaauaugaaacaaauuauucugguaucuaaaauaaccuaacugcaaaagcaacuccuacacacaugugguaauaauuuucaaaaagcuaucuuuuauuggauucuagguaauaacaauagcauaugcuuuuuguacgucuacucuuacaaaacaaauuuuucacaacauaaccuuucaagaaaccaaaaugcuucagauacuuuccaucauacaauaucaauucacuaacucaaauaucuggcuuaccggauuuaauacaaacacuuuuucagauuauuaucaaaagaaaagccauucaucauuuuuauuccaaaacaauuuauugauuguaaaagacucauauuuuaaaucauaaaguuucauauuuuccguuuucuacauguucuuguccugaguaacaggacugacuaugagagacuucacauaaaaugaauuucgcacauggaaggaaaaaaccuucaguagcaugauggccuucauuauagauuugugacuuaacaucuauauguuaagucacaaaacaagucuuaaaacauucaaaaaauugaaauaauaucaagcaucuucucugaccacauggaauaaaacuagaaaucaacaaaaagagaaauuuuguaaaguauacaaacacauggaaacuaaacaauaugcuccugaaugaagagugggucaaugaagaaauuaagaaggaaacugaaaaguucuugaaacaaaugauaaugaaaacacaacauaccaaaaucuaugagauauagcaaaaacaaauacaaagcaaaaacaaaaauauaagugccuacaucaaaaaaguagaaaaaccucaaaccucacaacgcauuuuaaagaacuacaaaagcaagagcaaaccaaacccaaaaucauuacaagaaaggaaauaauaaacaucacagcaaaaauaaauaacacuaaaaugaagaacacaauacaaaagauuagccaaaugaaaagcugguuuuuuugaaaagguaaacaaaauuggcaaacccucagccagcguaagaaaaaaagacagaagacccaaauaaauaaaauaagauauaaaaagggagacauuacaaccaaugauacauaaauuaaaaggauaauuagagguacuaugagcaacauaugccaauaaauagaaaaucuagaagaaaugaaugaauuccuagacgcauacaaccuaucaagauugaaccaugaggaaauccaaaaccuaaacauaucaauaucgaguaacgagaugaaagcuguaauaaaaaguuuucuaguaaagaaaugccugggacacgaugacuuuacugcugauucuaccaaauauuuaaggaaguaauaacaaucccacucaaacuauucugaaaaauagaggaggaaggaauacuuccuaacucuuucuacaaguccaguauuaaucugauacccaaaccaacaaagguacaucaaaaaaauaaauaaauaaaacuaaaggcuaguaucccugaugaauauugacacaaauauucucaacaaaauacuagcaaacugaauucaaaaacacauuaaaaagaugauucauuaggaccaagugggauuuauccuagggaugcaagcaugguucaacauaagcaaaaugaucaauaugauacaucuaaucaacagaaugaaggacaaaacccauaugaucauuucuuuuuuuuuuuuuuuuaauauuuauugaucauucuuggguguuucucggagagggggauguggcagggucauaggauaauaguggaaagaaggucagcagauaaacacaugaacaaaggucucugguuuuccuaggcagaguucccugcggccuuccacaguguuugugucccuggguacuugagauuagggaguggugaugacucuuaacgagcaugcugccuucaagcaucuguuuaacaaagcacaucuugcaccgcccuuaauccauuuaacccugagcugacacagcacauguuucagagagcacgggguuggggguaagguuauagauuaacagcaucccaaggcagaagaauuuuccuuaguauagaacaaaauggagucuccuaugucuacuucuuucuacacagacacaguaacaaucugaucucuguuuuccccacauuucccccuuuucuuuucgacaaaaccgccaucgucaucauggcccauucucgauggucgcugucucuuccaagcuguuggguacaccugcagaaaggcugucacuucacacuuggaagauugcacagcagccaggcagaggcgcuccucacuucccagacagggcagccgaggagagacgcuccucagaucccagacggggugguggccaggcagaggcgcuccucauuucccagaugggguugcggccgggcagaggcacuccucaauuccuaggcgggguggcggcugggcagacacuccucaccucccagaugggguggcggccgggcagaggugcuccucaccucccagacgggguggccgggcagaggugcuccucacuucccagacggggcggccgggcagaggcgcuccucacuucccagaaggggcggccgggcauaggcgcuccucacaucccagaugggguggccgggcagaggcgcuccucacaucccagaugaugggcagccaggcagaaacgcuccucacuuccuagacgggguggcggccgggcagaggugcuccucacuucccagacgggguggccaggcagaggcacuccucacaucccagaugaugggcagccaggcagagacgcuccucacuuccuagaugggguggcggccgggcagaggcgcuccucacuucccagacggggcggccgggcagaggggcuccucacaucccagaggaugggcggccaggcagagacacuccucacuuccuagacaggguggcggccaggcagaggcuguaaucuuagcacuuugggaggccaaggcaggcggcugggagguggaccuuguagcgagccgagaucacgccacugcacuccagccugggccacauugagcacugagugagcgagacuccaucugcaaucccagcaccucgggaguccgaggcaggcagaucacucgaggucaggagcuggagaccagcccggucaacacggcgaaaccccgucuccaccaaaaauacaaaaaccagucaggcguggcggcacaugccugcaaucccagacacucggcaggugaaucaugggagcccgaggcagggagguugcagcgagccgagaucacggcaguacaguccagccucggcaacagagggagaccaaagaaagaaggggcggggggaggggaucauuucaguugauacuaaaaaaagcauuugagaaaauucaacauccucucaugacaaaaauccucaaaaaacuggguacagaaagaacauacuucaacacaauaaaagccauauaugacagacccauagcuaguuucauacugaauagggaaaaauugacuuuucucuaagaucuggaacauggcaaggaugccacuuucaccacuguuauucaaaauaguacugaaaguccuaucuagaucaauuggacuacagaaaaaaauaaagggcauucaaauuggaaaggacaaagugaaauuauccuuauuggcagacaauaagaucuuauauucagaaaaaccugaagacuccagcaaaaacuuagaacugauuaccaaauccaguaaaggugcagaauacaaaaucaacauacaaaaaucaguagcauuuauauaugccaacaaugaacaaucugaaaaaugaaucaagaaagauaucccauuuacaauagcuaugaagaaaauuaaauaccuaggaaauaaucaaagaagugaaagaucucuacaaugaaaacuauaaaacauugaugcaagaaauuuaagagaaaauggaaaaauguuccauguucauggauuggaagaaucaauauuguuaaaauguccauacuacccaaagcaaucuagacauucaaugauaucacuaccaaaauaccaaugacauucuucacagaaauggaaaaaaauaaucguacaauuuauauggaaccacgaaagacccagaauagccaaagcuauccuaagcaagaagaacaaaacugaaagaaucacauuaccugacuucaaauuauacuacagagguaccauaacuaauacagcaaugguacuggcauaaaaacagacacaaagaccaauggaacagaagagagaacccagaaacaaaucaaaacaucuacagugaacuaauuuuugacaaaggugucaagaacauaaauugaggaaaggacaguuucuucaauaaauaaugcugagaaaccuagauauccguaugcaaaaaaugaaacuagaccccuaucucucaccauauacaaaaaucaaauaaaaagggauuaaagacugaaaucuuauauaucaaacuaugaaaccacuacaagaaaacacuggggaaacucuccaggauauuagacugcucaaagauuucuugaguaauaccccacaaacacaggcaacgaaaacagaaauagacaaaugggaucacaucaaguuaaaaagcuucuguacagugaaggaaacaaucaaccaagugaagagacaacccacagaaugggagaaaauauguucaaacuauccuucugacaagggauuaaaaccagaauauauaaggagcucuaacaacuccauaggaaaaaaaucuaauaauacaacuaaaaacgggcaaaagaucugaauaggaauuucucaaaagaagacauacaaauggcaaacaagcauaugagaaggugcucaacaucacugaucaucagagaaaugcaaauuaaaacuacaauaagauauaaucugaccucagauaaaacgacuuuuaucuaaaagucaggaacuaacaaauguugaugagacuguggagaaaagggaacccucauacauuguugguggaaauguaaauuaguacaaccacuauggagagcaguuuggagguuccucaaaaaacuaaaaauagagcuaccauaagauccagcaaucccacucccucuuauauacacaaaagaaagcaaaucaguagauugaagagaucucuccacucucauguuuacugcagcacuauucacaauagccaaaguuuggaagcaaacuaaguguccaucaacagaaaaacggauaaagaaaaugugguaccuauacacaauagaauauuauuauuauucagccauaaaaaagaaauggagauccugccauuugcaacaacaugaauggaacuucagguuauuauguuaagugaaauaagccaggcacagaaagacaaaguuugcauguucucacuuauuugugggagcuaaaaauuaaaauaauugaacgcauggagagcacaaggaugguuaccagaggcugggaaugcuauucagagguugggaggaaauggggaugguuaaccauauuuaaaaaaauagaaagaaugacuaagacuuauauuuucuggcauacaaggaagaugauacucaaaaauaauuuaauuauauauuuaaaaauaauuaagaauaugcuuauauuauuuguaacacaauggauaaaugcuugaggugauggauaccccauuuacccuaauguagauaucccauuuauccugauuuuaacaugcauuccaugccuguauuaaaauaucucauguaacccauuuauguguguguauauauauacacacauauauauuguaaacccacaaaaauaaaagcaaauauaguagccagaaagggacagguaccuucaaagaaguaauaauuauaauaauauagcuaacuucucaauaauaccuacagaagccagauggaccaauggacugauaucuucaaagugcugaaagaaaauaacugcuaaucuaaaauucuauacccagcaaaaauauccuucaaaaaauaaacagauuuuuuuaaaugccuucaggcaaagaaaaacugacagauuuacuuaacaguagacccauacaaaaagaaacaguaaagagcauuuuuuaggcagaaggaaaaauaaucucagauagcagcuugaagauuuagaaggaagaacauuaaggaggaagguuaaaauaugaauauaucuaaauguuauuaaguguccagaguucauuacuauuucaugaauccuucuuauauccacacagaacagggauaguauugauauugcuauucccauuuuacagaagaaaaaaaaaaaaaacaaggaaagucauauccaaaguuaauuuuuccaaaauccaaauuauaacccuggcaacugcaaggaaagagccuuggucuacauuuccccuaccauaauuaagaagacaaaauuaaaauuaaaauuaaaaagaaaugguucaaauaauuagagacaaaaauagaaaauccuggcucaccgaugcuuugacauugagaaaguauuuucucaguacagcaucugugaacuggauauuuucuguuugcccugcaaacuucccaucuguuuccaaucugcuccaugccagaagcugaccacugcauccaaggaucccuuucccucuggcuuccaguugaguuuggccaaugaaaaucauuggcaagagacuggagagagggaggaagguggggucagaguauuaacuuccucaccucccucccugcugagucuccaggauugauuguguccaucaaucuaaggcaacagcuccuaucagauggcccucucuuauagcuacacuacucucugcaggauccaauaacaaaucccuucucuggcccuuucagauacaggaacgguaauaguucccauuguuguuagugccaagaugcuucaccauuccuugcuagugucucuuuguucauuucuacucucucaauuaccccauuugagugaacaucuauuugcugccaagacugcuugccaauuuauagcauggaaggugguaaaaacagaauagggaauaagaaccccaacacuaaagucaaaaacaacuaaaauuggaucccugcuccaaaacuggcuuuguaagaguuugcuaacguuucuaagcgucucuuaucucaucuguaaaauaaaaaaauacuaguaguaccugcuucaaaaauuauuguuuggugugaauuaauaagggcuuagcccagugccugauugaugcaaagcacaggcuuaauaaauauuaaacuaguauuauaaauuuaauauuuaguaaauauuaaacuaguauuauaaauuuaauauuuaguaaauauuaaauuacuaaauugugaauauuacuaaauuauaauaauauugauuauuauuaaauuauaauaauauuacuauuauuuuggaagagaacauuaucauaauaaguaguucugcccuacuucaacauuacuggaaaaacaguggcauaaauuagcucaaucuuauuucagcuggcucagggcuaaagaaaauuauaauugggucaagucaaagcaaaucauuucagcacaucauauacaacuucccugaacucccuaaaaaagaauauauuacauagaaauugaauauauaauugugaucagaaauguucaaaaauaaggguaauuugaagacuaaaaauaagaacagaugaaagagaagacagaucaucaaaauacaguacccauccuucgguuuuaauauuaugacugaaagucuuaguaugcaugcaauugugaauaaaaagaccaaauacagccagcaaugcugaagcaugauagcuagauugguugcauguccuuuggaaaacaacugcagcugcugcccacagggucugcauaauaacaauauauuuggcagcacuaaacagauaaccaucuuccaaaauuucucuaagugaaaaacaguuaucaacaacaauaaaagacuucugacugcuguuuuaaccaugaacuaaaauauuuucucccagguuggccaugguacugauucaauagauggaaaaagaaaagcgugacuuguuccuuuauacugcaucaagguaccaguaguucagccucgccucuauguggacuacaguucaaguccuugaucuuccaggccauaacuagcugccuuccugaaucaaaugccucuaagaaacaccauuucccagcucccucugauuugaacuguuugaacuuguugcaauccagcaagcaaaggaagcuaaaacagaacucugcacacaugggcacuaaaugauguuucuaaguggcccauuacauaacauucaccaggaaauaccuaacucuuugccuagcuuugcuaucuugggcccagucuuucaagagagauaucauucagaaacaacuaucauucuuaaagggauuuaauucaauaacuguauuuauagcuucucuaaguaaaauaauuguuaaaagugggcauauugguaaaugugccaaaacuaacaguaauguuggcuacaacauacauaaugucaugugccaggcagucuaauaaaaaguuaacuuauccaauccccaaaauaaccccacaaagcagauauuauuauuaaacccauuuuacagaaaagcggggaggcacugaggcacagagaacuuaaauagcuugcccaaggucucagagcuaaugaguaaguuaaucagccauggucggagucuucugcuuuaaccuuuauaauaccccaacacuaaaaauacagcuuuaaaaaauauuccuaugugucaauguugaaccuggcaaauaaaaaaaaauuaaaaugaaaaaaaaugaaaauauuccugaaccaugacauuacugaauuaagaugcuucuauagcucccaucucuccuuucucuucuauuuauccucaaauuaacaauucaaagucuagauuuaccaacaaauaagagaacugagcauaucucuccuaaaaaaaagaaaaggcuguaauaaaauuucuacccaaugaaauuuugaaagguucacuacgguaaaaccauagaggacugaaaaacugucuuugauaacuauuuauaagguacuauaauuguccaagaaguuuucaauaagaugaugguauuuguguuuaacaaaguuaaaucuguccuaugcucaauuuuuaaagagaagcauccuuucaugauucugaauguauuauugaccaaccuaucucagaaguauuaucaaaugccugcuuuuggcuuuuucuguuccuacauaaaauauaaucaacaaacuuccaggaguccacugcauugguaauauugugagauacaucuuuuguugcccacuccacaaaaaagguggcaaguaggugccuaaaaaaagaguuuauuccuucuugcuucucuguuucuugauucuucuacuguuuccagauuaagguauaugaugccagaauuaccaaacuauaauaggcaaaacacaucuaccaguuuuagauucuaaaaucuauaaaccaagucacccaccgcuaaagacugaucaaugauuacaauuucuuagagaaaugcuuccuuauauucuuuagucauacagaaacuuauuuuguucuuuaaaguacauaucacaugguauguuccauagcaaugguuuacaguuuuauguauuuagaacagugguauucauugaauagauuuucaccucuaaaacaaaucugaugcccacucaggaagguaaguucauaggagcaaacauguagagaaaaaucaaccaucugagauauccacuaaauucugaaauaauucacaacaggucaucuccuggagucauauguuauucauuucuacauguucuuuuacuccggcuuguuuucuaaggcuugcaucccagaaaaucagaauguuuucccuuucaugucaacaaugacucuuuuaaaggucuuuucuauaucagaaagaaauauauuuccacugaaauuuucuuuuguacucugcaacuuuugaagauaaccaggcacagaaagacaaaaacuuuccuuugaagaguaaauguuacuggcaccuaaaccuuuucuuuuucuguuguuuguaacaaaaguacuggguccuaagauucaagauacaauauugaauucuaucugguuuccuauccuaaacaaaccacaaguggaagugccaaauuaauucugaacaaauuugcuucagggcaccuacaggggccaugggccuuuaaucuucacauaccaagaguguuuauucgccucuguuggaaagaaacacaagucugggaagucaaagguuggucaguagaagagaaaaaugggguagaaucucucaagaugacagaagaaaguaaugaacccugcaaguguuuucccuggcuagcugagagaauugccaaguuugggucagaggucucauuuaacuaggaguuccauauugcucuuuuagguuacaacaaucucaauaaagcaggugauuauuccuugacuuaaaagaacuuccaaacuacaaacucaaaaugaaguuaucauugccaaauaaugcaacuugugaauagaaaauaaugguguuaaagcaauuggguaucaagauuguuuacacuguccauaaaauuuuaucaaaauacgaucaaaugucauaaauuaaauucuaauuguuuuacacauacgguaugugauauuuuccacagauuuauaacuuaaaaguacuaacugauuccaagauauguucagaaaauaacuaucaggagucucuaacggagaauuccagagauacuucuuaagcaauaguacaucaguuuaaguaaucuauuuuggguuuuuuaagcuaguuaaaaucuuuuucuacccauuuuaaaguguguugaauuuauggaugaauuaaaauguauuucaacguauaaguagguuuaauuuuuacaugguuguuuaauucugugauuaauaggccauugaaaaaugaguuuguuaauuguugggauuuuucuuacucauguuacauggaagguucuggauauccucacccauuuuauauauuccaccuuuuauuuuuaugugaaaaauuucucuuuuugguauaaaaaauuuuauuaucuuuucuuugcaaauaaagaguggugucaauuuguaacuuaaaaaaauucacuguugaccaaaaauuccaauuacaauauuuucuagacuauuuuguuaacagucuggaucaaacagaugucaguauaguaauuaaaucacauugcaauauauaaauuuuucuugauuuaucaagaaaccauaucuuaaguucucucuuaaccguaucuuaaguucucauaucuuacuucaaugucaguguuuucuaaauuggaaaguugcuuuauuccaauauuaucuggaacuguguuuuuuugaauuccacaaacuaaaauaauaauagacuauuuuuuuuaacuuacaugcaagguagaaaaaauucugcagaaauuuuaaaagauggggggaaaugggaugaauuaggagugaaaaagaaguucaaaauuuaagcaucacaaaaaaaucugguuucuuaaaaaauuauuucuuaauuuugcuuacuuuauuguuuuucaaauaauugaaacuuuacauaaucuguagucuuugaaguuuaauuuuuaaagugcuguucaguaauuucucauuucaaauuuaaaauuaaguaccaaaaauuguguauaaauaccauuaagaaaaugacacaggagaaaaauaucaggaaauuauccacuaugguuuaagaauuuuacucuuaaacaucaauggcaauuaguaucucuuuuucucuaauauuaugaauagguagaauacguaugcuugccuuagcaguauaaauguguaaaauuauguaaugucucuguauauccuuuagucuagaaccauauuuuaaauguucaauaugcccauucuaacugaauggguacuaacugaagaaaaagcuccuaaauaaaaugccuaaauaaaagauuguacuggucucauuguaacaguaaaccuauuaaguuacuuccaacuagagcaaguuuacuuaggaaagaagagacuauuugaaaaagcauuuggcaaaauaaauuuauuaucaagaaaaccacuugcaaugaagcacagaauaucauagcauaacuuacauuuuuauugugucaguuuacauagaugaacacuaaaagcaaccauuugaauuucuagaugaauucaucauuaaccagaaaaucaaauuuggcuucaugaauauaaauucacuuuuaauguguaucauguuuagacuuuuuaauauacaagcaugacuaugauugcauaaaagcuucuaaaugugauuuauuuaguaagaacauuacucuaagauaucacauuaaagauugccucuuaaagcuuggguauccagcagcuaaaagggucacuacauuaccaaaagggagagggcagaugcugccuauuaauaaugcccacugucuuaaauuaacuggagccuccagccaagaugccucugccugcccucucuggcaagccacucacacuccagggaagaaagauauguacauacauacucggauggauggguggauggauggauggauggauggauggauggauggauggauggacaaagagauagauagauagauagauagauagauagauagauagauagauagauagauagauagauagaugauagauagauggaaguauugugugcgugaguguguguguguuuggcauaugggggggaggguugcugcugcuaacagaaguaaacauuuauaaauggaaaaauauuuauaaguagucuuauuguuuuaauugacuagaucaaaguuaaacagcaucauauaauguaaaauaaauuauuuguacuggcuucaaaguauauguuagacuaagauucacaaugcuguguuucugugccuucaauuuagagguucuuccuaggcucuucugagagaaauggagaaaaagucuuuaagaugccccacauuagaacaauauaacuugugcuccacugagaaaugaaguaacauaaaaauauuucuaggagucacacuaaaaccuacacuuuauguagaucucuucacgaagaaaaagaacuaagucucucagaagaaagugaugaaauaaagagguauauaaugaagaacaaaaaaagauauuugggagaaauacagcauauuacucauuaauaauuguaguaauuaacaguauaggaaucucuaugauuuaacuagaguacugagucuaauaaauagucuauagagauagguucuauauauugacuaaaugagacacaauccuauuuagacauacagaaaagggaaaauggaaagaaauaauagcauacugcacuuggucuuauauuucccgaaagacacuucauuuuauuauaaauuuucuguacugauacuuuuuccuagaugacaucaugggaccuccagaaacaauauuucaauagaaacaauacaagucugcauuauacaguaugaauguguucagggccuccuagguagaaauccauacauacuuugaccuguguugauuuaucuccucucauauaacaauuacagauccuuuuuuccgugucugugagucaucugcuugucuauaucaucauuaaaauucugaaguucuucccaaagagcaucaggauacuguauaauucugauaccaauuuuucuuugcuauaaccccuucuauuuucacuuucacauaauuacauauuuuauguggaaaaugauaauaugcauguauucaaguuuaauaaaaauauaaaauauuuucaugguaaaauauauaaaugaaauguugacaugguccauuagaagauaaccaaaucugcuuuuuugaaagugguaugagaaauuuuguacauaaaaacacuugaacucaugacuguugguauaaaaugaggucaacgcuaauaauuucuuuugaaacuuuuucuacaauuuuuuuuuuuuuuuugagacggagucucacucuguugcccaggcuggagugcaguggcaugaucucagcugacugcaaccucugccgcccagguucaagcgauucuccugccucagacucccgagcaccugggauuacaggcaccugccaccgcgccuggcuaauuuuuguauuuuuaguagagacaggguuucaccaucuuggucaggcuggucucgaaguccugaucucgugauccaccugccuuggcuucccaaagugcugggagagcaaguaugagccccugugcccggccaacuuuuuucuauaauuuaaaguaacaguauaggcauacuuaucagcauagcaaauauuauuuaugcauacaauaaguucaaauugcaauuaucaccuuaauuauauauggaucuaagacucuucaugggauauucaccugacauaauaaaaacaguaaaaaguuugaccuaaacaaagaaauaaauguuccacaaauagauggugugcggugggucaugccuguaaucccagcacuuugggaggccaaggugggcagauugcuugagcucaggaguucaagaccagccuggccaacauggugaaaccccaucuccaccaaaaauucaaaaguagccaggugugguggcacacaccuauggucccagcuaccuggggggcugaggugggaggaucacuugagccugggaggcagagguugcagugagcuaugggcacaccacugcacuccagccugagcaacagagggaggccuugucucagggggaaaaaaaaaaacauuuuuaaguagccaaacuaaauguucuuuuaauuuuccacaggcaagguauucaggcugugaaguaacaugacuuugaacccucuucuaagugagucacuuguuuucagaucauucuuucauuaaucucuucaucaugcauucauucauucauucacucaaccaacauucacugaaaaucaacucauugccaagcaugaagaaacugaauaaggguggucccuauaugaaagaggaaacaucuuucuauaagccaauucccuggagaaaacuucagcuggagaagguaguucuccccaaagacuugaaaguggagcggcccuaaagacuacacaccacaggacuccagucccagcuauagaaaaaaccuacuuaaggaauuaagaccuauuaaaauucauauugcaagacaaaggccuuguuuccaugcuacauggcuuccugaauaaacuccauuuaacacugcuauucaguuagcuuaucuuuagaacaccaaacuuuguagaauucacuggguuucuauggguuaaugaaauuuucuguggucuucuaugggcuagugauaucugagcaucacuuggagguucaaaugguuuaagaaugagauuucccaaaacucaagguucauuaauccauuuuaauauucuaaacguaaaguaacauauacuucuacucacaauuggauuuccugaacucaaaugugacauaaucuugaaaaaauuauucaaaauaggcaugaauuuucaugaaauauauacaagcugaaagaaagauauguauuugggagaaauaacauaaggaagguaacaauaaucuuccuaaaggcaacaucuaacuauugcuuaaguauuuuagcauuuaaaaauaggcaaagguaaccuggacaaaaauuauugugauuuuaacaaaacuuuaacuuuucuuaagagaacagauuuuagacacuaacuaaggaauaaagaaauaaaaaagaguuaagauaaauaacugauccaaaauuacuaugagaacugugauuucauugauuaaaaguaaagaauuuacuaucuaaauucuaugcuaguaaacacaaauucuaucugauaaaaauaucaaaacagaaacaaauaguauuuauaaggucugcugugaggcaggcacaaauaaauaaaaauuauuuuaugauauuucauauuauuuaaggagaacuuuauuuugcuuuguacccuauuuuaaauuuuuaacuacaaaaaugguauauuuacugaacugaaauuagcauaaauaacuaauacuuuuuucuuuaaaguaauuuuugaguaggaaacagcaauacacauuuccauuucuggcaaagauguaacagucuggacaaaaaggaauaaagcaaauacacagguuuaauggaccaccuauuuauaaccauacuccuuacuuaaaaaguaauucauuucaaugauacauaaagaaaucucuauguuuaauucuaagucauaaaaaaauuucuauaccaacacaaauacugagaauucuguucuaaucuuagaguaugucugccugggcauuacuucuaucauaucacuaugcuacacacacuaaaaaauuuuuuaaaaauuuaaagaccaaaucguucugcaaacuuguaguuuaauaaaacucuguaaaaaguucuaaauuuugccuuuuuuaaugucgaugcuuuaguggcugcaguaguugcagugaugucguuacacuaaggaacaacagauggguugaagggaagaacaaagaauuuccuacuaucuggaagccugcagauauugaaaaagcagugagauaacuuuuuaacugcaucccuccauuauuccccaugugauuguguuuuaauuuuucauauauuugacuuaaauuuuaaguacucuggauauugucuccauauaaacuguguugcagcugcuugaucacucacacaccagccccaugcugcauucacauggcaugcacguugcuaagguuuuggaaaguggaggucuuuaucuaacuauaggaccuuaacagauauauuugcuugcuccaucauuaguaaaguuuuauaaaaggcaaaaagcagaauuuuuacauuccuaaaugcuuuaaguuauugcgacauucaauccuaaaugcgaacuguagauauuacaauucaaaguaauuuccuucuaaaaaaauuuuuuuuuuuuuuugagauagagucucucucugucaccaggcuggagugcaguggugcacucucggcucacugcgaccucugccucccagguucaagugauucuccugccucagccuccugaguagcugggacuacaggcacaccuguagcacuacgccuagcuaauuuuuguauuuuuaguagagacaggguuucaucauguuggccaggaugguccugaucucuugaccuagugaucugcccaccuuggccucccaaagugcugggauuacaggcgugagccaccacaccuggccccaagaaaauuuuuaaauauucaauuaauaugaauuguaacuacccauuuacaagaaaauuuuuaaauauucaauuaauaugaauuguaacuacccauuuaaaauuuggagguaacaagauggaauaagaagaugagagaaauggaaauaaauacaaguuaaagauaaaaaguaguauacaaaauguugcaucugaaaugcaaacacuaccauuuuuuucauuguauuuugacuacugaaauacuaguaauuucuaauucacaagccauaacuuuucucucaaauaaaaagaaaaaacacuuuuacauaacacuguccuuaaaauacuuaauaauuuaucuuucauuuuuuauucauuccaaauaauuuauguuugaaucuaaugcaucuaaacuauuuuagauuuaaaugaaagaggcuuggcugcaucauuaguuuuccaaagacucaaguugauuuucagaaugucugagacuuucuaaaagauauuuaaggaacucauccaggcccuuccaccccucaguuccacacuccaaaaguaauaacuuuuguuuuaggcuuccacuuucugguuuuuccagguguuuacccuaacaacucuaaauaacauacgucuuguuagauagaauauugaaucgcacuaaucugaaagggaagcaauuaucuuagagaagggaaauguaucagaguuuuucaguaaaagcaaaaauuguugggacuucuagcaauaugguggauaaauacucugaauggaccuaccguauucugcuuuucuauauuguaacaccaacucacuuaggcuguaauuagcuguuuacauguuuucuuaugagcucgugcauguuauuugaucucucuaugccucaguuacaucaucuauaaaaugaggauaacaauaauaguaauaauaguaguaacuguuuuagaauuaaauauguuaauauguccaaagaauucagaauauugccuggcacauaaugauacaaauugcuauuaucaucauauaaauucuuagaacaguguuauugggaaauaacauguuacucauuagccaauaaauguaugcucauaaaacaucuucauaauauauacuucaugcuaacuaucaacaaauauaaaaauacucuugcucaaaaacauuugaacauaaaagguaauuuuuugaugaaauacaagaggaaaaaggguaauaagucuuucuucacuaagcaaagcuuuuaucuagccaaguuguuucaagacuagaacauacgugcuaauuauuaauagaacauaguucaucauguuacauuauucaacguuaacgaauucccagaauaacauuuugucaucuucuacuugauugaaacuguuacagucuugccaaugcaccacaauguagcagucucucauuuugagguaccacccagaguuuuuugucucacaaccaagagaauuaaguaguguggacacaaaaagguugagguuagagcaaaaguuuaauaagcaaaagaagaaagcucuccaccaugaacagggagccuggaaaagaguugccauuuuuacagcugaauguaaagccuuuuauaagaaaccaaaggagggcuggguugcauaacggcauaaggcacgaauuucugguagcuccaccccauccuccuagugcgcauguggguccuuagcuugaguuaauccauauugcuuuguuccccuuacugcacauguuucaggagacagaauuuuccauugcaggcaugucuggacaagucacccguuuauccuuucuuaccugugcagcugugggcaugucuuaggcaagccccgcugugcaaguucccucaucugugcccaaagcuugauuuuucaggcuguucuuuaguaugaaacaauuuaagugaggacccacccuaacugccugccugacugguuucuuccuuucuccucucucaaaacaauaacauuuuaaccuuaaauuaauucaguuuucuuguauagucuuaaauauuacacacacaaaacauuauauggguaucuauccuuuuuuuagcacauuaauaaagcagguagcaauucuuuuauuuuacacuuauuuuaaauaguaaacugcacuuuagggaacaaaagucaguggauuuucucuauuuaaaggcaggaaaaccauugaauacaguuccacauuuuagaauaucugggaacccccacaaucuguuaacuggcagguucuguugaucagauaaccuagaguuaaagaccuauuuuaucaggugagacuuaauuugcuuacaaguuucaaguuagaauuccaaaaaugacuuaaaugauaugacuauucaucuauuuuacuuuucaacccaacuuuuaguaauuucaauuaauaccguuaucuugaaauguaaacaugcaccaucacucuccuaaaucuuuuuucuuaagauguaggggauuuacuaagguuuuuaaaauguuaaaccugauguguuaaagacuuagaaaguuuugaauaagcuaccaauguagcucuuuguagaaauuaagagucuaaugaugaaaugaugcuagugcauagcaagcaauaaaaauugcuaauucuugcauuuccuuuugauucuaauuuuaagucacccaacauccuauaccauaagaguuauauauuuacacucuuuuuuuauucugaugauaacucugauuugugcuccaaagcuaguucugaaauacaggucauauacuacuuaauagaauaaaggacuaaguccacccaaaguucugaagcccaaaguucuaaguucuucuacaaagagcuuaguagcacauaaaucuuauguuaucaaaaaaaaucacuuuuucccauuucccuuuuauauuacaguaagcaacuaagaaaauauaaacuuuuuccucugggaaacagagauacagagauauuucucuuuuuuuauucuggugauaacucagauuuuugcacuccaaagcuaguucuaaaaaacaggccauacaccaguuaacagaauaaaggacuaaguccauccaaaguucuaaaguucaaaguacuucugcaaagagcuuagccgcauauaaacuuuauguuacugccccccacacacaaauaaaucacuuuuucucuuuuauauucuacaguaaguaacuaagaaaacacaaacuuuuuccucugggaaauagagcuauuucccagaauucucaggaacccauaaaaauaaacucauucuaucuuugaaaccagagagucaaauuucaguuaucaggaggacccacuaucugaaguaaggagaaaaaaauguuaaaucacauguguuuucuaagaaaaaugaacggcaaagucacuaaccugauagaaaugaucuccgggaccaaagggccaagaagguaugugcuuagugaaaggcaaacccuucauaacuagugaaaagcaaacacuuuccuuuuggcuacaacccuacugcaacugaaucccccauauaucaauuaugggauacagaaugaggaacccaaaacacaaaaggauuuuuccuaccgguauaaauuauuuucuuggagauugagaguuucauuuuuaagagauguucacagucuugaugacaguacuucuaaagaaguuuuucaguggaaacaugugguaauaaguagaauucuaccauugaaacauuuaauuuauaaaacagaaaaucauaaacccaacuggcauucuaacugcaacuacuuauccuuggcuauacaguguuucuaaaaucucugccaggcaaauuaaauagacuuacuauggaauguaacaaaaucaaacaaucuggaacuguaauuacuaugauauuguuuauaagaauggaggaugcuguguuuuacauuauuacauuaaaaauaaaaugaucaugaaaacaugagccaagcagaagauaucuaacuuuuccuaaggagaauuuuucugagaauuauaaccuugacugacaaauaaaaauaaagauauggcuuuuuaauuuauuuaaugauuccuacaaggucuuuuccaugugaauaaaacacuuaucaaaauagccauacuacaguuuaugaaaguaguguaccaaaugacaggccauaccucaauaaugguuuagccacauggcuauaaggacauuauaagcacaauucuugugcuucuccauuuuaagccccaucaauauaauaucuaggggucaucucauaaagaccuuuuaucugacacaauggaaauauaugcaugcauguaacgaugaccaucaaaaaucaugcaacuaauuuuacccccaaaauccuucaaugagauugacauaauuuguccaaauuauguuuacugagguaccaauaguaagaggaagaaaaaauauacgaacuaugacauaauucuguuccuucaucccccauaacucauguuaaguuacaguauaccacaaugcaauagcagauucauuaggcccuaaaccaaagcucuccucuuuugauaggaacccaugaaagccaagaguucugucacucuaccuaacauuucugauuauaaacucacugccccaucugauucagaauuccaaguucuauaugaaccagaaaacuguacagacaucuguuagugaccuaugauugaagcaacauauuuuauaacuacccucuugaaucuuuccaaccucuaccacugcccguggccccucuacacuaucuauugacuucuaaacaaagguagcaaauucuauaaaauuguccaaguaaagaacagagauuaauaauggcauauuauauacucagagauaaagccccaaaauaaacacuauaaacauguuucaaaguaagauguacuugguacuagugccucaugggaauuguaacuuggcauauacuacacugguuaagaguagcaaagauacaggagguaggagggaaguggcugggagaaagacaguaccucagcagacuaaaaaaaucuuccacuguagacauagaaaagaccaaaaccagugccgugguuucucaaaacugauauggaacacaaauuuuacacacuuccacagaaaacagagaaaacaaaugacaaagaaaugaaaauuaugaggaaaaagagagcagauauugggaacagaaaauaaguagccaaccaaaagauauuaguuuuccugaaggacagauuaaaucaaacaaaacugaagaaauaaucaaagauauaacauaggaaaccuuucuucagcagcaaaacaaaugguuuaaacagauuaaauucacuacauucccaauaauaucaaggaaaauaucaucauacagauauaugguggcaaguguggcauuuacagaaaaaaugaaaaacauucuacaagcaaucaaacauaaagaacugauuaccuacaacaaaacaaaaaucagguuguccauggauuucuccucagcaacaauaaagacugacaaagacuugaauucuaaucaaagauaauacagcaaaacuuaccaaaaacagcagaaaguacuacaauaacuaccaccucccaaaaaaaggaaauugaaugaggaaaugacuacagucacaaucaacaaacuuugaagccuaccaaauaucuuaaauucuggaccacaguaugauaggaugccaagagcuggcaccaacucugcagacuucaagcggaagagagagucagguccuagacuaacggaaugagauuuaaggacaugcaugggauacagaaggagugacaucagaagaaccagaauggaagcaaaagauauggcccuauaccugugcuuuuaucagcuuccuaaccaaugaagacagaaagacaagcggcagccacugauucuuagcaccaaggaccugugacaggggccguuaggggcuucugugacacucacuagccucuugaacccugaaaaccaaggaaaauggacccccagggcaaaagagaaaauaaacagagugagaaggugaaaauauucaggugaucugagcuaaucaucacucucccucaaaacuccccacacaauccuucagcaaacugcugucaccauuuaaaaaaugaguaacuguaaaauaagaagagauguauguguggaaauugcaaaaaaaggaaagggguagacaugagggagaugagaacauaaaagacagaaaaucuccauagcaaaaacuuccuaaagaaacaaaagaagaauucagagaaauaguuaccccuuguaucagugaaauaaaagaaacccuuuuuuucauuguuuggagaacucaaaagauacgggguugaaagccacacuagaagcaauaacuagaauaaauaaauuuuuuaaaugagaauaaauacacuaaaaaccaacucaagaacauggauaagcgacaugaaaaaaaucacaaaaaucaaaauagaaagaacaaauauauacaaauaauuaauugaugaggaguaauguuuuaauucuuaaggacugagaaauaagucagacgagcauccagacagaaaaaguaauucauccaauaagaugucuuuuuaaaaaaaauuaagcuaccuucaggcuuuuccacagcaacuuucaaaaccaaauggaauguccaaauuucagagggaagcggauguuaucuucagguauaaaagcaauauacaauuauuaagguaagaacacuuacacggcuuuccacaaaacuacaggaugauuaaacucaacucaccaagaaaugaaucaagauaauucaggaauaguaaaagaacuagugguaagcuuugacuccauuuagauauaucaacaggaugaaagcacuauagaaauugugauuacaaaaaauguauggaaguguuuuaaauuuugacaaaauaaauaauaauauaccaauaauaccagaauuuggcaagaagagaggaagaaaauauaaguaugcuauuuuccuuauguuucacaauaggaagucaauagacacuaccaaaauuugaaaugcagcuuuaaaagacuaaugguaucaaccaaaaaggcauuuuuuucuauucuuguuuagagaagucuuuuagaaacuaaaauauaauguugugaauaaacauuuauaaaaaauucauauauuccuuccacuucagcuauuucuuuuuuccacuaggauauaaugaaauaaauuuauauuuuaaauucauggccacacacgguggcucacgccuauaaucccagcacuuugggaggcgaggcgggugacucacgaggucaggaguucaagaccagccuggccaagauauugaaacccugucucuacuaaaaauacaaaaaaauuagccagucaugguggcgggcaccuguaaucccacauacucaggaggcugaggcagagaauugcuugaacccaggaggcagagguugcagugagcugagaucacgccacugcacuccagucugggcaacagagugagacuccaucuuaaaaaaaaauuaaaaauaaaauucaugugguccuguuuuguaaauuuuauucuaugccuaaauuugcacguguguagagaaaaauaucaggguugauauuuaaaagugccaacaaauguucauucuauuugauaagacucauguaacuuuaauaaaaagguauuuuauuuuucuuuguacuuuuaaauaauaguuuuuaaaaaugcaguucuauacuuuuugcaaaaaccacaaagguuauuauuuucucuaaaagcuauuuuaaaaacaaauaaggggccaggcaugguagcucacaucuguaaucccagcauuuugggaggccaaggaaagaggaucucuuggggcuaggaguucaagaccaaucuggcaacauagggagauccuaucucuacaaauuuuuuuuuaaucugccagaugugauggcauguaccuauagucccagcuacuugugaggcugaggugggaggauugcuugcgcccaagagaucaaggcagcagugagccauguucacaccacugcccuccagccuggucaacaaagcaagacccugucacaaaaauaauaauaauaauuuuaaaauuaaaaaaauaaggaagcaacaucaauaaagucugaaggugaaauauaacaauacauuuuuaccauggaauauaauaacacccuauaucauuccugggaaaauuaaaugaaccuauugaaagaugaagcauuggccagacacaauggcucacaccuguaaucccagcacuuugagagguugaggcaggagaauggcuugaggcuaggaguucaagaccagccuggacaauauaacaagauccuaucuauaaaaaaaagaauuuuuaauuaacugaguguggugacacaugccugcagucccagccaccuguggggcugaagugagaggauugcuugaacugaggcauucaaggcugcaauaagcuaugauuacaccacugcacuccagccugggaaacagagugagacccugccucaaaaaaaaaaaaaaaaaaaaaaaaaggcauagaccacagcauaccaauaacuaauaucuaagugaacucaaagcaaacaaaugaaaaaauaagcaaacaaaaaaaauuaaauggaacccaaaagaggucauuuuauagugacaaauuuuuuuaacucaccaaaaaaaacagcuaucaggaauauaagcugacuaacauagaauaucuaaaccaaaaagcuuauucaacagaaaacugacagaaaaauauaguaaugaaaaacuaauauucuacucuugcauuauaacaaauacaagaaaauaucaauaaaaaugcagaggugcuaaauaucagaauuuauaccuuacauaaauuccagaaauauuuaugaauuuucuguggaauguaagaauucaaaaagaaaauccuuaaaauacaggauagcaaaaaguauauaggcucacauucucuuucuauaaugcaaaaaaaaaaaaaaaaaaacaaaaacgacaaauuaacagcaaaacuuaaaccaaaaaagaaaaugucacuuuggaacuaaaaauauuuugcuaauaaauucgguuucaagaaaaaauccuucuucccucuaugagucuguuuuuucauauuuuaaaaagguuuuucaacuaagagaucuuauaaggucuuuagagccacagcucuuccccugacacauaaaaaccacaaugacuuuuaaguauuuaggaagcauauaucauauguucaucuuucucacugauuauucagugugauaugcaaaaguaaaauggaauguauuaucuagucggagaguuaggaaagucaaauaguaguucaucaacauaauuaugaaugugauagaaauucagagaagagggagaccaugauaagcaggaaaggcuuauuuaugugacuugagcuaugucucgaaauagaaacaugaaaauccagaaaagauaugggggaaacauucuggucaacaauauuagaucaaugaaagcuaaagaacaaaguauuauugagcacacauggacauaaacaugggaacaacagacacugucgacuacaagaguggggagggagggaguggcuguggguggaacaccuacuuauuggguacuaugcugacuacccgggugacagaaucuguaccccaaaccucagcaucacacaauauacccauguaacaaacuugcacuuguaccugcuguaucuaaaauaaauguuuaaaaaaauuuaaauaagcuaggaaauuuuuuaaaaagaagaaacuguuaaguaacaaauuuaaaauaagugacuauuguggaccuagccuaggaagaaaaacauugaaguacuagaccaaauugcucaaacuaaaaaaugagcugcaauaaguacugcaauaagauuuuaaagcuugcugugagcugccagcaaaguuuagaaugguucucaucuuugugaaguuucauucaaauggacuuccacacuuguagauauauuuauuugauaucuccagagaaaguaacauuacugauaaaugaugaucuuuauuugccacuugagaaacugaccacagcagaaguaagaugcugggcucuucugauucuguaaccuguguauugauuucauuuucccauagucugaccuacaaaaauugaaaauaauuaaauaaaaaacaauuuaauugagaaugagauuuaaucugaaaaggaagaagaaaacacagacagaauuggaacugguauguaauaaacaagguagagaggacuaaagcugccaaguaggugggaguggaaagaaaaaaaacaucuuagacucugagcaaaaugcuguuauuaaguauaauugcaucaacuugaucuaaauccaacauuucuuauucacugaaaagaaacguauuuaaaaagcagcaacuuccuucauaaaucaacacauucagccaaggaagcuucuaucaaaaagcuuuaacccuaaagguaauaaaaagcaagagaaaaauuauuucaguacugucaauuucaaauaacuuccuaauauaaauaugugggcugagcacuguggcucauacccauaaucccagcacuuggggaggccaaggugggaggaucacuugaggccauaaguucaagaccagccugggcaacauggugaguccucaucucuaaaaaauaugaaaaaauuagccaggaaugguggcauaugccuauaguuguagcuacucaggaggcugagacaggaggaggcauaugccuauaguuguagcuacucaggaggcuccugagacaggaggcagaaguucaaggcugaaguaagcuaugaucaugccaaugcauuccagccugagcaauagagcaagacccugucucuaaaaauaaauaaacagauaagcuauagcuaaguuaguaauaauuaccuuuaaaauucuaacagauuaugauauugauuugaguaauaacucucucucccacaugguauggcuagaugugcgucaauuaaaugcucucucgacugcaaugucaugaauuaauuuuguuuguacagugagcaggaagaacucgucagacaguuacaaauuugggggcuuauccaggauccacccuugcaaauaucugcccaugguucaucagccuccuccaguauaacagaccuagaggugagcucuuacaacugcuuauuucuacugagggucaucuuuggcacuguaccugcuggugaggcacugucgacccauagggcagagaucuaauuacagugaagaaauaguccuggaaccugucugaaaugccucuuauuaaaaaaucuguuugccuucaucaaauacaaaggccuagcccaucugcaaugccaccuccugauaugggaaacagcuguucagcugaacucaucuagucucaggacuaggaaauuaaaaaaauaugggaugauauauuuaaauuugcuauuuccuauuuagugaaucuguauuucuaacaaucuacucauuauccuauagucugugguucacuuaagugcuaugcuaaaacugugggugagaauauuaacgucuuugucauauaagccuuggaagcccaaucaggcaccuaugaauacaugcaaagcaguuccacuccucuuacccuaggggcaacccauaccacaacuaugcccccugucaguaggaagaaguuagagcaguccucacccuuuucccauaucauagcuuacaccucgggaaugaggcaugcugaaacucaaagggcgaaagugaaacaggcuuugcaaaaauugucacagugagaaaauuauggcagugggggagacaugaucuaaccuacaucccucuagccucuaaccuucaagcucccuuaauuauuccuaggcuuaggcuaggcuagcuuugggagacauuuagucuauaguuuaaguaaaaauagcccuuccccaaaacucaacugucuuuguaaagcuaaugagagaacaccaggcuaggaggauagaguagccugaauuuugcuaagguguagacaaaaacaauugccagccauuauuccagaggucacaagauaugcaacuuccccaauacuccuucagauaacaucacuauuguagaaccuaacaguggucuuguaagagaucuuuacagguuuuuugcauuucugaaacccaugaugguuccaccuggacccaccaacugcucccagaagugauucagcaugcaacaggaucauuucccacaccccuaugauugcaccuuccaaacaauuagcagcaagcacccauugccuagccaccccaaacucuucccccaaagaacuuuugaaaaaccccuaaccuaugagccuucaaugagauugauuucaguaauaagucccucuucagugugguguggcuggccuugcaucaauuaaacucuuucucuacugaaauacagugaauugauuuuguuugugcaacaggcagaaagaaccugucugggguuacaguaucuggcccacaauauuuucagcugucugcaggaaaauauuuauucaauugucccucauauaaaaagggaaccaacuaccuacucagcuauugggcauuagaugugcuuuguuggcaagauaaaaaauauggggcucuucuuagggaaugacaaaaacaggagcauugaaaauccaagugcugugauuucucgucacauuaaauaacagcaagacccucuaaugaaaugaugagcauccucacauggccuuguaaagugucagcgcuggcuuccucaggccucugcaggguaaacauacucuucccuuagacauucgcugucuuugugguuuacagacacuaaucccagagccacagucuguccccaggugaugacaaugggaagaaggccaacuaccacaacuacaucauagaacagaucuucacaggugggcugcaguuggacaucaccugccaagucugccauggagucuccaccaccacagaccccuucugggacaucagcuuagaucugccuggcucuuccacccucuuguggcccaugaggugagggagugagggcagcauggugaauggcaaaagccacauuuugggaaccaccacaccuauggacugcuugcaaaggugagaagcccaccagcgcucacguggcaaggaaguaucuuccucacaggaaggcuguuguugaucaggacaaaagcagggcuuuucauucacauacccaggauagagccuugagaaaagauguggcauuagccugcaguuggcugcagaugcucuugcuaguuuaugcuguuuuuuucuuuuuucuuuuuuugccggaugacuagauauugguguucacuagcuuugcauuguguaggguaucuguaacaccagcuacuauuccaacuuccccccuguaaaugaucugacagccaaagagcaaaacuggaagcucccuuaccuuuugugguuaauaaccuaaaccgcagcaugagcuaagagcugagugcucuccccaugguccacggccuuuuuugcaagugauuaaaauauaguugugguguucuguacuuaugaucauuuuugaaauuguccauuuacugccucaguuuagauaaguaauaagauuuaagaugugacuaugauaaaagguauuuaaauaacuguagcauacagcuuacaauuguggugagggcagaaaaccuuccuaaacuuuauguuaauugagucuaguguuuuacaaucuuuauuuucuuuuucaugcauuaauuauaguuuacugaagaagaaaaaaacucuaauagaaauuacaauggaauucuuucaaacacagucuaauccuauacuuuguguuaaauuauauguaagaaaagaaaaaucuucaguucaacaauuagaauuuauuuuuauauauuaauuguggaaaauacuaauggcaauauuuggauuuaauuguuuauaacugucaucuugcaaaagcuaugagaaauaggaagguucacucacagguaccgaaaauaaaaugacaggcuacuuuugaacauaagcaucaugaugcacacuauaugaaaauuugguguuuuacucauaauauuucaguuauuauugacuguuaacucauaaguugcaccuagaccaaaaacuauaaauuaacaauaaauaucugcugagaagccauaccuuugcacuuuucucaguauggugacuccugaaauggguacaucccuuguauauaauguauguguaaaaauauauauauuucaacuaaauguucucaauaaggucuuucuacccaucauucuccugugcucaaaauacacaccaaaaccccaauaauuuuuaaguauuucaagauauuggcuccugaaggacaugaagauuauaagucaaaaugagacccauacucaccaguguggaucugucuuuuugcaaaugaacugucacuuaagagaccaaagagaacagcuuuggauggauauauagacuccugcaagaauuacucuuccagaagugaaauacuugauguugcccugcuggcaagauguuuuuccuguucuaaauccuucuaaguaaaucugauacaaaaugucuggugaguaugaauauucuguuaaauuuaaaaagaccaugugauggacauugcaaaagccaaucucaaaacuuuuaaauuauuuuucagacacaaaauaacuauaacuuguguuaagugcauagcaauuagaauuauauguuuuuucucauaaaacauaagaaagcaacuucuuuuuaaaauauucaauguuuucaaaacaccguuuccauuuuucuaaaauucaggcuuuagauaaaacacugaugcaaauaugaauacccuucguugagcuucaacaauaauauuacacucaagcccuuaauaggagaaaacaacuccauccugaugagaaacuauaggugucacugaagaauucuacagauggcuuuuuuuuuuuuuuuuuuuuuugagacacagucucacucugucacccaggcuggagugcaguggugugaucucggcucacugcaaccuccaccuccuggguucaagcaauucuccugccucagccucccaagcagcugggacuacaugcacacgccgccacaccuggcuaauuuuuuguauuuuaguagagacaggguuucaccauguuggccaggcuggucuugaacuccugaccucagaugauccaaccaccucggccucccaaagagcugggauuacaggcgugagccacugugccccgccccguauggccuuuaaaugcucaauaaaauauuauaaauaaguagaacugaauacaucugagaaucuaugaagcuuuauggaaaguuguauuucuauacguuugcugauauuuucaauuccuaaacauaaucuaagaugcuaaaaaguucaucggcaucucaguuuuuauacugaugaccuagaaaaauuacucacuuagauggcucauuucugucauuuuugauaaauuuuguaaacuuaauguuaaaguaugaauucuguuuuucaauuuaaauacaaaguagccccacuuaaaaucuaaacuguguaaacacaugaucauuaacaauucugcaucacuugacuuaaugaaacgucugaaacaaggugagaacuuauuauaaugaacaguguaauaucgucacagucuaucaauaaauguucucuaaaagggacucaucaaaugcuaaaagaaauauuuuuguauucugaagaauaaucuaucaaguaaaccauuuucuugaugucuucaccaguuuuuaccuuuaauuuacuaaggauaucuugcuagaaauauuaaaugaaaaugauuaauagcacuaauuauccuuccuuuccaauaaaaguuauauuuuaaauuacuuuuauuauugacauucauacuacaaugucaccuguaauuuuuuaauaaaaucacuugucauuauuucauagaacuucuagaaaauuucuugacuaacauccucuuuaaaaacuguguuaaauuaaaucacuuacugcaaacagcccacucuuacugcuacaggaauguggggaaguuggguggcccacuucagugucacaucuugauaaauaugcagcauguuauuaugauuuccaaucaaaguauuuauuguuccuucagaaacuguaaguugaaaauacagaaaagagacacuaagaaaacagucauuuggaaaaguauaucucuuuuaggaaauugauagcacaaacuaauucuaacaccuggauuuuaauacauaaagauuuuacauaauaaaacauuauuuuguaacuuuaccaguauaaaaaagaaaggaaucauuuuacagucuuggaagcuauaacuagauaaucaccaacauuuuugcauuucaucuagaaagcaugaauuucauuaauauguaacacauuuaagcuaaugauuuacuacgcauucacuacagauaauucauucuauuagacauuacuauugugcuuauaaaagagucugauguucucuugaaagcaucuugaauagccacauuauggaaaguauuaauguaugccggaggccaauuuuacaagucauuuuguacaaaguaaaaugacugacaaaaccaaaugugugcuuuauaucaaacuuccauucaaacuuugaaaguuaaaauuuccauuacauauucaauauuaaacuguuuucauauauguuuacaauauguguaugaguguggcuuuuucugguguauaucacauagccuugacauauggaagagauaaaagaaaaucuuucuacacaccugagcaauauggcagaaaacaacuugggcuccaaucaagcuucuucaugaaucgaauuuguccauuauccuuaaggcaaaaaaaguuucucucaccaagaacaaaaacagaggaugccgacugauugaaagagacaauacauaugucaagggcuugcucuccaauauuuagaguccaauccaccuacaaagcaaaacucaauaucaauuuaguugcuaaccucagaaaauuucaguuauuuucauaucaauauaaauuaagaaauugcuuuacaacaaagcagaaauauaaagaugggcuaaucucuuucauuucuuuauucuuuuuuuuaucacuaugaccauuuuucugguauuuuacaagacucuaaucaaaguuuuguuccaugucuuaccaaaugauauuaacuauucugcaauucaagaacacuaaaacacuuaucugcuucccuaaaaaacuuccaugaaaaugauauugugcuuaauuugcaaaucaaauuuaauaauccauaaaaacuaucauuaugauuguacauguguuuuuauagggcaacuaaaaauauaucaauaugcauauacagaguagucaccaagccacuagagaguauagcagaauauucuauacauaagagcuacuccaggauaucuccauauugcugggauacaguuaauguucaauaaaugcuucuuaaaguaaugaaagaaugaauguaaaaugagagcuuuucaggauucaucuuccauacaauauuucuaagucaggaaaaugcaaaagagcaaagacacaccauuuugaaaaacauuggcagaaaggcauauacuguuuucaguuuuucuaacuuuuacuuuagguucagggauacauaggaagguuuguuauacagguaaauucauuucacagagguuuggcguauagauuauuuuaucacccagguauuaagcguaguaugugauaguuauuuuuucugauccucucccuccucccaccuuucaaccucaagugaaaguaagaacaugugauauuuaagugagaacaugugauauuugguuuucuguuccugcauuaguuugcuaaagauaauggccuccagcuccauccauguuucugcaaaugacauaaucucauucuuuuuuauggcugcauaguauuccaugguguauauguaccacauuuucuuuauccagucuaccuuugauggauauuuugacauuuuugaauugcugaggauugguuuauauccgauuguguaguuuauuuuagaguaugugcuauguggugacgagaagaaugaauauucuguuguuuugggauggagaguuuuguagaugucuauuagguccauuuggucaaguauuaaguucagaccuugaauaucuuuguuaauuuucugccucagugaucugucucauagggucagugggguguugaagucucccacuauuauuguguggcagucuaaaucucuuaguaggucucuaugaaauuguuuuaugaauaugggugcuuuuguguugggugcauauauauuuaggauaguuagaucuucauguugaauugaacccuuuacuauuauguaaugcccuuauuugucuuuuuuagucuuuguugguuuaaagucuguuuugccugaaauuaggauugcagcuccugcuuuuuuccauuugcuucacagaguuuucuucaucucuuuauuuugagccuacagguguacagcaugugagaugggucucuugaaggcagcauacaauugugucuugcuuuuugauccaguuugccacucuguguguuuuaaaugggucauuuagccuguuuacauucaagguuaguauugauacguguggauuugauccugucauuguuguuagcugguuauuacgcagacuuguuuguauggcugcuuuauagugucauuacuccauguauuuaaguauuuaaguguuuuuuguauugguuaguaacagucuuucuuuuccauauuuagugcuucuuucaggagcucuaguaaggcaggucugguaguaacaauuucccuucucauuugcuugucugaaaagauccuuauuucuccuucacauaugaagcuuaguuuggcuggauaugacauucuugguugaauauuuuuucuuuaugaauauugaauacaggccuccaaucucuucuggcuuguaggguuucugccgaaagguccgcuauuagccugauggagcucccuuuggagguaaccugaccuuucucucuagcugccuuuaacauuuuuucuuucauuuugaccuuauagaaucugaugauuaugugucuuggggaugaucuuuuuguauaguaucuugcagggguucucugcauuucccgaauuugaauaucagccucucuagugagguuggggaauuuuucaugaaugauauccugagagagguuuuccaacuugcuugcuuucuccccaucucuuucagggaugccaaugagucauaaaguuggucucuuuacauaaugccaaaugucuuggagguuuuguucauuucuuaucuuuuuucuuuauuuuugucugacugucuuauuucagaaagccagucuucaagcucucagauucuuuccacagcuuggucucuucugccauuaauacuugugauuacauuacgaauucuuguaguguguuuuacagcuuuaucagguccaguuaaguucuuucuauacuggcuauuucgucugucagcucuuguaucauuguauugugauucuuagauuucuuggauuggauuuugacauucuccugaaucucaauggucuuuauuuccuguccauauucugaauucuauuucugucauuuuagccaucucagcccaguuaacaauccuugcuguagaauuagugcgaucauuuagaggaagggaaacacuguggccuuuugaguugccagaguucuugcacugguuuuuuuucaucugugugcaugaguauuccuuuucgugagguguaaauugaguauagucaguagacuucuuuucuggauguuuucagagggcugaagcuuucugcaagguuuuuauuuauagcuaaauucuugccuuugguuucaaagugggguauguuagcaagugcauuggucaguaaguaggcucuuucucacuuauguggcaccucuauauuuucucuuucucuccuuuuuuuuuuuuuuugagacagagucuugcucugucgccaggcuggagugcagugaagcuaucucagcucacugcaaccuccgccucccagguucaagcgauucuccugccucagacuccugaguagcugggacuacaggcacacgccaccacacccagcuaacuuuuguauuuuuaguagagacaggguuucaccauguuggccaggauggucucgauuuccugaccucgugauccgccugccucggccucccaaagugcugggauuacagguaugagccacugcgccuggccuuuuuuuuuuuuuuuuccauuuggagucucacucuguugcccaggcugcaaugugguggugcaaucuuggcucacugcaaugguugccaucauguuccguaucaaugcucugaaagugcagcucuucucccacuucugugcuggcuguaaaucacagcuuggcacucccaggcugcacucugccucucuggggagaucucaagcuuuauauucccuccccagcuuagaggcagcagaggaauggaccuuagcagugguuggagccaagggucuugucuccuggggcuucacccaagagagaugcagagcugcaaucaauccauuaaucggcccaaaaugggagagcuguggacccaagccagggucccugacaggcauauauuguauaugaaaguaauaaugagaugguuucacagagaaaaaucugcauaaacaggaaauagggcugcugugaaaguuaggcuaugaucaacaaacaauggauccaagaaaagaucaugaaaagucacauuaaagacaagaugaauuuuuggccaucaagacaugaucuuagguauucaucuacuuuagauauuaaaauauuugaagaagguauaaaauccaaauggggcuggccagaaaggcaaauauugccaguauauguauaagaucaaucuguagaagggagacagccuagugaacauagguaggugcaucagacuaucuuaagcugaacuagaauucaacacuaagaaauuauuugauuacuauuuggcucaaguauugcuuaccuauauaaaaugacuccacuggacaggacaugaauaucagucccaugacaguuauauuucucauuauauuguaacaggcuagcauuuggcuuuguacgucagugucuguaccucgggcugaugugugccucacucugagaggugauuuauccaaagugaacaggcaaaucauguuucugaggccacagucugagauccagccacuaaauacuuucaauuuaccagguacugaaugccacucugugaccuccacuuagggaaauacacuacauucugaauuaaugagucucauaaaacacagaaauuugcuaagaacaauaauaaaaaaaaaauucuuccacuuccagccaagauggaguaauaaggaaaugauuuagcaucccaccuaaaacaacgacaaaguggacaaaauaaaugaaacaauaguuugcaaggcacuggacaccagacaacaaagcacagcaaucccuuaaagacagaaaacaaacgaggugaguggcaugauugcuccagccuugaaagaguuucuaggccauagugcagggaagaagaaccuaggcagagcccagcagacucugugaauuguggagauggauacucagagucuggagaaaccacagcaguuggaguuaacaagacagcacaccaaauagcuacauauaaaugcugcauacagacagaacucuggagaucugcagagagugcccucaaauauucagcugaguacuuacuggcaaauuauuguaaggaaaccacacaaggccagggaaagaaccacccaaaaaagauuagagauaacagugcccaacauucacacaggguauaagauauuuccugugcccaccagccaggcugcaaaaccucauaauucugagugaauugguacaguacuaagaaggaucuugccugaggaauagggaauaaguagcccuaaaaugagcacuacccuggucccacuuaacaagucuugagaacaaggcccccaaaaaucaaacuguuuccaaguaacuuaacugugucccagggauaaccucaagaacaguauauacauaaaaaaugaaaaauucgucaccagcaggcccacacuaaaagaaaugugaaaggaauuccuuuaguuugaaggaaaaugaaaccagauggaaagauggaauuauacaaauuaaagaagaacagcagaaaugauaccuacauggguaaauacauauuuuucuugucauuuaaaucucauuaaaauauaauugauuauuuaugcaaaaauaauuacaauguaauaugggguucacagccuauguaaaaauaaaauacaggacaauagcacaaagacuggaagguaggaaacagaagcauacuucuuauauuauauauaagguaauauaucaccugaagguagacuguguuaagucaaagagaaaaacuggaaacccuaaagcaaacacuaaaauaacaaaacaaagaguuauagcuaauaaaccaacaaagauaaaauagaauuuaaaaaaaaaacuggauaaauccaaagaaaagcagaaaaagaggaaaaggaaaccaaaaaaacuagacagacauauagauaaauaaaacaaaauuaaauggcagaguauauaucacacugauuuuaaaaagcaaaucccaaccaacuacaugcuucuuauaaauuaugcacuugaaguauaaagggacaaacagauucaaaguggaaagauagaaaaagguaucagaauaacacuaaucaaaagaaaacugaguauuuuaccaacagauuaaguaggucucagaaaaaagaagauuaucaaacaaaaggauaaaggucauuucauaauguaaaggggagggguucaucaugagacagaacagucuuaaauguuuauguaccuaauaacagaauuccaaaauaucugaagcaaaaaauaaauaaauaaauauagauauaugccaggcgugguggcucaugccuguaauccuagcacuuugggaggccaaggcaggcggaucacgaggucaagagaucgagaccagucuggucaacacggcaaaaccccaucuguacuaaaaauacaaaaaaauuagcuggacauagugauacaugccuauagucccagcuacucaggaggcugaggcaggagaaucacuugaacccgggaggcggagguugcagugagccaagauugugccacuacacuccagccugggcaacacagcaaggcucugucucaaaaauaaauaaauaaauaaauauagauauagauagacauauuuccaaggagauacaaaaaaauccacaauuacagucaaagauuucaauaccccucucucaauaacuaauaauaacuaguaaaaaaacuaauaaggauauagaagaguugaacaacacuaucauccaacauaaucuaauugacauguaugaaacacucuaacaacaaaaaaaauacacauucuuuucaggugcacacugaacguuuaccaagauagaucauauucuaggccauaagacaaaucucaaugaaucuaagagaauuuaaaucauacaaauuauuuuucugaacacaaaagacuuaaauagaaaucaaucaauaaaaagguagcugugaguaacacaggaagcuauuaaaugacuucccacaacuaucuuauuaaaaucacuccauuggguaaguucuguuucuucugcaauagauuugauauugcuccaugguaucacauuccugcaaagugacuaucguguaacaaaaugaaguuuuacugcuauuucuuacucuauucacuaaucgaauggaaaaaccacucaacugcaauugccuucagaauacauccucagugugagacauggaguaaucaauaaaaacugcaaaugauaaggaaaggcuauuccagacagaagaaaaaccauaugccuagaaugaagaagagccauggaauauuuggaacaaugagaggcccuauauggcugaagugcagacuauaagaaacaaauggaagaacaccacuauugaggaggucaaaggacaauuuaauuaccauuaucaguaaguucauccagacauuuugcuaugugcuuuauauauuuauuauauacaauacauauauuuauauauaaauaccuaauuuaucuuauaacaacuuuuuuuauuuugagacggagucuugcucugucacccaggcuagaguacaguggcacgaucucagcuuacugcaaucucugccccccagguucaagcgauucuccugccucagccucccaaggagcuagaacuacaggcaugggccaccaugcccagcuaauuuuguauuuuaguggagaugggguuucuccauguuggccaggcugcucucgaacuccugaacucgggugauccaccugccucagccugccaaagugcugggauuacaggcaugagccaccgcgcccagccuaauaacaacauuuuaaaauagauauuaucacuuugcaaaugaggaaacugagauuuaguaaggcuaacaaacuugcuguaacuugcucaaaaaaaaaguaaagcucucaagaccuguuugacuucaaucugugcuuuaacuauuauuacuauggugcuucuaaauucugugcaaaacuauaucauauuuuuauucauugugcucuuuuacuuuuuacuaccaaugaaaaaaaauauaucuucaucugauucuugacucuuuccaaguuacccuucuguucuaccaucuccugaacuucuguauccuaauacagaaaauucugcauagucuucuccaauacuguuauguuaguauucuaaauucuacauuauuucuccauuuagcuuccuucuuguguauccucagauuuauuucacuguuuccaccauaauuuuaguuccuucuauuuuuugccuugcugucuauggaaguucucaagauaaggaagaguucauaaucaccaucuauuccccaauuuacaauaaauggagaauucaucauuuacaauuuuucuucaaacuacuuuucaaauuaucaaacuucaccuuugucuuugagcuaauucuaucuuugugagcugugaauuuuuaucuuuuacuuauauauucggucgcaugccuacuaguuacaaaauauuuaaagaauuaauggccaaaacauuucuaaauuuuaugcaaacuaaauauucauagaugcaagaagcuuaacaaaucuuaagcucaaaaaaagagaaagaaaaguacacauuauaaucccauugcuccaaacaagugauaagagaaaaucuggaaagcagcuagagaaaaaagacacuucaaacaauagaauauaaucuacaaaauuuugccuauuaaggagagauuuuuuuaauguuucuauuuuuauuuguuaaaagugacuccaucuggauauccacaguucuagugguacaacucuacaaucuguuauauuaagaccaugaccaggcauguguuuccauugcucaacaacaaccaacucaauucuuaggucauuaauauaaccauaauauaggaaagagaauggcugacauauuuuuuuacauuuucuucccaugaauuauuauugacaaacauaugugauuagauauagcauuauugaaauuuuuauauauuaaaaaaaggccuuacaacuagucuuuuuccagaaccaaguuuuugcuguucagucuccugccuuuuaucugcaucuguugcaaaagcaaguaccugguaccuguaugaaagaaauuuaaaaaauuauaaaugaguuuauaauuaaaaauuauaaauuauuuuaaacuuuaaaaguacacaauaaucuauaaacuuuauaaagcacuuuuuccuaguuuuuaaaaacucuaaaauuuaagauugaauucuuauugagugauauugugacauaaaacuguguaaaaugucaugauaaagaaauuauaaccauauguccauuauucaguguugggaaaacagcucuaccaacuauuaaagcacuuccauuagaauuuuaugugacaaguaacaaugcucaagaaagaucuagcaccuaaacaccaaauagacagaaaaaaauguaaauaugcaaagcagucagauggaguagaaauuaucaauacauaaucuauggaaccaaaaagaacucaguuuaaccccaguuuaaccacuuaacuagguaaguacauuuuuggugaauaaucacucugugucuggcuuccccauccauaaaacagagauaauaaucucuaacacaaucauuguuaaaaggauuaaacaauaaauuauaaagugccuacuauuugguauauaguagguauacaauuauugauugauggguugacaaagagacagauuuauauagagauagagaucaaucacauaguaguuuguagcugguagguagugaguucucaguaaucgacauuaugaucuauaaguauuuuacagcuucuauuucaauaguggcauuuagcucaaauuauucuuaaaaacaauuuauaaauauuauucaaucuagaaaugauuaauuuaucuaauaaaguugaaauuucuauauuucucauuaauuaauggcauauuuuuagaagaauaauccuacuguacauaaagcaacuacagacucacagaugccuuucccuccuauugaaucaaaacucacauuuucuaagacacagauaucugagaguguaaaaaucagggaccugaaugaaggcaauguggcauaucuaaacaagcacugaaauguacaauggucuucaaaugucauauaccaacucugaaaacauccuaucucaaucaagaauaauucacuuauaaaaaaccuguaacuucaguugaaugcagaaugacuaugauuuaaauuuuccaagacauagaaggugaugacaaacuuaacaauagcuuauaaaaaauagaucuuauuaauaugaaaacguaauauauauaaauuucauucauuuuauaaacauauaguagggauccaauacaaacauuaacaauggaaaaacuacuacauaaucuauacucauaaggugcucccacacuaguuguagagacucauauacagacagcuaaguauaacucagaguauccugugcuaauuaacagaagguaugcacguaguaccaauaguaacaaguaauugggggagaaaagauaugcucuugguauagguucaggaagagaaagcuagguuuuaaaggaugagugaaaauucuaucacgcugguaaagaaggagaaggcauuauggcaaaucaaauaacaaaugcaaaggcaugcagcaguaaaagagacaugaaaggccaugacaggaguuuaggagagaugcaugacagggaggaaugagucauggggcgcaugaaguaagagggagaagaucucagccuuguaagaccaugcuacaaaaucccacggucagcugcagccaaucucucuauaccaucugagauugaccuucaaaaucccaaagucucuaaaagugcaaaauaauuagaccucacauucugaacuccaaauaggauuguuuuccuauucccaauucauagcaacagaaauaguaugcgcuggugacuagaacaucaucccaaagcuuguccugcuauggaucuaacccuaggcaauuaguuacauaggugguucauuuccuacagaaaccaaccugccaagggauaauauagauauucaugagauuguuacaaagguccaaaacucuuugagcuguuugaagcuuauauauauaacuauggucauuauuuuaucuaagaaauaagugagccccuaaagcggccuuauuaacauuaaaacagcaggcagaggcacagccaaaauugacuacugauuuccaaauccaaaccauuucucuuccuaaaagacaacucagaagaguauuuuauuacuuaaacuugacaguaaaauuagaugaugacaaacuuacaagagcaucuauuuuaugguucuuccuuaauuccucuuaacugugaccaauaaaguauguaaaaaucuauuucuaaaaccaaacaauuccaagcagauuuggaaauucugaaauaaaauauuuggaucuuuuuucuuaccacucaaguguucaguaacauaagcuacacaaaaaaguucccuugucgagauugcugaaagaauaaucagggccaauguaacaagaucuuaugaaagagugccauacaugucucucagaacagaaaggcacuaaucgcaacuacaccaagugcagcuaaacgguggugcuuuuugacucacuaaccacaaaugcuucacagguccuguagugcaccaauaacaaacucaaccacauaauuuaauacucuuccaaauugcuuuguaaaaacaguagcagguaacuaaaauauagauugaggcaucacagagcacaaaaguaaacccuccaaaaucauuuauuuucaaaauaaacagaacugucaccucagugaguggcaggaaguuuuggaaccuugauauguaacccagagaacuuuacuagaaauggaagcucgagacacagagcauuauuauguugauuucaacuauagcuaaaacauucuugacuaugccggggagaauccuuuucauugaaagaugccaguaacaaaacagaagcuuucuuuauacacuuuucacucuuuuaucaguucucauugaacacccacuuucaccaagguacagugcugggcacuucaggggauacagaauuccugccaucgaggagcacugagcuuagucaaggagaaaaacaaauguuuacuaucagugaaagcauaaguaauaccuaagggaagcacugaaaaacuacuauguaaauugagaaaaaggagauguugguuacaucuaggucagggaagaacugaaggggagcagggaggcuucuagacauaauuuccacgugcagagaaagaaggaaaagcacuucagacauaggagauagacaguaugugggaaaaaaaaaaaaggagagagagaaaaacccuuaacauauauggagacuacaaauauuuccauuuggucagagccaaagauuggagaagaauacuucuuuuuaaaacagucaauuaaauucaacagaaacacuuuuaaauauuuauuuaaggcugauuauuuacuuagugauguauuaggagcuauugagggguugcuggggaagggguauagcagacagaaggagagaaauaacacccauggcagguauacucuuuuagggagccucccuacauucaacucuuagaggucccaccucgaggccuccucagcauccuaugcaaagcucugcuauagccuguaugacaaauggacugaaguagcugacugacuuccugccuccuugaauacuauuugaggauaagaggcacgucuauuugacuacauuuccaguaccuugcacaguguauggcacacaagccuguugaaaaauauuugcugaaugaaugacugaauaaacaaacugaauuauucagucagugaagagauguuuaacacagauucuucucucaagaaccugauaaugcaagauacucuggaaaaugucaguacaagaaggcaauacaugacauuagccaaaaaucaguguuuuaggcaguaauauaucuaggaggugaaaaaaggaagacaguugaaccaguuaacuucaaaagucacuuccaaguccaaaaguccacaucauagagguaaaaugggacuggauuauaaaaagcacugaaugucaauaauaaaauaucuaggccgggcgugguggcucaugcauguaauccuagcacuuugggaggcugaggcgggcagacugccugagcucaggaguucgcaaccagcccgggcaacacaaugaaacccugucucuacuaaaauacaaaaguaauuagcugggcguggcagcaugcgccuguagucccagcuacuugggaggcugaggcaggacaauugcuugaacgcgggaggcagagguugcagugagccaaaaucgcgccacugcacuccagccugggcgacagagcaagacucagucucaaaaaaaaaaaaagaaaaaagucuaggucuuuuagucagaaauaaaaauuauucuggcuuaaggagguguuuuaaaagaaaagauaugagaagaaaccuucaaaguuuagagagaaaaaaaaaaaaacggaaauccaagugaaaaaauauaggccugaaccaaugggaaugggaaggagaggcugaauaagagaaaguauuaagggcagggauuacugacuaaauaauucugcaaggcaaaggauaagaaaagagaauaaaagaugaucaaaguuuggacauacauggcccagagaacagugguaccaaagcccuuacccuuacccucaguaaagggcaaacagaccaggagugguggcuaaugccaguaaucccagcacuuugggaagccaaggcagaagguucacuuaagcccaagagcucaagacaagucugggcaacauagugagaccccgucucuauuaaaaaaaaaaaaaugucucagggcaaacaauucucuuacuucaaaaagaaaaauggugcucaaagugugccccugaauuagauugaucuggaguaaaaauuuacaaugaugauuucugggucuuauccccuaaccuauuaaaagaaaucuaggggacuggggacuagcaucuguaaaagugcauuuuauaacaggcuguccaggugacuccuacguacacugaaguuugagaucccuagccuucacugguuuuuauuuaaacauaauuaagcaggguuuaaagaaacuaaagguaucaauaucaaaaaugaaaaugaguuauguguuaaaagccuauucuauuaauugauuauauuauauuaacugaauauagacagauuuaauaaagccucaaaagaacaaacauaguuuucaugcuuucuccaaaauccaaaaaugcagcagugauuaucauuuaauauaaucuauuaaaguugaaagcauauauaaguacaacauacgacuuaauguuguaaaccuucuugauugucaucauuucacaauaaucucguaucucaugcauuuuuaccauuauaaaugagccacauaaugcauaacguguacauuuuuuagucuaagacaaagaugaauuuaauagauugguauguuggagacuuaccacaguuaaaacaaugugagcuucuguuagauuaaacucacacauuaaggaaaucuacacauuacuucucuauccaaucacucccagaguuauuaucaaauuaauuccuaugcacauauuucaaagaguaaguaacuggguguuuaaauauuuguacuguggcucuagcauagcacuacuuggcaggaggugaggcacagagcuggguggaaagcuaaaaagcagauguccuaauauugcucaaguuuggcaggcuugaguaaacuauacagauauuuuucccaaccucuccaaauaaauauaauauuuuauuuauuaccaauagcaaugccaccauucaaucaucuccuuuggauaagagccauaagaauuacagaaggaauauuacaugaugauacacuuccuaaaucgguuaaauucugcuuacucacaaacauucacuuauuuucagaguuuuaacccuagaugccuugacaaugauuuacaaaaagcaaauggcuacuuaugaugagaaagcugcauuaacuuguuauauacacaacauugaaacaugaagacaaaaauuuacaucuguugccugaugaauuuauaucuucuucccaucuugggaauaaugauguggccaaaaauaauguugaaaagccaugaugauguguugcuuagauguuuaaacuuccaaauguugccaccaguaagacaacacaauaaaguuacuaaaggcacugaaaaccuccaaggcuauuucuuuucccagcaugaauuucuacucuuuuccccauucucucugccaauaaaaaacauacucuccaaaaacucaaaaccuugacuuuuauuuaaaucuagcugguggagaagaaaacagucucucucauacacaauuuaccaagaccaauaagaauuucuagcgaauaaguauaaacuauuugccuagggucauuuucauacuucacuuauacuaugaauuguucuucuaaaaaaguauugacauucauauuaacaguucaugccaguauuuuuccuauaucacacauauucuuuuuucuuauaaaagaauuccacagcuaaaucuucaauuuggcuuuuuucacucaacaucguauuuaauuauuuauuauaucaaggaacaaucacaauaauuauugagcauuuucuacaggguaguaacuggacauacauuuaauccuuauaauaaacuugucaaaaugagcuauauuaccuccuuuagagccaggauaaggaccaucaaacaucuggagugguaaaaucaggauuccaauccaggucugccucccaaaccacugcacuauauugccuuucaaauauuuuacaauaguaaaugauauagucuaagucaccacaaucacauauuuucaaagaaaccgaucucuuuuucauuugugauauugaagcucuuuguggacaaaaauuagucagcaacaaacgcaccaaaaaaucaugauucugaagacuuaacauccaaacuuacuuauaacuuuccacuuguuggcaggaagagacaguaaggaaggaaucuguacgggaacuguaggcaagaggaccaggcagaagaaagccagggagaaaucuuccaaaagcauagcucuccugcucaaauaccaucagcaucccauccauagacuggaugcaaauuaaaucucgaccuaaagaagaauuagagaaaauuagauaaucuauucuuuuuauaaauauaauauuuuuauuaaucacuaucuacaacauguaugucuuaggcaccaauuuuacauaaaucauagcauuaagcagcauucggugugaaaauuacuaauagugaaaaauaccaaucccuaauugcccucaacuauaaacuaauucugaggugucuucuacuauuagucuaccaguauuaagcacaauauucacaguucuuaaaauuuacugagaugaugguaaugaugaugauuucuaugauacaguuuaucauagaaaacugauacaguuuaucauagaaaacugauacauagaaaacauagauacauuaguaucccuaaucugagaaagaucuaguggcuauaaccuuucauguccugcuagugugauuaguguauccuauaauguauuacauagggaaaaauuauguuagaggaaaauuaagcuacucauuaagggaauaaauaaaaggccaaucuuguaccuugucaucucuagcucauacaccauauacaguaaguacuauaguaacuauucuuuauuaccuugaauaucagugacaaucuuaaauagcauacuuagauuuuaaagagugcucaaaaagaaaucaaauugcauagaaauagaugauacucuucuuguaucugacuaaggacaaucauacagcuaagcaacuuuuaaaaagaaaacauaucaccaaaagaggcuaaaaaaaaagaaaaaaagagagagaacaaacugaguuuuggagugcuuauuacugcauuauacucuaacccaccucaacugauacaauagauuuaucaaccuuaaauagccugaaagauguucuaggauaaguauugucugugaaugaauguucacuaaacauacaucugaaccauucaggaaucucuuuuagagagauaaaaauuguuuauauuaaugcuguuugaaaaguauucucucaauacucagauucuuuuauaacguaugguaggcuuuacaguuacuguuuuaagcuuuguuuuuguuguuuugguuuuuuuuguuuguuuuuuuuguuuguuuuuauuugagacagagucucacucuguugccacgcuggagugcaguggcacgaucucagcucacugcaaccuccaccuccuggguucaagugauucucccaccucagccucccaaguagcugggacuacaggcaccaccacgcccagcuaauuuuuguacuuuuaguagagacaggguuucaaccauguuggccaggauggucucgaucucuugaccucaugauccgcccaccuuggccuuccaaagugcugggacuacaggcgugagccaccacgcccagccuaagcuuuguuuuuuuaauguuauccuuauccacuaugcuauuaaaaguuuccaaaaaagaugugaguuuauaugcauguuguauguauaugcaugcuguacacauguauucacagagacacaaucagacaaaaagaaucucaucuagcuaucuggcaaaccuaccugucugcaaucagcaaaaaugaguaaguauaaaaaugccucuaaguaguuaaaauaaaugcugcaaggucuuuguaauaaaaaucaugcaaauuuucaaagguaggauucccaggucccacuaagggcaucaauucuuauuuuaauuaugguucuaagaauugucguuuuuauaaacaaguuacugauauuccuguagcuucagccuucucauuuguaaaaugaguauauuuguauaagagcuccaagguuaucagcuaaucuucagcaaaggcgccaagaauacacaauggugaaagaacagucucuucaauaaguggugcugggaaaacuggauauccacaugcaaaaaaaaaaaaaaaagauccuuaucuuacacuauacaaccaaaauccacucaaaguagauuaaagauuuaaaccaaagaucugaagcuguaaaacuuccagaagguaaacauaugguaaaaagcuucauggcauugguauuggcaaugauuuuuuggauaggacacaaaaagcacaagcaacaaaacaaaaaauagaggggaggacuacaucaaacuaaaaauuuucugcacagcaaagaaaacaaucaacaaaaaaacacauaaugggagaaaauauuugcaaaucauauaucugauaagcaauuagucucuaaaagauauaagaagcucacacaacucaauaacaaaaaacaaauaaaccaauucaaaaaugggcaaaggacuaaaauagacauuuuuccaaauaagacauacaaaucgccaacagguauaugaaaaggugcucaacauugcuaauuaucagggaaauguaaaucaaaaccacaaugagauaucaccucacauguuagaaaaaaagaaagaaauccuaccauuuacaacaacauggaugaaccuagagaacaucaugcuaaaugaaauaagccagacaacaaaagacaaacacuacaugaucucacucauacguguaauauuuuuuaaaagucaaauucauagaaacagagaguagcagggugcuuaccaggggucagggauggggaaagcaaggaaauauuggucaaaugauauacacuugcaguuauaauaugaguaaguucuggagaccuaaugcacagcacagugauuacagugaauaauaauggacacuugaaauuugcuaagagaauagaucuuuguucucaucacaaaaaagaagauaauuaugagaagugauccauacuaauauuaauuagcuugauucugguaaucauuacacaauguauauguauaucagaacaucacauuguacacaccuugaagauauauaauuuuuauuuaucaaucauaucucaauaaugcugaaaaagaguuccaaaguuagaggaaagaugucaaagucccuaacaugguauagcacacauaagacacagaauaaauuauagcauuauuaagaggguuauuauuaccugcuucccuagcccagaaaaaaagaaagugguaaauuagaaagggggugaagacacugucagcugugagaaaugacagcuaaugcccuaacaaaaauaaaagagaacaucuauaaaacacauaucaaauaauccaaaaaagaacaucugucugggcucaguuagcauaggagcaauuaugagcccuauauaucucaaaaagagaaauaucauuguuaaguggauuuaauauaguuugguauagcucuuuuuuugcaaaaaagaacuuuuggcagagaugcuaacugcugcccccaacagccauucuuucuuuaguaguagaaucaugaauuaucacuagacacauggccauccaaaauaaagcuuccacuuacaguccucuauuuacagacgcaucauauuauuauguucuucucaacaagauaggagcagagguuauacauacaacuugcagacaugcccuuacauggaccaacuauacacuucccuccccucuuuguagcaucaugguaaggcuggagcaguugucuuggccucagagaugaaagucacguauuguggacagcagagccucucuaucagcccuagacuccuuuaucuccagaugguuaaacacgacagaaauaaacaucuuuuuguuuuguucugagauggagucucgcucccucgcccaggcuggagugcaguggcacgaucuuggcucacugcaaccuccuccucccggguucaagcaauucuccugccucagccucccgaguaauugagauuacaagcucgccaccaccccuggcugauuuuuguauuuuuaguaaagaugagguuucaccauguuggccaggcuggucaugaacuucugaccucaggugauccgcucaccucagccucccaaaguccuggaauuacagggauuaagccacugcgcccggccaaacaucuuucuuauuuaagccaucauuaagucuagucuuuguuaaagcaaccaaacccagaucuuaaauaacacagaaccuaaucugagccuaaagauccauccagcauugcugucucuuaaaauuuaguuucacuuaacugaacccugguaccaaaaauaacagguauaggaaagauauugggacaauugggggaauuugaauaugacugcauguuagauaacauuaaggaauuauugcuaauuuucuuaagugaucauggcguugugaaauguaagagaauauucucauugggagaugugugcugacguauuuaugguaaaguggugcaagauguguaacucacuuucaaaugguucaucaaaaaaaguguauaaauacauauauauuuacaacuugaugugguagaaauauggguuuucauuuuacuuuuucuauauacuuuuucacaacaaaaauauaaaaaaauuaagucuaaauauauacauuuuguauguaaauacaaaugucgauauauuuucuauuaagauaugaaauauuuaugcaaugaccuugaccugcgguggaagauauuaugguaaccaaaauaauacucuugauaucuguguuauugaagacuguaagcucagaacauguguacuugcaagcagaaguaccaauaaaauuuguguucauuucaauaugugguaucaucgaaccacaaaucuucagucucccaaagaccucaaagaaguggucuucaaaauguggcccccagaccagcaccauuugcaucaccuaggaacuucucagaaaugccaauucuaagauaccaaucuaggccuaccauaugagaaacucuggucacagagcccagaaaugcuagguuuuaacaagccuagagacuacuacggugcaugcuaaaguuucagaaccacuaccuuagcaugauaggaugaaaaaguaaggccugaagaaagcuugagccccagagaaaaccuggccuguuagcauaugauaugguuuggaucugugucccuguccaaaucucaugucaaauuguaaucuccaauguuggagguggagccuggagggagggagguaauuggaucacgagggugguccuucaugaauggcuuagcaccauccccuugguacuguucuuaugauagugagugauuuaucacgacaucuuguuguuuaaaaguguguagcaccuccccccucccucucuugcuccugcucucacuaugugacaugugugcuccuccuuugccuuccaccgugauuguaaguuuccugaggccuccccagaagccaagcagaugccagcaucaugcuuccuguacagccugcagaacugugagccaauuauaaauuaccagucauggguauuucuuuauagcaaugcgagaacagccuaauauagcauaguagaacagguccuauuuccugaaacucuagcaacauagaggagaacacuuaauauauucaaguccaaguggcugccucuaaagccaaauaaucuagguuugaguccagcuccaccaauuauuagcugugagcuuagacucaaguuuccuuaucugcaagauggaguaacuacuucaguaacuugugagaauuaaauaaaauaauguauggaaacuagaccuagcaguggaaaauacccaaacacauuauuauuucuauaauuauuuucuaacucuuauacuacauguuguauuaauguuuaacugcuugcuauuucccacacacaucaugaugaugcaugcuuccuugcuuuuguuuacacaauuuucuuuccuccaaagauccuuuaacuuuucucccccucaucuagcaaacauuugcuagcuucccccuaguuauccauuccccucuccucaugcucagccauaagguuugggugagacugaccucacucuaagcuugaggcaaggcccugacuuauguaaaccaauuaguaccccaguagucacagugauugguucagggauaauuuacagccaaugagagaaaaaugaacucccuaauuugagcuggaacuagaggaaaaguuacucuucccuggugaguaaugcgugaggagcauacgguauggaaucacagaggccauuuggcuuuuccaaaagcaguuaagagagagccaugguagacacuguuugagccagugcaucaagccucaccuggagccaaaucuuccucugaacucugcaggcaauucauuccuguagauacugaagucacuuugagucaggucucugucccugaaucaaguagaucagcgcauuuuuccucugagagacaucacaagcuaagacucacaucuuuccauaagucuucucauuccgcuucaaucacccaccaucugagaucccacagagccccugucccaccuccaucuuagaacacgucaucuauugaaaugaucuguuuuugugucucucauuugcccuggacuaacucaaaggcagaaaccauaucuuacucaucuuuguaaauccagcaacuauaaaaugccuggcacauaggagauacauuaauaaaugucuguugagcugaaguaagcuaggcaaaauaauuuauucaucuguaccucagauuggcugagauuuuauuccauguguuucacucugcauacaaaguaugugaaaaaugcuuuauuuauuacaaucuuggcuacugauguuuagaaauauguagagauugauccaaaacauuacucaaaaauaaauaaauaaauccuucaaaucacuguuuuggaaaccacuucagaauacauaccaaaggcuccccuuacagauaaugggaauagaaagaacaguccagaaaaagccaugaaaguuuugucauucugacagaacagagccaacaggaagccuucacaaaagcaaugggauuucagaagcuauuuaaaugaccuugccaugaaccauacucaaagagucuuuaccacaugcucaguauuauaucaggagcuguaagaaauauggaacaacagcaauauuaacuacuacagccauuuacugagcaccuguuacauuucuggccuucuguuaaacauuuaaacagcauuauuaguuauaauuuuuaguaacucuaaaaaagagacaauagucccauuuuauacacgagaagacugaaaccugcagaacuuaaacaauuugucuaaugucaaagaauuagaaagugacaacaaauauucaaauaggaauccaucuggcuccauuauaacacacugaaacccugggaaggaaaauuuauauccauuuauuaaaauaauaugcauuaacauacaaaaucuaagugguguaaaacagacuaaacacugcagaaaaucaaagaacugcauuacaauaaaauuuccaggaaagauuucaugacagauacgaugcacccuggacugcaaaagauuggcagagugaauagcagucaaagguaaaaguagagggaaauuauuggacagaaaaggaacacagaaaaagaugcagaggcaauuauacuugauccacagugcaauggaucauguuucaccaacagagcaugaaacauaaaagcacaaauugaaaagaugacaauaucuuaacaaugacuccucaaaaauuaugcuuaaaccauacaggaaaaaauaauuuuuaaaucggaaaaaaacuaggagauuucaacagaauuuaaaaucuggauuuuauucuagucauuuugagcacaauaagagaaaaacaacuguugugauuugaaauauuacuuguaagaucuggaaacaaauugagaaagaacugaccaagaucaauuugagaggauuuuaaaaaucaauuauuuuucauuuucaaaggcaaaaaaaaaaauucaugccuguggggaugggggguagaggcagaaaaguuccauuauggcagcuucaugucaugaacauuuauucaauaguaugucucauuuucuggcauuaaaauaucauauagucaaagcuuuaacaugaugcauaaacugguaaucaacuaaauguuaaucauacugcuaaauuuaacagucuucucuauuaaauuauaaucuauucaugaaaauuacaaucuauucaugaaguguaggaguguacgcguguguguguguguguguguguguguccccaugcccagaaguucuuucuaccaugcaugacccagagcauguuccauccuucauuauuauggcaacaagggccucauggagggcaguccugaaugccauguccuccauuucucugucuuucucuuccuguggaauauauacagcagaguaagugguguagcaaacaugaaagaaaacuaccauuacucagcaugcuacauguuuuuugaaucucucuaugcucauauuucuuuuacacauugaguaaaaauacaagugaagaaaugcaaacgugaccuauggccaagcauauaugcaguucagcaugcagcugucaaaaauauuuggucuuucuccaagucugaaaaacacacaaaaaacagcuguauagguagucaaaaaggcagacaggaaacaucaagagacugaugcauaagaacagaagaguccaaaagucuguggaacuuccgcucauuuuguucauuuuacgcaugcacggaaaaaaaauuuguuauuguuacagaaagacugaaacacuaacacauuaaucuuuauugcaaaccuaccucaaaaaugauacaacauguuugcuaugaacaaagacauaaaaauauucagaguaggauuccaacagauacugccuuaaaaacaaauagcagauggauaucuagagguugcuggauuguaaauuugccauuaaauaucauuuuuguacuuuucacucauaucaucaugcaaauaaaacuacuaucauaguuuugagaucaugcuacuauuuggcuaugcuuaguaacuaauaauugguaauuagaugaaagaauagcuagcuucuuucuuauuacucucucccucauauucuguuauuguuugaacauucuaaagauaauuagugccuaauaauaaugcaauauccaauuagauucuaaguuuaaaaccuuaggcauaaauaaauacauuuuaaaaccugaaguaaacagaagaaaugaauaaauagaaugcauauguugagcugaauagcuaauauuuuaaaugauguaccagggaaaguuacacaaauucucaacuauaauucaaguguuacuccaauaaauagccucaugagacuaauugcuuuaagauacaagaaaauaaaauuuaagucuacauauuaacuucuccuaugaacuugucuuuugacauuuuaaugugucuaauuuuaauagcaaauuuuaauugccucacaaagaccauuacuagguguucugucaagcuauuuaucacaaucuuuuccccuaaacugugaacaagguuaauaacauaauauaagaaaauuacaaccauugauuaaauuagcauuauaugugauagguucaauaugaaugcaauuuuagaguuuaaaagaaggcccuaaacauuauauuauugcuugcauccacaaaauauugggugaauuauuuugucagauggaacgaucaugaaaguuuugauaacauuuuccauaacucauauucauucaacaaauuccaugcacauucauuguacaccuaguaugugcuaggagagacacagucgcuacucucagaaaguugggugaacaugggaguuaauuaaauaguacaacaauguaagaacagagauauauuaaaguaauuuaaaaggcuauggaaggaugauuaaaagcuucagaacacugggucuugcagguugagaaagaguuucccaagcaauuagagaagcaaaagcagauggaacaccaugcaucgagacauggauuuaaaaagagguggguggaagguguugggaggggagggacugggugcagagagacacuggugaugaagaugacauguucaucagaacugauggcagagccacaacuugaggacaaguuugcugcauccuuaucccagaccccugggagcucuaucaguuuccucaacuguaaaguaaugguaagaagagaauauuacaugauacugcaauaaggauuaaauauaauuaaaauacauacugccuaguaccuagcaagcauucacuaaauguuaaguaauugauauuacuggguuauucuauuccuuauagaccaaacuuaaaauugaaaaacuuaaaaaucaagggaaaaaauucuuucagagaaaaauggauaaaauuuaacaugagaaagacugcaugcacacacacacacauacauauacacucagaaauucaucuuuuuugccaaaaauggggggguuuuaagacuuuaaaaaauaugagaagucucucggaacuuaggucugugggaacuguuggcuguucaaaugauuuucugacuauuuuaaguuaacuuuccucaaaauagcaauuuccuuaacaugcuaacuauugaacucucuaaagaagaauauugugagugugucagaaucugggaauggggaaugagcugucucugucugcacacccucaccccaacacacacacauauucacauucguauucucucucucccuucccccaccccaauauugauauuuucuuacaggaugacucccuaagaaagacaagacagacaacaucauacagaagaacccguguacuuuagcauuccuuucuucuccuguauccaaaagaaaaauuauuaaagaaugaguauaacguugaggcauaaauuuuaaaaauauaaccaguuucaaacuaagguaaacuacucaagguaauagccaaucaugauaagaccccagagaauacucccaaaaauauuuaaaaacaaaaaaaauuaaauacuuuauuuuguauaaauauuccucacuugcaauaauaucagucccauaaagcguuaacuucaaaagcuaaauauuugcuuuuuacauauuaucaacucucuuaaucuuaaaucauuagcaucucaaaagaagaaacaagaaaaaaaccuuaguuuacacugaacucacugugaccaauuaauuaauguuguggaaaaaaaaaaaaacaacuaaagccaggaaauuaucagcugaguuucaacaugauuuaaacuuacaugguuuuaaaaggcaaaucaaaaugaauuagggauaguuacaacacuaaauuuccugaacuguccauuccuaucacagacuucaaugugccauuuagccauuguuugaucucuuaaauguccuugguuucuucuaagggaaguaguuaaaauaccacguuuaguaaaagucauacauacaaauauaccaaaauauucaucuuaauauacaaaugcaaucauguuaucaacccacucaaaaacuuccaagauacuccaguaccuccagaauuaaguauaaauucauaaacaagauauccaaaagaacuccucaguguaugucugcuaaaugaacauaguacucccucucacccagccccaucagccaaauacuccaaguaaaauaacccugcccuaaauguccuuauaucuuaaguccuuaaagauguuuauuuucuuuucauuaucuagcucauagcauugagcacagucucuuauauguuagugcuccaaaaauaucuguuuaacuaaacugaaccaucauaaaagcaagaaacuauguuaaacuguaguucuagauuagcaauaugucaauuaccaucaagaggaccaaaauguuugaaaguaucaccauauucacaugacaauuccauaagaacugccauuauguuuuauucaccaugccucuccaucccugauagucccucgcauccacuagaaccaaaaguauuuacugaaugaaugaauagcaucaaaguaaaaauaauauaaggugaaaguccugaaauaauuaguuuugguaugugacacuuaagagacugugauucaaaauuauuacagaguuuaguauccaucuugguauuacagaguuagaacuaagucaaaagacuaaguacucauuguaugccuaacacuagaaacacuaagaucuguuaagaagagaggggaaagguuaagguuaaaucugcucuuaaaaaaauaaaauaaagagauaaagccuacuggaaagacaauauaaaaaauauaggaaauaaaggaagcauggcugagaacucuacaaggaaaauauacaaauuaggagaaaaaucauucaaccacaaagaauaaauuguggaagcccaaaguggacaccaaaggagcagaaugauccuuagaucccuuaguauuucauaaaacucugacuucaaaagcauacucagauuaaacuuaaagcucuaguaauuauuagagccuggguacaaagucuuuuucuuuucaauacaaaacaagagauuauuaucagcaggcaaaguaccaaaaaggggcacuaauuaggauacucccugacuguucccuguuuccaaagcaggaugguauaucauaaaacaacaaauugaacaaauauggaaagaguaucaaauguagauauaguaccaauaaguaguggaaagggcagugauuuuugauucagaaacacaagaugauaagguuuugaauucuggcuuucacagacacauccuaaauaugugacuuggguacuuuguuuaauuucauccaguugguaucuucaaaugcaaaauaagccuuauuauaaccucuauaccgcaauggguugcuagaaagacuaaaggaggggaggagggaaccuguauuaacuaccugguacaguacauagaacaugguaggaauguauggcaaucuuaaaccaaaauuuagcaugcuuuaaaaaaaguaucaagccaacuucccccagcacccauacuuauuuauaccuuggauaucagauaauuuaguuauuaagucucacucuuuacauaccaaaggauagaaaagaucccagaggaagguuaggaaaaaaugugccaggaaguuggaaaugguucaauucagaaaugucaauuuuuauuugcuaaaguacucaguaaaacagugauucccaggcucaugaauuucauucaccuguaacauuucagaaacuacuggagaacaucguaggguugucagccuugugaaaagcccaucaggauguuuguuuguuuauuuguuuguuuguuuuuugagauggagucucacucugucacccaggcuggagugcaguggcacaaucucggcucacugcaaccucuaccucccggguucaggcaauucuccugccucagccuccugaguagcugggacugcagccauguggcaccacuucuggcuaauuuuuguauuuuuuauuagagacaggguuucaucauguugguuggccagguuggucuugaaccuccugaccucaggugaucugcccgccucagcuucccaaagugcugagauuacaggugugagccacuccgccuggccccagucaggaaauuuuuuaaagaaauagauuauaaucaccaauauucucuuaaaagacaauacuaauacaaauaaguaggaaguaaaaaaugucaucacuaaguguaguccucuaacugaauaaauuuuagcuuuaacuuacuuacauuagcucuuuuucguccauuaucuuaagaccauccaaaacuuuaacauaggauaguaauugagaaccucuguuacaacucagcauuaaccauuuuuaaggaacuugggaacaacuauuauaaagaacucagaaaacaaacacaaaaaguuuuucucuuccaggaacaaaagaaaaacugguuccuauucaggccuaggugaggaaacagacauuuuccauaaauauucugacuuguuaaaaucucacuacucuaagaguucuggaaucaaaaagugagacaaaggcucccucugcugacaaguaggcaguacgaucccauuaaaaaucuucccaauauuaauuggauacugcauaggcuuuuacuauucucuaucaaagacuggcuuuauuuuaugccuuaaaacaggaauucagcugcaucagauaugaaugugaaggacauguguaacuauguaacacuccuuguguauuccaauagauauuucuaaaucagcuuucaaaauucuugguuucugcucuaugcucuaaaaguuaacugagcuccaaugucauacaaggaggaaauuaaacaaggaaggcuaaagaauugagacagguuuuaagaggguuugaggaacaacgguagcaaucuaugaauacauugaugaccuuuucuaacagaaguccaaugaaauuaacagaaccaaaugaaagacuuccgaauuaacaguaauagccauuuacaacgugguccauacauuauuagcacauccaacuauucuauaacuugggaacgucaagaauuauuguccucauuuacuguggagagaccuaaggcucaagaaaguucaaaugauuuauuaaaggacacacagcugguaaguagcagggccagaacucaacacuacgucuucuaaccuuccuacuguuucuccaacugaauguuaugcauaguguagguaccuaaugacauaauuucuaaauuccuuucugauuccaaauuuaacauggucuaucauuaccauagcauuuuauaugcuuauaaguaacaucuaauuuaaauauaaaauguuaaauauuucacuuuagcagacaaaacuugaugcugaauucuuuguuaauugcuugcaaauguaaauaaaaucaaacaauaaguaggggacaaguagaggaggagaauagcauauaagacccugauucucagacuaaaauuacuguauaaaauguuuguucaaagcaguacuuuuaaguacaucaauaugcugcaaaaaaaaaguaaauaaaauuuagaagcuaaaaacuaaguaaaagugugaaccccauaaagguaaaaagagcuguugggcauuuuccuaaaucagacaaccauaagcuucaguuuuccugcucucaaaugagauacaguaaaggagaaaaaacuuguggaccaccuuuuguggagaaucuaguagauccucauauugacuuuaucuccccaguacaaagcaaagaccacaaagagcucuaccucuacuguaaggagaacuuguaaauagcauucccccucaagcccaggagaaagcaaaauaaaguacacaucucaaaaccuggaaccagaugaaggaaaaaaaaaucuauccuaggaauucauaaaccccaaacugauuuuaauguggguuugcagacuaaauucauucuauuggacgacccaagaaaccucagucugugauuuuaguauaaagugauacuggguuggaaguaccaccaaacaucugacaaaagauuacucaaaucuuugaagaaagacaccaaucauucccauugauaauguucaaaagaauaugaccucaaagucaaaguuacaauacacaaaaaauugaagguaacaugaccaagaaacagcaaaaauaauagagaaugagaugaaaacugcaaagacuucguguacugaaauugacagaaaauauaaaaauauuacacuuucuguuuaaggaaauaaaagcagguauuaaaaaugauuaagagaccuuaucaaugaccaagcgaaauuuuuaaaagaacagaaauuugagaaauaaaaaauauaauaauuaagagugaacaaaguuaacaaaacucuaagagcaguuuuaauaagaauuuguaacuaaauagcagugauuuagaaagcaaaacaaauaaaucuaaaaaaauccaagaugcaucaaaauacuagagaugaauggaaaauacaugugaaguuaagagacauaaagaauagcauaagauugucuaacuuauaucuaacuggauuuucacagguacauaauagagaaaauauggaaaaagcaacauucaaagaaauaauggcugagaauuauccagaacuguugaaagucaccaaugcuaauccaguuuuaaguccaauaaaucccaagugggauaaauaaaaauaaaucaucccuuagauaccugauaagaaacugcagaagcacagagaaugucucaaaagcaaauagaaaaagacugaaaccuaacuucuuucuaucaauggaagccagaguagaguggaauguuauauauuguguaggaaaaauaacuaucaacauagcuuugccuaccuagucuucuccuugcccuccccuccaaaaaauguuuuaaaguaauaaaacaaagauuucauucacaauagccaccaagcaauuagguuccuaacacacuaacgcuaggucaacuucgagaucuugacuugcucaggaaggcuacauuaaguaaggucaaauuaaguaauauaccccuaagauacacccuuauuaacaugguaucuuuucccucguaaugguugugauuugacaccuauugcuaucuacuuaaucauuaucuacuuaauguuuaucucccuccccaaacuuaaagaagccacagaccucgauuuuguauccauagugccuaccagggugcuggcacauaaauggaagaaaagaaggaagugagcaaguggggugggaaggaaagagacagagaagaucuaaccaaccaaaaaacuaauacagguaaaacguaaaauuuuuuuacugaaagacauaaaagaauaucuaaauaaauaagauauacuguguuccuggaugggaaaaauuguaucacaaacaugccaguuaugcauuacaauaauuuauagauuuaaugcaaugccaaauaauauucuaaaacaauuuuuuucauggaacucaauaaacuaucuuuuaaaguucaagggggaagugaaaaggagcaaaaauaacauagaaauuuuuugaagaacaaugggugggcccaguggcacacgccuguaaucccagaacuuuaggaggucaaggugggagaauugcuugagccaaguucaaggccauccugggaaacacagcaagaccucaucucuacaaaauaaaaaaauuagccaggcaugguggcgccugccuguugucccagcuacucaggaagcuaaggugcgaggaucaguugagcccaggacgucaaaacuacagugagccaugaucauggcacugcacuccacuaugggugacauagcaagauccugucucaaaaaaaaaaaaaaagaacaaugaagaaugauuagcccuccuacacagcaaaacauacuguacauuaauauuuuuauaugguauggcauucauuauagauaaacuacagacaaauaagucaaaggaaauaaauagucuaaaaacaaauuaaugacuaugggaauuuagcauaugagaaaagaauauucauaaaaggugccuggacaacuggauaaauguuuggggggaaaacuggagcccuacuguaaaccaaaucuuuaaaaaauacuuuuuuaagacagggucuugcucugucacccagacuggaguacgguggcacaaucacugcagccucaaacuccuggacucaugggauccuccuaccucagccucugaagcagcugagacuacaggugugcagcaccaccaugccuggcuaauuuuuuauauuuuuuuagagauggggucuacauugcucaggcuggucuugaauuccuggccucaagcaauccaccugccucagacaaccaaagcacugggauuauagaugugggccaccaugccuaguccauaucuaaaaauaaauuuaagaaaagacauuaaauauuuuagaauguuaguauaggaaaggucuuaaugagaauacaaagaucagaagccauaacaaaagauuaaaauauuugauaucauaaaaaauuaaaacaucuguaugauuaggcaaaguuggggcaugguggcacgugccuguaaucccagcuacuugggagacugaggcaggagaaucgcuugaaccagggaaucagagguugcagugagccgagauugcaccacugcacuccagccuggugacagagcaagacucugucucaaaaaaaaaaaguuaaaaagauaacccaccacucauaggcuguguguucaugggcagauugcuuaaucuugcaaaucuuaaauuuucucaugccuaaaaggagaaugaucaccuauuuuacaggguuguuuuaaggauuaaaugagaaaguuuaguuuaaauccuuagcguagucguagguaguagcaccaaguaaguccccaauauauuuuuuauuauuauuauaaauuaugcaaauauaagaagaugucacuuuugccugaugaagauuaggaacuuuuaaaaacuuucaaaaaaugauacuaccugguauuggcacagauauuacacacagcuaaugaaaacauaaauuaagcccaucucugugacauaagacaauuuaaaguaugcgucaaaagcuuuuugucccaauuauccaguccugggauuugauucuaaagaaauaucagaaaugaacacucauggagauucaaauacugguaauuuauaaccacaguauuuuuuaagcaaaauauuagaaacaauuccacuaauagggguauaccacagaauucuuuacgaccauuuagauuuauauugcaauagaauaauuauugacuuggggaaaugcucacaauauuuuuaagugagaaaaggacuuuaaauuaauaaauacaauaugaauccacuuuuacugcauauaaauucacaguaaaaaggcuaaaaaaaauccuaaaauacucauuugguuaaagcucucaguggcaaaaauagaaaauacuuuuucccucuuaaugcaaacuucauaugaaguuuucuacaaugagcauguuacuuaaguuaaaauaaaaacaagggucggucauguugucucacaccuguaaucucagcacuuuuggaggcugaagcgggcagauaaccugagguugggaguucgagaccagccugaccaacauggagaaacccugucucuacuaaaaaaaauacaaaaauuagccaggcgugguggcccaugccuauaaucccagcuacucaggaggcugaggcaggagaauugcuugaaacuaggagguggagguugcagugagcuaagaucgcgccauugcacuccagccuggacagcaagagcgaaacuccgucucaaaaaaaaaaagaccuuugaggaaucacacuccccacuauuccugaaguucaggccccaccaaugacugacucugccaugggacaugaugaucaaaguuugggcacacauuuuuuaaaaucacauguucaaacauguauauugaaccuuggcaagaaggcaaauguguuagaagacuuuuagcaaaaauggugaccuaaauauuggcggauuuauaucccucuuuccaaaagcacuuagauaauaagcagucagucugaaaagacuauuguuauuuaauggagcaaacaauguccacuguauaugaaauggcucucuauucuugaggaugagggaggagaggaagagaagagaggacagaaagagcaggcuuucaccucaucagaaagcaguugacacaauuucuauccacugaaauuugucaucugaaccaucaaaaaaccagacuucuacugaucuugauugucacaagaguaaaaguuugaauaagcauccauuacugagaagcauaccuagagcugauaacuccugaaucuuuaucaauuuauuuucauagagugaaaagucagugaaaaucuuccauuagccaaaugggcuuucagugagaagguuaauuuaaaugguuguugaagaagguacuagaugaaugugguaauccugaagugaggaaccucuuccucugagcuuauuugaucaagcucucugcaaacuuucuagaauauuuagccaacugccucuauuuuccaccacaagaucaacacauaccacuacucuuaagugaaauuaaauguaaaugcuaaaauguaugucacagacagaucaagaggauacacacccaugggcuuuacuguaaaggcauauacuaaggcagagugagccacugcaaaaacacacuguccauaauugaaauuuuagaagcaaucucaaugacuaaauaaugaaauauccaaauauagaauuguacauagcucaaagaagaacaaaagucuguguguuuggacaugaaaagauguccguguaacugaaaugaggaaguuacaagcuaauauacagagugaccucauuuauguaaaacaacauaaaacagaaccaaauauguuuauaaacgcauugaacauuguauccaacugcaagguugcucacuauuuuauuuaccuuggcacaagagugagauuucaucugcagaagggaaaugaaaaggaacuuuucaguuuugguuuaauaaaaauguauucauuuuauauuuuuaauauauaaagaauuacaaauaaguucaaugauuuauaaauauaaaaacuauugaaagcauuagauauacaucaacagaugacugauuaaauuaauuauaauguguaugcauguguaaaacacaaauuguacgucauuaaaaaugaugagguaaaaggguacaaaguuucaauuagacuggaggaguaaguuuuaaugaucuauuguacugcgcagugaccacaguuaauaauaauguaauguauauuucaaaauugcuaaaagaacagauuuuuaauguucucaccacacaaaaaaaauaaguugauaaggugaaggauauguuaauuagcuucauuuaaucuuucuacaauguauacauagaucaaaauauuacauuguaccccauuaauauauaaaauugucaauuaaaauacauuaaaaacaauaacaauccuacuagcacauauuauaauguguuguauaaauauuuauaaauuauguauuuuuuaaaugaugagguagauuuauauauauugccauagaaagacaggcauaguauauuguaaggggaaaagcuuauaauggacaguauaacccauuuuguuuaaaguauguauguguauauaaauaaauauauaaaauucugaauuagcaaucacaauuagucauaaaauuuaacaacauccacagucguaauuguuuuguauucauuuaacuguauucucuaauuuuuuuuucuuuuuuuuuuuuuuugagauggaguaucacucugucacccaggcuggaguaaaaugguacaaucucggcucacugcagccucugccuccuggguucaagcaauucuccugccucagccuccugaguagcugggauugcagguaugugccaucacacccagcuaauuuuguauuuuuaguagagaugggguuucuccauguuggucaggauggucuugaacucccaaccucaggugaucaccugccucagccccccaaagugcugggauuacaggcaugaaccaccaugcccgaccuuguauucucuaauuuauaaacaauacaguagugguguaauaaggaaaaauacuucuuaaaguaguuucauuacuuucauuuucguuacucaaaaagagcuauauaucuaaagucaagaauaaauaaaugcuaagccaguuucuugucagacaaagugaaaaguaaaaagauuguuuacauaauuuuaaaaauauauaaaauuugggagaaaauaaacaagcauuucugguaaaggugauuaagagucuggaaucaacucuacuuuuccccuucacuucugguauauguauccacuaccucagugacuuugaaucuuuagugcauacauauuuccaucuucagucauguggaucacuuuaaaaguccaguugauuuugucaaggacaaaaaaguggccaguaaaggcacaaacuuaauuugauguuauuccaacagaagcugcuacauuuuaaugcaucuuuauaaaacccauaaaacaagcacuauaaugaaaaagaaugccacaaaacuacuaacaugaugacuuuuagccuuuuuagugcacaaugggcagucaacagcuuuuuuuaauucugaggcccaaauguacuauaagguuuauaaaagaaaacucuacucccaaguucaaaauucucauugcuuaaaaguaguaauaaauucccuaguaaaacauuggauucugguuuuaauuagaaguaaauaugcuaagauugccaccuccugcucaagaaaaaggcaaguccuucaugaccuaugucagguggacuuucaaaagaccucagaucugaauccugucauaaaaaaagaaagaggaaggggaauagaagaauauauauuuucauguguaaacauaaaugaugccacuuaaacuauucaaugcuaccaaaugcaaaauucucacuccuaaaaaucauuaaacauauucuuucuuuggguccauguccucagauaaccaauagaaucccuuacuuaauggcauuuucacauuuaaaagucaguaagcacuuccuccaauaaaaugcuaaaauauacuugucacauauuaaauucaaaaccaaaauauaucaucaaugccaaauuaaaggagaaaaaaugauuauauuauaaaaccacuacuuuuacuaccuuccauucaaacaaauuucuaugaugaaacaaugaauguugaaaaaaaucaguauuucccaagaacuuuuucuccauucccuugagacugccauuaugccauucaaaccuuaaaauguucagauguuuuuacccgugucuguauauauucaaauauucauauauacacacauauacauauaugugcauguauauaaauguauguguguguguguguguggauagauggagggauggagauagauaaaaagauauagauauauagauagauaucuauauaugauagaugauaaauagauuucaagggggacaaaguuucagcuaugcaagaugaauagcuucugaagaucuaauguaaaacaaugugaauauauuuaaaaauauuguauuguacauaguugcuaagaggguaaaucuuaaauacucucacaaaaauaggaagggaaggaaaaaaugcuaacuauaugagguaauggaacguuaauugcuugauuguggugaauauuuuauaaugcaugcauauaucaaaucaucaaguuguaaaccuuaaaaauauacaauuuuuaauugucaacuauaccucaauagcugggggaaaaaauuauagcagucuccccuauccacagagaauacauuccaagacccccaguggaugccugaaaccuuaguaccaaacccuauacacacacuguuuuuuccuauacauacauacauaugauaaagauuaauuuauaaauuagacauaguaaucuugcacuuuggggccauuauucaguaaaauuaggguuaauugaacacaaacacugugaucaccaccacagucgaugugaucauugagaaggcuacuaagugacaaacaggagauuagugucuacaggguggauaugugggacaaaaagaugguuugcauccugggugggacagacaucagccagaaugaagagcaauuuaaaacuuacgaauuguuuauuucuggauuuuucaauuuaauauuucugggcuacagcugaccucagguaacucaaaccacggaaagugaaacuguggauaugaggggacuacuguaaauagaagcacgugcuggcaccuggcacagucccagucauauaaccuauagucaaaaaaagguuuguuuuucuuagcuuuuggaaagaaauagaaauuucaaaguuaaaagccuuuaucaaaagacaucuuuaacacaacaaaaagauauagcaucagcaguuguuugauuuuuccuucuuaaaucaaauacacucuucaucuaugauagcugaacagcugauuacugucuucuuauuuugggaugccaguuauacgauaccaguagcuuuuauaagaaaaaaaaugcuugauaugacagaaaacauaguguaugaaauacaauguccuuccuccuuauagaaaguucauauccuuuaauaaguaucacacaaaauaaaaucagcuauuugucaauaaaccucuaaugauuccaaaaauaaacucagcaaaaaguuaauaaugaaaagcuucccucuucuagguaaaaugauacuagacagauuauuuguaguuuauaaaaaaacuuuuugugaccuugugacauuuuauuaacuccuugaaaucauucaaaauugcaaugguacauucuaagagaaaauaaaaaccaaacaaaaagagaaaaaacaaaaacaaaacaaaaagagagaauaaaaacaaaaauaaauuaacacuuucgcaucaccaauagccacccaaacaaugggugccaagauucagaucuaaccuugaagauuacuucagcuuuccaggaauggcucauuucucaacccccccuauuucuucaauagauagcaugcaucauucugagaaauuucuaauuguuaaacucugcuaaaggcuuaagucaaagaacaaaugcuucuuguuacaaaacucaacaauuguaauagaauuauggguuuaacauauaaaguccugaaaccauuuucuaaacagaugaauuguuugagaguuacgacuuuccuuaaauuugccuacaccaaaacacauguuguuucaauuauauagcaaagacuauggcuucuguucaaaccuagauuuuauuguuuauaaaauuagaaacagauacacauacauauagauauauacacacacauauacaagcacauacaccuaggccauauauuauacaugaacaguugaaagguuuaauguguuauguaagaaguuacuuuacacacauaugaggaaguuaguauuaaucucacaaauggauaauucauucauaaacaacccuuuuuaucucagagauauccuuguacauguuaucacaauuauuuauacaauucagacaaaccuaaggaaguaaaaauaaugaugagcucuagcaucuuuauuuucuuaaaaaaaaugaagaacuguuuaaaaucacaguuuaccauuuuaacccaggaagggaggauuuaauuacaaucuacaaagucucuaaguguucaccaaaaccacacuacauuuuucaacaguacuugacuuaaaaguacauguauuucuauuuauaucuaaacuuuaguauuaaaggugauuuuaauuuucuucuuaauaaguuucugcauuuuuccaaauuuucuuaaaauuauuaauagauuaccuguauaauuuuuaaaaugauauaacuuuagagcaagaauuaaaacaucugacuaugauaacuaaaucagaaagauugguauugcuauaauagucacuuccucaaaauaaaauguauaauaguaccaaagaacuaauccauuaauuuaugacuucucaugguuuguucaaaagggacauauauuaaauucuaauucagaucuaacaguuguaacaagagaagaaaagaggaguauaaguuauacuugcaaugcaguccuuaauuuuuguuaauauucauccuauaauguugagcaguaggggugauuuugucccccagugguugucacacuggaugggggagcagagggguacuacuggcaucuaguggguagaggccagugaugcuucuauuuaucccauaauggcauauaggacauccuccacaacaaagaauuaccuagaccaaaaugucaacagcgucaaggguaguaaaacccugauguagagaaagaaacucuuauguuucaauuauaaaucaaacccugaaaacaaagaauucuaauucaaaaagucauuccugucuauuucuuuugaaggauacucuaauucggauuucccaagcaucuaaauuaccuacuucuuuaaaauaguuuuaaaaauaaaggguccaaaauccaaaugacacucuucacagaaauaggaaaaaaaucccaaaguuuauauggaaccauaaaaguuuauauggaaccaaauagcuaaaaaaaauucugagaaugaaaaacaaaguuggaggcaccacacucucugacuuaaaauuauauuacaaagccauagcaaucaaaacaauaugguccuggcaaaaaaaaaaaaaaaaagacacauaggccagaggaacagaauaaagagcuaagaaauaaacccaaauuaauacagucuaccaacagcaccaagaggauacaauaaguaaauaaagaacagucucuucaacaacuguugcuggagccaggcacaguggcacaugccuguaguccuagcuacucaggaggcugaggaaggaggaucacaugaccucaggaguucauggccaaccugggcaacauagugagaccccaucucaaaaaaaaagggugacagaaaaacagaauucccacaagcuaaagaaggaaauuggguucaucuuacacuauacacaaaaaucaauccaaaauggauaaaagaauagauaucggcacagauguggugaaaagggaacacuuguacucugcuggugggaauauaaauuaguacgacuucuauggaaaacaauaugaagaucucucaaagaacuaaaagcagauauaccauaagacccagcaaucccacuauccuggguaucuacccgaaggaaaauaagucauuacauaaaaaacacaccugcaugcauauguuuauugcagcacaauucacaguuguaaagauauggaaucaaccuaagucccuaucaauuaaugaguggauaaagaaaaugugcuauauauacaucauagaauacuacucagucauaaagaacaaaauaaugucuuuugcagcaacuucauuggaaauggaggccauuauccuuagugaaguaacucaggaacagaaaaccaaauaccacaaguucucacuuauaagugggaguuaacccacgggaacacaaagguguacagagugguacacuagacauugcagacucagaagcaggcagggcggaagggaggugaaggaugaaaaacuaccuguugggugcaaugugcacuauuuggguaaaggguacacuaaaauccuaaacuucacuacucgcuauacaauucauccauguaagcaaaaacacuuauaccucuaaaguuauugaaaauuuuuuuuaaaaaauguaauggauaaaagaccuaaauauaagaccaggaacuauaaaacuucucuaagagaacacagugggaaagcuccuggacauuggccuuggcaaugauuucuuggaaaucacaccaaaagagaaggccacaaaagcaaaaauaaauaaaucagacuacagucaaacuaaaaagcuucuauacagcaaaggaaacaaucaacgaaaugguagccuacaggcugggaaaaauauuuacaaaccauauaucucacaaggagugaauauccaaaauuuauaaagaacuuauacaauucaauaguaucaaaacaaucugauuuuuaaaugggcaaaagacauaaauagacauuucuccaaagaagacauacaaauggccaagacguauaugauaaggugcucaacaucauuaaucaucagggaacugcaaaucaaaaccacuaugagauaguuccucacacccguuagauggcuauuaucaaaaaggcaaaaaacaacaaauguuggcagugguguagagaaaggggaacucuuguauaccguugguggaaauguaaauugauauagccauuauggaaaauaggauggagguuuccaaaaaaauuaaaaauagaaugaucacaugacccagaaaucccuuuucggggcauauacccaaaugaaaugaaaucaccaucuugcaaagacauuugcacuuccauguuuauugcggcauuauucacaauagccaugauauggaaacaacauaagugugcaucaguggacaaauggauaaagaaacugugguauauaguuauaauggaauauuauuauuguauuacuauaaauauuuguuaucuaagaaagaaugggaucuugccauuugccacaacauggaucaacauggaggauauuaugcaaaaggaaauaagccagacacagaaaaaaauacauugcauguucucacuuauaugcagaauguaaaaaaagcaaaacaaaacaaaacuccaauacauagaacaaaacagugguuuccaggggcagauggcagggggagaaaauggggagacagaauacacaauuagaaauuagaaguauacaaggauaugaagucagaguauaaaaaguagcagauauguacaauaaacaggucuagagaacuaauguaaaacaugaagacuauagauaauaaaauuauauuguauuugggauuuaugcuaaaugaguagauuuuagcugcucuugccacagaaaugaaagaaaaauggguaacuaagugagaugauggauauguuaauuuguuucacuauaguaaucuuuuuaauaccuauauguaacucauaaaucauguuguauaccuuaaauauacauaauaaaauuuacuuuugaaaguuaaaauaaauaaagccuaagucuucauccucaauuuuaauucucuguuuucauuucccucuguacaucucaaaaacaaauuauaacuucaugucaggagauauaaaaauacagcugacccuugaacaacaacuguuugaacuguguggguccccuuauacguggaguuucuuccaccucugccaccccugagacagcaaaauugggguuaccugaagaggggucaccuccucuuucuccuccuccccagccuauucaacgugaagaugacaaagaugaagaccuguauaauaacccacuuagacucaaugaacuguaaauauauuuucccuuccuuaugauuuucuuaauaacuuuuuuacuauagcugacuuuacuguaagaauaccauauaaaacacaaauaacauagaaaauauguguuaaucaacuguuuauguuaucaguaaggcaacaguaggcuaauaauaguuaauuuucgggggagucaaaaguuauacguggauauuugacuuaaaggaggggucagcaucccuaacccccacacuguucaauggucaacuguauagagaaaguuauuccucuuccuuuugugacuaaaucuucuggaagaaagaaaaugaaaagguuucugaauuugaauaaaagaaaauauaaucuagcuguuaaggauuuuuauuucaaauuaauauuuauuuuauuuuuaauugcuucaacuaaauaaauauugaaggauuuaagggcaaacgacaugaauagacaauucucaaaaaaggauauacaaacagucaacaaacaugaaaaaaugcucaacaucacugauuaucagggaaaugcaaauuaaaaccacaaugagauauagcaccuuauuucuacaagaaugaccacaauuaaaaagccaaaaaauaauagauauuggcauggauguggugaaaaagaaacacuuuuacacugcuggugagaauguaaauuaguacaaccacuauggaaaacaguauggaaauucuuuaaagaacuaaaaguagaacuaccauucaauccaguaaugccacuacuggauaucuacccaaaggaaaagaagucauuauaugaaaaagacacaugugcacacauggucauaaacauguguguuuauaucagcaaugcaauucacaauugcaaagauauagaaucagccuaagugcccauuaaccaacaaguagauaaagaaaauaugguauauauacaccauggaguacuacugagccauaaaaaggaacaaaauaaugucuuuugcagcaacuuggauggagcuggaggccauuauucuaagugaaguaauucagaaauagaaaaccaaauaucguauguugucacucauaagugggagcuaaguuaugaggaugcaaaagcauaggaaugauauagaggacuuuggggguagggggaagguugggaauggggugaaggaugaaagaccacauauugaguacacuguauacugcucagcugacaggugcaccaaaaucccagaaauugccacuaaagaacuuaucuauguaaccaaaaaccacccauucccaaagaacuauuaacuuuuuuuuaauuuuuuaaaaaagauuaggccgggugcaguggcucacaccuguaaucucagcacuuuggaggaucaaggcaggggaucacuugaggucaagaguuugagacuagccuggccaacauggugaaaccccaucucuacuaaaaauacaaaaauuagccaggcaugguggcgugugccuguaaucccagcuacucaggagacugaagcacgagaaucacuugaaccuggaaggcggagguugcagugagcugagaacuccagccugggcaacagagugaaacugugucucaaaaaaaaaaaaaauugauggcuguaaggucccuaaacaaauuacauaauauauuaucauucuugacacagcuuuuugaaauuuacucauucacucuuuuuuggugcuaugugguuuuuaaaaauugugguaaaauauaccauuuuaaccauuuuagaauguacaguucuguggcauuagguacauucauaagugcauugugcaauccaccaccauucaucuccauaacuuuuucaucuuuccuaagcaaaaguuuguaucuaucaaauacuacuccccauuauccuuucccaagccccuggaaaccaccauucaauuuugggucuacaaaucugacuacucuacucuaagaaccuuauguaaaaagaaucauacaauauuugucuuuuuugugacuggcuuauuucacuuaacauaauaucuccaagguucauccauguuauggcauauaucaguacuccauucuuuuuguggucaaauaauauuccauuguacauauacaccauauuuuguuuauccacuuauccauugaacacuugaguugcuuccaccuuuuggcuauugugaauaaugcugcaaugaacaaggauguauaaauaucuuuccuaaucccugcuuuuacuucuuuuggacauauacacagaguggaguugcuggaucauaauuuuuuaauuguuuugaguauuaauucuagccauucuagccauauuuuguauccuuuuguuuguucuauauaacauugaaaguagaagaguuuucuauaauccagcagcacuuaucuaacacuuaucaauaaaagaccuaucagauauaaaaucacaagaauguguaacaaaaguagaccuguguauuuguuuaaacucuaaagcagauuaucaucuaaugaucaaaaagccauuaaaaaucaucuccaauguuaauagacaaaauucuccuggaaaaaaaaaaucuccacuauagagaugagaaauuuuccucuucugggucacaaauuaucaaggggaaagaguaaggaucacuuuucaaacugcacugacaaucacucaccagugagaaucuauagguucccccucuauaucuuuuuucccuuaagaaugagaaucauugccaccaaggcauuauuacuaaagggagugugcuguaccuuuggcuauguuggaagacaaaaccacugaaggugcuuaucuaaaaacaucuuccagcaaauauauauacaaaugugugcauaugcacacacauguguacauauauguauguaaaaucaaugaggauaaguaaaaugucuguaggucugcaucauaauugggaguaucaauaugaacccauaauauaguuuaccuuuaaauacuaaguauguauauuuccuaacucuauccaccacaacagugcagaagcaauaaccagcaggaguacugaacaccaccagcacccacacugugaucuucaaaugccauuucccacaaaaaaaaaaaaaaaaagaaccaagcuccuuaaagaaguggcugauuccaguucugggagaggaaauauaaaagaugaggcaggaacaucucauaauacgaagcaagaaagcuaacaaagacuacugaagcuaugucaaaaggguugaugaaccaacugggaaaagcucccuuggcuaaagauuguacaauauugacauuaacaaaaauaauaacuucagaugagugcaguggcacauguccauaaucccagcacuuugggaggccaagguagaaggacugcuugaggccaggaguucaagaccagccugggcaacauagcaagaccccaucucuaugaaaaaauauuucaaaaaguuaggcaugguagcagguaccaguggucccaacuacuugggaggcugaggcgggaggaucacuucagcccaggaggucaaggccacagugagcugugauuaugccacgguauucaagccugcgcaaaagagugugaccuugucucaaaaaauaaauauaaacaaauaauaacaauaauaucaauaaauugaaaggcaucacauauuuaaauccauuaguuuauuauaauaugaaaacaacaacuacuaauuugucaucuucaaaggaugcuagagaaccaacccugaauuuugaaaacagggaaacaacaaagcauuuauucugccuuucuccuaagaauauaucucuggguaaccuacuagcugauaaagggagauuucuuccuuuaaauguauuuccguuacauaauaaaaauuauaauauaaccauuuuaaucccuaauaaaucaguagcucucuagcacugccuagaucaucaauggcuacuguugccucaaaaagagagacaaccagggagcaugugccuccucacauaagaaugaaacacuagcuguaaaguuguacugccaaaaaaaucaaaccugaaccugaccaguccucuacaucuaacuacaaauuuacaguaaauguggacagaggaacacauuuacaagacacuguggggaugcaaugagcaaaauccagacugugggacguuaacaggacaaacaauccaaccuauucgacaaguaaguuagggagaagaucgguggggaggugagggagaagacagaaggaaaaaagagggagaaccuauuguuaaucuauuaacauauuuuuuaagccagaaaaauuugguguuacuaacacauuauuuugccacuguacucucaaguuaagccuaacugaaauguuugcuguaagaaugcuuuuaaaagccugaaaugaaguuacugcuuucaaauuauuauuugcaauuacugucauauaaacacaacagacagauauagaacaguuaagaauucagucuacagggucagauccaccagguccaaaucucagcucugacuuaguagcuguguaaacccaaguaacuaauuuaacuucuauaaccaucaguauccuuaucugcaaaaugaggcuaauugcacugaccugacaacauuguuuuggcgauuaaauaagauagcacacacaaauaauuuagcauagucauucaucaaauauguccaaugaauguaguuauuaguaguauuauaaauaauaaauauuucauaucagaauuuuaaaaauacaaaucugacuaaucacaaaauucccacucaaaaaguaaauauuauauuuaccacauuuaaacacacugagacccauuuaaggaaauaccacagaagauggaaaaaaguaauuuuaaauauacucagucaacuuucaaucuauguuaacugauaagagcaaacauuuaccaacuauaaaguaagagauuagaaaaucaaauuagcaauuauuacuacaaaguggcacuagccuuggagcggaagcuaucuguaaaauagacccaaauauaauaaauauuaaauagccccuugagcuuuuaggauuccauucauucaacaaacacaaguucuaucaggcacagaugaagaaauaaaggaagucuucuuugaucucaaguaacucauaaucuagugaaaaaaaaaaagacaaauuuuaaaaguguaagagagcacaguaagugcuuagaagaacauacagaguauuauaguuucacauaaaagacauuccuaagucuugggggugagaggaagguagguguaauugguuucaaggcccucuccccaaaaagugaagcaugaauucaauccugaaugagcaggaguuggcuaaaugaaaaacaugaggaaaaguguguugugcauaggcagaagggugagaaaguuguuguuagacaacuacuguuuucagguuccaguuagaaggaauaaguucugaagauauacuguacagcauggugacaagaguuaauaguaguguaccauauacuugaaaauugcaaacagagucuauuuuaaauguacucaucacuaaagagugauaaggauauaagaugauagauauguuaauuagcuugaauuaaucauaccacaauguauacauauaucaauacauccuguuauacacaauaaauauauaaaaguuuuauuugucaauuaaaaaauuaauuugggguagaaauauugacugccauaaaaaauauaaaauaaauguauauauaauuaaaaaauuaauuuuuuaauguauuguguuaaguugggaccugaaguaagaucagaucagggggcuuagcagggccagaaccuuauauaaacccuguuauucuucuuacaagugaugggagccacuaggaauuuuuaauuucuuuuuuuuuuuuuugagacagggucuugcucuguugcccaggcuggaguacaguggcgugaucucagcucacugcaaccucugccucacagacucaagugauucuuucaucucagccucccgaguagcugggaccacaggcaugcaccacuacgcccugcuaauauuuuuuuuuauuuuuaguagacacggggguuuaaccaauuuuggcaggcuggucucaaacuccuggccuaaagugauccacccaccucagccucccaaagugcuggaguuacaagcaagagccaccgcaccuggcgccacaaaaaauuucaagcaggacaaagacaagaucagauuugugauuugaaaauauuacucuaaagcagaaaaauggagaauagaaggagaagaaaccgggggagaccuggaacaagauaugaggcauacagaccaguaggaaugcucuuucaguaaugcacaugagaaacagagaaggcucaaauucaggcaauaaugguaggaauggugaugaagcaucuucuuccuucauuuccuauguuauuagaauucccuguugaaagccacaggaaaucagggccaacgauccuuacccuuuugcucacaggauaaauaaaaugucacccauuccaugcauucugcuagcuuagggacuauucuucaaacuuuucucuuaaaccaaccaaaaaaucaauuugauaucuuaguuauaagagaugaaaaaaucuaaaaagguauaaccgcauauaacaucuaucauuucuaucaacagucacaugcuugagacuuugacuucuuaggcagacacacacacacacuacaugaaauuuaaaaguuucauagaguucaugcuaauaaacaagaagccaaaaaauauucaaacacaucauuguaucugcuauugcuaauuauacacuggcuuccuuuaauuuacaaagacccccuuauuucacuguguguauauauaacaguauuuuccuuuuaggauuaaaguucuuauacuguauuuggucuuuagccaaaaguauuucauaucauauauguguguguguguguauauauauauaugauuuuuaagcauuucauaucacauauaugauuuuuuaaguauuucauaucauauuuuugacaugaaauacuuuuuaaaaauguaaacacaaacacacuuccaaauucaaacuugccacauaccucaaugaagaauagcaacucuggcagggcuuguaggauugugaaaauuuuuuaaacaguuuacaaacaauuaaaaauucacucuaguauaggaacaauauaaaaccuuuaucuuuaguuacaugaauugccugaaguacucuagauuuauuccagaauuacaacacuuuaucauuucugccuagcaacaaaaugaguaacuuaaaagcaagggaauuguucuaaucaaggacauaaccucccauaguagaaagcaguuuucccuaauuuuuuuuucuuguuagaauaaaauaaccaaagauagauauuuuaauacugaacugaaauaucuuuaaauacuuuuuccauggaguucacaguacuugaugauuucagucucauacgcaauuuuuuuaaaucaaaauauaauuagcacguucauuuauuccagauauugacuacuugcucuaugucuggaacagacuggaacagaguggacuauguacuggagauuaaaaacaugaauaaaauaugaucucugaucucaagaaagaaauguugaagucaagaaauacuaaaauaaagcauuacauaacacaugcaauaauuaaagguaagguaugaacaaauuaucuagguauaaacaagcagaaacaaccaacacagcagagcuucacagagaaagugacaccagcagagcugggccucagaauaggcuuuggccgcaguugauaagacaucagucuguaaagacaaucuaggcaggagaaacugcaugugcaaaaaagcacggcuaaaccucuaacaaacgcuuuagauuuuucucuuacacuuuagagaagguacauggcuuuaauuuuguaguuguaaaacaaauuucuuaguauaaauuaaaaccauauaacaugauuucuuucuccuuauccuuagccaagugaaauuuuaaacuuguauuuaaaaggugggcucagaguguuucauuuuuguuauuauuacuccauguaaaugugagaauuaaaaagggcacuaguauuuguuugguacuagucuguauaagaauaaacguaaauaaguaaacacaugaauuggacaauguacaauaggcaaauaauauauguauaaaggaauguaucacauagaacucauuucuuuacuaauaaaaucacagcauguaugccagaaaaugaauuaucuucacauuucauaaacauaagcgugcucaaaacugcuuaaauguagccuuuauguuuaugcacacauuagguacaaaguaguuuuauauacauagcaaucaccacaauggugaagacagucugaccacaauaggacacagcaaacaucaaagcaaaucucaggugcgggucgacuggaaauaaccucaacaucgcaaucucagagagcuucucacauuuagcaacaaggggucaaagucaaaaagaaucagcagcaucugcccugaccaucccucaacauggaaauaugccccucccuuuuuuuaacuaugccaugauauuuaaccuucaaacucuucucaucauuuccccugaagaguuguucccaacugugaggcaauauaagugugaauaguuuccucaucugcaaaauaaacugcaauuauaagacucuaagaaaaaugccuggcacaugguaaacacucaugaaaugggugaaacuguguccggaauugguggguucuuggucucacugacuucaagaaugaagccacggacccucgcggugaguguuacaguucuuaaaggcggcguguccggaguuuguuccuucugauguucagauguguucggaguuucuuccuucugguggguucauggucucgcuagcucaggagugaagcugcagaacuucgcggugaguguuacagcucauaaaggcaguguggacccaaagagugagcaguagcaagauuuauugcaaagagcgaaagaacaaaauuuccacaguguggaaggggaccccagcggguugccacugcugacucaggcagccugcuuuuuauucucuuaucuggccccacccacauccuauugauugguagagccaaguggucuguuuugacagggcgcugauuggugcguuuauaaucccugagcuagacacaaagguucuccauguccccaccagauuagcuagauacggaguguccacacaaagguucuccaaggccccaccagaguagcuagacacagagugucaauuggugcauucacaaacccugagcuagacacagggugcugacuggugugcuuacaaaccuugagcuagauacagagugccgauugguguauuuacaauccccgagcuagacauaaagguucuccacauccccaccagacuuaggagcccagcuggcuucacccaguggacccugcacuggggcugcagguggagcugccugccagucccgcgcccugugcccgcacuccccagcccuuggguggucgaugggaccggccgcgguggagcacggggcggcgcucaccggggaagcucggccgcacaggagcccacggagggggugggaggcucaggcauggcgggcugcaggucgcgagcccugccccacgggaaggcagcuaaggcccggugagaaauugagcgcagcgccaguggucuggcacugcugggggacccaguauacccuccgcagcugcuggccugggugcuaagccccucauugcccagggccagcagggcuggccggcugcuccgagugcggggcccgccaagcccacacccacccggaacuccagcuggcccgcaagcgccgcccgcagcccggguucccgcucgcgccucucccuccacaccucccugcaagcugagggagccagcucuggccuuggccagcccagaaaggggcucccacagugcaguggugggcugaagggcuccucaagugccgccaaagugggagcccaggcagaggaggugccgagagcgagcgagggcugcaagggcugccagcacgcugucaccucucaaaaccuucaacugauaacaguugauuacauaagaugugucaaucaccaacacaaugugugacagaaauugacauuuaacugauguugguuucuuauauugguuucuuuccuuccuuugggcuagcacacuagcauguauuaucuuguaacucaccuagcaaagaguuucacagaagaagcccgugguaaauccuaacuaacuaaaaggcuucuguaacuacuucugaauacucgccuaucucccaaugccacaugugguuaauaaguucuggcuuggccaguucaguuaccacacacuauaaaaauaauacccuaaauuuacaaaaauggcuuucuuaccaggagcuuaagccacuuuuaaacaacaguucauuacugacaaugacagggucaggcaaauauacaaccauauuuucagggaaauccaaggcuaagacuauggaccuuauaccaacaaagucaguaaaugguaaagcaaggacucaaacucagaaaguuuucccugaauuugaaauuuuuuuccagcccagaauguauuuccucaaaggacaaaaguacaaugauuuacaucaauuuuccaaauauucacucaguaaguauguaaucuauauacaguuguaauuaaacacuuguaaaaggaaaaaugucaaaucuuuucuuuauuaaucuguaccaauauauccuucucuguaaugucuaauucuaaauauuuugcuuuuuuagggagguuggcucuauauuaaguacaauuauuuuuaaaccuacuacaaauagaauuaaaauuguauacacaauuuaauguuuucauccuaugaccuuuuuauacuucuguuuauuuccuuucgccauuugcuuuuaauguacaaccaaugaauaaugguuuuuuuaaugcuuuauuuuuaaaaaugcaaucuuccaaaagcucagccagaaauguccauuucaaaaagcuuacuccagccaguuggcuuggucgaugacauaugugcaaagugaaaauguaacccauagugauuuucugcaggucagauggaauuacuuagcauacucaacaugguuuccaguccaugccucaagaggaauguccuucggcuagcaaguguuucuuuuaaacaucagacuggcuacuguuguuugaacgcuaguguuaucucagcaugguuagaauauaugugcaugcugagaauuauaaacauuauucuguaucaaaauauugaaauguauuuguauuaugaacauuauauggaguccacauaaaauuuaaguaaucagcagguaguguuugaggagcuaaacauguuuaauguuagucauuucuuccauuuucaaaguugcuuuaagcucaaaacacuucguagauauaauuauggcucaugugagcagaaaugcugaaugucaaaaaaacuuuaguguuaauaaaaauuagaaacugcaaauaaucuuaaauuaugcuauagcaaaugauuaauaauacacaaccuguuuagcaaaaccaaaaaauaccauaaauacaucaacauaugagaaaauuucaucuaauuuucuuauaucaaauuucaauauauauauuuauuuaaauacauuuaaauauauuuuaaaauauaaauuucaauaaaaagaaagugucaaauuucaccaaauauauuccuugcucuucuauagguuguauuuuuaguugguuaauuuuuuuuguuuuuggagacggagucucgcucugucacccaggcuggagugcaauggugcaaucucagcucacugcaaccuccaccucccggguucaaaccauucuccugccucagccuccugaguagcugggauuacaggugugcgccaccaccccggcucauuuuuuuuguauuuuuaguagagauggguuucaccauguuggccaggcuggucucaaacuccugaccucgugauccacccgccucggccucccaaaguauugggauuacaagcaugagccaccacgcccggcugguuaacuuuuucuuuuaagguaaucccaauuuuacaaaacaaugaauuuuuugaaaggcaauuuggcccauccaagagacuccuucauaccauaucaauaggcuaagaaaacacaaguauuuacagcaucaaauaaggucaagauucucccacaaacuaugacuaugugacaaagccaaccacuguaaacuuuugcuaauacuauaacugauuuucaaugaguuuauuaccugauugccuuuauacuucccguagauuucuuuuuuuaaaagaucaggaaauguuuucacaauuaaaaggcaauucuuuuuuagcccacugguuuguuaccuugauuggaauauaguaccuauccuuuuuuguauggaaaagaauuacuuuucuuugugcagacacacuaaucccuuuccuuggcaaacagaaaacaaaguucggcuuguuuuuuugaaggauaggacugaggccuagguuugggaacaaaaaaaauugugugucaaccaagaguaaagaauuucugcuacuaauggaagaaccauucuauuuuuaaagacaguguuuagaagggaguuagccuuauuaaaagcagaaguagaaaugucauuacacuagccaaaagaauaguauguacauuaugacauuguauauuuaacaagaacacagaaagcccaguggccuagugucagaaauaugcauugccuuguaagggaucagaguucaaggucauuaaacaaagccuuugauccucaaauggccaagcauaaggaaacuaguaacaaugaacuacagauggcaauaacaacccuuccccugcugaauggaaucagcauucagacuucucuuuuagguuaguuuccuaaacaugauauuuguaagacaaaagaaaauucaagaaaaguggcagaguaaaaaucuaaguacaaaaaaucuuagacauauuuuuacauguuuaaucuaaucauaaaauuauucuagagcuucuccucuuucagcuucucugucaucaugagaucuacuuuuuuagcucccgcauguaagggagaauauguaauauuuguccuucagugcuuggcuuauuucacuuaaaacaaggacucccaguuccauucaaauagcugcaaaugccgggauuucauuuuuauggcugaauaauauuccugugugugugugugucucugugugucugugugugucuaugugugugugugcauuucugcccagaccaaucucccaaaauguuucuccaguguuuucuuuuaguaguuucauaguuucaggucuuaaucuauuuucaggucuuaauuaaguucuuaauccauuuugauuugaauaucauauauugcaagagacaggagucuaguuucauucuucugcauauuguuacucaauuuucccagcagcauuuauugaagagacuguuuccucauuguauauucuuggcaucuuugucaaaaaugaguugacaguaaacauacagauuuauaucuggguuucuauacucuguuccacuggucuaugugucuguuuuuuaugccaguacuaugcugauuuguauacuauagcuuugucauauauuuugaagucaaguagugcgaugccuccagcuguguucuuuucuuuucugagacggagucucgcucuguugcccaggcuggagugcaguggcacugcacucagcucacugcaagcucugccucucggguucacaccauucuccugccucagccucccgaguagcugggacuacagguacccgccaccaugcccagcuaauuuuuuguauuuuuaguagagacaggguuucaccauguuagccaggauggccucgaucuccugaccucgugaucgcccgccuuggccucccaaagugcugggauuacaggcgugagccacugcgccaggcccagcuguguucuuuuuauuagggaugcuuuggcuauuuggagucuuuuguaguuccauauaaauuuuguuuuuucuaucuccacgaagaauaauaucaguauuuugacagggauugaacuaaguuuauagacugcuuugagugguauugauauuuuagcaauguuauccccaucuauaagcauggaauaucuuucuguuuuguguguguggccucuuuaauuuuucucaucaguguuuuauaguuuucauuguaaagaucuuucauuuauuugguuaaauuaagucuuaggagggcagagcaagauggcagauuagaagccuacaggcaggcuucauccuccuggcaggaacaccaaauuuuaacaccuaucugcccaugaaaaaggacugacacaaaaucagaugagcaagcaaaguaguaguuuuaacuccauaucacugaaguuuaacuaguuuuaacuucauaucacaguauaaccaaaaaucagaugaccaacuacaguaacuucaugucacugaagagggucggagacacagucuugaaucacagaugccuccccucccucauaccccaguguagagucugugcacuucauggagggacagcacagugacuugaggacuuuacauugaacucagugcugcccugauauaacagagaguaaagccauggugggcuaagccagcacucaugcaaggagggagcaccuggaccagacguagccagaggggaaucgcccaucccaaugguaggaacuugaauuucucaacaggccucgccaucaugaaccaaagugcucucggauccuagguacacaugaaaagcaguuuaggacacagguaugcaauuccuaggcaacuccuagugcuaagcuggguucagagccagaggacuagaguggcacuugagcuagggagacacaauccgggguggcuaggggaguggcugugucaccccuaccccaacccuagacagugcagcuuacagcaaugaaagugacuccauccucugcuuaaggagaagagaacgaggaguaaagagaacuuugucuugcauccuggauaccaccuuagccacugcaggauagggcaccaggcagugucaugaggcccccauuccaggaccuagcucccaaaugacauuucuagacacacccuggaccaaaaggcaaccuacugccuugaaaggaaagauccagucuuagcaggauucauuacaugcugauaaaagagccccugagcccugaauaaccggcagcaauacccagguaguacacagugugcccugggcucugagacaugcuaaugacacaugugacccagcacauucccagcugugguggcuaugcugaaacacucuuucuguuugagaaaugcagagggaaaaguaaaagagacuuugccuugcaccuuagguaccagcuuggccacacugagguagagcaacaagcaggcuccuggggucuccaaguccaggcuuaggcucuuggacacuauuucuggaccugcccugggccagaugggagcccacugcccugaagggugagucccaggccuggcagcauuuaccacagcugucugaagagaccuuggacuuuaagugaacauggucaguggccugccagaacacuucugugggccagugguaguggugcccacaggaagaggcuccucuaccuguggaaagaugggggaagagcaggaaggacuuugucuugugguuugagugccagcuuagccgcaguagaauugaacaucaggcaaauuucuaaaaucucugucccugccugggaccugggggcucuugccauccugaagggaagggcacaaaccuggcuggcaucagcaccugcugaucggagaacucuagggccuugagugaacauaggagguagccagguagugguuacagcaggccuugggugacacccaguacuacacuggcuucagggcugacccaacacaguccccaguguugguggccacaagacugcuugcaucaccaaaugccuaguuccagguggcucagcacagagagagagagacuacguucaauugagagaaaguaagggaaaagaauaugagucucugccucguauuccagagaauuccuccagauauuaucgaaggcuaccaaggccguaccucuaccagccugcagaaaccacagcgauauugugcuuggagcugaagucccucugaauaccugaaagccuucucaaggacaggcacaaacaagcccagacugcaaagacuacaauaaauaccuaacucuucaaugcccagacacugacaaacaucuacaagcauuaagaccauccaggaaaacaagaucucaccaaacaaacuaaauaaggcaccaggaccaaucccagagaaacagagacagagaauucaaaacagauguguugaggaaauucaaagaaauucaacauaacacagagaaggaauucagaauccgaucagauaaauguaacaaagagauugacauaauuaaaaagaaucaagcagaaauucuggaguugaaaaauacaacugaaauacuaaagagugcaucagagucucuuaauaguagaauugaucaaacagaagaaagaauuagugagcuugaagauagccuauuugaaaauacauggucaaaggaaacaaaauaauaaaaugaagcaugucuacaagaucuaaaaaauagccucaaaggggcaaaucuaagagguauuugccuugaugaggagguagagaggggugguagaaacguuaugcaaagagauaauaacagagaacuucccaaaccuagagaaauauaucaacauucaaguacaagaagguuacagaacacuaagcugauuuaaccuaauuaagacuuucucaaggcaucuaauaaucaaacuccugaaggucaacgauacagaaaaaaucguaaaagcagcaaaagaaaagaaacaaauaauauacaguggagcucuaauacauguggcaacagacuuuucaguggaaacuuacaggccaggagagaguagcauaaaauauuuaaaguguugaaggaaagaaaaacccuuacccuucaauagugugucuggcaaaaauauccuuuaagcaugaaggagaaacaaaagaugagagauuuccucaacaccagaacuguccuacaagaaaugcuaaagaaguucuucaaucuggaagaaaaggauguuaaugagaaagaauaaaucaccugaagguacaaaacacauuggcaauaguaaggacacagaaauauuacaaaaccauagucaugauggguaaacuacucuuacauuaaguagaaagacuaaaugaugaaccaaucaaaaauaauaauuacaaaaaauuuucaagacauaguacaauaagacauaaagagaaacaacaaaaguuaaaaagcagggggauaauaacaaucaaaaauaaacaaaaaaaagcaggggaaugaaguuaaaguguagaguuuucuuuugcauguuuguuuuuuguucaugcaaucaggguuauacugucaucaauuuaaaauaauggguaauaagacagucuuugcaagccucacaggaacuucaaaucaaaaacauacaagagauacacacacacaaaaaagcaagaaauuaaaacauaccaccacagaaagucaccuucauuaaaaggaagacaggaaggaagagaagaccacacaacaaccagaaaaaaauaacaaaauggcaggaguaaguccuuacauaucaauaauaacauuaaauguaaauggacuaaacucuccaauuaaaacacagaguggcugaaugcaugaaaaaacaagacacgaugaucuguugccuacaagaaacacacuucaccuaaaaagauacacauagaaugaaaucaaagggauagaaaaagagauuccaugcaaauggaaaucaaaagaagagccagaguagcuacacuuauauaaaacaaaagauaauucaagacaaaaacuguaauaagagacaaagaaggucaucauacaaugauacaggagucaauccagcaacaggguauaaugaucuauacacucaacacuggagcacccagauauauaaaacaaauaucacuagagcuggcugggcucgguggcucaugccuguaaucccagcacuuugggagaccgaggcagaggaguucaagaccagccugaucaacauggugaaaccacgucucuacuaaaaauacaaaaaauaagccaggcaugguggcgcacaccuguaaucccagccacucaggaugcugaggcaggagaauucgcuugaacccgggaggcgagguugcagugagccaagacugugccacugaacuccagccugggugacagugcgagacucugucucaaaaaagaaaaaaauacauaucacuagagcuaaaaagacagaacucaacacaauaguagcuagaaaugucaacaccccacuuucagcauuggacagaucuccuagacaggaacucaacaagaaauauuggauuuaaucugcacuauagaccaaauggagacauuuacaaaacaucucauccaaaggcugcagaauauacauucuucuccucagcauauggaucauucucaaggacagaccauauguuaggucacaaaaugauucuuuaaacauucaaaaaacuugaaauaauaucaagcaucuccucuaaccauaauggaauaaaauaacaaauuaacaacaagaugaauuuuggaaacuauacaaauacauggaaauuaaacaauaugcuccugaaugaucagugugucacugaagaaauuaagaaggaaauugaaaaaguucuugaaacaaaugaaaauggaaacauaauguaccgaaaccuaugaaauacagugaaagcaguacuaaaaggaaauuuuauagcuauaagugccuacaucaaaaaagaauaaaaacugcaaacaaacaaccuaaucaugcaucuuaaagugcgagaaaagcaagagcaaaccaaaccaaaaaucaguagaagaaaagaaauaauaaagauuagagcagauauaaaugaauuugaaauuaacaaaacaguagaaaggaucaaugacacaaaaaguugguuuuuuaaaaagauaaaauugacaaaccuuuagccagacuaaguaauaaaaaaagagaaaagaccuaaauaaauaaaaucagagaggaaaaaggagacuuuacaacagacaaugcauaaauuaaaaggauccuuaggagguacuaugagcaacuauaugccaauaaauuggaaaaccuagaagaaauggauaaauuccuagacacauacaaccuaccaacauugaacugugacaaaugcugcugagaaaguggagaaaagggaaccuucuaacacuauugaugggaauaauuaguacaaucacugugaagaacagugaggaaguuccacaaaaaaucaaaaauagagcuaccauaugacccagcaaucccacucccaguuacacacccaaaagaacgaaaaucaguauaucaaagagauaucugcacuccuauguuucuugcagcacuguucacaauagccaagauuuagaagcaaccuaagcuuccaucaacagacaaauggauaaagaaaaugugguuacauauauacaauggaauacuauucagccauaaaaagaaugagauccugucauuugcaacaacaugaauguaacugaaggucauuauguuaggugaaauaagccagucacagaaagacaaacuucacauguucucacuuauuuguggaggcuaaaaauuaaaacaauuaaacucacggagauaaagaaagaugauuaccaaagucugagaaggguaguugggggauggggagguagaaauggcuaaauguacaaaaaaauagaaagaauaaauaagaucuaauauuugauagcauaauaggaugacuauagucaguaauaauuuaauuguacauuuuuaaauaacuaaaagagucuaauuggaucguuuguaauacaaaggauaaaugcuugaggugaggauacuccauuuacccugaugugauuaugcauuguaugcauauaucaaaauaucucauguaccccauaaauauauauccuacuaugugcccacaaaaauuaaaaauuaaaaaaaaaaacagaauuuuccugaauucagaaaauaauaguggucacccacuucccccuacccuccuagaaaaaacauaaaaccacacugaauccauacuuucugcauuacuaggagaaagaacauuugcugccuucaccauauguagaagaaaaaagaaacaaauuccauggcacuucuaccaucagcccacugcuacuaccacaaacuucaggguauugaaagugaggaaagaaaggcuuauaagauucugugaaaaagaacagaagaaagcaaaggacuuauggaaggcacagacccaaccaccccagaaggaaaaggugaaacaauaaaugcaaaaauucucaacauggguuggaucuacaaguucaaagcucuggcuacagagaaggaauuugaaagggugcagcacuggaaguagcagccucugggaacacgaauacuuagaggaauuugcuagaaaaagaaaacagagacagagguuuguuuaucauagggaaauggucaaaaucaauucugcagcuacuuuagauguauuauagacaugagcaaaugaauauguggcuugauguugagagccagauauucacuuagaagaaacauauaaauacugaauaggggauggcaaaaaagaauuauguaggaaugaacugaaguuggauauaaugguaggaaugcaugacuuuuaaguuauuucuaugggcugggcaugguggcucacaacuguaaucccagcacuuugggaggccaaggcggguggaucaccugaggucaggaguucaagaccagccuggccaacauggugaaaccccaucucuacuaaaaauacaaaaaauaagccaggcaugguggcgcacaccuauaaucccagcuacccaggaggcugaggcaggagaaucgcuugaacccaggagguagagguuucagugagcagagaucacgccauugcacuccagccugggugacagcacaagacucuaucucaaaaaaaaaaaguuauaucuauauguaaguguacacauuuaugugcacaugugcauauauguauauguuuauguacagauauguauauauguauauacaugcacauauuuucuagcacugucccugaaaggggcuaaaaguaaagauaccauaguaacaggaucacaccuagcaucuauaucuuggucucuaauacuauauagauggcugcagcaggauagguaucagauuagccuggaacaucuuacuaugcuagaaaguaaagaaaugcuaacaaaaaaaaaaaaaagaagacaugucacaaggacacaggagccagcuuaaagaggcucccacuggccaaaucugggacaauuuaagcaucaaaauuauuagguucaguauugaauuaaaacuaacagaaaaaaauugaaauucaugaauccacauaauaagcagacaaauaaauaggggagaagaaagaucuacugcuuacaguagaagauugagaaccaacugacaaaugugaaggaagugccaauuuggaaaucaucauuuugcaacuaccacaguaaagauuauugcaggcaagaauugcuaauggguuaucaauucaagggggaauguugaugaaaagcaaaauauuuacauuuccuuauuaguugcaaggcauaaaacaccaguaauuaguaauuacacaguggagaauucagguaacaagcuuaaccagaagaucaaaauuaaucauuaaugaggaugcuucuaugugauaauauaggaagaaugcaauaucaccuauucuugacaggauuuuggacaacaauguauaaucuugauuuaaucacagggaaguaagagacaaaaugagaaaaaaaauuuaaugguaugggagacuauauucuucaaaaaugucaaugucauaaaagacaaagaaaauuggaggaaauuuuccaaauuaaaagaggcuaaaagacaugauaauuuaaugcaaugccuaucccuagccuagauucuguaauaguuaggauggaaauguaaucauugagaugggaaauaaugugcuacagggcacauuauuauauuauauuauuagaccaauugacaaaauuagaauuuggaugauacaguagauaaaaauguuauauaucaauguaauuuugggaaacugauaacuguacugugguuauauaagaauauuucuauucuugagaaauacauacuuucuuucacacuguucagggaaaaauguacacacaugagagagagagggagagaaggagacagagcaagugagagcaagggacaggaaaaaacauaaagcaaauaagguaaaaauauuaacaauaggcaaaccuggguaaagggauaaaguuacgucuuauuuuuaaccucagagaaaaagaaaggaaauauaauaaugucuuagcuaucaguaacaacuagugucauaauaauguaaauuuuuaugucuauuacagaaaaggccaagcugcuauaacaaagauaucccaaaauacaauggcuuaaauuagauaguuuauacuuacuuuacuaacuauaaagacaguuucuucucuuaaccauucccacacuucuauaaguaaccccuugcuuuaaaaucccuucauuugaaucaucugccaugaaucuauuuccugcugggucauuaacugauacaguacuuggggauuugcagagauuuggggacugguuugcucacacauauuugaugaaugcgcagaugaccucccugccaggggaaaaaaaugaaacaacaaaauauaggacaugcaaugaaaucacaauuauuaaaaugaucacugcugcaaugugggauggagugccagugaaggacaaagcuuugagauaggugacuacuggacuuaauuuuugauaacaauaaucauuauaaagauggcugagugggcuaucugcuuuaauuaaauacuuacaaaauaaaaaagauugagacuuccaacugucaaaucaagacagugacuacaugaccagagauguccaucaaaaaaugggcuacuugaucuacugagucaugaaauuggguaugugaagaucaauuuaaucuauuugauuaaauagaaaucaaauauaugaacaggaaaauaagacauaaauuuaaugagcacuaguggcucaaacuccuauaguaucuacccuugcugcuucacugccucuuucaugccucaugaggaguuccccauaaccaaugaacagaagaaaaaaauacacagaccugguuuacagauggguuugcaugauauccuuguaccugaagucagcuaaaguaucgguuucccacuuagggguauccuuaaaaaacaguuacaaaaagaaauuuuccaguagauguaaauuugaacaauauaucugguggucaguuuacugggaauggaagaugaccugggauuuagauuuauacugauaggugggcaauagcuaauggguugggauuaaguaauuagaaagaacaaaacugaaauacugguuaaaaaggaggucuagagagggagguauauggaaggauuucucauaaugaacaagcacugugaaaacacuggagaauaugguucccaggaaaagaaagcuuccaccaaggaauacagccaugguucuacuaaauuugaagcagagaauucucuggucgagacuccaccacauaggggugauaagcagagaagaagguuaguguacuaaagaaugauugauccuuauuucuaagaggaaacuagauggcugcuuugcaauaaaaacagguaggcuaugucuaaaauccaagggauucauugggcugccucuuagcacaauguuccuaucugauaaaaucgaugggaaacuacaguaacccaguaaagacaggcccacuaaagacuuaaauccuuuuggguauaaaaguaaagaauugugaccaaccaaaguacuggaaaaacuaagaggaacaugaaaugaguaguggagagaggaaguuaugauuaucaaugucagccucuugacuagcuacaaugguggagacuguuacagcuaaguauauuuuauacuagucaauuauuucucccaauacaccucuuuuccugcuaucuuguaugaggguaguagugauggcuacaugcaacuuugguuucaaaugggaauauggcugaaauauuaccccaugacaauaagguaacugauuggacuucgugucucaucuguuugggggugagagguuuucaucugaaugaagaguaggaggaaggaccuuucuccauggcccucucucuuaauaagcccucaaaauaauaucauuuccuccuccugucccuucaccuuagaagugauaacagcuuccacugcugauaaucugugugcuucauuauuuguucccuuaacccugcccacacuucuaucagugaucccuucacuaaaauaacuuuuuuuuuuuuuuugagauggagucuggcuccgucacccaggcuggagugcagugguguuaucucgacucacugcaaccucugccucccagguucaagugauucuccuaccucaaccucccaaguagcugggauuacagguacucgccaccaccaccaccggcuaauuuuuguauuuuuguagagacgggguuucaacauguuggccacacuggucucgaacuccugaccucaggugauccaccugccuuuggccucccaaagugcugggauuacaggcgugagccaccaugcccggccuaaaauaucuuuuaaucauccaagauauguuguauuuccugcuaggaugcugacugacacaaacguacauguggaaauuagaaaaguaguguucguucuggccgggcgugguggcucacgacuguaaucccagcacuuugggaggccgaggcgggcggauuaccugaggucaggaguuugagaccagccuggccaauauggugaaaccccgucucuacuaaaaauacaaaaauuagacgggcguggugucacacgccuguaaucccagcuauucgggaggcugaggcaggagaauugcuugagcccgggaggcggagguugcagugagccaagaucauggcacugcacuccagccugggugacagagcaagacucugucucaagaaaaaaaaagaaaagaaaaguaguguuccaauaucguaaaaauaaauaaauaaggaugguuaauuucuaauacuuguuacaugcaaccuacagagcagcauuuaucauaccauagucugcugaacuccuguggcuccuauaugagaauuaucuaggguacauuaaaaaugcacauuccugagcuguaccccaaacuucucaaaucugaauuucuggaagugaggccucagaaacaacacuuuuaguaagcccagaaaagucucuguacacuaaaauguaagaaccacuguucuagagagcaggguucucaaagugugguuccccacgccaguaguauuggcaucaccuggaaaccuguuagaaaugcuaacucuggggccucaugccacuccuacugaaucagaaacucugagaauggggcccagcaaucuguguuucaauaagccucccaggugauucugguagacacuaaaguuugagaaccacuauuguagaguuuugucucuucucucuauagcaaacguguaguuuuuaucagccagcauguauucccaaauucugugugauucaaauaagacuaacuaccuuaccaaccccuaccaccuaccaagcagcugaggacuuaaccaagaugugggcccacagaguauaccauccucugacacuaguggugggcuccagaauuagcauaugacccaagcugggccacuuggagcccuuggcaaauccuuguuggucagaguuauugggggagccccuuguuuuccacuggaguuacuaagcuggagguugacaauggguaagggaaaccaagcaugggacugaguacuuuauagacauuaucucagaugcugauucuuucuccagguaaguuaaguuuuggaugauaacaggagagccauguugauaugguuuggacuuguguucccccccaccacaaaucucauguugaauuguaauccccaauguuggaggaggugccuggugggagguaacuggaucaugggggcagaccucccccuugcugcuuucaugaaaaugagugaguucucaugagaucugguuguuuaaaaguguguacagcaccucucccuucucucucauccuccuuauccaaccauguaagacgugccugcuuccccuucacccucaacuaugacuguaaguuuccugaggccuacccagccaugcuuccuguacccugcagaacccugagccaauuaaaccucuuuucuuuauaaauuacccaaucuuggguaguucuuuauagcaaugugagaauggacuaacacacauguauaauaguaaauggcucauauucugucacaagauaaaccaggcuuccuaacuggagauagaaaauuggagccugagauuauuaacaucucuaacaaacacugguuaaaaugcucauauagaagaaguucaugggcaagcacaguuuuuaucuccucuucuuccaaaaauaauacuagaaugauaauaauccuagcaucugccaaaguuaagaaugcccccauucucugagcaaaaccaauacuauugacagcaaugaaaaugaaauuguaggaaauugagacagagcccuaucgaacauugccacucuccuuauaauucccaauuauuaugccaaguucucauauauuacucacccugaugccuaccacauacccaaaugugggauuacucaacugucugaacauucacugggucccagaagugaaauaacucacucaacuauggaggcagacaaccaagcuuuucauccaucacuuacagccgagcuucuguaaucaugaccuggcaaccauucugacccccuuuccuuuuucacacaggacagaaaauaagagccuuuggagaaagccaaucacauauucuuuuaccugacuagugacucugggacaaguuuuucucuaauauuuucuagaaacauuacaucaaaagagcagacacgacuuccugcuuuaagguggugaauuaaagacucuauguccccuucucucaaauaaaaaaaaaaugcccccaaacaacaaggauaaaagaaacaaacaugagcuucuucaaagaaaucagaccugugguaagccuacccacaaucugugaaaauggaaagugaacaagaagagguaaaugauaccgaagaguagagugaggucaacuuugaaugcuuagagagaaauauacugauucaccccacagaauucugaaaagucucgggaaguaaaagcacuagguaccacagaaagugggaugacguaggaucugaaaacagaggagcuguuuaaaagucuauggaauuugugcucgcuuuggcagcacauauacuaaaauuggaauaauaacggaaagaaaaaaaaauuaacaauaaaaauaaaaagucuauggaaauaaacagauacccaggauccuuccuccauaggaaacagaaagcacauauucugaagagggugaacuaaacaaggaacuccagauuagggggacaccaggcauagaagagcaugggaauggggcagacaccugaaaauacaugaagaaaaagucuucauccugauagucaacccaaaaccuccuuccccacccagguccagaauacauuaugcccaugguccccaaauaggagugaaaaaaaccucuagaguaagaaaacaaccucaggagaaaagacauacaacuacugcuauuugaguccccaauaaaacagccaguuauccccuaacuguccuaaaguaaaaguaaagcccaccaguugacaaacccaggccccugucuccagggacauacagcuuacagucagccuuuauuguauggcugucaaauagaaauugauagccaauaaagcuaagccagcuguucaaaaauccaacccacuuucacagugcucaauuuuucuacugauucauccucaaauaaaaacugaugaccagaaaugugaggaaaaccugcuauaagaaaagcccaagaaaaacaaaagagcaaaacaaaauuacuccagaacaaaaugagaucauuaaaaggaagaaaauuggguguugggggggauuccuugucucuagauaacaggaaggucuccaggaacuagaaaaaaacugacagauucaauaauaugagugaaagccaggaaaaccuucaggaauuguaaggcaauauaaauaaauauguguguuuuaaaaauccacuaagaucauuuuccuuugaguagcacaggacauuggauucauaaaaggacacuggacuucugugaucuuaguacucuacaaugaguaauauuuacauaauucaaacaaaguauguguuuaacuuuuagaaucaugagaagucauggaagauuuaaguuauaguuacagaccagcauguaaacauuaucaacuuggacaauguaagaauaaagguagagcggauagagguugagagacuuaaaucagagagaaauaacaguaaugauaaagauagccaaugucuucauuuuauaaaauguagaaucaaggagcugaaaguugguagaacaagaaauagaaauuaaguauacuguuugaacgugcacaggugaccagcaacagaaaugaaaacagugauauaauuggaaggaggauaagaaaaaggaagugucaauaaucaaaacuucuaccacugugguacaucaaaaucuaaauaggauaaauccaaaaauagggugugaucacacaaucuagagauaaggagugaaccaucagaaaaaauaaaggcaucagugacucauauuagagaguagggagaauaauggggagagugaggccuucauaugcuuuguacuauuugacuuuuuauuuuuaucaaauuaacuacacaugguuaaaaguuauuuugaauguuucugggcucuugcaaggcuuaaaauaaaugguuuauuuuuaaauguauaacaauauacuguaucuugcuaacauacuucuaacaucccucuccuucuaagaucucguugccuaaaaacuucauccuuauuuuucuagcagcccugcagcgaauugaaccauauuuaaagagucuuuuuaaauuaucccaccuucauuuaaaauugccaguaaaugugugugguguauaaucauuuuuaaguuuugaagugagaggaggaggaaaggagacugaguaaguauaacauuaaaaaaaaaauagauugcugaaaagccaaaaaguugaggacugacuucuacacuucuagcuugcuucaauaacugugcgauaaauacaaagagcucaacuauuccauaauaagcccuauauaaauccuaaaacucuaccaugauauauuagccuuuaaaagccagaaaaacauagcuauugccaguuaaucuugaaacugggggaaauuuacaggaaauauguuucaggcauauuagaggucccuaauuuuagugucuucauuaacugaguaacccauuaggcccaauaccuacuaaccuacaucauuugucaaacuuacauuuauuccaguauaauuaauacaaacugauuccccaacagauaaucuauucuaaauauugacaucaaaacaauaugguuuucaggaaguugggcaagagaagcaaagaaagaauaagggaugaaugauggagccaauuucccaaguuuaaaaagaauuugucgccaucuuucaaaaagaaaagaaccauugauuggguucccaaauuauauuauguguugaucaauucaagaauagccuaauacugcugagaaaaccacagaauaacagaauuuugaauaaucuuucauugaaaggcaaaaguuaaacaucauauuccuuuagagaacuagcaacaguagacauauuaauagugcuaggcacuguuccuaauauaucaggacccacauuaaaaccacugcugaagucuagaaauggucauaacaaaucuuucaaccuuacagcauaaaagucaguugauaauuucuuugucuaacaccuaauaaaauucauucuuccaaaauuguggaaaagcuaagcacaguccucccuuauuauaaaguuuccuguuacaagguugcaugguuuacacauauguuauacuuuauuauugaaaaaaaguccuccuuauaacacccucuuuguuguaauacucaacauacuuugccuccgggcuagauauauaaugaaagcaaaaugaauucagacagauuguugaggaaaaaaagcuaguuucuuuuuaguauucuuucuaaagucuuuuuucuuuccuuguagcuuaucaucaucucaacauuuuguuucuacuuaacauuuuccuuuucuuuuuacauaguucccuugguaaaugaaagaugauagauuguuaaaaacaguuuguaccaccuuggaaacaugcacuuuuaauauacaaauccugccuuccaaaaccuuauauaaauuucaucuuuaggacaaugaacuauauaggacuuaaucaaccagcugaaaaaagccauaugaaaucuuaauuuuccacucacacauuuuauguucacagucuccuaaaaucaugauauaacuuuccaaauuaaauuuaggauuacaucucaguuauuguuuccauauuaaauaguacugucuuauuuuagcaaagaucuagaaaugcugauuuaaaagguucauguucgcaaauuucaauaaaagaaaauuugauuuuaaaauccagcucacuuuuaacuuagguagaaacauaauugaaauaguaauauaauauaggugaacuuguucugaugccaagcuuuaccauuucugauauucuaaguuagccagaagugacugaaauuauguacaauaugaaauacugaagauacaaauuuaguaucuuugaagguugagguaaacacauauaauaugauucuucuacaaaaagcaugccuaccaauauuagaacucuauucucaauauucuugggugucauaaaauuuuauaacaguaaaaaagauugggaauuuuuuaacaguauaauuuaaaaaucauuuuacacuuguaugauacuuauauuuuuguauuguccacauaaauaauuauauaaagaucuuaauagcuuuauucauauuggccaaaaacugaaaacuacucaaaaguccaucaaaaaaaccuccuuaaauuuuauauaucuaguauauccuauaaucagaguaccaguguacuuuaaaaauauauuugacaugcuaguagucaacacaagcaguugcuuuucauauuaagcauuaauauguaucuuuauuuugugcuacagaauuuaaaccucaaagcaaguuuccauguagagacuggaaaaggguggcugaaucaacuuaauuuaagagagacccgggggaagggcagauuguucauuucucauggcaauguguuguguagaugcauuuuugaaacugcuggaagccuuuauauugcagugucacuugaauaaaguaguucaugguagccauuuuccuucucaauugaguaggauauuuaacagcuucauuacuccacuguuuaaaaagagaccacgaugaacuauauauauggaucaaaaaugguugucaaauccuaucaagaccaccacauuuaaccaucuugucaaaggcagugcugaccacaagcaucaccuuaaagcuuuuccagucuuggcauuuagcuaccaugaaagaaauuauuuuuuuuuucaaacaacacuaagaaaccucaaauuuuuuuagucuuucccucucuuagcaauagcaggcaaggagguauuuaaccaaauuuugauaguguauguauaacgggaaucagaacucaccuuuuagaaaaaguaacaacuuuaaaugaucauguaaaaaaccaaucugcagacuacugggaacucucuuuauaaccuucccccaggaacuaaggguuuuaugcaacauaacauacaggaaaucacuauuugaaaguaacauuauuuuauaggucuuggaccagagauuuuauaaaugaaugccauguauaugagaaaacucagcacaggaugagagucaauccuauuauccccuugaucuuccgacuucucacuguggauccauaaaggaucuuaaaaacaaaugagggaaguucuccaauauaauaaaacaccuacacuuuaaugccuaggcaaggaacgggagccaguacaccacagagauucuucucuaacauuacgcucuaacauuucaaccacauguaugagaaaauaagggccauaugguucacuggugagacaagggcuaucaaaacauuauccauugauucccugugaggaaaacagcguuaaucuuuuauuagcacuaacacccccacacaaaaaaagcaaggcuguguucuggcuguucauucaccccagcugagcauaucaguucacucucuggauggcaaucaaagaaaccagacagcuuugggaagcacagccucucagcaaccacauguggccacuaauacauuuucuuggcagauaagaaaaaggcuccaguucagacaauuagaaguuauuugaaggcugaggaucugauuaucuaggauugucucaagauguagcaaaaccucagagugggaaggaugcuuuuuuuuuaauuuuuuaaaauaaaaauuaaaaagauguggcaaaaggugacugacuuauccuucaguucacuauuuucuuuggcaggacuuuuauuccaaagaauucaugaauuuuuauuuaugugacaauauaaucccauacaagcuuauagaagucauuuuaugauuuaaaaaauauuccacuaugcucauauauauuauugauaaaaauccauucacuuccuuuacuaacaauuauaguccaaacauacugaaccuuuuauauacaguauuuuuuuccaccucagucacaaacgugagacuacugugcugucagaccuuauaaucuauaccaugccgauauuauaucuagacucugacauuaaauuuuccuugguaaaaauucuacuuuucugaacuuccauuuggcugaaaaaacaaucaaaguagaaaaauuggaagaauuaaaggaaaaugaauuuucacaggacacagagagaaaaguguuacagaugaaaagaugugucuuuuacacuaaauauuagagaauuuaaguaauuuuuuaaaacaaaaacauuuugauuuguggacauuaucacaaauacucgauaguucugaauaccacauuccaagcuaaaaaguaggaagaguaaucuauagaaacacaguugcaauuagauaagacaguguauuucuacuagauaacuuacauacaauaugcugcaucaccagcauauugagaaauaaugugacuaagggugaacccaggaggcccaaguuacucacccucacuuuaccacuaugggagacagugaccacaauaacccaugccuuguaauagauacuuuaacauguuuguuaaagaggaaaauaaaacuuagaaguuggcuagaauaauggaacugagcuaacguguucuaaaaaaauaaccccaaagucuaaaguauauaacacaucagcccugcccaaucaaaugucuauuuugguucaaucauucaacaaauacuaauuaagcacccacuaugugccaaagacugugaaagacacuagauaugcagugaugaacaaaagacacagucccugcccucaggaagcuuauagaaaaaccucccucucauuccuuucucagaacacauagaccuucucucuaacuagcaaggcaauuaaauaacaguuacuauauuaggaagaacaugagcuuuggaaucagauagcucuggguucaaaucagauagcuaugccuggaugugucuggagaaacaccucuaucucucugaucuccagucucccaguaugaaaaaauggugauuauguuaucucacugggcuaaaugcaauaccacaacauauagaagagaauaaauacuagcucucucuccacauagucuucucuauaaauaaauauaaaaauuccugcuagauaaucaaacuccaggaaacagaaacaucaaaauucugcauggaagagaaguuucuaagcuuagaagaaauaaaguguacaagaaaagaaugaucugaccacauuaaaacacuuacacaguuuaaaagccaauaacaaucuggaaaaaagauauucacaucaaauacaaugaaauuaaucuguacuaaauaagucuaccagaauuauucaaacaacugaacugcugaauccacaggaauuuuuaugaugaacauucguuuuucaaauccagcauugggauuaguuuuaaagacccuuuaaaaaauguaacuucguggauuaaacaaauaaauaaguaaauuauagaaaauagcaaacauacaccaauggcaaugaaaccaaagaaagaacacaauuucauaccacaaucuuuaaaauauggugaccauaaagcagauguuuccaagaaucuucagggcuggacuuggugcauuuugugaagcugcuaagaccaaacuccacauaaggagaaggaggggugaggcugugaauaaacaaaauucugaaaauuucauuaaaacucucaaacuuauaggaagacaaauccaggaaggggaggggagauguagacagcccagagaaauggaaaugcccauaauaccauaaguucuaccuuuaccacauuccuucuggucagaaaagaaaaauacagguuuuaucauuuugguauuuuuucugcaaaaagaaaaaagcaggaaaggccauagaccauaaaaaauagcagccaagcuaaauaaauaucuccagcaauuaugaugaguagaagaaguggaagacaggcgagaggaggaauugccaugugaagccucacacacacccacagaggaccagaagaaaaguaggggguggcgaauggaaacagcuucuaaugaaauacaaacaagggaagcaacaaauggcacugacucaaggaaaacugaugaauaguaagagagaagauccaaaaucuaagaauaucucucagccuuccaagauaacagguuacagaccaaccagguagugugacaguaauucaagaugcuuagcaaaaucacaaaagagaggguugaagccaaauccuacaguaaggcugcuacagacaacccuucuuccuccccaugucuucuccacugccccuagauaggugauaagcagacacacugcaugauauccaaccgucaaaacaguacgucaggaaggaaaacaaacuccucucugauuggguaggaaagaaggcaagaaaaauucaccagcaccauaaaaaagcaaacaggcccaaacagagugggccaagcuaagcuugauugcucaagcaagguaaagaggcuggccuggcaaacccacaaacauacuacaaaaaaaaaaaaaaaaaaaggcagagagagggacaggggaagacaauaugcgaaagacagaugaagaaaaacagaaccaagaaucagaacaaaggucucuaaaaacauuucacacuacugagcaauuuaauaagaauaugaauuaaacaaaacaaacacacagugacaaagugauaugggaggcuaaauaacuaaaacaacaaaaaaaagaacccaaauaaaacccuaacagacagauauauagauauauauaggagauaccacauuauaauugaggggcaguuuguuaacaagugaaaaaugguuaugguaucauuuaccaaaucuccaacaaccagugggucaugugaccacugggucacagcagcccaaauccacauaauauggauaggauguaaaagggauagaucuaaaaugacuguaagagacuacuugcuauggucugaacgucauccaaaauuccuguguugaaaauuaauucccauuguagugguauuaagagguguggccuuuugggaagugauuaaguaaugagagcuucacccucacgaauggauuagugccuugugaaagaauggagggaaguagcuuaggcccuuugcucuucugcuccucuguucuucugccaugugaggacaccaagguggugccaucuaugaggaacaggcccuagcugcacacugaaccugcuggcaccuugauuuuggacuucccagccuccagaccugugagaaauaaaugucuguucuuuauaaauuacccagucucagguguuuugguauagcaacacaaauggacuaggacacuacuacgugucaggaaaucucagguuuaauguaacgaaagucauuuaagagcauuauuccaaguauauagacugaaaaaguaaccugaaaagcaaguuagaaagaauaagcagaagcuuaugugcaguucaagaggucuuuccccaaauauaaaaugugcacaguuuuuauauuauucuauauauuuuugccaucuuaaaggaaagacaaguuuugauuucaagugcacgaauugcaggugaaauguaucaucacuaaauauuuaggaauaucuuauaauaugccacuuuuccuauuugcagcuugacccaaaucacgcagauuuuuuucugucuucuaguaaauucauauauuuuaauacaaaauaaacaccaauauugaauaaauuacucaacugacuucaagauauaugcauauaaaguaaaggcuuuuccauuuaacauuuauugucauaacuugcuugcauuccauuauacagcaccagacuugacaugauaaacaugcuuuucacugguugggcccuuuaggugguaagaugacuaaauuccagaaacuguaaaauuacucuaaaauuacucuggguuagcucaaguugaaacauucuggauuauauucuacuguccacauauauguuuucagugguugcguuugggagguggugcuuaaucauuuacuuuuuuuuuuuuuaccgguacauauguuuuaaauaugccucugugaacaagacuacuuuuauaacaaaaguauauacauccucaugugaagaauacugaaagugaggaaaagauaaaguaaaaaucauaacuuacauuauuucaaguuucaaucucuucuguaaauaauuugagacaugcccccgaauuuaaauaucuaugcauaccaagccuaaaaucaugacaaaugauuuugcaaagcacucaauuaaauucaauuacaacaaauccucaaaauacacacaaacauuucaagcaauuauccccacacacuguaccagaaugaggcugcauucagcccaggacagagcauauccuuuaacugcuuaggcccugccuucuccaauucauauacacaccugagggcacacucucaaaucaccacugcuggccucuccugucaguucuaagguaguaccacagggagguccuaggagagaaagugaaaccaaaagcaagguggauauuuacaguuuuuuggccacccagcaccuauuucacucucuuucauuaaugcuacagaaccagguuaaaggugaccccuuuauauauugaccccauguuguuuacuucuucauucagacugaccauuaacucaaagcucacggauaccaaauucaaauuuuuauaucaauugcuuuaaacauagcccaaauaaggauauuuucagccuguuuugcauacccugaaaaacugcacccaacauccacuagcuacagguaaaacaaacccugagcauguaaaagacuguauguugcugcugcccuccccaguccugcuucucagcaaccuggacaccuaagccccacucuagguccucucuccccagaaagcuccccugaccucugccccuucuggguugaggccaccucacucucucuggaaggucucuugcuguaagggaccuccucuugaaugcaauccugccaaagcaccacgcaaauaaagcuuauuguguucuacugccaucugauagccaugucuuuuuucuugaucaccuccaaaguccucagauucaccacaguuaauuauucacugauauuccucuggaaauccaccccucuucccucuccacucuuacccuuagugguaagaggacuucccacaccuguggcucaggcucaaguuaaucacauuccuuugguggcaaugauugguucagagauggcccaaccagagccugugaguuggaaacagacuuuuguugagccuucuacgagaaaggaagaaccucuuuuacauggacuagaaugugacaaguaaagauuuaaagcugcuauagccaucauguaaccagaaggaaauagccuaucccaggaaauggaagcaagagaugaaaagagagaaaccagaucugaucacagagaaggcucaagugacguuagccagucaacuuccuauucuugcuuaagccaacuguuaguugcaaccaagggagucuucaguuuuaccaaagacaagguuggaaagaaaacaaaaguacaucuaaauccacaugaaaaagcagaauuauggccucugcaggaaaugggagguuuggauuuuugacgguaacauuuaacucuugaguuguguguuaacagguaagcucaaaauauaaauauccccauguauccucuaccaaaaauacaaaaaguuagccgagugugguggcgggugccuguggacccagcugcucaggaggcugaggcaggagaauggcgugaacccgggaggcggagcuugcagugagccgagauugcgccacugcacuccagccugggcgacagagcgagacucagucucaaaaaaaaaaaaaaaaaaauccccauguaaaacaaagcucuauaaucaagaaaagaaauuuuuuaaaggaaagcaaauaaguuuaagauguugauaaagauaaaaauugaagaaagagccagucacgguggcucacaccuguaaucccagcacuuugggaggccuaggcaggcauacuggcugagcccaagacuucaagaccagccugggcaacauagccagaccuuguaucuacuuuuuuuuuuuuuuuuuuuaagacagagucucacucuggagugcaguggagugcaguggcucgaucucggcucacugcagccucugccuccuggguucaagcgauucuccugccucagcuuccugaguagcugggacuacaggcacaugccaccacgcccagcuaauuuuuguauuuuuaguagaggcgggguuucaccauguuggccaggauggucuugaucuccugaccucgugauccgccccccucagccucccaaagugcugggauuacaggcgugagccaccacacccagcaacuauuuuuuuuuaauuaaaaaaacauugaagaaagaaccagauggugguguaauagugauaauuucuaauaaaguauuucuuuuccuuuucuuuuuuuuccaaagggucugacuuuuaaucucaugaaguauuaaauaggcuuuuuccccauaaaccacauauuuauuaugaaaagaaggcaauaauucaacagggcuauaaggcacaaauuacacgaugagaaacaauguuuuaaauuauaggcacaucauaaucaaaacaacauaauuuuaaaaauaaaaauggggccaggcacaauggcucaugccuauaauccuagcacucugagaggcugaggcaggcagaucgcuugagcccaggaauuugagaccagccugggcaauauggcaaaaccccgucacuacaaaaaaaaacaaauagccuggcaugguagcgcacaucuguagucccagcuacucaggaggcugaggcaggaggacugcuugaacucgggaggcagagguugcaguaagcugagaucguaccaccgcacucagccugggugacaaugcuagacccugucucuaaaacaaaaaaauaaaauaaaauaaaaguaaaaauguauucaggucaaauuuuuucagcaaaauacuaucuaugaaaggcauuugguuuaucagauuaagauuucaugauguguucucaaagacuucucccccccuuauaaaacauguuccccucuggcuauggcuuuaauugcaccuaccuucaugcccaaaccccuuuacaaagcaccuuuccuuugggauuuccauuucuucucuaugaauuccucauuccagugcaacaugaccaauguuccuacccuucuguuaaaauuauucucccuaaaaucaccaaugacuugcaaaugaccaaauccaacauuuucuuuccaauacuccagcugcuuaaccucugaacucucaaguccuucagugccucuuggaaucucucccuucccucuccuuccaugacaccaugcucuucugucucuaaauuuauauuccuuaaucucugugcuaguuccucuucuuaucccuacccuuaaauuugucauucucaacaaacauagucauaguacucuugaagagcacuauauccuucuccauuaaagaucagcugguagcuaaagaaaauaauugucccuuacugagggcuuuaugcuauaaguuaaaaagucaauuuaguagccuaaaaauggcaagguuuuuaaagcacuauaaagucugaaaaguaaucuucuugagaggaacaaacuauaccagaaggaauuugaaugguucaaccuuugggcaacaaaggcuaaagaccauacugaagaccauaaaauugaaacugggaauuacuaaucucuggauuaaagaggauaaaaaugaagggcuggaauaaaaaagguaacagcacacuccccacucucauuuacuccccucgcccccgccccuccccccacccuaccccacccccacccgccacacacacacacacacacacacacacacacauucacucaacuacagggagcugcucuaauccuagggcaucguuuugcacauauucaucucuaucaugauuugccucauuauuuuauaguuaacccuucaucuuuauuacuccuagauugugagcuacuugagaacauaaacugucuuuuuucuuuuuucgagacggagucucgcucugucgcccaggcuggagugcaaugaugcaaucucggcucacugcaaccuccgccuccuggguucaagcgauuucuccugucucagccucccaaguagcugggauuacaggcacccaccaccgugcccagcuaauuuuuuuguauuuuaaguagagaugggguuuuaccacguuggccaggcuggucucgaacuccugaccucaagucuccgcccaccucagccucccaaagugcugggauuacaggcaugagccaccauggccagcccauaaacugucuuuuccuuaucugucuauuccaagaaaacuaacacagugccugggcacucagaauucuuaguaaauaugcaucgaauggaugaggggauggacagacggagggacaaagagagaugauguaagggaggaacaacacaccagacuugcuucagucccugaaagugcccaagcaccuacaacaaaccaacaauuccuucccagugucccuguuacacacuugaaagauuccuauauaagguucaucaucuuuucacagccaacaagguaaauuucggguaacugaggacuuugggucaguuacuacagggacucuaaaucagacuaucagugaaagaaauucuagcucaaauaucuugauacuacauagacuacaagaaguaucuuauuuuacuacguuaaguauaugcagcuguugaccuuaaaacaauauuauuuucuucaccacuggcuuucugugaaucaauauuaaugcugucuuuuuccaaauauuauuuugaaauggcaaguuugucuuaacuagguaaaauaccauguuaacaaccauuggaaauuuuaguaacacaaagaaacaaaagcaagugaaaaucuggcaaaaauaucauuuuguucuuuuuucaaaaacaaguagaguucaaauuaccaaaacaaauaaauuccaccaauauuacuaacauaucuuaaaucuauuaaaaucuaccuuuucaaaauugauuuaguauauguccaaacuguaacuuguuugucuaugcuuaugcuacucacuaaauuuugcaagcauuaauuugucaagagcauaaaaaacaaagauaaacuaauauuuuuuuagaacccaaaaucacauauuccuucaaaaaagcagcuuggauuuaaauuuuaaaaaacaacgaacauuuuuaacuucaaacacacuuccccucugcaaaaauaaauaaauaaaagcccaauacaaccaauuaauauuauaauuuuuggaggaauuuuaaauuuuuuuggacuuuucuuacaaaccaaagcaccaaccagaaaaauaaaacugaaaaagcaaacauacgacccagaaguuaacauauuucccauaaucuaugaagaaucaaagauaugcacuuaacuuuagccaaaccaaacuacacuccauucugauaggaaaguuuuuucugaaugggggaggagguaaauucacucacagcccaaucaaggaggcaguuuagugugacuaauaccagaagccucuagaugcagacaggcuggguagaaauccucccuccaccacucacaguuacuuuuucaaccuguaaaagcucuuagaacacugccugauacaaaauaagcauuuugcagacauagggcuauagcacaccucuagaucacugcagcuuagcauuaccuggaauauugucagaaauucagcauuuaagguccaauuucagacuuacaagaauccgcauuuuaaucacgauccccuuauaauucaaaugcaacuuaaaaguuuuaaaaaaguuaaaaguuugagaagcacagcuagaaagcgcuuuuauauuauauucuguuaucuguuauaauuaacugucuuuuaaaaacccacccuguugugcaacucaaagaaguuacauuuauuuuuaauaaaagacaaagcauuauuaugggaucaacauuccuccauuagugauuucuugccauaccuuauucuaaagcagcagcaacuaaggccaaaaguuauagaggacugccaucuaguguuaguucauuuugacgcacacacaaaauacugcacaccucuucucccacugccuuuccauaauuuaaauaacacauuugcuuaaaacuguguugggcuuuaguuuuguuuaauuccuuuauugagacaugacaugaauaccaaacaauaauuccauaagaugccauaugaaauagaggaaaguagaaaacaaggauuuuuagguuucuuuuuuaaauaacaucaacuccagggaagcuuuccaauuaaaagaaucacccacucacuacuggaaaggugcacacuaaauauacauuaaagacaucaggcuuagaaagugggcuuucuuaugaaauguacaagucuuggagucuuacuuucuucuaccuaaguucugaacuuuuugcaauuuauacaguauuuaaggacuaaagcuacuuucauauuggaaaaaaauauuuuacaagugucugacuuaauaacucaaccucuccacucuauccuaaggaaauaaucagaaauguagauaaagauuuauguaaaaagauguucauucauagcuuugucagaagcaucggaaccaaagcgacuccaccgugaauagggacuggguaaaaugaggcugagaccuacugggcugcauucccagaagguuagacauuccaagucacaggauaagacaggagguuggcacaagguacagucacaaagaccuuacugauaaaacaguauguaguaaagaagccagccaaaacccaccaaaaccaagauggcgaccaaagugaccucugguuguccucacuacucauuaucacuaauuauaaugcauuagcaugcuaaaagacacucccacuagugccaugucaauuuacaaaugccauggcaacaucagggaauuacauuguauggucuaaagaggggaggaaaccucaguucuggggaaauugcccacccuuuuccuggaaaacucauaaauaauccaucccuuguuuagcauuuaaucaauaaauaaucauaaaauagccaaucagcagcccucagggcugcucugccaauggaguagccauucuuuuauuccuuuacuuuguuaauaaacuugcugucacuuuacucuaugaacuugcccugaauucuuucuuguuugagauccaagaacccugucugggggucuagaucaggaccccuuuccaguaacauucuccuggugaaccaugaaagaacgauacgaaggagacuccugacccaaaggaaacagaaugcagaacccauuggccgacuaugguuaagugguggauuagaggcccaacuuagaagauuuaaagucucuccuaagacagaauggguuaaaugacccucuuaauaaaaaguaaggauucucgacaaauuuggguucgagacccaacuuaggaagguuagaguucuucuuaagauuuaggcgguuagaggccccucucaguaaaaucucuugguuaaaaaugaauuuggcauuaugggauguuaaccacuauuuucuuuggauuaaucugccuugcgcucuuugcugauggcuguggggggauuaggcauguacaggaucaccggacauggggagcuucuuuucuccccaaaaggggaaacuugaaagcugaugggacugcuggaaaagaucccuuagcaaauuacaagcaaccaccugaacuuuguuuagugucacugcaauggugggucuuucucuagcuuccccuaagcuccucgucuucccaccccacugcaggcaaugcuuuucucccuucccuugccuuucuucucucacucucucucucucucucucucucugugugcaaacugcuuauaggugugguaaaaaucacuaccucuugcaauauuuuaauuaaugagaaaaaggauuugugaggcuggucuuaagcuauagcaacucuggggaacuuucugcuauaaauguuuuuuacuauauucugucauaaagaggaguaccuuaagauugaacaugggcuuaggacacaugggcuuagaacaagccugcuguucaagcuagcccagcaaacuagucagcuacaaacuuugcugcagguuccugaagcaaacaaacaaaaaaaaacugaaugagguuccccgcuugucuuguuuuauguccuugggagcuugaccuuuuaaguacguggcaguacuuucucuuguucucagccaucuggaggacaggaauuuuggaguuuaugucagagcucuaaaaauuaucucaagcaguuaaaagcuuuugcaagcucaaaauugacugcucuaggcucuuucugggaagggcaauggaaacuguccagugcuguagcuuaguaacuaaggcuuauugguuucaccugugagguuacuuuugguaacauuuaaaagccagaaauauugucuguuuggccugguuaaaguaggguaauaagagguuuauaaggaauuuuuuuuaaggagcacuaugguuaaaagucagcuuacuuaaaagcagauauccaaguuauacguacauuuuaaaggccuuuauguuuuuuuuuccucuucguggauuguguuuuucuggaaaagggguuuuuucuucucagucaacugaauuuucuccauuuugucuucuugacauucuugaugcacacgagaggaccuaagauaauauuuaacagcuugggacaccuugggaaaaacagaggaggugcugcagacuccauuuuggggggaaaaaaagacaucuguuucccucguggaacccuaagaauugaaaauagaucccucucacauuuuuuacuuuuggggguauuagaaauuacuucauauuaugcgagagauuucaugcguaauaacuagguaggaaauacacuuuuggggacagcuaauggaaguuauggggggacacucagcucuuuccauguuuggaucagagaagcaugcucuuggccaccuagaagguauggaaauguccccauccccuacugagagauaagacucccaugggaaaugggcugcuacccaucccuuuuuugggauccaggaucugguauaaaaauggaacccuuaauuuugggggaucuguuucgccuuccaccuauaccuguuuauuaaggcuagaaacugaaugcuuuaaagggaaacuuagaaacuggcaaaugaaaaaucuuacaacuauuggaucuucuuuugucuguguauuuauauguguugugugugugauguuuauauauaucuauauaaguucugauuaauugguuuaaaaauaauaggcacuuaaauauuauaaaaaaauuaagacuauaaugccuuuuaguucacgugacuuaaguaaucuuugggaaauaaaaacacagcuuuaaagauuauuaguaaaauaaagacacuuggucuaaauuaggcaggucagauauuagguuugauaaaugcuuuaaggucauaaacugcuucuuugacucuugaaaauuguucaacuuaacugcuguggagccguuagauuuuaaguaaggccuggggacauguggaguuagccacauccccuaacuauacaugagagucacaccuuaucugcacuucugucuggugcccuaggcuccacaccuaguacauaauuaaaaucauguauuuaccagauuuuucaccaaaaguaaguuucuaagaguuaacaguguaacauauaauugagacuacuagagaaagaguuuuauaugcaaggugugucaggaaaaugaaaugugcuuuugaaaaaagauuauaagaaggcauggaaauguggauuuuuuuuucuuuuugccuaguuuagaggguuaaaggauaguuuuuuguuuuguuuuguuuuguuuuguuugagacggagucucgcucugucacccaggcuggagugcaguggugcgaucucggcucacugcaagcuccgccuccuggguucacgccauucugccaccucagccucccggguagcugagauuacaggcacccaccaccaugcccagcuaauuuuguuuuuguauuuuuaguagagacgggguuucaccguguuagccaggauggucucgaucuccugaccucgugauccgccugccucggccucccaaagugcugggauuacaggcgugagccaccacgcccggccaaggauuguuuuaaguuagaugggaaaaagccaaagguuugaacaaguuguggaagguuggugaaaaauuaaucuuguaaaagaaauucugugugugaacauaucggcuaaaguuaaagguguauuauuccauuuuuccauaaauugaacauuggaauaaaagcacaacaggcuuuucuuagagcacugaucugcuuuuuaacaacuacaacaaaaaaagguguaaaggguuauaugcaagguuuauaagaaucuuaucuuaugaucaaacuaaaauuggauagauuugucuauaagguuuuauuaagaauugguugacaucaauaguguacuaaugcaaaggugaaaauuggcuuucugucucgaacagcauuuccaaguuauauuaaaaauaauaaaagauuuggcugggcauggugccucacaucuguaaucccagcacuuugggauuuccagguacaaagaaguauauagaaaugucucaccuauuauucucuagagguaugcuagggcuguuagguucaauuucucauauuagaagugucccaccuauccuuuaguuccaccugcagaaggcuccuugcacccuucuugcacuucguccacucuggcagcuccccugggggagaucuaagucccucuuggcaucggcaugcugguacaaauccuaugacaggauccucccuaagccauaugaggugaccacggaaucgcagauaggacccacucacucagcacagcaguaguacuuuguaccauucacacaagcagcaccucaaguaggagugcuugugaucauucacauacacauucagcacccugaauaucccgaccgccaaggaaauacuuugucgccuuuaugauguuucuuaccucgcucugugcacagaguuaccuggucgccacgguaugugaggauccuuuuccccagguugcuagccuggguuuauuugucacaccagguggauccccagucucucacccugaggcuaccgcaacaaggcagugggacauuucucccuacaagaggcaacuggagaccuguucuccaggagagaaugggcucccauacgggccaccagauuguuacaaacaaaugcuuguccucggugccgaaaagaagaacuagugcucaaagaauuuucucggccaggugcaguggcucacgccuguaauccuagcacuuugagaggcugaggcaggcgggucacgaggucaggagauagagaccauccuggccaacauggugaaaccccaucucuacugaaaauacaaaaauuagcugggcgugguggcaugugccuguaaucccagcuacucgggaggcugagguagaauuguugaaccagggagucggagguugcagugagccgagaucacaccgcugcacuccagccugaugacagagcgagacuccaucucaaaaaaaaaaaaaaaaaauucucagcaaggcaauuuuacaucuauagaagggugcaacuugcagauggagcaauggugagaguacaccugaacaagggaggggaagggauucuuauuccugacacagguacccccuacugcuguguuguuccccuauuggcuaggguuggaccacacagucuaagcuaauucugauuggcuauuuuaaagagaacagggguaugagccagaguggcggggugagcaguuuggcaggaaagacgguuauggaacagguaacuaaaggugacuuaggucagagcgggugaccagggcugacugaggucaaagcaggcaaccaggauaagucaggacagagcaggugaccaggggaacagaugugaacuacugauuaaaacugguggaaaaggcuauuuacugaaacuacaaggaaguuaagcuuuaaaaugaaggacaaagaacugaacauacugauauacugauucuuugaagagaaauugagaacucaguguauccaacaggguuaacuugaucugauaauaaaauaaaaaguacacugcaaucuauauaauagugguccccaaccuuuuuggcaucaaggaccaguuuuguggaagacaauuuuuccacagaccaggaagggggaagauuucgggaugacucagcacauuacauuuauugugcacuuuauuucuauuauuauuacauuguaauauauaaugaaauaauuacacaacucgacacaguguaggaucaguagaagcccugagcuuguuuuccugcaacuagauggucccaucuuggcaugaugggaggcaaugacagaugaucaggcauuagauuugcauaagagcacacaaccuagaucccuugcaugcacaguucacaauagaguuugugcuccuaugagaaucucaugcagccagaucugacagaaggcgcagcucaggcuaaugcaagugauggggaguggcuguaaauacagaugaagcuuugcucacucaccugccgcucaccuccugcugugaaacccgguuccuaacaggucauggaccacuacacaucuguagcuuggggaucggggaucccugcuauauaacauuugaugugaccuaaagaaccacuguuaugcuaucaaaaaacacuuuuauuuggccaaagcacuuuuuucucauguuauaauuuuuuuaugauguauggaauuuaguaauuugcuuuuuggagauucaguagggaaaagugaauugaaaauagcuaauuaaacaagggaggccuagguucccuaaucaggucagacauuuuuucaaagaacaguaaaaaucaguucuaaaagcugaggaagcacuucacugacagacucuccccucaucuaaauuucucucuucaucuaacucuagauaucuccuuaucguucaaguaauccaaacauuccuguuacucaagcaguccuccaaccuaaccaaguguuuuguuucacaucacuucaguuaugcaaaauauuuauuugcacaucaccaccaaaaauaucccugaugcugcuugguauacccaaauucaauuauuccuugucuuuaucuguauguauuaauaaaaaaaaaaaacugaguucacacaaaugaauaauacuuccaaaaugaagucauuuucucauguugcuaaggaaaaauacaaugcaacaguuaaacaaugaacucauaaaacaugaguccaggaagagcuaagauauuauaaaaucccuaguuacaugcucugcagguggcacaggaacauagauacauaugcacacagagucacacaaucacacagguaagugucaccaccuggcuuccuauccucaauccagcaccaccagcuccucuacuacccugucacggugcagggagagaaguugguuuggaaauaagagcccucccaugccaacagcaagaguguacacaagcaagcaccaagccuuggugaaucuggaagcucugggacugaguggacacaaugaagguggccuuugugcuaauuagaaaaagacaccccucugccaaggugggaggaacccagucucacugagccagugcuagauaaaggugaugccuuugugaaacacagaaaaagcaccccuuccucuggguagauuuacuccaagccagaaagcauggcucgaugagcaggaucaagucuguauuucagacccacaucccccacucuuccagcugcccugugcagaaacgacccacacaacccuguacagcagccccagauauggguagaguggagagagguguuugcagcuuuauccugccuguagcagguagagcagugacuuccugucaauaaggucaaccauuuuuuccacugagagagacagucagguaccacaguuccaucacacacaaaaagagcucaguuucagucagcuuauauauaaaagacaaaaucuguagaaaaggcaguuuuagaaauguuucuauagaccauauaaaaauaugcugguuauauaaaaaucaaagacuuccaauguuuaaagguuuuuuuuuauuauuuugauuggguauuuggucuccuauccaaguacuaaccaggccugacccugauuagcuuccaagaucagacgauaucaggcacauucagggugguauggccauagacuugcuugggcauuuggauacaaagguuucaauaaaaugucuauuuuaacucuuucugagagucaaaccacuuaauccucuguuuuauaugaccaaauauucuaaaucugucacuugaaauagcauacucaugauuaaaagcaaauuaccuuuuacaccaccaaaugauccauaggucauauugcaggcuguucucugaagauuauguucauacaucaauuucaucugacauugguucccauguuccacauuacccaagguuccuaaggaaaaaaaaaaaaggauuacuuuguauuuguguacacuaaaaaacauuaauuuguucucauccacuacuccgauucuaaguaauuuuagggaaauuauaauggcaaagcacuaaaauauuauguauugugaaaaauuagcauacugaugacacacaaagccaguacaguuaaaacaauuuacaucucagcuaaauuacaccauuagacaaaauauuacccuggggacacuuuauauucuauuuuuauuagacagauuauaucugaguaaaguguaauuauuuaaauaacaacaaaacccucuaauuucagaucugaaauaaauaaguucucugcauuuauaaacauuaauagagcaaagaaaugacucaaagugucuaagaaaaaaaaauccccaacacuuucaagcaauuaguguuccuaccccaacucucaaaauauucaagccccuaauuauauucuaauuuaauugagaaauuuucuaagcuucccucaacaaguaaauaggaaaauguuuuuuauuugaagucugccaagaagaaucuccuuccaaacacagaaaaauacucugcauuuaauagacugcaugugcuucacuuucuaguucuuuccaaaugagaaaagaguauuuaucuguauuuuauacauauagagcaagaacauuaugauuaaaaaguguguuggaaagaaaaaggauucagaaagcaauuuuuuccauaaagaagcaucacucauuaauccaaaauguaaaaguuaaggaaaauuuuaaauuaucauaaagcaaaugcaauaguccucaaacuggguaguacucaaucacuaaaaauaucuaaaaauauauguauguguacuuauuuauuuauaaauuuauauaggagcauuuauuuguuuuggguuuguuuguccagaagaauuuaccaacauacacugagauuguaagaauauauuuuuauuuccguuuuagaauugaagcaccuuaaguucaaaacaaauuuacagaaauuuccccaaaaucauacaguauucaagguagagaacugaguauucaaaccagacuuuuagaaccuaaaccaaaucuuuagaaccagguacuauguauuguauccugcugcccaguuguccaccauuuaacaacuuucagggaaugugguccucgcacccaguaaagauuuuacuguccauggauccugucaacgacaauuuccccaaagaaaacagcuucaagaauaugucuuuuccacugcaggguaccagaauaugacaccucaaacaggacucuuuggcauauggauuauuuugagcaaaaggacacagggaacuagccggaaaagcucuaaaaacaggucgucauuuaaaaaaagaaaucuccauuuauaaaaaaaagucucccucccuuguaccaggaagaggaguacccuuagcucuuuucaauggagaaggccucaacuuaaaucaccauaacaaacuuuacuaagcaacccuuguuuaccacacuuuuucuggucaccuucccauaacuugccuucuguguacagaagcccaaaacccauuuucuuuuauuucaccuaaaaugcuauguuagcccaagguccaacuacccuuuugagucacuccuuauggaauauuccuauguguacaugagcaaugcauauguuaauaaauuucugcuuguuuuuccuauuguuaauuagucuuuggccagucuaauuuauagagccccagcuggagaaccuaagauaaguaaagauuuuuuuuucccucccuuuugccuuucucagccuggccaaucaugguagcugacauucagccaaucguaggcagccaacugaccagaccauguucaaguaagguaaaugcuaagcugucaggaaugaagcuguuucuguaccucacuugcauugucuguccauaaauguuuccugcucauguugaagagcagagcgcucugaaccuccucuggugguugugagggcugcccaacaccugagguauucuuugcucaguuaaaggccauuaaauuuaaauugucuuaaguuugucuuuuaauaguuaaaagaggaaaaacuaucaggggaggauuucuugaaggagaaucauuucuacucaguuccaugguccccacaaaugguuaauuaacauuaguuuuguuguuuuuuuuuuuauuuuuauuuuuuaaagacagagucucacucuguugcacaggauggaguucaguggcacaauuuccacucacugcucugacuccuggauucaagcaauucucuugccucagccuccugaguagcugggauuacaggcaccugccaccacacccagcuaauuuuuguauuuuuaguacagacaggguuucaccauguuggccaggcuggucucaaacuccugaccucagguguuccacucgccucggccucccaaagugcugggauuacaggcaugagucaccgcaccuggccaaaaauagauuuuauauaccaauagaauaagaaacaaacauaaaggcuuaaauuugccugcugaccuugauggaggaugaaggcuuucuggauucuaaaugguaguaaaaucauugaggugccaggaagcugaggaggaaucacaaccaaaccagccacaugggugagggaaacacauacgguauuaaccugaagagaguucuagccuccaagaaaccagaaagagcagcuccaagagucaccugguuuaucccuaaagaaauuucaaauuucauucugaacuguuaaaucaaguuuagccuaaagcugccuccuuacauauuuuaaguucagccuaaagguuuuucuguacauaaugaacuauaacauaaauggaaguguaaacagacuguaaccuucccuugugccaaucaucgaguuuuggccaaaggcggucagcugaucaaaccauguucaaauggggugaaugcugaguuguaaacaauccagcuguuucuguaccucauuccauuuucuguacaccucuuucauuuuucugucuauaaaucuucuacuauguggcugcacuggagucucucugagccuacucuggcucaagaggcugcccaacucacaaauuguucuuuguucaauuaaaugcuguuaaauuuaauuuggcuaaaguuuuucuuuuaacagauggugucagaagugggauccaaaguagagguucuaacaacccccaggagagcugagcgaccaagcgagguacccacuaggccuauuguguccauugcucucucacagcaacuggggaucaugguaaguucucucucagauucagaagcuccacauauuuguguuuugagcucuccuaguuucuuugagcaaauuucugauccaaacuggguuuggaagucacaacagaaacuggacugggucuaggaucagacuggaucuaggaucagacuggaucugauaauuaacugucuuguauccaguaagggggcuucuuauaucugacuaggucagaaaaaaacugguaguaaauggaaauauugcaggcgguauaaaguuuagcucuuggaaauuagcagaaauuucuguguucuacccacuuuguuucauuuuucuugcacacuuagauagggaaaagucauuggcuagguugaccaaggaggucugagagccaaagccaauauuugagguaaaaaugggaaccuuaguuucugaagaacugaguaacuuccagcuuauacgugcauaaguauuaggccccagaagcaguaaagucuaacagaaauggcaaaauauuacuaaagauaaguuacaaauguggaauguuccaaaugaacaacacugcaccaaagauguaaauuugaaaaugauggcuccccaaauagucucaucuagggauggcuauugaccuguggaagcuucuaaaauuuuucaauuuuuuuuuuuuuuuuuuaggauggagucucgcucuguugccaaggcuggagugcaguggcgcaaucucagcucacugcaagcuccgccucccagguucacaccauucuccugccucauccucgcgaguagcugggaccugccaccacgcccagcugauuuuuuguauuuuuuaauagagaugggguuucacgguguuagccaggauggucucgaucuccugaccucgugauccacccgccucagccucccaaaauacugggauuacagacgugagccacugcacucggccaaauuuuucaauauuuuuauuaaaagacucuuuauaaaaggcaaauaaaaagcuuaagcaacuaaagauaaaguguuuauaaaaggcaggcccucaggcaaaauaggcuugcuucuuuuucagaugcaaccaugcugaguccaggcauagaggaugcuuucuucccccuauuccuuaaugggcuccacucugaacucaguaauuuuaguuaagaaacaguagcuaaauuaagaacaccuauugaacuaaaauaugccuuucuggaauuucauuggcuaucuugaaacccuucugcaaaagaaauuuacaucuauuaaggaaaucaccauuuuuaaggaugucugccuguguauauuagaaacucuucccauuguuuuaaauuggcauaagucacaccuuugauuaaggugccuuucuggccauguugucuuaacugaacuuuuaugggagcaccauuuuuuccuugguuugagacaaaugaugauacaauauuuaggccuaaaaucuuagcuauguacauauggaauauaauuuuuuguuguuguaccuaagaguuauuuuagaaaugcaaauuuguugccugguuaacaauugcuuagggcaaugaaacaaguaacuggaagauuaauagaccaaauagggaaaaggaaaacuauuuaaaagcuagcaaaugaaaaucuuucauguccauguguguuaugugucugugauaauauuugguaaauaaagcaaauucuaaaauuguugcuaaaauaggaauagcuucaaaauuaucaguuaaauauaacaagauauuugcuugauugacugugagcuguuuuugguuuagagccucuggauuugggggucugcauagguggacaugacgaggucuagagucguguucuuuucauuuuuuuuuuuuauuauuuuuuuuuugagacagagucucgcucugucacccaggcuggagugcaguggcacgaucuuggcucacugcaagcuccaccgccuggguuaaugccauucuccugccucagccucccgaguagcugggacuacaggcgcccgccaccauguccagcuaauuuuuuguauuuuuuaguagagaugggguuucacgguguuagccaggaugaucucaaucuccugacuucaugaucggcccaccucggccucccaaagugcugggauuacaggugugagccaccacacccggccuagaggcauguucuuagugccuagaccaucagcuacaagccagaaccaagcccaauaugcucccuucuccccugcuuuccugcuugccuacuggcuauuuggggagggguugaauccuccagauauagucuucacagcccugucuucuauccugaccauugcaccugguaugucaggacucagagaggccuugaccuucauaagccuccuggguaccaugaggcuacuuggcacccagaaugacuaagggaagacauuaaggaggguaccugugucauauuuucaaaauuauuuucaguaauuuaaaaucuucaggucauguuauauuaaauuaaauaauaaucauaaaaugucugagucauuuauaaguuaaaauauugaaacauuaauuauuaaacaugaguuugucuguauacguugauguuauuuuuauaugauacagaaaagcuacauauauuuaggucuguuaaaaaacaauaauuugaagaaaaaucuuucuaaaaacuuaaaaaaauaguuuuuaucacaaauacugauauaaaauuaguucgaaauuauuuucuaggguuuuaaucagaaauuaagguuacuaagaguuaaaauuuuaguugauauauguaauuaaagcuacuagagaugaaacaauuuuguauacauaguguauaaacaaaagcaagauauguuucagcuuucuacauauggcuagccaguuuucccagcaccauuuauuaaauagggaauccuuuccccacugcuuguuuuucucagguuugucaaagaucagauaguuguagauaugcggcguuauuucugagggcucuguucuguuccauugaucuauaucucuguuuugguaccaguaccaugcuguuuugguuacuguagccuuguaguauaguuugaagucagguagugugaugccuccagcuuuguucuucuggcuugggauugacuuggcgaugcgggcucuuuuuucauuccauaugaacuuuaaaguaguuuuuuccaguucugugaagaaaggcauugguagcuugauggggauggcauugaaucuguaaauuaccuugggcaguauggccauuuucaugauauugauucuuccuacccaugagcauggaauguucuuccauuuguuuguauccucuuuuauuuccuugagcagugguuuguaguucuccuugaagagguccuucacaucccuuguaaguuggauuccuagguauuuuaaucucuuugaagcaauugugaauggcaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucauccgcaaacagggacaauuugacuuccuuuuuuccuaauugaauacccuuuauuuccuucuccugccuaauugcccuggccagaacuuccaacacuaugcugaauaggaguggugagagagggcaucccugucuugugccaguuuucaaagggaaugcuuccaguuuuugcccauucaguaugauauuggcuguggguuugucauagauagcucuuauuauuuugaaauacaucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuugcauauauugaaccagccuugcaucccagggaugaagcccacuugaucaugguggauaagcuuuuugaugugcugcuggauucgguuugccaguauuuuauugaggauuuuugcaucaauguucaucaaguauauuggucuaaaauucucuuuuuugguugugucucuuccaggcuuugguaucagaaugaugcuggccucauaaaaugaguuagggaggauucccucuuuuucuauugauuggaauaguuucagaaggaaugguaccaguuccuccuuguaccucugguagaauucggcugugauuacaccuuauacaaaaaucaauucaagauggauuaaagacuuaaacguuagaccuaaaaccauaaaaacccuagaagaaaaccuaggcauuaccauucagaacauaggcaugggcaaggacuucauaucuaaaacaccaaaagcaauggcaacaaaagacaaaauugacaaaugggaucuaauuaaacuaaagagcuucugcacagcaaaagaaacuaccaucagagugaacaggcaaccuacaaaaugggagacaauuuucgcaaccuacucaucugacaaagggcuaauauccagaaucuacaaugaacucaaacagauuuacaagaaaaaaacaaacaaccccaucaaaaagugggcgaaggacaugaacagacacuucucaaaagaagacauuuaugcagccaaaaaacacaugaaaaaaugcucaccaucacuggccaucagagaaaugcaaaucaaaaccacaaugagauaccaucucacaccaguuagaauggcaaucauuaaaaagucaggaaacgacaggugcuggagaggauguggagaaauaggaacacuuuuacacuguuggugggacuguaaacuaguucaaccauuguggaagucaguauggcgauuccucagggaucuagaacuagaaauaccauuugacccagccaucccauuacuggguauauacccaaagaacucuaagucaugcugcuauaaagacacaugcacacguauguuuauugcggcauuauucacaauagcaaagacuuggaaccaacccaaaugcccaacaaugauagacuggauuaagaaaauguggcacauauacaccauggaauacuaugcagccauaaaaaaugaugaguucauguccuuuguagggacauggaugaaauuggaaagcaucauucucaguaaacuaucgcaaggacaaaaaaccaaacaccgcauauucucacucacaggugggaauugaacaaugagaucacauggacacaggaaggggaauaucacacucuggggacuguggugggguggggggagcggggagggauagcauugggagauauaccuaaugcuagaugaugaguuagugggugcagcacaccagcauggcacauguauacauauguaacuaaccugcacaaugugcacauguacccuaaaacuuaaaguacaauaaaaaauaaauaaaaaaaagcaagauaugcuuuucaugaggaaaguuaaaaaagcacaaagauauguguuaaaaauauuaucugguuugagguuucuuauagguuucaaauugaaggaguaaaaaaauagaaaaaacaagaugaauauagaaagcuggaaaaugcaaaaugaaagguuuauggaaaucuugugugguuaagagaagacagauuagauaaauuuauuuaugagauuuuauuaaaauuagcuuuaguauuuauaauacacuaauacaaaaguaaaauuuaauuucucuuuugaacaaaaauuuguguagcauuuauuaauaagacacaguaaaauauuuucauuuaugcguugaguaaacugcaaaaaggaaaaaaaggaggaggaaaaagagauaggaucugucaugcugucuuaggucuuauaacugaaagacugagucuccucuaucaaagaguacagguuucuucuuuuucaaaaaaaaauucuuguaauuaucacuuuggcuaaacgaaugaccauuauuuuauggugaccugugauccuaucuuggucaaguguuauaaaaccuugacaauuugaugggcuucccaaaaccaaauuucaggucaaaauuaagucucuuucagccucuaacuuugggaugcuacagagggcaccugaagcagccaaaaggagauaaacaggauuaucugaaagguuaaauuacacgggaagcacugucaaacaugaaaugauuuuuaaucuucaaguuacauuuuaaugaauauguuauuaauauauguaccaaaauuguaugggauuucuaaaauucuaguaugucugggcauaugcuaucagucauauuuaugguuguuauguuauuauaggccauauaaaugacaacauuuccuugucaauuaugucuuuauaaucauuuaaaguuauuuccacaguuaauugcuuaauuuuaacgcaguuccugaaaacuuuacaagcauccaaaauccuagaguaugguaucuuuaaggagguucaugaaaggauagaaaggaccccgacaagcacucuugaauacagguuucugguaacuuuaggaucauauaauuuggaugggguaagaauucccagaauuuaaggcugaucgugguggcucaugcuuguacucccagcacuuugggaggcugaggaggguggaucacaaggucaggaguucaagaacagccuggccaacacagugaaccccaucucuacuaaaauacaaaaauuagcuggacaugguggugggcaccugcaaucccagccacccaggaggcugaggcaggagagucgcuugaacccgggaggcagagguugcaaugagcugagauuguaccacugcacuccagccugggcaacagagcuagacuccauuucaaaaaaaaaaaaaaaaagaauucucagaacuuuaaugaacagacugacuaguuuauaaaacugcuaacccaagcaggacaaaaauauucaauaccaagaaaauacuuugucagauuuuuaugcuaaaccagacaguacugaaauuguuuauauauacaaugugaacgaacuccaugauccaagucaaaauaccuauaacuuucaguuaucagugcugugaaccuaaauuggagaaacaacuguuauuuaagaggacauuaaguccaacauuaagcauggacucauggagaaccuggacagccaccuugugcuuccugaguccuuaaagcuuuuguuauuaaaagcucugcauucuaugacucaucauggaagagauaaaauuauccaaauuaaaaauguauuaauuggaagguggucacauaggaacagcucugaucugcagcucccagcgugacugacacagaagacgggugauuuuugcauuuccaacugagcuaccugguucaucucauugggacugguuggacagugggugcagcccacggagggugagguaaagcaggguggggcaucaccucacccaggaagugcaagggguugggggauaucccuuuccuagccaagggaagccgugacagacuguacguggaaaaacgggacacuccugcccaaauacugcccuuuuccaacagucucagcaaauggcacaccaggagauuauaucccacgccuggcuagguggaucccacgccuggcuaggugggucccacgcccauggagccuugcucacuacuagcgcagcagucugagaucaaccugugaggcagcagccuggcagggggaggggcauccgccauugcugaggcuugaguagguaaacaaagcggcuggaggaagcucaaacuuggcggagcccaccgcagcuuagcaaggccaucugccucuguagacuccaccucuggaggcagggcauagcugaacaaaaggcagcagaaacuucugcagacuuaaaccucccuaucugacagcucugaaaagaccaaugguucucccagcaugguguuuuagcucugagaacagacagacugccuccucaagugggucccugaacccugaguagccuaacugggagauaccucccaguagggguugacugacaccucauacaggagggugcccuucugggaagaagcuuccagaggaaggaucaggcagcaauauuugcucuucugcgauauuugcuguucugcagccucugcugcugauacccagacaaacagugucuggaguggaccuccagcacacucgaacagaccugcagcugagggaccugacuguuagaaggaaaacuaacaaacaaaaaggaauagcaucaacaucaacaaaaaggacauccacacccaaaccccaucuguaggucaccaacaucaaagaccaaaggcagauaaaaccacaaagauggggagaaaccagagcagaaaagcugaaaauucuaaaaaccagagcaccucuucuccuccaaaggauugcagcuccuugccagcaacggaacaaagcuugacggagaaugaguuugacgagcugacagaaguaggcuucagaaggucgguaauaacaaacuucuccaagcuaaaggaggauguucgaacccaucacaacgaagcuaaaaaccuugaaaaaagauuagaugaauggcuaacuagaauaaacaguguagagaagaagaccuuaaaugaccugauggagcugaaaccauggcacaagaacuacaagacacaugcacaagcuucaauagcugauucaaucaaguggaagaaaggcuaucguugauugaaaaucaaauuaaugacauaaagcgagaagagaaguuuagagaaaaaagaguaaaaaaaaaaacgaacaaagccuccaagaaauauggaacuaugugaaaagaccaaaucuacguuugacugguguaccugaaagugauggggagaauggaaccaaguuggaaaacacucugcuggauauuauccaggagaacuuccccaaccuagcaaggcaggccaacauucaaauucaggaaauacagauaaugccacaaagacacuccucaagaagagcaaacccaagacacauaauugucagauucaccaagguugaaaugaaggaaaaaauguuaagggcagccagaaagaaaggucagguuacccacaaagggaagcccaucagacuaacagcggaucucucggcagaaacucuacaagccagaagagagugggggacaauauucaacauucuuaaagaaaacaauuuucaacccagaaucucauauccagccaaacuaagcuuaauaagugaaggagaaauaaaauucuuuacagacaagcaaaugcugagagauuucgucaccaccagaccugccuuacaagagcuccucaaggaagcacuaaacauggaaaggaaagaccgguaucagccaccgcaaaaacacgccaaauuguaaagaccaucgaugcuaggaagaaacugcaucaaccaacgggcaaaauaaccagcuaacaucauaaugacaggaucaaauucacacauaacaauauuaaccuuaaauguaaauggccuaaaugccccaguuaaaagacacagacuggcaaauuggauagaguccagacccaucaguguacuguauucaggagacccaucucacaugcagagacacacauaggcucaaaauaaaaggauaaaggaagaucuaccaagcaaauggaaaacaaaaaaaagcagggguugcaauccuagucucugauaaaacagacuuuaaaccaacaaagaucaaaagagacaaagaaggccauuacauaaugguaaagggaucaauucaacaagaagagcuaacuguccuaaauauauaugcacccaauacuggagcacccagauucauaaagcaaguuuuuagagacuuacaaagagacuuagacucccacacaauaauaaugggagacuuuaacaccccacugucaacauuagacagaucaacgagacagaaaguuaacaaggauauccaggacuugaacucagcugugcaccaagcguaccuaauagacaucuacagaacucuccauccaaaucaacagaguauacauucuucucagcaccacaucgcacuuauucaaaaauugaccacaugauuggaaguaaaacacuccucagcaaaugcaaaagaacagaaaucauaacaaacugucucucagaccacagugcaaucaaauuagaacucaggauuaagaaacucauucaaaacugcacaacuacauggaaacugaacaaccugcuccugaaugacuacuggguacauaacgaaaugaaggcagaaauaaagauguucuuugaaaccaaugggaacaaagacacaacguaccaaaaucucugggacacauuuaaagcaguguguagagggaaacuuauagcacuaaaagcccacaagagaaagcaggaaagaucuaaaauagacacccuaacaucacaauuaaaagaacuagagaagcaagagaaaacauauucaaaagcuagcagaaggcaagaaauaacuaagaucagagaagaacugaaggaaauagagacacaaaaaacccuucaaaaaaucagugaauccaggagcugguuuuuugaaaagaucaacaaaauugauagaccucuagcaagacuaauagagaagaaaacagagaagaaucaaauagacgcaacaaaaaaugauaaaggggauaucaccacugaucucacagaaauacaaacuaccaucagagaauacuauaaacaccucuaugcaaaaaaacuagaaaaucuagaagaaauggauaaauuccuggacacauacacccgcccaagacuaaaccaggaagaaguuggaucucugaauagacaaauaacagguucugaaauugaggcaauaauuaauagcauaccaaccaaaaaaaguccaagaccagauggacucacagccgaauucuaccagagguacaaagaggaggugguaccauaccuucugaaacuauuccaaucaauagaaaaagagggaaucuucccuaacuguuuuuaugaggccagcaucauccugauaccaaaggcuggcagagacacagcaaaaaaaagagaauuuuagaccaauaucccugaggaacacugacacgaaaauccucaauagaauacuggcauaccaaauccagcagcacaucaaaaaguuuauccaccacgaucaagucagcuucaucccugggaugcaaggcugguuuaacauaugcaaaucaauaaacauaauccaucauauaaacagaaccaaugacaaaaaccacaugauuaucucaauagaugcagaaaacgccucuacaaaauucaagaacccuucaugcuaacaacucucaauaaacuagguauugauggaacguaucucaaaauaauaagagcuacuuaugagaaacccacagccaauaucauacugaaugggcaaaaacuggaagcauucccuuugaaaacaggcacaagacagagaugcccucucucacgacuccuauucaacauaguguuggaaguucuggccagggcaaucaggcaagagaaagaaauaaaggguauucaauuaggaaaaagggaaaucaaauugucccugugugcaaaugacaugauuguaaaucuagaaaaccccaucgucucagcccaaaaucuccuuaagcugauaagaaaguuuagcaaagucucaguauacaaaaucaaugugcaaaaaucacaagcacuccuauacaucaacaacagacaaacagagccaaaucaugagugaacucccauucacaacuguuacaaagagaauaaaauaccuaagaauccaacuuacaagggaugugaaggaccucuucaaggagaacuacaaaccacugcucaacaaaauaaaagaggacacaaacaaauggaagaacauuccaugcucauggauaggaagaauccauacagugaaaauggccauacugcccaagguaauuuauagauucaaugccauuaccaauggcauauaaccaauaacaccacacgucuacaaccaucugaucuuuacaaagcugacaaaaacaagaaauggggaaaagauacccuauuuaauaaauggugcugggaaaacuggcuagccauauguagaaagcugaaacuggaucccuuccuuacaccuuauacaaaauuaauucaagauagauuaaagacuuaaauguuagaccuaaaaccauaaaaacccuagaagaaaaccuaggcaauaucauucaggacacaggcaugggcaaggacuucaugagcaaaaaaagaaaacuaccagcagcgugaacaggcaaccuacagaaugggagaaaguuuuugcaaucuacccaucugacaaagggcuaauauccagaaucuacaaagaacuuaaacaaauuuacaagaaaaaaacaaacaauuccaucaacaagugggcaaaggauaugaacagacacuucucaaaagaagacaucuaugcacccaacagacacaugaaaaaaugcucaucaucacuggucaucagagaaaugcaaaucaaaaccacaaugagauaccaucucacaucaguuagaauggcaaucauuaaaaagucaggaagcaacagaugcuggagaggaugaggagaaauaggaaugcuuucacacuguuggugggaguguaaacuaguucaaccaucguggaaggcaguguggcaauuccucaaggaucuguaaccagaaauaccauuuaacccagcaaucccauuacuggguauacacccaaaggauuauaaaucaugcuacuauaaagacacauguauacguauguuuuuuauggcacuauucacaauagcaaagacuuggaaccaacccaaauguccaucaaugauagacuggauuaagaaaauguagcccauauacaccauggaauacuaugcagccauaaaaaaggaugaguucauguccuuugcagggacauggaugaagcuggaaaccaucauucugagcaaacgaucacaaggacagaaaaccaaacacugcauguucucacucauaggugggaacugaacaaugagaacacuuggacacaggguggggaacaucacauaacagggccugucgugggguggggugcaggggcagggauagcauuagaagaaauaccuaauguaaaugacgaguuaaugguggcagcaaaccgacauagcacaaguauaccuauguaacaaaccugcacguuguacauguacccuagaacuuaaaguauaauaaaaaaaaaaguauuaauuaguguagugacuguuccauguugcuaaaagaguuuacaaccaauguuugcuuuucaaacccauauuccuggaaagacaaccaaaauuucagguacauuucugcuagcugaugagccauuuaaacauuuauagaaagauuucauucaauugucauuuucaaugcaugucuucugguuguauaaaagcuuucccaugcaagagggcugauguuauaacauuagcucuauuugucaaaguauauuuccaccuggugaagaaagcuuuucacagucugcugacugaggacaaucaaccccuucaaaaucuagaacacaaagauugaaucuucugagaauaccagagaaagacugcccuugccaucuacauugcagcaacacuuugggaccuugaaauuuugaguuaauaaucucacaacucaaaagggccccuccacucuuggaacuguacacccauuggcaaccuuaaaguaaagcuaaacaggaaaguuucuccccagaagaagaugguauccaugauauagacagcuuuuucucaagaucacagaucaagacuucucugcuaucaggagacucuuaccuauuuuuucuugcuuaugcuuccaugaacaauagaagugaaaagagggucuauuguguguauucauagaguauacuuuaauuugugaaggauuuugcagccagccuuauacauggaauaccuuaugccucaauagauaaaagacgaaggcccaaugcaggugagaaauuuuaaugacacauuuguugccucauaaucaguuagaaacaggacauugguccacuccucuuaaccuacgucacagguuaaagagaacauuuccaagaagucuucauucuucuaaauagacaucauuuguuaggucuccuuuuccaugguuugaaguaaaugaggcaauaauuagaaauguaucccucaugauaggcuuuauagaagauucuacccuaaaggcuauggucacacaacagacuuuguauucucuuaugaaaguuaugcuaaauaauagaacugcucuagauuacuuacuggcuaaacagcaguaucugugcacuugcuggcacuucuuguuggccauggagaaaugcaucacauugagcauuauagagauucaguuacagggaacuaacaaagagacugcuuauuuaaaacgaacagacucuuuaucuagcucauucuuugaucuauuuaauuuuaguugguuugguucauggggacccuggcuaagaagcaugcuccaaacucuugguauuauccuccugauagucaaaauaguaaucucccuagugugcuauauucucucaaaaguuuuaaauguuugcaugcagccaucucuagagugccacaugaucucucuucaacuagaaggacaagagcuuaaaaagaugugugaccaugagggcacuguaaccuaugaaugacauccugagaccagaaacccaaaauugauguuaaaagagaguggaacuaaggcccuaaguuuuggucacacucucaccuaugugagaaccugacuaaaagggggaaguuuuaaaauaaaauuauggaaggccauuguuuuggacugaacucaugcacuaggucccaacagacaagaccaagccaaaaugaagucacucauguuaaaugugacauaaucaaacuaagaucuuaaggaaacacaaagcuccuagaacagaccagguuuuguuuuucuccucuaaacaggacauuccagcauaaggaaguacccucuacucuaaccuuuacaaaaaauaaacuaaauuccuuguuccuaccuuacaaaauccacuguucugcuauuucucaguggguuuugagaugaaauaagcacauuuacaauggugauagugacaucaaugacuaguuguggucaaucucucaaaauugagaggaugaccaaaagaggaaaauuguuaaaucaaguuuagccuaaagcugccuccuuacaucuuuuaagcucagccuaaagguuucucuguacauagugaacuauaaccuaaauggagguggaaauagacuguaaccuacucuugugccaaucacugaguuuuggccaaucaaaggaggccaguuguucaaacuauguucaaauaagguaaaccucaagcuguaaccaaccugaccguuucuguaccucauucuauuuucuguacaucucuuuccuuuuucugucugucacuuuccuuuuucugucuauaaaucgucuuuuaccauguggcugugcuggagucucucucagccuacucuggcucaagagacugcccaauucacaaaucauucuuugcucaauuaaacucuguuaaauuucauuugacuaagguuuuucuuuuaacaacaucuacaaccagaucaaucccucugaauaagaaaagcaccuauacaugccugcuagccaaaaugcaagcaggaacauuaggaacucaugucaaugaacauaggugucagcagccaauauuuaaacuuggcaugaaacgacacuaggcuuuguguaaaaacuccaaaugcacugauacaucuuaaaugucagguaauagcacuuuaaaauuuaauaaugcaacuauggagaaaaagacaauuuuccuuagauaacuaccuuggaauaaaagaaguauuugggaaucuaauauuucugaccauuuucucccuaaaaaagcaucagugacauaauauuaaaauuauuugcauagguuuugcccugggauauauggacugaauauagcauauaugauuauagucuacauacauuauaaaguuucaucaauuagaaaauacaugaauauucaaacauuuaugcaacaggccuuacuuaaacaagaucugauuuaaaccaaaaaauucucuggaaaaucagaggucacuuugacaacaguuuucggugcaauuuuagguaacugcugagcaaucuaaggauguuaaacucaaagccauuacauauuaaguaaaucagauuacguaagacugucaaaaguaaagaaccacaucuuuuuugcccuccucauggaaaccauuaaaauucuauaaauaugucagauguuuaguaaaugccucuugagaaguacacaucuuuuggaaaauaauauuuaaaacaacauaaucaguacggcucacacucacacaucuguaaccauuuauucagaaacugaagcccaucagaaagaaaucugagaugccaugugaugcuuucucuuuaccagaguaugauaagauaggccaacuucaggucagcaagacccuguuuuuuucucuauauuaagcauacauuugaugacacauaacccaccaaaaagaaguuagcaaaauagccucugacuauuaaggguuguuagguauguccaggagacugaccuuagaaaggcuccucuaguuugaaaauauuugagaagggagcaguugaagaaaaggaugucaaguucagcucacacguuugucugcugacacuagugguuucacuuaaauuagaaaauguuugugcuuccccugugacaguaaaagcuagguaaaaguucaaucuggaacuucaagaaacauauucaagagaacaaaaacauucccaugcuucucaauuuaagcccaagccaggaaaaauauacaaauugucagcccacaucacaagaggcugaagaaaugaaagacagaagggaagugagguggggccuaagagaauguaguuuggacaacuccuaguccccagagaauacaaagcuuuuaaaugaacacaaagaauaaaagagcuauaaaaucaccauucccauagcaaauaacuuucauuuucaacacuuacuugaaggauaucaauaugccauaaacaaauugucaccuaauaugccaguuucuuucaguacguuuuucugauaaguacacuuuuuaucccuugucugugcucuaagccccaguggaacuccagaggcaucugucuuuuuggcccauaguucgagcaggaccagggaaggccuagugucuaaucgaauuucuagcuucuaagauacccuccucucugcccugcuuagagcccccauggagcuucagaaggaacuaauugccaaagaaguauucuggguaacuauaacuguaggcaaauucuccuccauggcuuguguaacccacuuaguaaaauaacaggcuuacggucaaaaacagaagaacaacuagauccaugcaauaaaguagccuauaucguaugauaauaccuucuccauuuacucuggcauacuaaauaaaugcccugacacuaggaggagcaacaugaaaccauguccuuuaccauaaaaucaaugagagcacacuuuaucaggccucugacauaaacagagugggaaauaaaaugauagugguaacagagaaggggacgaaaacagaacauggugaagaguaauaaagaaagccacugucaauugccucagcacuacccagaaauuuguucauucauucauucaacaaguauuuacuggaugucuaccauauaccacgccagguuaccaagccugccuuggaaaucuaaaagaucuucacccugaaaagagacugccuaagaauauccaacucagucaguaaauaugcaucauuacucaaauugaaagcaaaauacaaagaaagcccaaaugaagagaauaagucugagaaauccaaauccuagaagguaacauuuacagcaagcuccaaaggagaggaucucugguaaaaggaacagccucacagacacuuaguuuucucauacccauaaaaaaaaugcccccaacacugacauccauuaaaauaacucucaacuugaacuaaacuuaucuaauaauugaaauaaaaauuuuuaaguuauaucuuacauuuaauaaaggccaaaauaaaauauaauaaaaaccaaaccacauacuauaauuuuaauaaaaaccaaaccgcacacuauacuuguacccacagaaccaugucagagaaugaaaccugaugaagccugacugagugaagacaaccaaaaaccaagaaauuggaacgguaaagagaaaauacuugagguucaccaaagaaaauguacuucaaaccacuaugacuuagcaucuaaucaauuuuguuauuguagaacauuucuuaagacucaagugucuuaaguacccagaauuggccucuauuagucacaggcaaucccggaaacaauucuggagaggcaggugauuaagaggaauccucugcuagaaagauacauauacacagaaauaguagaccaugaaaauguaauagccuaaguaucugaaagaauaaaugaaaaaugggaaaauguuaaccaagacaagaaaacauucaacuaaauguuuuguguucucuaccaagucagcacuagggaauaucuauucucauauaacauuaagcccaauuuguaauauaaauucuacauugguaaaaauauuucuuaccugagacagaguagacacaaaguuuucuagaauguaacacagccaaauguagcauuucgguaccucugaaaaacagagaaaguuuuuaaaguuuuccaauauuagcuuuagacguaaccaaaaaguuguaaaauaauuucaaaaagaucucauaaccacagccacugugaguaaacaaaacaauucauuagauaacauucuaaacugaaaaauaaauauaacaauaaacagccaaugugacaaccccagaggcucaaguacucugccucaaggcacugccuucagauugaagccaacagagcuuccaagaaaaagucagaucugagguccuucccuaagugcuauuucuuucaauaaagaaauccaaguucuaguccuggcuuucugacuaauucauccgugacuuugggcaagucacuaaaaucucccugagccuauuucucaugaaaaauaagagguucaaugaaaugaaauaaaauaaugugaaaccaucuuggaaagguuaaaacaucacaaaacaccaaucauuauuacaaguagcauauaucacuuccauaucugaaauuuuauuacaaguauugaaaauauuucuguuuggacuaaaucucaaauagaaauaaacuaccaauaucaccacaacaauucccagccuaucucaagugguuuccagaaacuagcauggcacagucuagagauccuaaauucaguuuucaaggaucaagccagggguuguuaaugaguaaagaguguaaauggcugugauuaacuggagacugaaccagacuaaaggagguggcuauuacuugguucugggcuuggggccagagccccacauuuuucaagaaaagccagaaagcauuggguuuuaugugaaaucucuugguucuuaaauguugacagcucuuuuaaauuuaaaauacugagcaggcggccagguguaauggcucacaccuguaauccagcauuuugggaggcugaggugggagggggcgguggaucuccugagaucagaaguucgagaccagccuggccaacauggugaaacccugucucuacuaaaaauacaaaaauuagccaggcaugguggcacgugccuguagucccagcuacuugggaggcugaggcaggagaauugcuugaaucugggaggcggagguugcagcaagcugagaucacgccauugcacuccagucugggcgacgagagugaaacuccgccucaaaauaaaacaaaauaaaauacugaacaggcucacauguacaagcaggccuccaguguacaacgccuguuuagaacagacuguucuaaacugcaaggacuauaauugaagucugcagaccuagguggggguucugacucugcaccuuacuauauguaugaucauuuaaacuuucagaguguuaguaucuuauuuacaaauaagaaucuuauuagauaacaucugcaaaacauuguuacaauuaauauauacucaucauuugcucuacuaguagaaaaugcaaauauacaugacuaucacauaaucaguaucaccuuuggaaauuuuguauauguacccuggacauucaaaacaaguuuuccaccaugcucaggaaaagagcaugaugucauagaaaggccuaguauacuaucuacuuaacaacguuaacuuccuccccuuccaaugugagcacauagaugagggcuauacuuaaggacuacuauacagaaugauuauuggcuguguuucacuuuuuuaaugguaagguaaaaacacuuuuuagcaggaaggaugcuuuugucuccuuacuuuguaaauccaucacaccuaauauguccuaggcacaugaugggaaccuaaucaccaucugcuuuuagauggaguagauauuuaccaaccacuucggucacaaaaucuccgcaauccagccugucacaaagcauaaaagucucaucucauaucccagccuaaagcaucuaagcuacagcuucccaacagaauaaaacauaucacuagaagaaugugaaugcucaugagugguuguuugguuuucaagcaggaguuagggcccugacuaaauggccccuggggccaauaaauuaugauaaacaaauguagaaugccaaaauccagagcuuaggguacugcccagauuuaaaaaggcaaaagggagcucaaaaagaggaggcaaacugacucuggcuacuugauaaguguucaucguacuucuaaaugaugaagaaauacaagcuuaauuuuaagaaaguuuguguaugaaaauaagaggaucagcaauaucaucaguaaauaaaaagcagacauauuacccaaaguucaaacuaauaaacaguuuucuaaaauaaauuagauuuaagaauaaaguacuuugaaacaaagcucuuguagggggaagacuuacuuuguggguugaacugacuucuuucaagaaacgauagggcaucucuaccccaaauaacuauucauuuuaaaaccucaaagcuaugaaccaaaaaguaaugguuaucugcuacuucaucuaauuauaaauggacacuuauauaacuuuaaauaaguagauacuucuuauuuauuucuuuauuugguuauuuucaaaagcuuaucucuuuguuuuuaagcuucugauaaugucaggcaucuuaagucuauuacuauuaaaaggcccuaaauuauuauaucuuaaauguacaguuuccacauaaaaagcauuccauacgugagaaaccccuaggugacaauauccagaaaauauauuuaauucauggauagucuucuuugaagaauacacaaaagugacacuguaaaggauugacauacuccaaguaaaauaccagaauuagugggcuuacuuacgaaacaaacuuuccuacuuccacuugaaguacuggaucucguagauccacuucuagaagcaaaucuucggcuugagcuccaucuccuguuuuugcaggaugggggcuaaagauccuuagguaucccauaaagcuacccacaauuauuuuaucuguagagaauuuaaaaaaaaaaagauagagggagaaacaaacauuagcaaaucucuuaggaaauaagcuuucuaauguguaaaagagaaaucuaaaaauuaaaagaauucagucuugcuuuauacacaaaggccacucugucaaaaaagguguaauuaaagaguacuuauuuuaauaacacacagcuuucauaaauagcuuuacaucccuauagucaaauguacuaacauauugcauuuuuuccuaaaccuuuauuugguaucaaagucauaauuuaacucaaucaaagcaagccccuuuaucaaaggacuaguacaauguuguaaacugauuccaucauagaggccaacucuauaacugcuuguggcugucgaaaacacuguauuaaaaaggauucugagucgucacuagauagagugccuugauaagcaauguuucaucuuaaguacaagcaggggaaaugauagaauggguguuguaaguuaaauuguguccccccaaaaaaagauacguuaaagucauaaccccagguaccucugaaugugaccugauuuggaaacagagucuuugcacauguaaucaaguuaaaaugagguccaguuaauuagaugugugaucaaacucaauuaguguccuuuaagaggacagaacagagacauggagggaauggcaugcaaagcugagugcaguggcaugccccuguagucccagcuacuugggaggcugagguggaaggacugcuugagccaaggaguucaaggcugcagugagcucuaaucgugccacuguacucuagccugggcgaaagaacaagaccuugucacugaaaaaaaaaaaaaaaaaaaaaaaggcugggugcaguggcucaugccuguaauccuagcaccuugggaagccgaggcaggcagaucacuugagaucaggaguucgagaccagccuggccaacauguugaaacccuaucucuacuaaaaauagaaaaaauuagcuaggugugguggcgcaugcccguaaucccagcuacccaggaggcugaggcaggagaaucgcuggaauccgggaaguggaggcugcauugagccgagacagugccacuguacuccagccugggugacacagcaagacuccaucucaagaaaaaaaaaauccucauaauaacccuaugagagagguauaauccugggaacuucaauacuggaggcuuacaaggucucuggagccaugcccauuccuguccccacuaaaggcuuguucaguucaacucugccugcauugggaaagcuaucuuacauucauuccagcaccuucuguacuuaaaucuaucaguuuccugucacuuguggccaaaaaaaaagauaacugauauagaaaugagcacuagaaaauaaacugcaggcaugcaaacaugcaagcauauuuggaauugguucuucuuuuuuuuuuuccuuugagacagggucucacucuguugcccaggcuugaguacagugaugcaaucacagcuuguugcagccucaaccucccaggcucaauugauccucccaccucagccuccugaguggcugggaauacaggcauaugccuucaugcccagcuaauuuuuguauuuuuuguagggaugugguuuugccauguugucugggcuggucucaaacuucuggacucaagcaaucuaccugccuuggccuccaaaguaugggaauugguucuugaccugaaaugcgguacaaaacaguaagauuccuuguggggacaagaguaacuuuauuuuaaaugcuaaucugccaugugacuccugacuaaacucaaguccaagaacuccucuaagaucucuaguugauguauuacucuuuaugcagaaacaucuauucauuuuaaguuuugccuuuccuccaaaacagcacuugauguugcugcauacaucauaggcugugacacucauagccaccuacacauucuucucagagcauguauacuuuuuuuccccaagauacaagcccugggucuggggguugugguguggagagcugccugucuugcaacugcccaggacauuucugcccauaaguucaccuaauaaaucacuguauacugacaaacuggauuugucugccucaaucuuugguucucagcuccuucaguauuugagggccacuuugcguauaugcccuuucacagaacacucccauucauguucuaggugggguuaaguaucacuuuacauuguaacagaacaauuaaucaaguuaucaucucuagucaucugggacccugugcccauugcaggugaaacucuaguagacuggacagcugcugccauagccagcugaacaaggaggaacaccaaaccacauguaagauagcuuuaucgaagauagcuuuauuuaaauuaaauuggauaauuuaaaauaaaagaaugauagguuuaaaucucaaaauugucaucuaaggguaaagaauaaaacucagggucuuugguacucugcagaaacauuucucaccacuuacuacucagauaguggggcuuaaucacugagaagcucauucagagacugauucuuuaaguuuuaaauuacaauaacaaaugaccugacaaaucucuccagccuucuuaaguaaaaguaaaggcacugaucaggaagaauggaauuauacuguuauaauggaguccagaaggguuggagaagacuuaaaccuuuaaaccuuccuaaaacauuccccgcugagcuucccauguauccugucaugcccuaaauccccacuuuuacucacuaaauaaccaagauucauggauaggucaauauagcccuaucuucagggauaagaggaggucaggauggccaaguccacaugguaacaagcuaacccacugaaacaaaauguauauguacgacuauuaaaauacuuugcaggacuaguauaguaaccagaucucagauaagucugacucucacagauuucaagcuacaauuaaauaugggauuccccaggaauuaaugaacaugcaggcauuaaaugaaaagccauuagucagucuuauuugcucucuacuccaauucuagaaauaaacuuucccuccaggccacagguuggcauguaaucuaaauuguauuauucagauccucucucucucccucauucucacuaucucucucaagagucugaaucuugaguugagagaauuaggaaaguaagugccauuuaaaugcaugggguguucaauuucaauuguacuaucaagauuaacaaggaauccuucuguguuuuacucggcuucuucuaaagaauuucaggaucccuguaacucuucucucacugucugaucaccuaaaaaaaaguagaggucaacugacauuacuguuucaaccucccaacuugaccugcaaauuucucuacaucgguauacauucuuaccuucuuuccucuggcacuguggaaaaaagcuuccacaucuguccaagguuaauccuuccaucugcacaccugaucccaucucugacuguccucucugggucccugcuccaucaaugaaagccucuauucuacacauugaauuuuucccacuucccuugacccuccauggucuccaaaucaucauccucccuucuucaauucacagcuaaguuucuuuaaagagccauaaauagucuccccaccucccacucacuccccauucauacauugcaaaucuagaucucauuaccauugugcccacacauccacucuugucauggacacuaaugaaccacuugcugcuaaagagcaugaaaacuuuuaggccaggcucaguggcucacgccaauaaucccagcacuuugggaggccaaggcaggaggaucacuugagcccaggaaguucaagaccagccugggcaacacaaggagacacugucuguacaaaaaaaauaaaaauaaaaauuagccaggcaugguggggcacaccugggagguugaggcugcagugagccaugaucaugccacugcacuccauccugggcagcagagcaagaccugucuccauuaaaaaaaaaaaaaaaaaggccaggugcaguggcucaugccuguaaucccagcacuuugugaggccgaggcagguggaucacccaaggucaggaguucgcgaccagccuggccaacauggcaaaacccugucucuacuaaaaauacaaaaauuagcugggugugguggcaggcaccuguaaucccagcuacuugggaggcuaaggcaggagaauugcuugaacccgggagguggagguugcagugagccaagaucacaccacugcacugcuucccaguuaccagccuaauuaguuuuccugccucucugccugcucuuuucagaaucuacuacucuucccacacuuccccuguugauccucauauucuccagguuacaguccuauaccuccuccccucuuauuucaacuucucucccugugcauuuucaccuguucucagagcuccaaauauaaacaccauauuguucauccccaaaucucuaccucuauucuguaaacuagacauuccuaucuuaaacagagcauauccaaaacugcucuuguuaacuuuccauucuauaagaucaacaaaaauaauucucaaacuugagaaugccagcauucaauuuuggaacuuaucaaaaauuaggaaaccuaagucacaucaccccaccuaccccuggagaauacaaucuuauagcaucucaugugucugggauagaaaaucuccauauauaauaaucaccccacaauauuaugacacaggcuuuggaacacaaugaugaguguugucuauguggaacacacauauguaaugauuuuuguauagcaagcuucggaaaacagaggaagcugcucacagcucaccacaaacugugagggaagcaguaucucagcauauucguaaccuacugguagcaccccaguagugagcucuaauagaaaugaaugaguguacaguauguuauucagauaaucaguaaguauaguuuccaaccaagcugaacuuuagauaguuuaggcagaaguggguuugaaauuguucucucuggcagguauuucuguggcaugacucuuacauggccaaauaacuggggcaucacaugcuuuaacaaauagcgggggcagaggcaggguugaggaaccuuccaauauccucugaauagaaggccuucccaucuccuaucaguggaaaaucagggaccaaauuuuccuucaaaacaacuuaguaggugcucugugcaguuuaguacucccacucuucugcuuuaccaauacaauuuucuccuuucacauuuuccugcagaucccacuguuuuaauuauaggcaagaaaaacaauuuuuaaaaaauguaaggggauaauauuuauaugcaguaaacaaaagaauaguuauaauaaguuuucuuuuuaagaggguaaugacuagaucacaaaaaaaaagcccaugacuauaaaccaaauacaaauuucaaauagcaaugauacaauaauacagaauuaaacuguuugaaaggucacuuaaaaaacaugaagaugcauaagaauaagcuagaauguagguuuuaguauuauaauaugauaaugaaagcaaggauuuaacaauuguuuucuaccaccaaauagagcuaguguaauuucauuaugguaugaaugguuuccagguccaauaaauuuauuuuucuuguaaagaauuucuacaaaaggaaauuuuucaaaauacaaaauauuuuacuaacuguccccuacaagaccaaauuuugauacaaaugaagugaugucauauaauuuuuacuaaauuccagcaaacaauaugacagaaucaguacaaaccagaacauaaacaaaacagaaagacuauaguuaucagucugauaccuaaauauuauuaaaaaaaacuaccuucaaaauuagguacaauuaugauaguucaauuaaguucuaaaaaguacacauuuucaaaagcaagucauuuuuaucucuuuuuuuuuuuuuuuuuuuugagauggagccuugcucuguugcccagguuggaguguaguggcacuaucucagcucaccgcaaccucugccuucuggguucaagcgauucuccugccucagccucccagguagcugggauuacagaugcccaccaccaagcccagcuaauuuuguauuuuuaguagagacaguguuucaccauguuggccaggcuggucucguacuccugaccucgugaucugcccacgucggccucccaaaagaacugagauuacagcagucggccaccgugcccagucuuauuugaucucuuuaaaacuuucauccaagauguaugguuguaaguugcuuaccuuguccauuuccacuauugucaacauuagccagacacaaacagccuugaucaaauucuucuuuaucucccagaauaguagaccaccaaucacgggcuuuaaauaaagacauuuucuuucacacuaaaaagaaaacauuuauaauaaucuacuucacacuaugaacuaauaauuaugucuuaaggcauagcaaauuaaacuuggacagaucugagaaggacauuucuauauuaacuuuuuaauauuuuguacacauauuugaaaccacaaauccaaauggcuggaagcauuaaucagauauuuugcaacaccguuaguaaauugggcugagaaauuauacauuuauguugugcuaauucucucuucuaaaacauuuaggagagaacugcagaaaauaacaaaagaacagauucuuuggaggaucaagauucaaauuccaucagcacuauuuaacauguaagucuucagugaaauaccuaacuuccuuucagucuagucauuggcgagacugcacuagaguuggcccuuuguaccuguggaagauugguuccaagaccccacagaugaaaaauccccagaugcucaagucccuuauuauauauaaugaccuaguauaccuaguacagucagucuuccauauccacagguuucaaucugcaguugguugaauccauggaugugaaacccggggacacggagggccaacuccaucuccuauuacaaagaguugcugagacaaaugagaucaaaugcauuagugacuagcccuggaacugguaugcuauagguacucaaaaagcauucacuuccucuugcuauguuaguuauagaaaggcaagauagaagagggaaauucacaccaaaaaagaagcaggaaaauugggcugcaggaccauuuauaccacuaacuauccguguguccuugggcaacccaaacaaccucuccuuacuuugauuucuuaucuagaaugagcauauaccagcccuaccuaccacugaguugcugauauggcagaugugaaagcacuuggaccuuuugaauuacaacacagcaucacaugcccugggacucuacaacaguucauuuauuuaacauaaaugagguuuuccuucauguuacaccgauuuaaaugguagcuacgaagugcagucaauucuccuuauucacgaaaguuauucuguauaaggccgccauaaacaaugaauuagcaaauacugaaccauugcuccuaggagaaacacaggguuagacagauuccugcaagcuucuaguaacaacauuuucuucaaccaaucaauacauaauguaguuuuuuguguguuucuauuuaaagauaccuuauuuaauauguauugcugauucauuacuaugggaaucaugcccaccagcacuagaacucaggcugaacuaaccuuaucuaauuucauguacagaugcuuuucaauuuaugaugggauuacaucucaauagauccaucauaaauugaaaauauuuuaagucaaaaacacauuuaauauaccagggaaaaaaucaaaauucaaaauuugaaguaugguuucuauugaauguguaucacucucacaacauccuaaaguugaaaaaucauaagucaaaccaugguaagucagggaccaucugucuguucuccacaagauacaucacagccuucuugcuuuuaggaacauuagacagcacuucaguauuacauuugcagaccauuuuaaacagugaaaacaccacaucccccuccaaaaacaaccuacgaaaaugugggagaaaacaugacacuaaauacuguagaccaugaaaggacacuuguuuacgguaugagaacugaaacaagaaagccauuguuuaacaucagcugggaacaugugcaucaggugacucaauuuuuacuccuuugcacuugaucacaaaugaccacaaaagcaucgcaagcacugauuuggggguuacaaauaaauuuuagcaaguaggcaaauucacaaaugauacagagucugccaauaaugaggaucagcucuacuuuuuuaaaauguagaccaaccugccucuuaaaguaagcauuccacaugagcuaaucauagaaaccaaggucauuuguuuuuauacaaaguuggccaagaaauuggcuguaaauaauguggugggaaaguauagccucuagaggcaaccugugugaguuugaauuccugugccaccacauguuaaccaugcaaccaguggaagguuacuaaaaguuacugaacaucucuguacuuucgcuuucucauuuacaaaauaaagguaagagugguguugugaugauuaaauaagaaugcaguuuccuacagaacuggaaaaaauaugugcaagucauauauaugauaaggaauuaauauccaggauacauaaagaacuccuacaacucaacaacaacaacaaaaacaaaccaucccauuaaaaaaugggcaaaagaaccugaacagacacaucuccaaagaagauacacaaaugagcugggugcgguggcucauacuuguaaucccagcaucuugggaggcagaggcaggaggaucacuuggggccaagaguucaagaccagccuggccaacauagugaaaccucaucucuacuaaaauacaaaaauuagccaggcaugguagugggcaccuguaaucccagccacucaggaggcuaaggcaaaagaacugcuugaacccaggaggcggagguugcagugagccaaggucaugccacuguacuccagccuggguuacggagugaggcucugucucaaacaacaacaaaaaagauauacaaauggccaaggagcauaugaaaagaugcucaaaaucacuaauuuugaacugaaaaucaguucaaaauuuuugauuugcauaucaaaacaauaucaccucacauccauuaucaaaaaaaacaaaaauauauucgaccuaagaaugaugauugcaagaagaaaaaaacacaaaauaacaaguguuggcaaggacauggagaaauuggaaucucuguacgcuguuggugggaauauaaaaugguguagcuacuauggaaaacaguggguaggucccacaaaaaauuaaacauagggccgggcacaguggcucaggccuguaaucccagcacuuugggaugccaaggcggguggaucaugaggucaggagaucgagaccauccuggcuaacacagugauaccccgucucuacuaaaaauauaaaaacuuagccaggugugguggcaggcgccuguagucccagcuacucgggaggcuaaggcaagagaaugccaugaaccugggaggcagagguugcagugagccgagaucgcgccacugcacuccugccugggcgacagagcgagacuccaucucaaaaaaaaaaaaguuaaaccuagaaauuuugauccagccaucccacuucuugguggauauccaaaagaauuaaagacaaucucagagagauauuuuuacacacggauuuacuguaucauaauucacaauaaccaagaggcagaaccaaccuaaacauccaucaauggauaaauggauaaagaaaaugugguauacccauacaauggaauauuaugcagccuuaaaaaggaaggaaacugacaucugcuauguagaugaaccuugaggacaucauguuaaguaaaauaagccagucacaaaaagacaaauaccauaugauuccacuuaugugagguaccuagaauagucacagaaacauuaagaauggugauugucaggggcuagggagaaaggagaacuguuaauagguauauaguguugacuucgcaagaugagaaguucuggagauugguugcacaauaaugucaauuuacuuaccauuacugaacuauauaguuaaaaaugguuagauguucaauuuuaugucacauuauuuuaccacaauuaaaaauaaaaaauauacaguuuuaguuuuuuacaaaaaggaauacaguagaccacuuaguacaauaccuggcacauaauaagcacucaauaaguguuagccauugcucugguuuugauccccuuuuaugauguuuuaaacuuacauuaaagaaaaaaacucaguguucugguuaaacacacuaugguacaucuacaccauaccaauauaacuugagaauuuaggccaggcgcgguggcucacaccuguaaucccagcacuuugggaggccgaggcgggcggaucacgaggucaggagaucaaaaccaucuuggcuaacacggugaaaccccgucucuacuaagaauacaaaaaauuagccgggcggguagucccaguuacucgggaagcugaggcaggagaauggcaugaacccgggaggcagagcuugcagugagccgagauagcaccacugcaguccggccugggcaaaagagcgagacuccaucucgagaaaaaaaaaaagaauuuaaaacauaacugacacuugcaacuuggauagacugcaagagcauuaugcugaaugaaaaaaaaauccaaaaagcuaaaauauuaaauaauuacauuucuaacucucaaaaugacaaaaucauacuaauguagaacagauaggugguugcuagguuuacaggaggguguaacuaugaggagcuaauaauaaaaggcaauuucuuugggauuaauuucuuagaacuaucuacaaaaaaaaagugcaucuaacauaaaaccugguaaaauccaaaucaaaucuauaguuuaacuuuaguauuauacuaacaucaauuuaauggugggcugggcacgguggcuaacaucuauaauuagccugggcaacauagggagaccccaucucuacaaggaauaaaaaaauuagaugggcauagugguccaugccuguagucccaacuacugucaggagucugaggugagaggaucaauugagcccaggaguucgaggcugcagugagcuuuuuuggggagugaggaauggagucuugcucugucacccaggcuggaguauaguggcacaaucccaacucacugcaaccucuaccucccaaguucaggcgaucuccugccucagccucucaaguagcugggauuacagacaccugccaacacgcccagcuaauuuuuguauuuuaguagagauggaguuuccccauguugaccaggcuggucuccaacuccugaccucaagcaauccacccaucucggccucccaaagugguggaauuauaggcgugaaccaccaugccagccugcagugagcuuugaucaagacacagcacuccagccuauguaacagagacccagucucuacgaaaaaaacaaauuugaugguuuugaucacuguacuguuuucauugggaaaccauuauuuuugcaacuucuaagugagucuaaaauuauuucaaaaugauuaguuuaaaaaaacaaauaccaggagaaaaaagaaagaaaauuccauccauaguacucugcuuaugcuaagaaagaaguuagauaaacacugggaguugauggaagugaacaaauaucuaacagguaaacaaauuuaucaugaguuucaaaauaugugggagacuuucugaaaaauauuugcaccauuuguuauuacuaaugacauuauauaaccauacaaauugucagauuacuaaauuucaaaucugguagcaagcauucaaaaaacauaauaauaucuguauuacacuuuuauuggauuuuugagaggaaaguaacaguauucaauaaaucccauauauucucacuauauaugccaaguaccuaggagaauuguaauaugccauauuacuggacuaugagaaugaggauacaucauucacuugcagcucagagcaaaauauuacccaaauucacacuugaaaugccaaugauucccuaggaggacucacaggacacagcauagucaucuucauggcuaugaaggauggcuacgauaaaaggaugaaaagcauaaucaggaaagggaaaaggugcaugaugggauaucugaagaaaaccagacacaagcuuagaagacaaaggagugguacagagguuaagaagaggaggaauccggcugggugcgguggcucaugccuguaaucccagcacuuugggaggccgaggcaggcagaucacgaggucaggagaucgagaccauccuggcuaacacggugaaaccccaucucuacuaaaaauacaaaaaauuagccgggugugguggcgggugccuguagucccagcuacucgggaggcugaggcaggagaacggcaugaaccaggagguggagcuugcagugagccaagaucacgccacugcacuucagccugggugacagagugagacuccaucuccaaaaaaaagaaaaagaagaggaaucuaccagaagcuuaacaggggcauucacugagaucaaaacaaagccagaagugaguuaucucgaaggaaguggaaaaaaaaaauguaucuagaaaaagggagugaccaacuguaucaagugcuccugauacaccauaaaggaugaagacuuggaggcauaagcucuauugggagacauagcuaaggacagaaauuaguaguaaccaaccaaagaguaagugauccucugcucacuccugcaucagccgguucaaaagucucaaggagagaaaauaagaaaguaagaacuauacaacacucaaagggggucuuaccuuugccuaacacagacagaaaagaaaacuucauggggccugccuagagaacauacuaaaccaaguaaaggagaaagagaagagauuuuucugucaaugauaaugaaugauacauuuuuaaaaagucaaaauccucagauaagugaccacaagagacaaagcuggaguuugaauauaaauacugcaucaagucaaaguagcuauccuaugaaaauggccuuaaaaaccugugagucaauaaauuuuuucagcuugcuagaaugaauacaaaaaauccuccaauauuaugaucuagugggcuguuaaaauaaaaaagacaaaaaaagaaucaaaagaauccuccaauaugaaagaacuuuccaacaaugucuacaaauaggaaugccuauagaagacauucauuucucauuaacuuguuuuuuuguuuuguuuuguuuuuuguuuuuguuuuugagacagaguuucacucuuguugcccaggcuggagugcaauggcacaaucucagcucaccgcaaccuccacuuccuggguucaagcaauucuccugccucagccuccugaauagcugguauuacaggcaugcgccaccacgcccagcuaauuuuguauuuuuaguagagacgggguuucuccauguuggucaggcuggucuugaacuccugaacuuaggugauccgccgaccucagccucccaaagugcugggauuacaggcaugagccaccacaccuggccucauuucucauuaacuucuaaccgaaaauuagaaaucuacuuguacugacaaaauaacaaaggcaucauuuacauccuucuuggcaaggcacagugguucaugucuguaaugccagcacuuugagaggccaaggcaggagaaucaguucaggccaggaguuugagacgagccugggcaacauagcaagaccccaucuuucccccccaccaaaaaaaaaauauuagccagucuccacuagagcccaggaguugaggcuacagugagccaugauugcaccccugcacuccagccuggacaacaaagccagacccugucucuuaaaaauauauauaucauuauuguuucuccugcucuaucaauuuuuccuuauucacccaccacuucguuagcuccugaaaucccccuuuucacagaguuuggucccuugcuacuccagguguaaucccuggaucagcagcaucuguaucacucaaaagcuuaugagaaauguugaaucucauccuccccaaacaguaucuccaggugaaucacaugcaccuuaagguugaagaggcacugauguaacugauaccugauugccuaaguggauauuuucuuacagcagagcuccaguuuuccccuucuuuuucagaggaccucugccguccguuaccuuuugagggcuuaaaaaaaaucauuuuucaaaucaaagaccuaaaacagcuggaaaguauccaucaaucagcugguccucucauuuuauaggagaggcccagauaaguuacaugauucccauaccucacacagcuaauugcaggaccuugcuucugcauacucucucccucgucucuaguccccugccucauuaggcugccaauaaucugcaauuuaauaucaaaaaacugaaaaagcauguggauagaaugauuuuuguguuguuuguuugcuuuauuuuaaucuuuaaagacuguggaggaagggcuaauuuuuaaaccuauguccaacaaauggcucuuccucacaagaccauggcuaccuuaauuauuucagaacaacaauauuucagagcaacaacaaugacuuucaugccagggcaaacauaaggucaugcauagcagaauuucauaaauuccauuacauaaacaucuuguauguuuguucccccaauguccgaaguguuaucaugcaccauuguagacgauaauuuauugaacaauaaggacuuacaucuuuaaagaauuaaugaacaauagaaaaaaacaacaauuugggcugauaaucaauagucaucauuuguuucccaagugcgucucuccaguuucaaagguagaagcagagaaggagcacugcccacucccaagaaauuaagaaaccacaaacucucaucaguacaaaguugggauaccacuaauuuccuuugauaaaaaaauggguggauuucaaaagacaacuuaggcagcagugauggcagccacugcgaagacacuggcugcagcgggggaggcauggcaggggcugcccacucugcggagccagugggggcugggaacaggcaggagccccgcccccuaccagguuggagggccaggagcccugcgcuccugggcacaucugcagcuacccaaucacagcuccagacccaagcaucccugcacugucgggggcccgggaagcaccccugccccugcaguuuggaagugcccacucccgcucccuggccucucccaacucccagugcccacuccaauuucgaaccaaaguugaagccgagcccaggugcugucgcaacccggccaggugugugugcgcucagggcagugcugauacaccaguccccuaacaccucgguccccuccggacucugggcaccgacagcacaggaaggacacccaggaggagcugagggcuuggguauaauccacugauacacccaagaacagaggagacccucugcugacucaagaagaaauaaaaaaucuaaauagauccauaauaaauaaagaaauugaauuaguaaucaaaaaacuauccacaaagaaaaggccaggccaagacagauccacugguggacucuacuaaacaauuaaagcaaaauuaucccaauucuucaaaaaccacuccaaaaaauaaaagaggagaggauacuucccaccucauuuuauaaaucuaauuacccugagccaaaaccaaacacaucacaagaaaacaauagaccaauaucccuuaugcauauggaugcaaaaauccucaacaaaauacuacuagcuaauugaauccaauaauauauaaaaaguauuauauaacaugacuaaaugguguugccugaggaaugcaagguaggcauccuuaacauccagaaaugaguuaauguaaaaucaauacaaucuaaaucaaaagccacuugaucaccuccauaaauccaacucuuccauuauaaaaaaacacucaaaacacuaggaauagaagguuccucacacugauaaaagacaucuaugcaaaauccacagcuuacaucauacuuaauaguguaaaccgaacacuuuccuccuaagaucaggcacaagacaaggaugucugcauucaccacuucuauucaaaaucauacuggaugcucucaacuauagcaauuagguaagaaaaggaaauaaaaggcuuccaaauuggaaaaaaagaaguaaaacuaucuuuacucacagaugacauaaucuuguauauagaaaauccuaaggaauuugggaaaaaacuauuagaacuaauaaaugaguuaagcaagguugcaggauauaaaauaaauauacaaauauccaugauauuucuauauucuugcaaugaacaauccaaaaugaaauuuuaaaaauaauuacauuuacaauagcacccaaaagaguaaaauacauaaguuagccagguaugcuggugcgcaccuguaauacuagcuacacaggaggcugaggcaagaggaucacuucagcucaggaguucaagauuacagugagcugugaucacaccacuacacuccagccugggcaacagagaaagaccccaucucaaaaaacaaaaaaaaaaagaauacuuaggaauaaauuuaacaaaagaaguguaaaacuuauacucugaaaacuaugaaaacauuguuauagaaauuaaagaagaucuaaauaaauggaaaacaucucauguucauggaucugaagacucaauauuguuaggacggcaauacuucccaaaucaaucuacagauucaaugcaaucccuaucagauucccagauggcuucucuguagaaaucaacaagguuauucuaaaauuuguauggaauuuccagggacccagaauagcaaaaacaaucucaaaauuaaaaaagaacaaagguagagaacucacacuuccccauaucaaaacuuacuaaagcaacaauaauuaagccaguauggcacuagcauaaggauagacauaaacauaaauggaaaauacugagaguccagaaauaaacccauacaucuaugaucaacugauuuucaacaaaggugccacgaucauucaaagaguaauugcaacaaaugggucuaagaugaccgaauagugacaugcagaagaaugaaaucggacacuuaccucgaauaauauuuuuaaaauuaacucaaaauaugucaaagaucuaaguauaagcuaauguauagcuaaaacuauaaacucuugaaacucuuagaagacuauauaaauaaaucuuuaugaccucagauuuggcaauggauucuuagauuugacaccagaaacgugagcaauaaaaaauaaauaagggcaaggcaugguggcuaaugccuguaauuccaauacuuugagaggccaaggcaggaggacugcuugagccagaagucugagcccagccugugcaacaugaugagaccccaucacuacaaaaaauauaaaaauuagccaggugcaguggugugugccuguagucccagcuacuggggaggcuaaggugggagaauugcuugacacuggaaggcugaggcuacagagagccaugauugcaccacugcacuccagccuggaugacagagcaagacccugucucaaaauaaauaaauaaagccaggugcaguggcugacgccuguaaucccaacacuuugggaggcugaggcaaggaaacugcuuaagccugagagauugagaagagccugggcaacaaagcgagaccgcaucuauacaaaaaagaaaaaauaagcugggcaugguugugugugccuauaaucccagcuacuugagaggcugaggcaggaguuugaggauugagcccaagaguuugagguugcugugagcuaaaaucaugccaccacaccucucagcuugggcagcagagugagacucuaucucaaaaaaacaaaauaaaugaauaaaguagacuuuaucaaaacuaaaaacuuuuagguuucaaaggucaccaucaagaagaugaaaugaugggagaaaauauuugcaaaucauguaucugauaauauacaagaacucauacaacucaguaauuuaaaaaagucaauuaaaaaugaacaaugggucugaauagguauuuuuccaaguaagauauacaaauggccaauaagaacauaaaaagaugcucaaggccaggcgcaguggcucacgccuguaaucccagcacguugggaggccaagguggguggaucaccugaggccagaaguucgagaccagccuggccaacauggugaaaccccaucuccacuaaaaauacaaaaaaaaaaaaaaaaaaaaauagccaggcgugauggcaggugccuguaagcccaauuacuugggaggcugaggcaggagaauugcuugaaccuggaggcagggguugcagugggccaaaaccacaccauugcacuccagccuagggaacaagagcaaaacuccguuucaaaaaaaaaaugcucagcauaauuagucauuagggaaacacaaaucaaaacuaugagauaugacuucacaccuacuaugacagaaucgaagucagauaguaauaagcauuggugaggauguaaagaaaucagagcccucauauacugcuagugagaaugcaaaacgaugcaaccacuuuggaaaggaaucuagaaguuccucuaacacuuaaacacagaauuaccauaugacccagcaaucugacacugaaguaucuauccaagggcaaugaaaacauaugugcauacaaaaaaacuuacacauaaauguuuauaguagcauuauucauaauaucuaaaauuuggaaacaacccaaauguccaucagcugaugaauauauaaacaaaaggaagcauccauacaguggaauauuauuuggccauaaaaaagaaaagaacaaaauacugauauauguuacaacauaaauaaauaaaagcauauagguuuuagaaucagacauaucuggcucuuaaaaacaugcuaaguuaaagaagccaguaacaaaaggccaccuauuauaugauucuguuuauauaaaauauccaggauaggcaaauucauaaagacagaaaguagauucuuaguugcuuaggucuggggguaggggagaaggaagagagaaggagaguuauagcuaagggaugcgagguuucuuuuugaguugauaaaaauauuccaaacuuggcugugguaaugguuacauguaucugugaauauacaaaaaaggaacugaauuuuauguguuaaaugggugaauuguaugguauuugaauuguauuucaacaaagcuguuuuuuuuuaaagauaacaaaugaugauggauacauggggguucauuuuguuauucuucaugcuuuugguuaugcuucaaauuccccauaaacuuucauuuuuuuuuaaagcagaacacuccuguauuuuggccacauuuaccauuaggccaggugugguggcacacaccuguaaucccagcacuuugggaggccaaggcggauugaucacuugagcuaaggaguucaggaccagccugcgcaacauagugagaccucaucuuugccaagcauggcagaaaaaauaaaaauuauuacaacuuuuuuaaauauuaaaaaaagaacaauagcaaauuaaauucagaaggucagcaaaauaaauucugcccuuucuccuggaagacaucccaagucaucaagaaaaugaaaaauuagccauaaauugagacacaaauaaaaugcuaaucuguauuccaaucuaggaaagauauaggccuugacauugagauauuaagauaagcagguaggugugggaggucugguacugacagguuaggaaagaugguaaggaacaauaguaauaaaacauuuuuuggucaugaaaccuggcuuuuggguuacaaaauaaacaaaaaguguuuuaaauaacaaaaaauaaaauauguauacaauguuuuuuuaauucaguuuaguuaacugucuugaauaaggaaccgagguuugcauuuuauccccuuuucauucaguguugauuuccaguugcucacugauuugucuuuaaguaauuggaaaauaaaaaccagguuuuuaaugacuucgccuuaaaggaaaguaucuacuaaucauuuacuaaagccagucaggauucuaaaugcuuugcaagcauucuauuuugauauucauaacaaaacuacaaaguaaauuguagauacuauuauucagguauccuugaauacagagaaguuaagaaauccgugccaguggucucacuaguuaagugaugugcgguaccuaaacccagacugucuacuccagaacccuaaacaaacggccuaugcacacgccccuccauguagacuauaaaagcaauagcucuauucacacuaauucuaaacacuacaaguucaaacuacaggcaaguaugucauaaauuugauuaaauuguuaaaggaugauuagaagacaauaauuugaagguuguaacaggugcaguccuauaaacaggcauaacagauuaguuucuaaugccuuauuagaauaauaaaugggagauaaucuccuuauccccuaaacuccagaaauucucuucuauacucuucacuugacacuuuuuuguuuugaauacuuuuuuuucuacaacaaguuuacucagauuuagguuucauuuaagagguggcugaccuuuuuuugcugaccuucugaauuuaauuugcuauuguucuuuuuuuaauauuuuaaaaaguuuuaauaauuuuuauuuuuucugccaugcucggcaaagacgaggucucacuauguugcccaggcuggucuugaacaccucauugaccuaguccuacaauaugaucagcugugaaaacaauaaccccaaagaaugcuguggaaaaaacauacagguuugaaggucaguucuggaaacagaccuugcagcuguuguucauuuucagagcuuugcuuucuccagguuaugccagugucacaccaaauuuaagaaaguagaaaucaggucuuccagucaaagaaagaugacaaaugcauguaguguucaaaagaaguauacugcuuuugaaggcaauaauacaagggcucacuguuggaauuuucaacaaaagacucaaagggcaaaauaacacaaaauuuggaguaggacagcucugggugcacuuucugaccacguuacacuacaugaucuuaaacaagucccuuauccucuaguaucucaauuguucuaggguggaggaggauaaaauggcucaacccauagcaaguacucaauagaugucaguaauaacccaacaguagaaacagugcuaguaggagagacagugguaguagugguaguugaaagagacggugguaguguguucugugcaagacacaauuacgaaugccaaacucacccucuggaccgaaauuuuaaaugggacucacaaagacugauaguaaucacuaauggaaauguuauuaaccagcagggauguuuuauaauaauuucauguauuuuaauaauuuucaaaaauauuucaaaguauucuaaagcguaagacuuacuacaucccucaaaagguguaaaaguuuuaaaauuacuauauauacuauugcuguuggauuuuuucccuucagugagcauuucuaucaagaaguuguaccauaaauauaaguguauaguuguaauuuaaccacgacaauuacacacaaggaaaaaucccuuaaacucugacaaauaacuuguaacuuauuuucaaaauaaaguuuuuuaaaauucuucuuuaaaaacuucuggguuuucuaguuuuuuuuuuaauucuuccguauauucaugaaaaaaaucucaguaauuguuuucuuuauaaaaugcuaauaaguuagaaaaucuuucucugaaugcuggccaacuuaagacccauagcuuauccugcagcaucuuucaaguuguuuaucaaugaggacauguaagauguguauaccuguaagauacgguuucauuuuuaaaguaaaagugagauacccaaaaaaauacauuucuccaggaaauugaagucaaaggcaggauuugacuggcaggaggugcugauaaaaucagcgcagcucaucuaaacuguuguggucuccaaguaacaagaggagaaacaauaauccuauuacuagaaggauuggggguauuaguacaugcauccuacuucagucguaggcugggaacugcuuugcccauuuacucacagaccuguugaagugucucaggaggaugcucaugcuccaagugacauuccucaauggaauccuuaaaaauucucaucccuuuuuucucaaaaguacucacagaaucucauacacuuugugcuccuaguguuuguuuauuucagugcaaacaucuaagaaaucaaucaccuuacagacuccaaaccauuauacugcauuagagaaucuuguucacaaaauaaaacauggaaaggguauucauguacccgaaguuuaacaacagacauaccaucuuaccugaugccacgucagaugagcucugccccaccuuucugcgaacccucguucggcaaauuuugcuuuaugaacgccugacaaggucccagugauggagcagagggagcaagaacggacggugcagagaaaagcaaccuuuagcuucacuauucccucucguccuccagcugaaaguuguuccacgucccgggcaaagagagagccccaccaggcagcaccaccagcuccacagaguuggagugauucccccaagaagcuccccugcgccccccgucacccccagagaccagcagaggaaacggcaucuaucccuuggaagacacuaggcaggcgagaacaaaugcaaguccugcugcucacaccgaggaggaaaggauggaggaggcggugaaugggauguagcagaaacccgacggccgcagcggaagggacaccuccccucuccagccuaacucugagccaucuucgcccuguugucauagcacuuacaacggacgccacu

SEQ ID NO: 192037 - RNA, 12313 nt, Homo sapiens
gcgagcgcaacggaggucgaaggcguucagacucuuagcugaacgcggagcugcggcggcuaugcuguggagcggcugccggcguuucggggcgcgccucggcugccugcccggcggucuccggguccucguccagaccggccaccggagcuugaccuccugcaucgaccguaaggaucuccuggcgggcaguaggacagguguccagaaccccggcggacauauguccgcgaggggcugcagucuccccguuccauccagucaccccggcgucagcuccccuuccggccagucacccccccggccuggcucccuacuccggccggucacccccggccuggcugcccccuccggucggucaccaccauccggguccccaucuggcccgucaccccugcccggguccuccuccggccggucacccccgccccgguccuccuccggccggucacccccgccccgguccuccuccggccggucaccccccgcagguuccccuccggccggucauccccccgcagguuccccuccggcccggguccuccugcggccggucacccucggaugcuuagagaagugaagaaacuuggggcuugguuguuguuggguugguugguuuuuaaucauaacaguaggucauaaaagcagugagaauauaagaagcuggcugggugcugauggugacaacugcacaagaacuccaggucauacaagauuugcucacacacaaagauuugguaucuuaacaccucuggcuauaagacacuuuuaguguugaaacucaugcaggaaaaauaauuauuauugccagugggaaacucuaccagagcugacaaacuugagugucuuuaggcucugaacaguaauuugaauguagcgaggagugguggagacccggccaguuugugacuucucugccaagaauguuuauaaacacuuuuuucuucugaaauauuuuuaaauuuauuuuaaauaaauggcaguuuucuuuacaacagaauaagucccuuagauaucagaucuauaaaguacaguaaggcauagaauacuguuuucuucugaauguccuaaaacucauucaagaggugcugcccuggccuagcgcuuagaauuugauaacccagauuacccugguugauaccgaagcagauaaggaauuauuuagagguggguuuuguuauuguuugcaucuugcuuacacuugaguggcucugcagucaaaggcuuuucccauuucauuuggaguguuuuucuauuuagcuuuaccuuuuuaguguauauguauuggcaucuugagcucugcuaguaacuauguauuggcaucuugaacucugcuaguaacuggcaaaguucaugaguggugguauuuguuuuguuuuuauacuguauuuccuucugggaacuuguguuuacuuaugcauaugauuugcauaaaacuauuuccuuccauuagaaugcaacucagauuuauuucuuaagccugugguuccuugaacuauuuguuuuaggaaguagccauuuacagaagaagaagauuuguuaacauuuaaugagcucuugcuaggauugaaauagucauccuuugugugaauggaucuuauuuauuuauuuuuuugagauggagucucuuucuguugcccaggcuggaguacaguggugcgaucucaacucaccgcaaccucugccccacggguucaagcaauucuugugccucagccucccaaguagcugggauuacagcacaugccaccaugcccagcuaauuuuuauauuuuuaguagagacgggguuucaccauguuggacaagcuggacuugaacuccugaccucaagugauccaccugccuuggccuccccaaagucugggauuacaggcaugagccacugcgccuggcuggaucauauuuauuuuuguaaccccagcacugcuaccuaguaaacacccaauaaacauucuuuuggaaaugaucuuugagccauggucuacaguaacagcaacccuuguacaaaauugugugaauaaauggccugaccccagucagagaaccaugaauuguuuaucccuaacucuguuccugaggguaauacccaacauagguuucugcucugaguuucucaaggcagccuaaucguuaauccucagaacucuucauuucugacuuucccauuuuaaugagaguacugaucacagaaagcagugcccucuccaggcucgcauagccagccauuacugaugcccagauuugccccaaggaacagacucuggcaccugcccuuguguucuucugugaggacugcaucgcuuguaggcacugaaguaaauuauugccaaguguggcgccauagucuucccauagugcucuuuuuucuuuuuuucuucuuuugaaacagagucuugcucugucacccaggcuagagugcaauggcacaaucucagcucacugcaaccucugccuccuggguucaagcgauucuccugucucacccucccaaaguagcugggauuacaggcaugcgccaccacacccagcuaauuuuuguauuuuuaguagaggcgggguuuuuccauguuggucaggcuggucuugagcuccugaccucaggugaucugcccgccucggccuccugaagugcugggauuauaggcgugaaccaucacgcccagcccauagugcucuucagugucaguuauaaugaccaaaguucuagcacuguggccucaaccucuaggucuacaacugcauuuuacuaagugcuaggauaagagaugucuggaaguccccuauccuguucuagguugaucuggaugugugcuagaacuguccuuucuccauaugacaaguggaauaacgacagaagcugccauucucuagcuguuaaaggcuauaccguguaugggaaauacuacaguagauccacuuucacaacuucguggugcuucuuguuggcaacaccuuguuggcaacacugacccuguccuagaacaguauaugcaauccugcccacagcuuccaugggacuuaaugaagagcagaaagaauuucaaaaaguggccuuugacuuugcugcccgagagauggcuccaaauauggcagagugggaccagaagguaggcguuuuucuugugcuuagacguucuaacaacagaugucucaggcagaccuuuaucuuugucuccugauaauguaauuguuaaaugucuccuccacuuaccaacucuuacugcaagugagaauaccgguaguggaugauuuuuccuagaaggcauccugaucaucuuguacauaacuuuuuuuuuguuaguugaauaaagauuuggauauaaaacuaaggcaguucuauagauaauaaaaagaaacuucuuaaugccagaacaaguuuuuacaggacccauguuaacugauaaccacuguaagaugacaaacaggcauauuaagagaauucauacgcugucgcaugugcaagccuccuaaucccucacugugcccucuaaaaggaaggccgucucugaaucagcugcugaucacccugcucucuuuuguacauaggagcuguucccaguggaugugaugcggaaggcagcccagcuaggcuucggaggggucuacauacaaacagaugugggcgggucugggcugucacgucuugauaccucugucauuuuugaagccuuggcuacaggcugcaccagcaccacagccuauauaagcauccacaagugagugcccaagcuuggaaggcacaaugaagugcucacucgggcugacugugagaguucagauucguaggaaaaagauugaucuuuugaagcugaguguccucaaggaacuggacuuaaaaguacacucuaggggccgggcgcaguggcucgugccuguaaucccagcacuuugggaggccaaggcaggcagaucacgaggucaggaguuugagaccagccuggccaacguggugaaaccccgucccugcuaaaaauacaaaaaauuagccgggugugguggcuggcgccuguagucccagcuacucgggaggcugaggcaggaggauggugugaacccgggaggcggagcuugcagugagccgagauggaccacugcacuccagccugggcgacagagcgagacuccaucucaaaaaaaauaaauaaauaaaauaaguacacgcuaggucuguugcugccuguuggacuugauucugucauccuguguauugcuuagggaaucaggucagccagcuuucucagaaaucuuauuuugagcugguaccaggagacuucuccaauagagugaucaggguccucucacccuuuuauuuauuuauuuauuuuuaagacagagucucgcucuguugcccaggcuagggugcaguggcaugaccucggcucacugcaaccuccgucuccccgguucaagugauucuccugccucagccuccugaguagcugggauuacaggcacgugccaccacaccuggcuaauuuuuuuucauauuuaguagagaugggguuucaccauguuagucaggcuggucucaaacuccugaccuuguguucugccugccucggccucccauagugcugggauuacagaugugagccaccgcacccggccccucucacccuuuuccucaauccaaagauggaacugccagugauuugaggaaguaauagaaacuacuaauagaaagcacauauaacucugauuuuuagaggcucguguaaccuaacuagaaguaguacaaacgugcuggugagaaguaccucagccugguuaucucuggguaguccuuauuccaggaauauguuuuaauccaccguuugccuuuaaagagucuucccaauugugacucuccccuucccacucuucugcuuuacuccacugcccugcccuuuguucucuuuccccuucucccccauuuuuuuuucuuuuccaucuuuauuucugucauugucuuuucuucuugguguaccuaucagcaugugugccuggaugauugauagcuucggaaaugaggaacagaggcacaaauuuugcccaccgcucuguaccauggagaaguuugcuuccuacugccucacugaaccaggugaauuugccacacugcacugagauauagcagggagagaugcuuccugcucagauggcauuaccgagcacuccuuccagccucuugacaugucgagccacuguuuaucuagcuguuugguugaggaguaauagaguccugugaccugaugucacaaggaccaagaagccuaucugguguguugggagguaggcaguggccugacugguaugagcaguuuccaccaaguacagagaguuccuuuggccacuuggguuuugcagugacacacucugagcagggucuguuuagagaagauuuccuagaagauagaauugugcugggcucccucgaccucacugacuuucucaccuucucucugcugccuuuugaucccuccucaggaagugggagugaugcugccucucuucugaccuccgcuaagaaacagggagaucauuacauccucaauggcuccaagguacuagcgugcguccucccagagcacuuuggagauuguucccagcuuccuccugacauccucugguuccuucacauccgcggguuaauacucccauaggauuuuuauguguugggaagagaaccucugacccauuucucuuucuuuauucucacuguuuguaucucuccuaaucugauuccagaucauuucguugacuuuugucuauccuuuuuauacucucuuggacugccucucugaucugcagucacugcagcgaccuuuuaccucaccucagucucugugccauuggaccuuauugucagucucugugccauuggaccuuauugucagucucugugccauuggaccuuauugucagucucugugccauuggaccuuauugucagucucugugccauuggaccuuauugucagucucugugccauuggaccuuauugucaggaggacccagugguguucccagacgcugugagaacucaagcauucccugguccuuuugcaccccuuuuacccccacaggccuucaucaguggugcuggugagucagacaucuauguggucaugugccgaacaggaggaccaggccccaagggcaucucaugcauaguuguugagaaggggaccccuggccucagcuuuggcaagaaggagaaaaaggugaguggcuguuggacaggaaacaauucagguuaugagacucugccaccugccagcccaacuccugcucuauuucagaaaacagguuugcauacuugcuaaccuaccuuugaagcaguugcuucuauuaggauuuucaacaggagcauaugaaauacaacagggcauuauuaaacacuaggccucuggggaaagugacaauguuugccaguaaauucuucaagccaccugugaguguucugaccucuccugccucugcuuuuggccuguguuccuuauccagcugcuuacguuggugcacuuuguugcuccaggaagagacgcuuagagaagaccugguguuggccacaagucucaguaauggaaggcguguggucccuuuugcuucuuugauuaaaaauaaaguaaaacucauuggagaugauuguggguauuucagcaacccaagaaggacacuuagguacuguaaguaauuugaaaaguaagauacuucuaggauuaagagccgccauggccagggcaugaacaggagacuugugaucauguaaccguaauugguaauaagggcucaagacccauucagauuuuuuagaccagaugcucaaagcagucaucucucucuaguuuguacuguuauggggggacuuugugagagaaggcagguaaugaaaugaccccuaaguguaccucuuucucacagcuccucggguuucuguauuuuccuacaggauccuuccugauccucuguaacuguaaggcauuaugcauuuuagcauccccuucucuuugguaacacagcaaccauuuccuaggcuucuacugugugugaagcccaugcuaacuccugggcaggaagaccuucaguaaaaggcuuagaaauggaguuuauccuaucaacaaaagagagcaaggaaaugauguaaaggcagucuauuuucagagccagagaggaacugggagauuguagauaguuugugguuuucaauuagaggcacugaaauugggggcaguuggugucacaauccuaaaagaaguugugagaaguguuuguagguuagucagguagaguagacauuaguagauucucuuaauaaguuagaaaauguuuagcugaaacagguaucuuucugagugcugacaggccuuuaaaccugaacuuuuucuuuuuccucauuuuaaguucuugugggucuaagucuugggugcugaaacccauaccucacaggcucccguccccagggaaggccgcccuaccugcuggauuguugggcaaccacgcagucccugauuuuugccaggugggguggaacucccagccaacacgagcugugaucuucgaagacugugcugucccuguggccaacagaauugggagcgaggggcagggcuuccucauugccgugagaggacugaacggagggaggaucaauauuggugagauacgcagggguguggcagggagguagcgguccgggacaggcacugcuguuuuccagcuugguuggaacgucggcgcucuuccccucuagcuuccugcucccugggggcugcccacgccucugucauccucacccgagaccaccucaauguccggaagcaguuuggagagccucuggccaguaaccagguaaccucugccuugccuccacauggcuuugcacuauuugcagcccgggaccugcucuagggcccacauuuccaggagagaagccaggaaauuccucugucagucccaccacuguccuagccagagcuugugcuuuauuucuguccaucuuuucuugggauaucuuuaacgauauuaaagugucgggugagugaaguggacuuagcacuuaaaagcaauaaauuuccucuauagaaaaagcaagagacuuugaagcuuuggaucacuuagaaaaggcgccuccgagaugucuuaccgaggcuccugcaccaggugcuggucuaagccccucagucuugucugguucucugcucccugugcugcaguacuugcaauucacacuggcugauauggcaacaaggcugguggccgcgcggcugaugguccgcaaugcagcaguggcucugcaggaggagaggaaggaugcaguggccuugugcuccauggccaagcucuuugcuacagaugaaugcuuugccguaagugauuccucuggcucuccugggauggacagggaacagcugcuaggcccaggggucuugagagacaugagucagauuuggaacccagcccuccuggaaucccacaaggaucaccuuaagcuuaaggauauaaaugaacucaugagcggccuaugugggagcucucaucgcuggcuuuuaggccugcugcaugccauuauacacuucauuaugucacuguuguuugguuguguucuaggcgagaaaccaccuuuggaagguucacagcagccccaauuuagcacucugccauguuuacauugucaggcugcauugccacuagggggaaccauagcuuuuuaucaucccagccaggguggcugugggcagcuucugccuggcagguaauaagggagaggggcagagggcuuugagucgccugucuggggggaacugacaaguuuaguaggugaacuucccuugucucuaaccauacagaauguggaggcccucuuugagcuuggcuguuugugguucuuucauggguuuauggcgggcugccagaucgugggcugggguaggaagggaagcugcuugcuccacagucuucccagaguccaagacgucuagucccugucucccugcagaucugcaaccaggccuugcagaugcacgggggcuacggcuaccugaaggauuacgcuguucagcaguacgugcgggacuccaggguccaccagauucuagaagguaaaaauugccagagguuauucucuucccuucagaacgggggcgggaucgcugcuuuccccacucucuguccccaugccuccugggccucagggugcagucaagcccugucugucucgaggcuuccuccucccucccguuccgcagagcuguucuggcaggggccuggaguccagagccgcagcuucgucccuuucggggggccucagaucgcucugcugcugcccuuuuccucuggagaucugcgagaagggugaacugagauaauggaugagaaagcauguugaaaaccacagccggggcuuuucucuaagguuaucgaguacgugguucucagggauccaagaacagugauggacaaggcaaaugugagccaguauggucaucaguagcucuauauugauuaucagccagauggccuaaaagauaccugucucaauauuacuaguguauuuuucaauaaaauaaaccaucacuauauggguaucuucuugguagucacagacauucuaucgaggaaacauggaagccguuggggucgggcucggagccuggcugucuccacucucuacagccagugcggaagucuugaaaugacacgacucuuggaaaagcaggaggggcagaggcuucuuugagugacuucggugaagcaacgugaggcugccuugcuggaaacauuauauaauggggcuucccugccccuuucacagcacccuucucaaaccucagccugugcuggaaucgccuggagggcaugggagcgcagauugcgggccucaaccccagagcuucugcuccagagggucuagugugggccugggaauuuguaucugcaacaagucuucaagugaggcugccacagcuugucugagaaccacacuuugagacccaccgcucugguguuaaugucagagucacaggcuaccacagguuagaccgcugcuuucuucugcaaaccucauuccagaaagauguuuaugggcucagucgccaguguucaaacugaauucccgagagucguuuuccuuccauuacucuuggaauugcuuucucacugagcuuuaugugcguaggaaacuucgccuucauucuaacucucucuccacccugcaauaauaagcaggaaaacauuuauuguaggccacaccaucacccacuuacagaagaauuggggcacucaucacuguaucacuuuguuucaucauggacuuuacuguuggauaaaucuacaguuuaugcuuuauuugagacgaugugacuacugauuccucgaggggguuuauauuucuuuuugcauuaaaggccacugcuaaaaaugaagcaaauaauugauacccuccuuucagggaaaauguuuucauucuuuuguaagucaguuuucugauuaccaaagaaauguguauuuauuguugaaaccuuauaaaauuaggaaaaguaggcugggugcgguagcuuaugucuauaaucgccgcacuuugggaggcugaggcggguggaucgcgugaggccaggaguucgagaccagcuuggccaacccggugaagccccgacugucuaaaauuauaaaaaguuagcugggcgugguggugcaugccuggaaucccagcuacucgagaggcugaggcaggaagaucgcuugaacccaggagguggagguugcagugagcugagauugcaccaucgcacuccagccugggugacagugagacuccaucuaaaaacaauacaaaaaauuagccgggccugguggggccugguggcacaugcuuguggucccagcuacucaggaggcugaggcaagagaauugcuugaaccuggggggcggagguugcagugagccaagaucacaccacugcacuccagccugggcgacagcaagacugucucaaaagaaaaguaaaagaaaaaaaaucacucauguuucuacauccagaauguuauuuugguacaucuccuuuuaggcauuuuacucugccuuuguugguacauuuuuaauuuuaauuagaauuauccuguauauacuguuuuuauucugccuuuuuaaacuuuauauaagcauuuuuaccaucagaagaaguuuuuaaaaaaguauuauuuccugacauuuuucaguacuuuguagagaagucucugauaaucucaucucucccaggcuaaaagcaaugauuguaguuuaaaucugcagcuacucugaacuaggccuggagcagccuggucagagcuuuacuaaacucucagacuuugcugcugugaaauucuuccuccuuccucccucuuacagguagcaaugaagugaugaggauacugaucucuagaagccugcuucaggaguagaacccacacuuguucuggccugguguucagugcgacugcagucaguguugaguggugccaugugggccgcucuauuccaaaggaaucauggauuagacccaagggcugagcuccucuagggcaggaccugcacccuguguguuggcaccagcaucgggucuuggacuggggcagaauccccaguggaaccggaagagcuggacugaugagaaacaucagaagaacacauacuaccuuguuuuccuaaugccagaagggugaccagugaagauucaccgucaaaccaugaaaguccuuucuuggauccacuuuaucuugauuagucugcauuuuacuaguucacuggaucccuccucuaggggccuggggacuuucacugaugcucuuccugauucuagagcaaaggugugggaaggggaaauggaggaaugcccuccugucugugucguucucugugccacagcuacagaugcagaagguuucucuggauagcacaccucugaauguaaaucaugauaaaauggauauuuggaaacuuacuccuaagcugugauuuaggguguauuucuacuucuggacugccucaauaucaagggcugagacuuuugaauuuugaauauucguuggguuucauguuaagaagccuguggucuaggagugcuauucaguguuucuuuuccugauaaacacuuugaauauuuuuuuuguguuuuuguuuccuuuucugaagcuguuccuccuuuuaaauauuuuuaaucacauugauaaaaucuauccuucaccaccucugguucuacuauaguugauuuuuauuuuaaauguuuaauuguauuugauuaaacacuuaacuggauuuuggaauaauaaaacucucguccaauuuggcuuuuaa

SEQ ID NO: 192038 - RNA, 5088 nt, Homo sapiens
gcgggggucgcgcugcacagccugcggcgcagcggaggcggaccgcagucgagucugcagaguguugggucuguagccagcaaauuacuucaucaucuagauuauccauucaguugauccuaauuagcaaggauaacaagguaacacaaggcuuacuuauauucacccaacaaaagugucucuguggagccacuucccagugaacuacauacugagauagggguuccuggaugagaaggaccaaggacagaaccgagaagaguuuaggggcagguuaugcgagauggaaauggcgcagauaacggagggaaggauuugagggcucaaacguaggcgucuguguuucgcaaaaguuggagacguucuaggcugccucucguugccuccaucucgcucugcgcggguuuuggaggacauuagcauucuuucuuguaucuccguugauuccagaaucguccgcacuaaaguccccugcagcgugaccaugucgagaccccggaagaggcuggcugggacuucugguucaggugagcugccccuaggcugcacaaaggcagcccaagaaaaaacuuuucucgaagagccuguuuaguacucauuuuucacucccugcuuuuugagaacccuuugugauauuuuuacuccauuauccuuaaucacucuccaucuucuuuacuugucucaccaagcuccuaccuacaguuccuuuuucuuguuuauucaggcaaugguuguugugcacaaagacucuuugagauaccagguggcgugcuaaagaauauaaagcgccugcuugcgggugaacugcaaacagaugugaugggguucaggaaaauggauuguuaaguuuauggagggaggaaucacggggaaggccucgagaaggauguggaauuugagcccagccuugaagaaugggagacuuuccacgggcaaaguuuaguacuaagaaaacgugaugucguuuuuauaaucacaaagauggauggcauucuaaguggauggaggaggaggaacauuggaagguacagaaaguaccucuuuugggaaugacagggguuccagauauacuacagcacauugcaguuauuuaucaauaugugguguuugcagugggccuguuaacuccuaaggggccauuaggaaacuagguuaggaagguaugcuggguucagagcauuagacagccauaaaugguauuuaaugacaauugauguagggacuuugacuaaauucagaggcaguauagucauuaaguagcuucagauagaccucagugacaggugcugaccucauaucuugauuccaccauuacuggaugugugaucuggagcaugcuucccagaugaagaguagaacaucucacagguuauguagauuaaccgaguuaggguuaggguaacacauagaccuugggcccugucauauaguaauuuaacaacuuagcuacugaaugccuacuguguuccaggcacauucugauugucuugggaugaaaucgaaucaucaccauuuuucuacaauguccugaaugaacuguuucuuucaacuuuuauuggcaccuucaaggagcagaaaggagaugggccaggagccacagugagcaagaaggaaagacguaugagaugagaauaauaaugcuuuuauuaugcacuuauuguaaugccaggcauugucuaggcccuuuguauuaccucauuuaagcuucaaaauaguugcaaguaggugcucaguuuccucuuuccuaugcaaaggcauagaagagagagugaggaaaggaaaacauguauugacuacuguccggaccuuuaauccugaacaacccuguaagguguucuuacccuauugaauagauaauccagaagauacccuguaagguagguauucuugucuaauuuuuauagauaaggaaagcuucuuaacaguaagauuaaguuccuacagcugguaauggauccaugauuugaauccaggucugacuccaaagcuaagcuuuuuccauuaugaaacauugccuuuaacaagcaugaucuuuucuuuuugcuucuccuauugcagacaagggacuaucaggaaaacgcaccaaaacugagaacucaggugaggcauuagcuaaaguggaggacuccaacccucagaagacuucagccacuaaaaacuguuugaagaaucuaagcagccacuggcugaugaagucagagccagagagccgccuagagaaagguguagaugugaaggugagacccuugaccugucuccagucccuucaugguguuuuuuaaaugagaagugaauaugggacaccauaggguuccauccccagcuucuuaucuuugaagggaaggaaaaagguaaaaaugaauaaaaucggcaggguuuauuaucaucagcugguuugugaaccuguguaucuagggcagggguuggcuaaccuuugccacaaagggccagauaguaaauuuuguaggcuugugcguguuacagucucuguugcaacccugcccuuguagcaagagaguggccacagauaauaaguaaacagcuguggcuguguucaaguucaacuuuauucacaaaauccagcaugggguuagauuuguccugaaggcuauagucugccaaccucaaucuuagguuaccuuucucugaacaccugccaugcuccuaggugucucccugccaacaguugauguauauuucagggaauuuaauauagccugggaaaaauauaagcagaacuauuauaaauauaaaguaaaaugcaaguaacuagcagauuacuuuaucaccuagauuauucauucagcuaauccucauaauuagcaaggauaacaagguaacacaaggcuuacuuacauucacccagcaaaagugucucuguggagccacuucccggugaacuacauacuuccucuauagccaguggccccucucauuuuaggggaaggaacugucugcuuccauaugugcuuacuaacuggccaaggauuguuuaaugauugaauuuauuuccucuugccuaguucagcauugaggaucucaaagcacagcccaaacagacaacaugcugggaugguguucguaacuaccagguaagaggguaaggaggaggucgccugagacccaggugggaugaaugccugccuccuccucaugacguacucaguagcagaaccucuuggccaagguugcuuuuucucagaagcaaaccugauaauguauuaaaaaaugccuuaaguacucugcaugaaauuuucaauuggccuguguucuggccaauguccugguaaaagucuggguguccuggcaaaggggaaggacuuucuaaugaauugaggaguugcagacaagaaucacccaucuauuaaaagcagacuugauuucugcuaaaagcuaguacuuuccagcuggugggaggauaguuacucuuucuucucccgggacaggcucggaacuuccuuagagccaugaagcugggagaagaagccuucuucuaccauagcaacugcaaagagccaggcaucgcaggacucaugaagguuaguugggcagguuuuggugugaaucccuuuuccuccagggagacuaacuuaaguagauauaaagggauauaccuuaauuaggcaacaaaaaaguacacucccccccaccccaucccccuuuuacaggaauagggaaaaacugcccuggccccuuccuaucugauaacucaaagcaggccuucauucagguccgacuagcacagacuucacuccaccucuaagucuugaucucacucgaaaacaggccugaugauagcuccuccaagcuuaucaggauaaaauuauuaacugugcagaggggaaaaaaacagugguaccaguaauaaccuuugccauuuguuuuuagagcauguuuuuaagacuuuuguaaaaacagaguugauuuccuagucuauauauuagacuauauauuguuuccaaauaucugagcccccauuggcuguacagcaaggcagauggguuaagaaugugcagggaagaaaugaaaguuggauauggauuaaaagauuggcuguggagcugacugcaggcagaugauucaaagcuuuuguuuugguuucagaucgugaaagaggcuuacccagaccacacacaguuugagaaaaacaauccccauuaugacccaucuagcaaagaggacaacccuaagugguccaugguaaagacuaugcuuucuauuucaugacaggggaaggaugaaccaggggaagaagacgguuggggugacuguaggucaagguacacggcccagcacuuacucagaugaggugauacugagauaggagcuuccugugggcgguuaaaaauacagugggcacagucagccuagacacgucuuucugucauguacacuguugucacauagguggauguacaguuuguucggaugaugaaacguuucauuccccuggcugagcucaaauccuaucaucaagcucacaaagcuacugguggccccuuaaaaaauaugguucucuucacucgccagagauuaucaauccagccccugacccaggguaagagugggcccucuccuuuauuguccauauaccagaaugaccucaugaauucccacuuacuagcugauuaaacuugggcaugguacuucaccuuucucagucagcauccucaccuguaacacccaugagggagggaauguggccagaguuaccuguuacuauuacccaguacucuauagugcuuggcaccugguaaauaguuuugaacgaaugacugcucgccuuaguaccauguaagauguaccugugccuggcacaacuuuccuguucaagaggggacauuaaaaacuaauccuuccuuuuucccuuuuuuuuuuguagaagaguuugauuuuguuuugagccuggaggaaaaggaaccaaguuaacugagauacugcugcuggaaugggcgagacauugcugcaaagaagucaagcuuuuuucagacaaaaggugugagggggcuugcuugguaugcuuaccugggcuuguguaccucagugguuuuuguguacuuuuuucaauaaaauaucaaaguugaagaa

SEQ ID NO: 192039 - RNA, 88034 nt, Homo sapiens
uuauuccauaaagcauaagauauuuuaaugagaaaacgaaaacaaaaucaaaccuuagucucauguuucuaucuaaagacacucaaaacuaguuuuucccugcccaucccuuuccuaacugcaacuuuaugugugaccauguaauaaaggccaguuuaaagauuuuuuuuuuaaaaaaaguuuaaaccuuuuuuaaaaagauuaaacaaucaggcuagcaaaaagguacucaauacauauuuuccuuauaucaaacaagcuaauuucaguacaauauaacuauacagaauauauacaauacacauguucacaaagcaaacacuauaggcucagaacagauuugaaaaaacaugauauucacauugauuacaauaacccuaaaaaugauuguaacguugaaacggcacuuaguuuacaaaaaaggucacaaaaauauauauauauauguagucaccaagaacuaugguuccuguaaaauacuaauagccagauacuaguauauaaaaugugaaguucugauauuguauacauuuuuuggaaauaaaacaaaauccaaaaccauuuuuguuauugucaaaagucaaacaugccaaguuaacuuagcuauggccagugucaccaaguaaagccauacuugaaugagaugacgacuggauacaaagcuggugaacuggggacuggcacaguuaagaguuguacuaauucuaggaaagggguagaagacauaaaaacacccaucuauguaauuuaauucacauuuucuccccugcaucaccuucccuugagaguuucacaaaaugccagugcccagaaagaaucacaaugcuauaacuggcaggguaaaaaaguccccccgccccgacuuccuugcugccgggcuauaggcaaauauuaaagcaugcaucagcuacccaaagccaucagucacccaucuggaagaccaugguguacaguuuccgccuaggcuggcugcacuaggaaguacuccaguuuuuaaauggagccagcuuuauguuagcccuguaaaauauugagcuacuguagcagcaaauaugacauuacagaaaaacaaaauuuuauuuaaaaaauuguuacaucaaaauuuuuuuccuucaaaucuguguccuuuaaccaaacaacaguuucuucuaucacuuaauucuggucuuauuaccucagucugacuuucucauuaugcuucucuggaaagacacuucuaaauccuggagauuaaauuuacucuuaaaaauggaaauacaggaauuuuaaaguaaaaagaaaaggucuguucuaaaaguucuuucacaaauauauauauuuaaauauuaaaauaggcuaccuaggauuuuuauaaaauggcuuuugaaaagauaguagaggcacaaagaagccauauacuauccuccaaguuggacauaaggugccacaaggcugcccuacaaagaggcaggcaaucucuaccugaugcaacgggaggcaccaguaaacaacagaaacauuaaauacauuauugggaacuuggaccaaaaccaaauuuuacucuauuagggaccguugcuuuuuuaaaaaauaccuugagauauaagcauuagaagucaucacuuuguacaaggaagaaaaugaauacaguuuaugaucuuacuccuuccaaauaccugaugucacucauuucagguaccugaaagaugaaaagcagugcaacuuucaacaauuuaauggacuacucucauuaugagagacuuuacacagcaucugucaacuugaaaauuaaauugguaacugaaauaaaaaaucgccuagagaaaacacacauaagcuaauccuagaaaaggcucuccuuagaaagcagguguuucuaagaacugcaggaaaggcuucccaucuugaacacagcuuccacuaauaccaagggaaacgugcauuaagaggagagaugacagggcucccuuaaagcaggaagauuuauccuuccucagcaggugauguacuuugguaaccucaacauucauuuaugggaugauuuuucaucuguuuuauugaauaaugaaaucuaaauguggcuagauuggcauuugggaaaacaagggccuuuuaauaaaaguccugacacuggagcuccucccaccacuaggcaccaauuuuaucaguauaucgccacaaccgugccugggacuuuaagcuucaucagcaacaucagucaauuuaaacgagaaaggaacuaauaaaagaauuugacuuuauaaaccagguacuuugaacaaaaacuaaaaauuuuaaaguuaaaaaaaguuuuguuuuuaauccgcaguccuuacucuuaaguucucuguaaacuauuaugcacacagaaaccuugguauuagcugaagccggccugggucuugcacaguggggguuuacuuaaguaaaaguagcacaaacauuucaaagacaaucucaauuuuucagauacugccaaaccgagauaccaauaacaucugaaaucuuugcagagacuauuuauaaaaacauggaaguguuuuuauuuucccaucauaaaaauauaaucacgauagaguggaaaugucuaacuguauuaguuuaguaaaaaguuaaaaaaaaguaugaccacugaugguacugguacuacaagucuucaucccauaacugacacaggcuuaaccccccauaaauauuacaacaucucaacuuaucuaucgucuaaaaugaaacauccagagagcgacuguucuuaguugagccugggauugaaucaauuccacuuuauuguuuaaucugaaccauuauugcuuuuggcuaauucaucuugcugaggacuuuccaaauaaaaauacucugucaccauacugucaagcaaaaacgacaaugaaagauaaaaauggguauaggcaaaauaaggaacaacuuaauuuaaauguucauaguuugaguuuaaagccugugggaguaugcuuaguuuuaauauuccucauagacauguuugccacaacagagcuuccuuguuaccccaauuuuguuucacugcuucagaaaagaaaauuuagcuuuuauacauucaucucucaauaacuuucaaaaucuaaauauauuacaaauaaagcaucuuacgucaauaacuuacuuacagugaaaacuacauuuauuuauuaccuucuggcaacuuugggucuguuucuucuaacuguaaacuucacacuaguuuuuuuuucccaguuaguauuaauauuuagaaaauuuuuaauucucauucacuuggauguguauuucagaauuacagcuucauacuuugcagaugacugaaacaaaguaacauaugaaaguuucuaauucuuuuguucauuccacaaaucucaaacuucagcuaaaauauuaaaauuuuaggauuauucauucaaguaauaagucucuguuacagaauugccacauuauacaguaauguauuuuucaaggacuauuaaagcuaaaagggacuaaaacauaaucugagaaucuucaagaauaaaagcugauaaaauagauaacuggccucuauuuagauuaagagaaaaaauuagaaauaaaagacugaaagauuuaauacagcuuccaaaggcucccaagagaaccauuuauaaacugggagagucuccugaaccagccuauuaguuagaagguaacugaguuaccaauaauuauggacaucagauguauugacuagucuauuucauuuggcaaaguauuuuaacaagaugaaaguuuuuuuuuuuuuuuuuuuuugcuaguuauuaagaacaaagggcaugugucguaacaggggaucuaauuacuguaagccagaaugauugcugaaaugucaaaauguaagauugaaugaggcuauuuaaacauuuuaguauauuuugucuuacugaaauugauaaaaaaaaaaaacuggcaauguaacuaaaugcguaacuaauuacuugaaauaaaaagauuacuugaaauucaaauuaagaaaaauccauuuaaauauauuugugggugauaaucuccaucugcauccauuuauauaaaacuuaaaaugccaaaaaauaaagaccaauauuaaucucuuuauuucugaaugagaugaaaucacugacauguuugaugcuuccacuauuagaauauacccuuuaaacacgaaaagaacaacugcaggagcuuuaacauccauuaucaugggugaacaucuuuguuuacuucuaaaguacaucacaccuauuugguaguuaaaaaacugaaaauaaaagcuuguacaaaaugcuugguuuuaaaaaggcaauuuauucugcauucugaaauuuaagcccuuuagauaccacaaaguuacccuccuggccuuaagaaagauagcuacguuuaagcacucuaaacuggaauauuuauguuuaguuacacugguaauuucuaaugaaugggauaauauaacuggcuaucucuuugcaauauuuucaauauguccugguaaaaauuaugcaucuaggcaucccuaagaugaauuugaaauaaaccuaaauacuacuauauauacaauuaucccuugcaaaucuguuuccuaaaacagauccauaaacagauccaauauccuuaaaguacauauauaucaagaaaaauguacccucacugaaauagaaaaaggccuuuauuuguaucauuuuauguuaaauacugguuaguuacugguauugauaagaucugggcagcagacaacuaaccagauaugcauuuucacaguauauucagauuucccauaaaacuuggcaauguguauuaccagugaaaaucuaaaguuucuacuugggaaggaauacccagugauggguaaucccucauucugagaacacagucagaauaucuuggagcuaccaacauugugcuuggcucuuaaugcgaaguuuucaggguuggggaugugcuaaaaacacuuuuaaccaaucaaucugcaaaccauucuuacacguuucucuucuuuauucuucuuuccuucuuuucuuuuuucuuuccucuugcucuuucaaaaaccaccucuuggaacuaaggguaacaaugauuccuggucauaauuuuaccuauucuugucaauacagauuuuaaaauuaauuuugagauuuaucuauugcuaggccuaacaguuuucaaagaccacaacguaacauuaaaauuccugaccuuuccaguugagacacagcaguacuauaugaaguauuauagucugcugcagaaaguaaugcaacccuaucagugaagaagcauaaauggugggagccuaucauaaccuguauaugcugauucuccugaagggaacacaccuauguuuggcagcaaauggguaaaaacaaguucaugagugagguaaagaguugaaaacaaguuaaggacugcagaauaugggcagacacagagaaucuuaaccuaaaacaguucuaaggaauuuaauuuacuuuuccuuucuucacauguuuuuggggaaaaaauuacagaauuagccaaucuaaaaaaaugaaacaaaucacuauaauuaaaaauauauacauuuaguauggucuagcaccugaacaaaauucagaucuuguguuuugacuaaagaacuguauuuucugucuaucaaaucaggugcucucauaauuauuaaacuuuggguaucuacacagaaacuuauuccaaaguucacugcucauggacuuacaaauauuuaggaucaauauuagagaugcuuuaauggcaccagaugaaaaguauacccaagucuagaggaucauacaaauuucaacuacagaccagaaaguuucauauuuuuagcagcagaaauaauauucauuaguuuaagguuuucaguuucucauuagucuuaauaauuuuuuucucccagauuuaugagucauagaugaaaaucuuacagucuauacucuucauuguugccuacguuguguaaaaacuauaguuaacuguuuuuaauaacuuugcaaugucuaaaaauaaauauguaaggacaauguaucgcugucauaugggauucaguaaacaaucuaguuggguuaagaaugcagccuuggccggugcagugaucccagcagucugggaggccaaaggaggaggaucacuuggucuaggaguucaagaccagccugggcaccauagugagaccucaucucuacaaaaaauaaaaaugaaguuaaccaggugugguggagcaugccuauaauccuagauacucaagaggcugaggcaggagaauggccugagcccaggaguucgaagcugcagugagcuaugacuuagccacuauacuccagccugggcaacagagugagaugccauucuuuuaaaaaaaaagaaaaaaaaaaagaauguagccucaauagagaauuauuuauuauguccaaaagagcacaaugaaaacauccccaacaacacauaaaccuauauauaaaauauagaauaucuccaguauuuuuacuuuauauggcagcacgccaauauaugcaagagaacauauugauggggcagggggaaaacugauccgggcaaugacacagucaggcauuacauucggagaccagguaaacagcaauuuuaaucugaaaagcaguaugagaagaguuccuaugaagcugggauuuacauacuucauucuccguuccuggucauuucauccacagcuugacuguugucaaucaugguuccuugccuuuggagugguacuauaaagguacagagaaugcccaucucaguaccaaaauuucaccaugaaaaaucauaacagaaaugacaaagcuuaaagaaaaguacgccggauuucagaaguauuuaccauaauaauuuuuaagaaagcuuaccauaaauacuuccaaaaacaacaggcuuuacaaaauauuauacaacauccuguguacagcaguaaguaucuacucaggccauuugucaagcuguuuaguaauuaguuucucauguacccucuugucucaagaaggucaauaaucaucugauuuccucucuagcuaaugaucuguuguuagccuacuuuuaacaauggaagaaggaacugguauauguuuuaagucaaccaguucuccuuaagucucauaguuucuguuucaacaucauguuauuguguacuuacagaagcaaucucucaguuaggaaaaauaaaaucaguuucagggcucagaaaguaaaaagggaaauucuuucccaaucucccccucccucccacccggcuuuuuuuguuuaaaaaauuaaauuaaauuuaaauguacaagaccaagcacaggcacuuuccaaaaaacaaaacugaagccaaaucacaaaacuacucaauaguuauagaagacagcucugauuuuggggggucaucucugguugccucagcacaagcacugcucuuuggcugcucuggcacuucuuccucuuuuucugccagcccaccaagagaccccaagggaaaagugcuuucacaauucuggguugaggagaccugugaaaugacaggcauuugaacagaggaguugcuuucaaaaccguguucuccaagaucauauugaacaagggucucuucuuguuccugguuuaaguaguccgguacuaggaaaucacuagauaagaggcaaaggaugaaauauggaauuaauuuucaaaccaguaauagauaagcaacaguaaaaagcucugauuuauacaacaaaauugggacucuucauuucacuaauuguucagugaagauuaaaacucaggaacuuucaacuuauaaacuuuccuaaauaugaaccaaaacauccauuaaaaccaaaauguaucaaucuuccccaccaccaauacaucagguuaauuaucacuuucauuauaacucuggacaccuuaacagccuuucuuguucuauguagaggaguuucuauauacaaaacaaauguagcaugcucacuuaaacaaagaucaucugaguaacuuuaaugcuaaacuuuucuugauuauacauugaguaagagauauauaaaccuagcuuuguauuacuaaacuugacauagguuaguuaagaaacuaaguccuuaugcauaaaugaccugauacauaaucuacuauaaaguugggaaauguagaaaguaauuuauguguauccugcuauuacauuugguauaugaaaauacuaauaaagaauuuggaaaugaaugccuugagauugguuaugugauaauccucaaaacguguucaauuauugguccccacaggcaacauggacaguaaaauauacuaaaaacaguggcuacuuuccuuaagugaugaaauagaaaauauuuuaaauuucuucuucauacuuuucuguauuuccuaaauuuccuacuuauaagcaucuuuugguaauugaaacuaaguaugugaaauaagucuuaucuuagaggcuuuauuuaaaucuuuauuacugaacuaagaacuucauuauaccauaauugucaauaauauauguacuuagacuugauaagguuauuuuauaauuucauuguucaguauuaauaaaaaauuaaaaucuguucaucugcaaaguaauuuagaaugcccuauguuauauuuucuaaaaagucuucauucagguguuagagaagaagaauggagaauacagggcucuguacagggacgauaaagauaacaugaguaguuaacaggaacacuauuuuaguccugaacaaacuauguuuaauaugauauguauaaccuaagguuuagugauauggcaaccacacauucagaauuagagaugacugcauuaaacaaaaugaaugucugguuugaagggaaaaacaaaaucuacgcaggaauaauuuggaauuuguuuacaaauaagguuuuaagucagggguggugcccacacuuguagccccagcaggagaacugcuugaccucaggaguucgaggcugcagugcacuaugauugugucuaugaacagccacugcacuucagccugggcaacacugcaagacccuaucuauucaauuaaaaaaaaaaaagguuuuaaaaauaagggugauuuaaaauguaaagauuugggcugggcaugguggcucacgccuguaaucccacagcacuuugggaggcugaagcaggcggaucacuugaggucagggguucgagaucagacuggccaacauggugaaaccccaucucuacuaaaaauacaaauauuagcuggguguaguggugggcaccuguaaucccagcuacucaggaggcugagguugcaguaagccgaaaucgugccacugcauuccagccugggugacagugagacuccaucucaaaaaaaaaaaaaagaaagauuuguaaaaauuucauuuuaugagaaacuaaggauuccuacagaaguacaauucuuauaaacaauuuaaaacaacaguuuuauaucuagagaaggccuuagaaaccaucguuuaaagcuuacauuuuaucuuucucuaaguuucaagcuuuuucauguguaaagugacagguuuaaucaacagcaguuaguggcagagcuagaucuagaagcugauuuccugggaugcccuauaaaucagaaagguaauucuauuauaaauuaauauuacaagaauagagcucuaaacugaaugaaaauagcaaugacuucaugaucuaaaccaucacacccacuauaguugccuuugaaauuuuucuuacuggccaauggcuauuccuuuauauagaauauuuuuaaauagagagaagugguaaagaauuuuauuaacaucuagagucuggaguaauccaguaucacuaagcaucaucugacaugguaaaauuuccaguaagaucuauuuaagguccauuacagaauuacuuaaaccuuguauuauuuaaaaaauaucucaagaggacaaguagucuacuucugcaggaaaauauuuuuaauaccaacuauaaaauguuuauaauuuuauauacguagaagacucagcaaaauuuuaucagaucaggagauuagaguaugaacagugggaauccguaacaaaugugacugacuagcuggcaaccugauguaaaaacacagaaggcugcccuaaaagcaggaaaagagaguuuagaaagcaguuuuccugguuggguuuucguugugcaccucaccugcucuggaaguaguuugcuagcucugaugcuucaugguucagacuccucaggugcacgauuaaauuuccagaguuggugaacauggcgccacauguuuugcacucguaaauccgaggcuugcggauaaugugccgggaaacccucaugugguguuuauauuccccgaaggaagugaaaguggcacuacauaucuggcaccggaaacagcguuuaccuucaugcuuuaggcgaugcaucuuuagcgaguaagcccuggugaacuuuuucccacagcggucacacugaaaugguuuaauuccuguaaauaaagcaaaacaaaauaucuaaaaacaaaaauaaacugaaaagucauaaacccuacaaauuucugaacuauauuucuguagcaacagaucaucugaaaaggcaagaauuaccagcaaaaacauauucuaauugaguaucucagaaaaugugcagaauaugugaaaagucacaagugcuuaaaaaggaaaagaaaaaaaggcaguaggggaggcaaacuagguaacgucuacugaagcugauuuuugaaugcuuuucuagaucaucuauuuuacuaacuucaaaacacaauuuaacuacaguauguagacagaacccaaauccccacuaacagcacauauuauuucauuucauuagagguuuacauugaacggauaugaaaaucaucaguaccuacucucuguucccuaucucacagagaaacgagaagaaagaacaauuuuaacaucucugaauguaaugagcaugacagaaccaucauuugauauaauggguuuuuuuggguaauaugauguaauauugauagaaauaaaugaguuauaaaguguauuaauagucuccucaaauucauuaucacaguguuuuggggaaaaaauuuuaaaaccuuucaaaacacagucuacggauugaacaaagucacagagaauuggugcuaggacagggacuguaagaccuaucuacagaaggggaaagugagauaguaacucacgcagcugaaaacagcagcaaagaucucuuacucgucagaggucaguguuuuacccacaagaauccuguugccuucaugugauuacugaacuaaaauuucaaauccccucuauacauuuauccaaaaucucuguuauguuuaaaaaaauacaaacuacaaagcugacucaucagggcacacagagauuuaggacuguagaauugaaaguaaauuagcaagaaaauauuacauuuuuaaacacacuuuuauuugggaaaaauuucaaacuuaaagagacauuauaagaagaacagcacaaagaacacccauacagacccuuuuaacccuauuugcuuuaccaucuguguuugugauucucuaucucaccucuaugugcacaccuaauaugucuuuuuauuuacaaaguacucacuccauaucaccuuauguucuuuuaaucagaauacucaacacccguggcaagcagcuuucugacacugcaucauuucagcaauaaaccuuagcuaaucuguuuucauuugacuucccagaguuuuuuuuaaaacucagaagccccuguuuucuauuuuaacugggacugcaaaauaaaauguuuuagagcguucacuuacgcaccaacagggaaggugacauuaccugaguggaugagcaugugcugcuuuagguucugaauacgggugaaucgcaccccgcagguuggacacugaaaaggucugucgggaccauuuggacuuggucgcucuguacugcugguggaaggagcaauguagaguugguagggauacugaacauuuuccaaucuaaaaaaaacagaccaaagaaggcaaccaggcucugauuuuuaaacugaauaaacacugcuauaggucaauuuuaaaugaaaaaagauaaaacacuuaaagacuuuuugaaacaguuuaacuguuagacuucaaguuuuacuuuaacaauaugaaaaacaauguuaauguccagaaugccuuuuguuuuuuuuuuuuauuuuuugagacggaguuaggcagaagucauaucguguagggcuuuagaaggcauagcaaggccuauagauuuuagguaugaauaaagaauguuaagaaucuauagcuuaaaacagugacauaaucugacuuaauuaaaaaagaaaagaugauuuuggcugcuacauggaaaauggauuaggggaagaaugcaaucagaggcuacuuugaagguuauugcaguagucaaggcaaaagaugguggugacuuagaguaggguggcuacaguacagauuagaaaaguagacagggauauauuuuauaggcagaguugacaggacuuaaggauuaacuacgagggagaugaagagugguaaggaaaaaagauuaagaacaauccucagagauuuugcuugagaaauuaggggauaaugaugaugcuuacugaaaugggagaaaggcuggagaagcaggauucagacaaggaguuagaaaucaagaguucugucuuggccuuguuaaaugugaaaugcccuuuauacauuuauguggaaauaucaagcagggagggaguuauggguauacagaucagacuuuggcagauguuuuucacagcaguccguacagcacacauucugacuuugcacaccauacagucuguuucaaccacucaacucugccauccacaaacaauaugucagcaaaugagccugguuguguuccaguaauacuugauuuacaaauaaaggugguaggcuggaauuggccugugguucauaguuugccaacacuugguacagauacgauuuaaagcaaugggacuagguaguuuuggaaaugcuggggaaaaaaaaaagccuuguauagguacucuaauuuauaaugugaugaugcuacuucauuacuuugaaaaguauacugaagugagguuguaauaaacuucuacaacucuugagaugaaaugcuugaauuuggaguuguaaacacaacccuuaagagguaacgaaaugcuauguuaguacugaccgaucaucaucauccggaggagcauuagugcuagacgugcuuugaaguguaggcaagcccucagaaacgccuucaucuacugagccugugaauaagagaaagaggaccacuguaauccuuuggugugaauaagccaagauuguaacugaaagcuauauuauaucuaagccucugacauauauuaucuaguguucauauccugaauuauuaauccaaaguaguguucuacauuuuuuuuuuuuuuuuuugagacugagucucgcucugucgcccaggcuggagugcgguggcgcgaucucggcucacugcaagcucugccuccuggguuuacgccauucuccugccucagccucccgaguagcugggacuacgggcgcccgacaccacgcccggcucauuuuuuguauuuuaguagagacaggguuucacuguguuagccaggauggucucgauauccugaccuugugauccaccugccucggccucccaaagugcugggauuacaggcgugagccaccgcacccagccguguucuauauuuuuaaauguuugugauuuuaaagaaaaaccacauguaagauaauagucuuauauuacuauuuaaguucuuuuagaaauauuucuuugacacauuucagaaagcaagcagggcaauucaaaagcgaacaaaaauccacauaaaacugaguaauuaaccauuuaaggaaacacugaaauucuuauuuuuuaaaacuuauugaagacauacaacuuguugcacaacuuuuauacagaauuuaacagauaaagugaacacccaggcaaccuccacacacaagccacacgaaagcacggccagcauccuggaaguccccauucauccuucccugaucauaaaccccucccuucuccaaaagcuucuuaugguuaucauuuuccuccucccauucucucacuuuuaaaaguaauuuuaucuugaauacaaguauccauaagguagguauucguucuugcuggaacacaacuuuggcuggacuagggcugcuucugccuacaguggcagaguuuaguagcuuuugguugugacagagaccauguggcaguuaugucuaaaacaguuaucauuuugccuuuaaaggaaaguuugccaaggcuugccauaaacaauacuuuuuaguguugucuggcuguuuuauauaaaccgggucauacuauauguauucuuuugucuugcuucuuuccuccaacauuguggacucaucguuuuuacguguaaccaaaguuuauuuucauuguuuauaauauucaucauuauccauuuuacucuugauggacaguuuuuuggcuauuaagaacaaugcugcugugaauauccuuaaugcacauaagcaugcuuuucuccaugguaaagacuuaggaauggaggugguacauauguaggaauggaauugcuaggucacugaacacauuuaucuucaacuuuauuagaaaauacuaaacucuuuccagagugacuguacuaaauucacaucacugcuaguauaucagaguugugcugcuccauauccuuaccuccuuaccaacauuugguauugcuggauuuuuaaguuauuaccacugguuuuuaaaauuauuaccaaccugguguaugucuuacaauauuucauggugguuugaauugcauuucccuuauaacuacuggggugaaucuagugucacauauuuacggaaucucccuuccucccucuuuugugaaaugccagaguugucugccuuuuuagcauaagaguucuuuucacaauuuguauauaagcccuuggucagugauacauacuacaaauaucuuuccccaucccauggcuuuuuuuuucacccuuucuaauggcuucuucugaugaacaaaguuuaacauuuuaauuuaauuaauccuuuucucauuguuauggcuuuuuggucuuguuuuuaaaaaaucuuucccugucugaaauuaucuuaugaaaaguaucauguuuugugccuuauguuuuuucuuuaacccauuggaguugacuuugugaccgaaugucaugaaaggucugccuucucugcucugcagugccuccuguguuguaugucauguauaaauacauaggucuguuuucggguuuucuauuaguuccaucugcuuaucuguccuuguauuaaugccaaucuuuaguuacuguagcuuuauaauaaaucuugcuaucaaguagagaaaguucucugcccuuguucauuugcuuucugaacauucuggcuauuuuuugacuucugcauuccuguauacauuugagaaucagcuugcugaauacaaguggaaauaaauauuccauuucuccccuucuauuuguuuagaaguuacacaauauuuuccuauuucuuuguauugguugccuuagaaauuagagauauacuuuguuuaccaaagucuaaaguuaaaaccuuuacuuccuucuggauaauacaaagauccuagaagcuuuaacuccauuucccaccacuuccauccugccauuuacaaauugucugauauuuuacuucuuuguucugauuaagccccacaaacauuaucauauauacauguucucacauuuaccucugccuuugcuguucauucuugcaaaugaaaccacucaucuaugcucacuucacuucugccaaaaguccauucuuuauaacuuuuuuggcaaugauuugcugaugaucaauucuuuuuguuugaaaacauauuuauuuucaaauauaaauauuucauuuauauauuuuucaaauauaauucauucuugaaagacauuuuuacccuguguagaaaucuagacugggagcuauuuucuuucagcacacugaggauaucaucccacugguuucugguggugguaaaaagucauauucuuuugaagguaaugucuuuuuacauuuuuuucccugaauuuucucuacaauguaucuaggucuguguuucuuuuuacuauuccuguuugggacuggugucuuucaucaaaucuggaaaauucucagccaaccucuccucucucuuuagagcuuccaucaaaccuacauuuguugucuuccgcacccuucuccucuuugcuacugcaguuuccaccacugugucucucucuguguagcacugaaguaauuucuucuaguuuaucuuuuaauuuccuaauucucuucuguugagugcaaugugcugccaaaauguucacggagauuuuaauuuugguuaucauuuuucuuuucuaaaagucccauuugguacuccuuaaaucugcuaugucacuuuuuauaguuuacuguucucugcaauuauuguucauguuuauuuuguuaaauacaguaagcauauuuacuuuauaucugugcuugaaaacuacgccaaguggcaaugccaauauauuucugcugcauuuaaaaaacacauuuuuuuuuuccuguugguucucucucugccuuguuuucuugagugcucugguaauuuuucgacugguuauugcccuugaaaauuauuuguaggaaauugaguugcugaggucaggauacauaaugcccuuuuccagagaaguuuuauguuugcuucugcuagguuccugggcagcauuagcuauaugagauucacuguuugagauuccuuggccuacccacucaaagucuguguuguaacaauuuguaaguggucuagcaguaacuucucagggauguguuuuccucucuuuuuccuuuucuaguccgcucauugccaaggcagguuuuucuacaguccccuggaguuuggaggacagggagcagguuuaguucugacaguacaaucccaaaggacaaugcacaugagcaugcuuuucuccacaguauauacuuaggaauggaagugguauauguguaggaauggagccgcuaggucacugaauacauuuaucuucaaccuuauuagaaaauacuaaauucuuuucuaaaaugauuguacuaaauuuacaucacugcuagcaguauaucagaguuguguugcuccauauccuuaccaacacuugguauugcaggauuuuuaaauuauuaccaaucaggaacguguuacaauacacacauuaagcagggagcagguuuaguucuaauguaaaccugcucccugcuuaacguguggggcaacuuuucuaagacuuuacaacuuuuacacacucugagcuuucaguuucauuucuccugcucuuugaguugaucaaccaaagcccauuuguguuuuggcaaaugucuuaaaggcaaaacugauuuuagugcucugaugaucuacuuaccucccugggccaggcuuucuccccuaauuuaaccuugcaguuccuuggccaucuuuucagcuuuucaaacaguuuaaaagugaauuuuuaaaaacuuaaaauuuguuguuuguggugggacaguagacucaaacaaccuagcuuauucucauuagguaaugaacucuuuacugaacacaaaccagcuguguugcaccaaaugaacaaaucugagccucugagaauuucggucuuuuaauagcaaacaagcuuuugguuauaauauuuuaaugaaaaugaaaauguggccgggugcaguggcucaugccuguaaucccagcacuuugggaggccgacguggguggaucacaaggucaggagauccagaccauccuggcuaacacggugaaaccccaucucuacuaaaaguacaaaaaauuagccgggcgugguggcgggugccuguagucccagcuacucgggaggcugaggcaggagaauggcgugaacaugggaggcagagcuugcagugagccaagauugcgccacugcacuccagccugggcgacagagagagacucugucuggaaaaaaaaaaaaaaaaaaagaaagaaaauguacuaacuguaacaguuuguacaccacuacauacaugugaacauuuaauaaguaucaucugcuaaugaacauacgggaugaaauuuccuucugaugaagauuuggaaucuaauacuuaaguuucccucuuuggaacacuugaauugcugucauuaggaaacagguacaucauccacuuaaguaaaaagcguuuuaaaaaacuaaauuuuaaggcauccaaacuuuauuuaaucacuuguacuggaaaacuugugacaggguuacauuuugccuugacuucuuaaaugaaggacaccauauagaacuuauuuuuuguuucuugaugacucaccacaaucauaaagaacacucauuacuauacaguguucuaauacuuggguauacucugaggcuuuugaaaauacgcaggacuauguguguuuacauucauucccaauugcacccccauucuuucuggucuccccauuccaucccuucugguguauguguagcauuucugugugugucuuuucuuuuucuuucucuaucaaacggcauuccugcuuuuccccuaugucuacuuaugcaaguuacucccagguucuucugacuuguuuuuaauccagauguaggacagagaaccagauaaugcugcauuuuaagaaagaacuguuuacuugucaguaucuucccauucucaguuuuuuccuuaaagaaaagaaaaauaaacauuaacuuuucaaucaguccugggcuaagaaacuggaaaaacaccaguauuuagcguuggucccauggacaucaagaccuauuugacggugcucugaacuuauucagagcacagacaguauuaaagcguacagacaaaggcuugccccaaaacgccuggaguugugauaaggguaggccaagaagacuggcaucugcuucucacuaucagcuugugauaaggguaggccaagaagacuggcaucggcuucucacuaucagguugugagaaggguaggccaagaagacuggcaucggcuucucacuaucagguugugagaaggguaggccaagaagacuggcaucugcuucucacuaucaggcaggccauacucuuucgaggagggaauggacucuuggugaggugagaauaaaaaccacacugucugggaccgauucuaguaccgucaaagguuuguuuaaaaagcugguugaaaagaacuaaaaugcaguacaagauacaucuagcagauggcccuucuuaaaacaaauccaucucuacauucuaaaaugucuagauccccugauucaauggauagugagcaugcaaagcaaagcaaaacuauuuucccucacccauggcuacugaaugcaccaacagcuaaaaaugaaagccacuccaagcuaaaaugaguuaaaacagacuuuuggaauucuauguauacuguggagguaaacacauaguguuauaucacuuaugcaacuaucagcaaaaaauaaauuuugugcaacuguuuuucuugaaaugaugguuuuugcaaauaacacaaguaaucauaugaauuggaauuucaguuaaacugauuuaacagcagaauauauacacauauauauacacacacacauauauauauacacacacauauauaugcacaauauuacuuuccugaggugacagugauguuucuuaaauuauuaaaaugaaguuuccuuucuacccuauagggauucuguucucagugguagugaggcuaagaauucuggucagacacuuuucaccuugugaaacaguaaaacugauucacagagacaaucagcuuuauaugggucagggcuagcuuaucaagacagagucgacucucuccccaauuagaagugcuguaugauagcuucuguugcaucaaacucaaguugcugcugccacuguucagguauucaagauacuuacaaagaucccucuggaauugaaaagcaauuacaguggucaucuccuacugaguauuuaccaugugccaggcauuguucuaaaagguuuucaauauaagaucucaauuuauacuugaaaaagagaaacaucuuccaacauucagaaacaggcuuggcacucauuuagggguggggccugguccuuacagccacaguauucuccuggggaacauaaacagucucacaaaacaacauaaaaucaagucacucugugacccuuauuuaaagcgagacuaaaaaacacuuuuauuugugcaaucacaaacauaccagucauccccaucucucgcuggcuaaugagucacuacugcuauagauucacuuuagucugcauuccuagauaguauuuauuaagauauucaauaacagaauucucucuccuuucugacaucaccaguccugagcaaaccucacuuccuugaacccucccuaauggagaguaagcaucccugaaaucacccaacacaaggccaaauccugcgcuaaggccuuuuuaacaccuucuuacugacaaccagcccuaaaaaccccaugguguauaaucucccuuguugcaaaugagcaacaaacucaaccuguucaaucauagguggucuuuggcuauagggcccaggcagaaauaaagauccacugagauucagcuaaauuccuuguugcuucguccugggauccuggaugagagggcagauauaaaaucccuuuugaggugccaccugcccuuggcugggauguaaguucaugcugaauuaagcucaaauaguucaaugaagcccuucacugucagguuuguuuuguuuuccuagaaacagucuuuugaaaauauuuugguuauucagauuguguugcuccuuggugaaacuguuuucuaggcuaacaccugcucugaagaucaucugccugccugccugcuguguuaacggccuacaagagaaauaaacgauaaugagaggaugaacauagguuggauuaguucaucugaacuggcccuggaggccaaguucagaucucugacuggcaaaaccauuucaaaacuuuacaagguauaacacagaugaacugugaaaacauuaugguaaaaacauaagccagugagaaaaaaaaacccacguauuucaugaucccacugauauaaaauauccagaauaggcaacuauuaauauuuacagugguuugccuaggaguggggaugggguuagaaggacuagagaguuaucuuuuuaaguaacaaggcccaaccuaaaaccagcagucuuuuuucuccuuuaaauuuguuguauuuauugcuuuuauuugcugcaaguugauacugaauuuuacaaccuuuccaugggcaaguggaaacaaaaggaacuuaaaacagcagguaaaauccuaucugaacuaauuucauggauaaucaaauuauuauuuuggaaauuugaaaauaauacacuaaacauuauauuuucuaucccuagaaagacaagauaccucucagagauguucuuuaacaaauuaguaaguaaaauuaaauacucuuauggaacuuacaggggaaaaaguaccaugcacaucuuccuuuucucccucucaaauuuacugacugccuucaauaccgcaaggaauuuucuguauggcuuuguuuuaguaugcaaguuuggaguuaagauugguuuguugagagugauuaguacauuugccaugaaggcaaggaaaaaacaucauauuggaguugggcaugguggcucacgccuguaaucucagcacuuugggaggcugaggcaggcgaucacuugaggucaggaguucgagaccagccuggccaacauggugaaauccugucucuacuaaaaauacaaaaauuagccaggugugguggcaggcaccuguaaucccagcuacuugggaggcugaggcaggacaauuacuugaacucaggaggcagagguugcagugagcugacaucacaccacagcacuccagccugagcaacagggcaagauacuggcucaaaaaaccacaaaaacaaaacaaaaaaacacaagaaacaaaccacauugggauuaucugauucagagcaguucccaugucugcuuuauagaauccauuuauaauaauauauagguaacagauucuacuuauauaacugaaagauuuguucuacuuauuaacuuguuaauaacaucauaaagggcugggugcaguagcucaggccuguaaucccagcacuuugggaggcugagguggguggaucacuugaagucaggaguuugagaccaaccuggcccacauggugaaacuccaucucuacuaaaaauacaaauauuagcugggugugguggugugugccugcagucccagcuacuugggaggcugaggcaggagaauugcuugaacccaggaggcagagguuguaguaagcugagaucaugcuacugcauuccagccugggugacagagugagacucagucucaaacaaaaacaaaacuaucauaaaggcaaaaccugaacugauuauauauacuugggagugguaaaggaugacuauuucacaugccuaacucaauaucuuagauauuuagacagauuaauauuuggguuccuacuuucuuaaaugauuaaaauuauaauuauucaguaggcaguucguuacucagaagguaccaagguguuuucaauuacugacucugguaguuuaguaaaaacuugguuguaucaacaaauagcuaugauuucuugaaauuaaauauuuuguuggauguguguucauguaaauucuucacaacuauuuugaccccaauucaggaauaugaacuucaguggcugcugugggugacauuauuucccccagaaagacacuacgucuuggcugcuggcaagauggccgaauaggaacagcuccagucugcagcucccagugagaccaacacagaaggcaggugucugcauuucuaaugagguacccuguucaucucacugggacuaguuaggcaguggguacagcccacagagggugagcagaagcaggguggggcguuaccucacccaggaagugcaaggagccaaggaaagcagugagggacugugcuaucuggcccagauacuacgcuuuucccacaguuuuugcaauccgcagaccaggagauucccucgugugcuacaucacuagggccccggguuucaagcacaaaacugggcggcuguuugggcagacaccaagcuagcucuucuuuuuucacacaccaguggugccuggaaccacagugagacagaaccauucacagaaccuuugcagcccccugcaaagggggcugaagccagggagccaaguggucucacucagcaggucccacucccacagagcccagcaagcuaagaaccacuggcuugaaauucucacugccagcacagcagucugaaguugaccugggacgaucaagcuuggucgggggagggacauccgccauuacugaggcuugaguaguugguuuuccccugacagcgcuaaaaaggccuggaaguuccaacugggcagaacucaacacaguguggcacaguggcuauggccagacugccucuuuagauuccucuucauugggcagggcaucucugaaagaaagacagcagccccagucagggcuuauagauaaaaaucccaucucacugggacagagcaccugggagaaggggcggcugugggcgcagcuucaguggacuuaaacgucccugccugcagguucugaagagagcagcggauacucacaaggaggguucuaccagcacagugcuugacuucugcuaagggacagacugccuccucaagugggucccugacccccaugccuccugacugggagagacuucccaacaggggugacagacaccucauacaggagagcuccggcuggcaucaggccggugccccucugggaugaagcauccagaggaagcagcaggcagcaaucuuugcuguucugcagccuccgcuggugauacccaggcuaauagggucuggaguggaccuccaacaaacugcagcagaccuucaaaagaggggccuguuagaagaaaaacuaacaaacaaaaagcaauaacaucaacaucaacaucaacaaaaagaaccuccacacagacgccccauccaaacccauccaaaggucaccagccucaaagaucaaagauagauaaauccacgaagaugaggaaaaaccagcacaaaaaugcugaaaauuccaaaaaccagaaugccucuucuccaaaugacugcaacuccucuccagcgagggcacaacacuggacagagaaugaauuugacaaaucgacagaaguaggcuucagaaggucgguaauaacaaacuccucuccacuaacggagcauguucuaucucacccaaugcaaggaagcuaagaaccuugacaaaagguuacagcaacugcuaacuagaauaacccguuuacggaagaacauaaaugaccugacagagcuaaaaaacacagcacgagaacuucacaaagcauacacaaguaucaauagcugaauggaucaagcggaagaaagauaacagagaaugaagaucaacuuacugaaaugaggcaugaagacaggauuagagaaaaaaagauugaaaaggaacaaacaaagccuccaagaaauaugggacuaugugaaaagaccaaaccuacgauugacugaggucccugaaagugacagggagaaaugaaccaagcuggaaaacacacuucagaauauuauccaggacaacuuccccaaccuagcaacacaggccaacauucaaauucaggaaauacagagaacaucauuaagauacuccucgagaauagcaaccccaagagacauaaucaucagauucuccaagguugaaaugaaggaaaaauguuaagggcagccagagagaaaggucagguuaccuacagagggaagccaucagacuaacagcggaucucucuacagagagugggggccaauauucaaauucuuaaagaaaagaauuuucaauccagaauuucauauccagacaaacuacguuucauaagugagaaauaaaauccuuuacagacaagcaaaugcugagggauuuuguaaccaccaggguugccuuacaagagcuccugaaggaagcacuaaauauggaaaggaaaaacugguaccagccacugcaaaaacacaccaaaauacaaagaccaaugacauuauaaagaaacugcaucaaugaaugugcaaaauaaccagcuagcaucaugacgacaggaucaaauuugcauauaacaauauuaaccuuaaauguaaaugggcuaaaugccccaauuaaaagacacagacuggcaaacuggauaaagaguugagacccauuggugugcuguguucaggagaccuaucucaugugggucaaagacacacauagacucaaaauaaaggaauggaggaauauuuaccaagcaaauggaaagaaaaaaaagaagcaggggcugcaaucauagucucugauaaaacagucuuuaaaccaacaaagaucaaaaaagacaaagaagggcauuauauaauggcagacggaucaaugcaacaagaagagcuaacuauccuaaauacauauauacgcaauacagaagcacccagauucauaaaacaaguucuuagagaccuacaaagagacuuagacccccacacaauaauagugggagacuuuaacaccccacugucaauauuagacagaucaacgagacagaaaauuaacaaagauauucaggacuugaacucagcucuggaccaagcagaccuaauagacagcuauagaacucuccaccacaaaucaacagaauauacauucuucucagcaccgcauggcacuuauucuaaaauagaccacauaauuggaaguaaaacacaccucagcaaaugcaaaagaacggaaaucguaacaaacagccucucagaccacagugccaucaaauuagaacucaggauuaagaaacucacucuaucagagguacaaagaggagcugguaccauuccuucugaaacuauuccaaucaguagaaaaagagggaauccucccuaacucauuuuaugaggccagcaccauccugauaccaaagccuggcagagacacaacaaaaagaauuuuagaccaauaucacugaugaacaucaaugcaaaaauccucaauaaaauacuggcaaaccaaauccagcagcacaucaaaaagcuuauccaccaugaucaagugggcuucaucccugggaugcaaggcugguucaacauaugcaaaucaauaaacguaauccagcauauaaacagaaccaaagacaaaaaccacaugauuauaucaacagaugcagaaaaggccuuugacaaaauucaacagcccuucaugcuaaaaacucucaauaaauuagguauuaaugggauguaucucaaaauaauaagaccuauuuaugacaaauccacagccaauaucauacugaaugggcaaaaacuggaagcauucccuuugaaaauugacacaagacagggaugcccuuucucacucaccacuccuauucaacacaguguuggaaguucuggccagggcaaucaggcaggagaaagaaauaaaggguauucaauuacgaaaagaggaagucaaauugucccuguuugcagaugacaugauuguacauuuagaaaaccccaucgucucagcccaaaaucuccuuaagcugauaagcaacuucagcaaagucucuggauacaaaaaucaaugugcaaaaaucacaagcauucuuauauaccaauaacagagaaacagagagccaaaucaugagugaacuccuguucacaauugcuucaaagaaaagaaaauaccuaggaauccaacuuacaagggacaugaaggaacucuucaaggagaacuauaaaccacugcucaaugaaauaaaagaugauacaaacaaauggaagaacauuccaugcucauggauaggaagaaugaauaucgugaaaauggccauacugcccaagguaauuuauagauucaaugccauccccaucaagcuaccaaugacuuucuucacagaauuggaaaaaacuacuuuaaaguucacauggaaccaaaaaagagccugcauugccaaguuaauccuaagccaaaagaauaaagcuggaggcaccacacuaccugacuucaagcuauacuacaaggcuacaguaaccaaaacagcaugguacugguaccaaaacagauauagaccaauggaccagaacagagcccucagaaauaauaccacacaucuacaaccaucugaucuuugacaaaccugacaaaaacaagaaauggggaaaggauucccuauuuaauaaauggugcugggaaaacuggcuagccauauguagaaaggugaaacuggaucccuuccuuacacauuauacaaaaauuaauucaagauggauuaaagacuuaaauguuagaccuaaaaccauaaaaacccuagaagaaaaccuaggcaauaccauucaggacauaggcaugggcaaggacuucaucucuaaaacaccaaaagcaauggcaacaaaagccaaaauugacaaaugggaucuaauuaaacuaaagagcuuuugcauagcaaaagaaacuaccaucagagugaacaggcaaccuacagaaugggagaaaauuuuuacaaucuacucaacugacaaagggcuaauauccagaaucuacaaagaacucaaacaaauuuacaagaaaaaaacaaacaacaacaaccccaucagaaagugggagaaggauaugaacagacacuucucuaaagaagacauuuauguagccaaaagacacaugaaaaaaugcuuaucaucacuggccaucagagaaaugcaaaucaaaaccacaaugagauaccaucucacaccaguuagaauggugaucauuaaaaagucaggaaacaacaggugcuggagaggauguggagaaauaggaacacuuuuacacuguuggugggacuguaaacugguucaaccauuguggaagucaguguggcgauuccucagggaucuagaacuagaaauaccauuugacccagccaucccauuacuggguauauacccaaaggauuauaaaucaugcugcuauaaagacacgugcacacguauguuuauuguggcacuauucacaauagcaaagacuuggaaccaacccaaaugucaucaaugauagacaggauuaagaaaauguggcacauauacaccauggaauaccaugcagccauaaaaaaggauggguucauguccuuugcagggacauggaugaagcuggaaaccaucauucucagcaaacuaucacaaggacaaaaaaccaaacacugcauguucucacucauagaugggaauugaacaaugagaacacuuggacacaggaaggggaacaucacacacuggggccuguuguggggcggggggagggggaagggauagcauuaggagauauaccuaauguaaaugacgaguuaauaggugcagcacaccaacauggcacauguauacauauguaacaaaucugcacguugugcacauguucccuagaacuuaaaguauaguaaauaauaauauaauaauaaaagaaacucauucaaaacugcacaacuacauggaaacuaaacaaccugcuccugcaugaccacuggguaaauaacgaaauuaaggcagaaauaacgaaguucucugaaaccaaugagaacaaagagacaagguaccagaaucuccgggacaugcuaaagcacaguugagagggaaauuuauagcacuaaaugcucacaucagaaagugggaaagauguaaaaucuauaccuuaacaucacaauuaaaagaacuagagaagcaagagcaaacaaauucaaaagcuagcagaagacaagaaauaacuaagaacagagcagaaccgaaagagacacacgaaaagcccuucaaaaaacuaaugaauccaggaggugguguuuugaaaagauuaacaaaauagacagacugcuaaccagauuaauaaagaagagagagaauaaucaaauagacacaauaaaaaaugauaaaagggaugucauuauugaucccacagaaauacaaacuaccaucagggaauacuauaaacaccucuucgcaaauaaacuagaaaaucuagacgaaaauuccuggacauauacacccucccaagacuaaacuaggaagaagcugaaucccugaauagaccaauaacaaauucuaaaguugaggcaaaaccucaaaaaaaaaaaaaaaaaaaaaaacaccccuucaugcuauaaacucuccugaaauagccuaccaaccaaaaaaagcccagcaccagacagauucaccagacagauucacagcugaauucuaccaaagguacgaagagaagcugguaccauuccuaacaacagaaaaagagggacuccucccuaacucauuuuaugaggucagcaacauccugauuccaaaaccuggcagaggcacaacacaaaaaaagaaaauaccaggccaauauaccugaugaacauugaugugaaaguccucaauaaaauacugacaaacugaauccagcagaauaucaaaaagcuuauccaccaggaucgaguuggcuucaucccuggaacgcaaggcugguucaacacacgcagaucaauaaacguaauccaucacguaaaacagaaccaaugacaaaaaccacgauuaucucaauagacgcagaaaaggccuucaauaaaauucaacacccuggcugggcgugguggcucacgccuguaaucccagcauuuugggacgccgaggcaggcggaucacgaggucaagagaucgagaccauccuggccaacauggugaaaucccaucucuacuaaaaauacaaaaauuagcugggugugguggcaugcgucuguagucccagcuacucaggaggcugaggcagaagaauugcuugaaugagcugagaucacaccacugcacuccagccuggugacagagugagacuccgucucaaaaauaaauaaauaaauaaaaauuaaaaauaaaaauucaacaccccuucaugcuaaaaacucugaauaaacuagguauugauggaacauaucucaaaauauuaagagcuauuuaugacaaauccauagacaguaucauaccgaaugaguaaaagcagaaagcauucccuuugaaaaccggcacaagacaaggaugcucucucucaccaccccuauucaacacaguacuggaaguucuggccagagcaaucaggcaagagaaagaaagaguauucaaauaggaagagaggaagucaaggguauucaaauaagaagagagaaggucaaauugucucuguuugcagaugacauaauuguauauuuagaaaaccccacugucucugccccaaaacucaagcugauaaacaacuucagcaaagucucgggauacaaaaucaaugugcaaaaaucacaagcguuccuauacaccaguaauagacaagcagagagccaaaucaugagugaacuuccauucauaauugcuacaaagaaaauaaaauacccaaaaacacaacuugcauguucagcacaugcaucccagaucuuaaaaaaaaaaaaaaaaaaaaagaaaaaguacaucuuaauccuugcuaccaauguaugugaccuuauuuggaaauagggucuuagcagauguaaucaaguuaagaugaggucaugcuggauuagggugggaccugaauccaaugacugguguccuuuuagggagagagagauuugaagccaguggcaaaacagagagacagggaaggucaugugaagacgaacgcauauacuaaagcacaauaucauauacuggagcuacaagccaaagaacaccaaggauugugggcagcugccacaggcuggaagagacaaggaaggauucuucccuacaaucuucaaagagagaaagauccuucaaagggaacuaacaccugucguucagauuucuggccucugacuaugagagaauaaauuuuuuuuaaaccauucaguuugcgguacuuuguugcagcagcccagggaaacucacacagaggguaaaagcacaagaaacuaacaaaguuaauauggucuucccgguucuccaauauuuuggacaaaucuuuauuauucacuaguggcuuuucuucuaucccuucccaaaccugaauauagguauuccccaagguauccccuugguuuuggcucuucuguuuuuccuauugagauugaauuugccacuacuaguagaaaagucccaaguugggaaucucacuuaucuuuucuacugcuuuugaaaugacacugcuugaucaucauccaagcacaauuuacacagaagugaccuugauaauuuacucucaaaacuggauucccaccaccuuccacugauuuucauacggcacuaacuacauuuaauagaugcuaaaaugcuauugauucauaugauugccauuauucucuauagcacuaaggaagaaaaaagcaacuguagaagacugccaacuguaagacauaucuggauucagaaauaacaaaauaugaaaaauugugacuuagaaucaauggaauauaauaaaguguuaccauuauuuccuagucaucagaguacuuuaaccucuccuguucuuucaauauacauauucaguaucaucagguacuaagucuuucuuuacaaagucuuguaauaucuauuuucuuucacaugguuuuaagucuucauucacaccaagauaagugcacugcaauuggucucugagacugucucuguaaaaccaaacucacugcaugucaauaacaguuuuccuaaaauaucugcauguuuuuguuuuuaucccuuuaauguagacuccuuacuaccuaccacuaagauaaaauccaagcuuacuuggccuacuuguggcagacacugcuaguugcauacucaauauccauuuugcucuaauuuuguucaaggcauuuagguacccaacuaauauacauuaucuucccagauucccuugcagcuaggaaagacuaugugacacagacuagcagaaguuuuuuagggauuucugagaacauaggugcuuucuugauacaaagcauugccccuuucuagaauacaaagcugaagaugaaaugagcaucuuauggaugaaaccaacaaaguaaagauggcaguuuauaaauauacaaguugccuaggccacugauuauauugcagauucacuguaccagcccuggacuuuuauuccugaacacuuugugauaaaaaaucacaagcauuccugugcaccaguaacagagagccaaaucacgagugaacucccauucacaauuacuacaaagagaauaaaauaccuaggaauauaacuuacaagggaugugaaagaccucuucaagaacuacaaaccacugcucaagaaaauaagagaggacacaaauaaaugggaagacauuccaugcucauggauaggaagaaucaauaucgugaaaauggccauauugcccaaaguaauuuauagauucagugcuauccccaucaaguuaccauugacuuucuucacggaauuggaaaaaacuccuuuaaauuucauauggaaauuuaaugagauaccaucucacaccaguuagaauggugaucauuaaaaagucuggaaacaacagaugcuguugaggauguggagaaauaggaaaugcuuuuacacuguuggugggacuguaaacuaguucaaccauuguggaagacaguguggcgauuccucaugaaucuagaaacagaaauaccauucgacccagccaucccauuacuggguauacacccaaaggauuauaaaucuuucuacuauaaagacacaugcgcacauauguuuacugcggcacuauucacaauagcaaagacuuggaaccaacccaaaucccugucaauaauagauuggauaaagaaaauguggcacauguacaccaugaaauacuaugcagccauaaaaaagaaugaguucauguccuuugcagggacauggaugaagcuggaaaccaucauucuccgcaaacuaucacaagaacagaaaaccaaacaccacauguucuuacuaauaagugggaguuaaacaaugagaacccauguacacagggagggggacaucacacaguggggccuguugggggauggggggcuaggggagagauagcauuaggauaaauacguaacgcagaugaaggguugaugggugcagcaaaccaccauggcauguguauaccuauguaacaaaacugaacguucugcacauguaccccagaauuugaauuaaaaaaaagaaaaaaauacugccagagaaaacaacuauaaaucauuuuauuuucaaucuaaaaagauaaauaaauaaauaauaaagaaaaaauaaauaaaacucugcuacaguuaaguuacugcagaagggauuccaucaccugcacuuaaaugcaaccccuacugaaacuaggauucgaggcucuuuacagccugcgcucaaccacuccuuuugucugaucucccacuauucccuacaguuucaggcaucuguacuuacuuacaucauuuugcacugaauucacuguuuaccaaacacacaaugcucuuccauaccucuguguuugcauauauguucuguguuuuuauguuuucacagaaaugacauucccacacuuggguaaacucuuacuuauugcauaagacccacucaaacauauaguguaacuugcucuuuccuuuguugcaaccauacuacuuuguucacaccuccagaugagcacuuuugauaguucacuguaaucauuuacuuucauaucugcuuccccaauuagaugauuaaccuaauugucauugcagggacuauguguuuuucuuuauguaucauaaauguuugcuuggcacaugguaaguuuucaauacauauuuuaaugaagaauaaaacacaaacuggauuuaacugcuuuuuuguguauguguaucugccuuugucccagcagauaccauucaauuauuuuuaucuuccccaaugugcaacuuguaaaaaauaaacgauagugcuaauagcaucucaagcaaauccaguuaccauguuuuacucuucuuuauauuuccuauaugaccgagcacaaaacuuuuuaucuaacaggaacuuaaaaauguuugaauugacuuuauagcaccaagaaaaacacagaaggcauuauaccuauagaggaagacuguggacuaaucagaagguccucuuggacuuguucacuuccuggaacugucugcugaucacucagcgaacucugagaugcacugacaggcugggacacuuccucauggaccuccucaucacuuaaucuuucuacuuugacccggacaucuucuucgguaccuaaaggcaagguaguuuuugugcucucacaagucacauaaucagccauucuucuaccggucucagaugggccagguaauucuaaaguccggguauuuucugcuugcuuaacuuucucaggcugaauccuucgaucaauuccaaaaggaaaaguccaaggaaaagcuaaggaagagucaacugguugguuucuauuuucugaguaggaagcugaagaauucaauaccuggggugagcuuguuugugugccacacuuuacaggacuuucaggagacauaacaauguagcuuuugcgcuuucuccgggauucucggcagacaggaaugguucuuucuaccacacugcacucugaggacacgggagaaaugcucccaucucgagaaguaaaauugcaguuagaauuauuuucuuguccagcaucuagacccuuuucagguuggcuguuggguguauuccauaaaaugcuugauuucaugaacucugagcaggugcuggcaacacugaacauuugcauauagcuggcugcugcuagaacaucaauaauauuuucuguguuaauugauagaguggcuguguaagcauauucuaaaagagguauaaagccagucacuguaacaugaugcagauccaacacauucuuguucucauccucggcuuggccuacaaguuuggugcgaaagaaaucacugcaagcugcuaguaccaccuuaugugcccggaagauuuuguccuggacacgaauagugauaucacaaaaauguccaucauuucgcagcauauuuagcuuuccaagcauuuccuggcugugggaagaggagcuaugaguaaauguuuucacacccaucuuuuacuuccucuucuacagaugcucuucaaggaugcaaauaaaucagaaauguccuaaaaaauacauaaaauaaagcauuaauugauauuuuagugguuuaaaaugugauuuagaucauuuucauguggccacuguacuaaauuaaaaagcugaaagaugguagugacagagaaacuucaagguagggacuguauagaaauauauucuccuuaucugccuuccaaacuguccaaucagugaagucugugaaccaauguuuuuuuuuguuuuguuuuguuuuugagacagagucuugcucuguugcccaggcuggagugcagcgggguggucuuggcucacugcaaccucugccucccggguucaagcaauucuccugccucagccucccgaguagcugggauuacaggcacccgcccucaugccuggcuaaguuuuguauuuuuguagagaugggguuucaccauguuggccaggcuggucuugaacuccugaccucaggugauaggccugccuaggccucccaaagugcugggauuacaggugugagccaccaugcccggccugugaaccagcguuuuaaugagcugcagggcugcaacaguuuguaaauaaugacaauuauagagugucuucuaugugccagacaguauuugaaaugcuucacauuuaauaguuaguugauugucaucauaucucuaucaguaggcguauuaucauuccuguuucuaaaugugagcaugcagcaggcaaugccaguguaaacacugaacaauccauuacauaaucaucccuguuaauguuuuaugcagguaaauguauagaggaaaagaaagaugggaaaaagaaaaaaaggaaguggaaagaaaaaaaaaaagauuucaagaugaauuuaaaaagguugccaggugugguggcucacgucuguaaucccagcacuuugggaggccaaggcaggcggauugcuugagcucaggaguccaagaccagccuggccaacauggcaaaacccugucucuacaaaaaaacacauaaaaauuaggcgggugugguggcaugggccuguagucccagcuauucgggacgcugauguggaaggaucacuugagccugggagguggagguugcagugagccgagacugcaccacugcacuccacccuuggugacagaguaagaccccgucuaaaaaaauauaagucacagacuauucuaacuugagaagacaaaaugaucaauuugagacuguuccaugucagacuucacaaaaggauaaggcauaaaucucuguuccaaagcagccagguaaagcuacugaaauaauuaucuugaccauaauuaguaacagaaguucgaauguaaacugagugcuccacauacccuuccugaagucaacugaccacaaugagacacuagacagccagggacuggucuacgcaaaccaucauguaacauauuugcugauuuaggucucacaaaaaugagaugaaagaaagaaaaugggagggcuauauauaaagcguuuuguucauuuauugcaucccaggagacuagcuucugcuuuuaaagcauggccuucgagagugcuuacuuugggaucauguggcugagggaagaaacaugcuuucagagcaagugaauuaguuauaauccagggaccaucugcaugaacaaaggugugaaggcaagaaauuaaacagcauauuuggaagacaugugcaucggaguauuaaaaugaaaccauuuccaucuugaauaggccccaaacaacagauaauguacuacguucucaagugaggcacaagggcaccuuauacaagggguaguggaaaacuauuuucaaccuugaguuacauccaccuucagucaucuuccguguucaaagaguagauaugaaaaggauuuuugcugagaguaaucaguuuguugugaguugcaaaccccauucuacuucccugcuuacuccccugcagggaaaggggcuucaaggcaugcugauccuuuaccucaaaucuauggaaaauauguuacaacugaaaaaacucugaagggcacauaagucugauuuaaacaacaaucaaggccaagacguaugccuacuaucucccaacaguauauaaaggcaucacaguggagugguugaaagcacagacucuggagccagaaugcucacucugcaugcugguucugcuauuuuuaccugugucaccuuaggcaagucauuaaacaaacccucuguaucuuacuauauucagugguauaagaaauauaacacaacacaccucauagaguucugaggauuaaaugaccuaauauauguuaaguguuuagaauaguaacuaguaacauaaucaaugcuauagaaacauuaguugcugcugcuacuaacauugcuaucaaagaccuuuucuuccugaaagggccagaaaccacagccagcaaaugaagagaagugaaagaagaaaguuggggaagagagaaagaaagaaaaaggagguaaaccacaccuaacucuucaacugcaggccuguaguaggccugaggugggaaaggagggaaagcuuuuacucuaaguuuauuaguucuugaaaagauugcugguauuuccugaaagugaucagaacaguuauuaaaacuuacucuccaggaagcuggagaacuaacuccacagaagaaauaaaauggcucaugaguaccucccguaagucaugcuuguucacauauaugguacgaagucugauauacuuagaaguaugggaugagaagaaggugaugaugaggaaaugcauucucuaccauauauuuaucacaugcauuucccaauaugucugcagaaacucaggcccaagauaugcuccauaauacaaacuuauauggacaaauauauuuuggauacagagacauaccucaucuucuugcacuuugcuuuauuaaacuuugcaaauauuguguuuuuuacaaauuggaaauuuguggcaacccugcugucagcaagucuacuggugccacuuuccaccagcuugugcucacuucacauuugugucacauuuugguaauucuugcaauauuucaaaauuuuucauuauuauuauaucuguuauggugaucugugaucaguaaucuuugauguuacuacuguaauuguuuugggguaccacaaacugcacccauauaagacagugaacuuaauguuguguguguuaugacugauuuacccacuagucauucccccaucucucuccuccuccucaggucuccauauuccaugaaaaacaaggauauugaaauuagaccaauuaauaacccuacgauggccucuaaaugaccaagugaaaggaagagcugcacguuucucacuuuauuuuuuuuuaugagacggaauuuugcucugucacccaggcuggagugcaguggcacaaucuuggcucacugcaaccuccaccucccagauucaagcaauucuccuuucagcuuccagaguagcuggaaauacaggugcauacaacaaagcccagcuaauuuuuguauuuuuaguagagaggggguuucaccauguuggccagccuggucucgaacuccugaccucaagugauccacccgccucauguuuuucacuuuaaaugaaaugcuagaaaugauuaaguuuagugaggaaggcauguugagagcugagagagccugaaagcuagaccuuuuauaccaaacagcuagccaagcugugauagcaaaggacauauucuugaaggaaauuaaaagugcuacuccagugcacacacaaaugaugagaaaguaaaacagccuuauugcugacaugcagaaaguuugccuggugugcacagaagaugaaaccaaccacaauauuccuuuaaaucaaagccuaauccagcgcaaggccauaacucucuucaauucuaugaaggcugggagggaugaggaagcugcagaagaaaaguuggaagcuagcagaaguugauucaugagguugaaggaaagaagccaucuccauaacauaaaagugcaaggugaacccacaagugcugaugucgaagcugcaacaaguuauccagaagagcuaguuaagaucauugacgaagguggcuacacuaaacagcagguuuucaauacagacaacacagccuuacacuggaaacagacacauuuaggaauuucacagcuagagagaagucaaugccuggcuucaaaacuucaaaggacgggaugccucucuuguaagcggcuaaugcagcuggugacuuaacuggaagccaauauucauuuaccauucugaaaauccuagaccccuuaacgauuaggcucaaucuauucugccugugcucuguaagugaaacaacacagccugaugacagcacaucuauuuacagcaugguuuacugaauguuuuaaaagcccacuguugaggccgacugcucacaagacugcuuucaguauauuacugcuuuccaacagugcaucuggucaucgaggagcucugaugaggauguacaugacugauguuguuuucauggcugcuaauauaacauccauucugcagccuauagaucagggagucauuuugauuuucaagccuuauuauuuaaggaauacauuucaaaaggcuauagcugccauagauacugauuccucugacggaucugcacaaagcaaagugaaaacuuucuggaaaagauucaucauucuagaugccauuaagacuguuugacauucaugggaggaggucaaaauaucaacauuaacaggaguuuggacaagauugauuccagccuucauggaugacuuugagagguucaagacuuucacaaaggaaguaacuacagaugaguuggaaacugcaagagaacuagaauucaaaauggagucugaauugcugcaaucucaugauaaaacuugaacagauaaggaguugcuccuuguggauaagcaaagacagugguuucuugaguuggagucuacuccuggugaagauacuaggaacacuguugaaaugacaauaaaugauuuagaaaacuacauacaccuuguugauaaagcaguggcaggguuucagaggaucaaguccaauuuaaaaaaauuuuuaauuaaaaauuuuuuuuagcugggcgcaauggcucacccuauaaucccaguacuucaggaggcugagguggguggauggcuugagcucaagaguucaagaccagccuggcaacagggugaaacaccaucucuacaaaaaauacaaaaauuagcucagugugacgucacaugccuguagucccagcuacucaggaggcugagacuggaggacugcaugagcuugggaagcagagguuacagugagccgagaucaagccacuguacaucaaccugggcgacagagugagacccugccucuaaaacaaauucagaaaagcuggcagagguugguugguucaugagguugaaggaaagaagccauccucauagcauaaaagugcaagguaaagcugcaaguacugaugucaaagcugcaaguuauccagaagagcuagguaagauuauaauuuuuguuuuagaggcagggucucacucugucacccaggcuggaguacaguggcaugaucauggcucaccguagccuugaaguccuagggucaagcaauccuccugucuuagccacucaagcaucuaggacuaugguguguaucaccacgccuggcuaauuuuuaaauuuuuuuauuucuuuagguagagauagggguaucccuauguugcccaggcuggucucgaacuccuggccucagcauugcaaagugcugagauuacagguuugaacuacuacaccuagcaaucaacucugauuuugaaagaaguccuucuauaaguaauaugcuaucaaacagcaucacauccuguagagaaauccucgugaaggccgggcgcaguggcucaugccuguaaucccagcacuuuggcacuuugggaggccagggcagguggauccccugaggucaggaguucgagaccaaccuggacaacauggugaaauccuguuucuaccaaaaauacaaaaaauuagccgggugugguggcaggcaccuguaaucccagcuacucgggaggcugaggcagaacugcuugaacccgggagguggaggcugcagugaaccaagaucaugccaugcacuccagacugggugacagagugagacucugucuacaaaaaaaaaaaaaaagagaaauccucacgaaagaaagauccagguugggugcaggggcucaugccuguaaucccagcacuuugggaggcugaggcaggaagacuacuugagcccaggagcucaaugcaauggagugagacccacgucuaauuuaaaaaaaaaaaaaagcgggggguggagugggguaggggaagaaagauucaacccauguggcaaacuucaucacugucucauuaaacaaacugccacaacuccaaucuucagugaccuccauccagagcaguagcacccaucaauaucaaggcaagaccuuccaccaacaaaaagauuaugacuugcugaaagcucagauaauugcuagaauuuuuuagcaacaaaguauuuuuaagauauuugaaaaaugugccaaguauaguggcaugcagcuguaaucccagcuacucaggaaguuaaggugggaagagcccuugacuccaaccugggcaacacagcaagacccugucucaaauuuuauuuuauuuuauuuugagacagagucucacucugucacccaggcuggaguacaguggcacuaucuuggcucacugcaaccuccgccucccggguucaagcaauucuccugcuucagccuccugaguaguugcgaauacagucgccagacacuacaccuggcuaauuuuuuguaauuuuaguagagaugggguuucaccauguuggccaggcuggucucgaacuccugaccucaugugauccaccugacucagccucccaaagcgcugggauuacaggugugagccaucacgcucggccucaaauuuuaagagagagagagagagaaaaaaagaaaaugucauacauaauauggacaguugagaaaccacaagguauaaccugaaguuuuuauaaguuagccaagucucuuuaaaaaaaaaaaaaucucgccaggcacgguggcucaugccuguaaucccagcacuuugggaggccaaagcggguggaucaccugaggucaggggucaagaccagccuggccaacauggugaaaccccaucucuacuaaaaauacaaaauuagcugggagugguggugugugccuguaauccuagcuagucgggaggcugaggcaggugaaucacuugaacccgggagguggagauugcagugagccgagaucacacuauugcacuccagccugggcaaaaagagugaaacuccacuaaauaauuaauuaauuaaucucauuuaucucuguguguagaugaauauguauauguguaguuauaaguuuaauuuggaggucauuuaaaauucuugaguaaagaucaguauuaacuacaauuacuaauuuagacuuugugcagcauuuacaaguaauaaaaauguacuuguagcaguuugcaauuugaacuauucaguaauucaggaaguuuacuucccacccauuuuauuccaaauuacugaugaaauacugcuaucacacauucuugugaaagugguauguugcuaaacaacauauaauuuaagggaauacaaaaaagaaccuacaauuuuuuuuuacaguuggguugaaacaauuuugccaaauaagguauacagccuaguugauaaaguagauugguuuaaguuagacaaaucuuagguuuuaaauuuucacuuccccauuuaccagccaggcauuaaaucugagucaaguuguucaccucucuaaugaugcuucuguuuuuuuucucaucugaaaaacaggaaucauagaaauuauacuuccaagauagccaagaggauuaaauuagcacaauuccuggcauaaagcaagcauucaauaaacguuagcuauuuauucacacuagaaaaagugugaacaaaaauuaaauguagaucaaauuuuaaaaugucuauuuuucacagcauuuuaaaaaccuguauuuugauauauagauuagcugauaaaaauuaucagaagauuugagauuaaaacgaaguagcucuuagcauauaaagugacguggcugcuuaacaugaugaaagagaaaguaaugagacuguuaaccuuggaaguaauuuuaguuggaugggaaaaguugauauuugaaagaauguaucuauuuaaauaugcagccacaucucaaaacuggaagcuaacuuucaaaagauacuaaccagguuuuaauuaugcuaaaacugaacugagaucacucacucgcagcuuauauucuaauuaaaacccaugaaggacagaaaagguuaaggagaggggcauauaaguuuaagaugccuguaagaggaauauccagguggaaauuuauacauaaacuugucuguauuggcuuuuaucaacuaugcuccagauagaacacuaggggcuuuagauaugcuaucucacaugaguuuacauuauaauacccugauuuuacagaugaggaaacugaggccagaaaauuauuugguucaagaccacuuauguuuauaccaagcuucagaccuacaaucuucuucaaaaaguacagguagccacaugggaguagaagaguccuaucugccuuuuaagaagauuucuugguggcagcagugaggauaaagaaaaugcaucugagaaauauuuagaauggaaaaccaccuaggcaugauuuuguacuaaggguggguggaacaguagcuaaaagagucagaugguuuuaucucuaacuuuguuuucaccaaacaagacaaaagaagagcugguuucgauagggguugaugauggggaaagaaauguuucaauuuuggauauacugaguuuaaaauaccugagaagaauauccacauguaaauuuauacaugaaguugcccauucuggccugcaguucagggaagaagucacgauaaauuucauucugcugaauuuaucagagcugaagacauguaaagaauguacggggacgaagggcagaaaggcacguuguuagaagcuuggagcagauagagcaaaaggccuuggugaaaacauuuugugucuaauuucucucgacccuguccaguauugcacauaacauacaacagagugaaauauaugaaugaauaaauuuauguuauaaaauuucugucugguuuugcuauauaaaaugccuauaucuauucauuauaaauaguuaaaggaaaaaguugcaauuugaguuuacagucuugaauuucacauuaaaagcaucaguaugaaaugauaauguacuuaaucucuagcaaugaauauggcuagcacccagaauggcuucuaaauuccauuucucaucucaaaaaaacuauaaacucauggguccuuagagaaauggcugauuccaugucucaggcaguaaaugccuucuggaauaucugaccagauaacaaggaagcuaccaaagauuacucgggguaugucaaagcucaagucaacuugaggagguucccaacagacaaaccuaggagaacccccuccaacuuccugccagcccuaagcaaucacuaaucuauuuuuugucuauaaacuuccccauccaagacuuucauaugaauggaaucauauaauaauguggacguuuggggcucacuucacuuaguauaauguucuaccauguaucaugccucauuuacauuuauugcugaaaaaauacuccacuccauauuccgcauuuuuauuaucuacagguuaauggacacgaguuguuuccaguuuuuggcuauuaugaauaaugcugcuauaaacaaucguguaaguuuuuguguggauguauguuuucaguuuguuggguauauguguaagacaggaauugcugggucauaugguaacucuauauuuaaucauuugagaaauugucagacugucuuccaaagcagccacaccuuuauauucccaucaagaguguaugaggaggcuggaugcggugguucacaucuguaauccuagcacuuugggaggucgaggcggguggauuacuugaggucaggagucaagaccagccuggccaauauggugaagcccgaacucuacuaaaaauacaaaaaaauuagcuggguguaggggugggcgccuguaaucccagcugcucgggaggcugaggcaggagaauagcuugaaucugggaggcggagguugcggugagccaagaucacgccacuguacuccagccugggugucaacgagacuccgucuccaaaaaaaaaaagaguguaugaggauucugauuucuccacauccucaccaacacuuaugauucaacuuuguuucuagucauccuaguggaugugaagugguaucucacuguaguuuuaauuuacauuucccugauaaguaacaauguugagcaucuucaugugcuuacuggacauuaguguaucuuccuuguccauuuggagcucugcccauuggguugucuuuuuguuacugaguugucagaguucuuuauauauucuaguugugaguugcuuaccagagaaaugguuugcaaauauuuucucucauucuguggguugucuuuuaugacgguguccuuugaagcacagaagguuuuaauuuuuaugaaguucaguguuuuucuuuugcuguucaugcuuuugguaucguaucuacaaauuccuugccaaauacaaagucaugaagauuuacuaauaucuuuuuuuuuuuuucaaggaguuuuaaaguuucaggccuuuaaccuauuuugaguuauuuuuuguauauggucccaccucguucuuuugcauguagcuauuuaguugucccaguaccaucuguuaaaaagcguauucuuuuaccacugaaagaucuuggcauccuuguuggaaaucaguugaacacaaauagguuuauaucuggacucucuauuccauugauuuauauguccuugugccaguaccacaaugcuuuaauuacuguuguuuugcaguaaguuuugaagucaagaagcugaguccucuuauuuuguccuuuuucaguacuauuuuggcuauucuggguccccugcaacuccauauuaauuucagaaucagacugucaaucuuuacaaagucagcaaggauucugauaggaacugcauugaauuuauagauuaguuuggagaauacugcuaucuuuacaauguugaaucuucugauccaugaacaugggguguuuuucuauuuauuuagauugucuuuaauuucuuucagccauguuguaaguuuucagaguaugaguuuuucuuuguuaaauuuauucuuuugaugucaccaugaauaaaauuauuuucuuaauuuuuuuuuuuuuuuuuuugagacagagucucacucugcugccccaggcuggagugcaaugguaugaucacggcucacugaagccuugaucugcugggcucaacugaucccccuaccucagucuccugaguagcugggacuacgggcaugggccaccaacaugccuggcuaauuuuuguauuuuuuguagagaugggguuuugacacauugcccaggccggucucaaacucccgggcucaagcaauccacccaccuuggccucccaaacugcuagaauuacaggcaugagccacuaccuccagccuguuuucuuaauuuaaugcuucacugcaaguguauaauaagacaacucauguuuguauacugguuuuauauucugcaaccuugcucaacuuguuuauuaguccuauacuuuuuaaaugaauuccuuacgauuuucuauaaacagguugaguaucccuuauccaaaaugcuugggggccaggcaugguggcucacaucuguaaucccagcacuuugggaggcugaggcagguggaucacuugaggccaggaguucgagaccagccuggccaacauggagagaccccacccgcccaaccccggcccaucuauaaaaaauacaaaaaaauuaguuugacgugguggcacaugccuguaaucccagcuaguaggggggcugaggcaggaaaauaauuugaacccaggaggcggagguuucagugagccaagagcacaccacugcacuccaaucugagugacagagcaagauugucucaaauaaaaaaaaaaaaguuugggaccgaaaguauuuugaauuuuagaauauuugcauuacauguuauuaguugaacauuccuaaauccaaaaacccgaaauccaaaaugcucuaaugaggauuuugagcgucauguuggugcucaaaacacuuugcacuuuggcgcauuucaaauuuuacauuuuuggauuugggaugcucaacguguauaagaucaggucaucugaaaacagucuuaccucuuccuuuccaaacuagaugccuuuuauuuaucuugccuaauuuccuuaccuagagucuccagugcaauguuaaacagaaauagcaagagcagauauccuugucuuguuccuagucuuagaaggggaaauucccagucuguuaucacugauuauguuagcuacgagguuuucauagaugccccuuuucagguuaaggaaacucuucucuauuccuaguuugcuacaguguuacuaucacuaaagggaauucaaugagucaaaugcuuuuucugcaucuauugauauaaucauguaauuuaaaaauuauucuauuaauauauuccauuaauuaauuuuaaauguugaacuagccuuggcaaccuggaaaaaaucccaguugaucauguaugauacaguuuguuuuuuaaaaaaauauguugugggauucaguuugcuaguacuuuguugaggauuuucacauccauuauucauaagagauauuggucuggaguuuucuugugacgucuuugucuggcuuuauugucaggguaaauaccagccacauaaaaugauaugggaacagcaguucccuccccucccguuuuuuggaagaguuuguaaagaaucgguauuaguucuuuaaauguuugguagaauucacuguaaagcuaucugagccugggcuuuucauugaagguaguuuuuaaauuacuaaucucauuacuugauauagaucuauucagauugucuacugcuucugacauuugacauaugacaauuauauugcuauaaaauuuuucauaguauucuuuuaugaucuuuauuauuuccuuccuuaugccuccuuaaguagguuugcucuuuuuccagugucuuaagguggaggggcgaggucauucauuugagaucuuucuucuuccuuaauauaagcaucuguaacuauaaauuucccucuaagcacugcuauaacuacauaccgugaguguuuguaaugucguaucuucauuuuuauucaccauagaacauuuucuuuuuuaaaauacauuuuaaaaaauagugacagggauucacuauguugcccaggcuggucucaaacuccugggcucaagcgauucuccugccuuggccucccaaagugcugagauuaaaggagugggcuaccaugccuaacccacucuagaauauuuucugauuucauuuggauuucuuuuuugaucuguugguuauuuaggaaugcauuguuuaauuaccacauauuugugagcuucucaaauuuuuuccugcuuuugauuucuaauuucauuccauauggucucagaacauaaucuccauuuuuuuuugagacagagucucacucuguugccagacugguaugcaguggcaugaucuuagcucacugcaacuuccgccucccagguucaagcaguucuccugccucagccucccaaguagcugggaguacaggcgcgugccagcaugcccagauaauuuuuguauuuuuaguaaagacaggguuucaccaugauggccaggauggucucgaucucuuggccucgugaucggcccaccuuggccucccaaagugcugggauuacaggcaugagccaccgcgccaggucauuugcauuaaaaucuauuggccaggugcaguggcucacgccuguaaucccagcacuuugggaggccaaagcgggugaucaccugaggucaggaguuugaggcuagucuggcuaacacggugaaaccccgucucuacuaaaaauacaaaaauuaaccaggcaugguggcaggugccuauaaucccagugacuggggaagcugaggcaggagaaucgcuugaacucgggaggcagagguugcagugagcugagaucacaccuuggcauuccagccuaagcaacaagagugaacgugaaacucugucucaaaaaaaaaaaaaagaaaaaagaaaucagagguuuguuucauggcuagcauauggucuauaauggagaauguuccaugugcacuugagaagaacauauacucuauuguugcugggugaaguguuccauagaugucaguuaggucuaguugguuuauagcgucuauuuacuuguugaccuuuuaauuuucuauacguuucuuuuuuuuuucuuuuuuuuuugagacagagucuugcuguguugcccaggcuggagugcaguggcaugaucuugacucacugcaaccuccaccuccuggguucaagugauucucuugcuucagccucucgaguagcugggauuauaggagugcaccaccaugccuggcuaauuuuuguauuuuuaguagagauaggguuuuaccaugauggccaggcuggucucaaacuccuaagugaucuguccgccucggccucccagagugcugggauuacagguguuagccacugugcccggccuguucuauacauuauuaaaagcgguauacugaagucuccaacuacuaauguugaauugucuguuucuucauuucuguuuuugcuucauguauuuugguauucuguuauuacauauaugcaacauaacuguuacagcuuccugaugaaaugacccuuuuauccuuauaaaacgucucuaguaacacuuuuuguuauaaagucuauuugcuggauacgaguaaaaccacucucgcuuucuggugguugcuguuuacaugauauauuuauuuccauccuuuuacuuucaaucuauuuuucuuugaaugacaauuaugucuccuuuagcuagcauacagcuggauaaugcuguuuauaaacuuagucugacaaucucugucuuuugauuucaauccguucacauuuaauguuauuuguauaguuagauucaaacgugcaauucuaugucccaugucuguuuuguuccucuacuauuccuuuagugcuuacuuuuguauuauuuucuaauguagcaucugcagguuuaaaaugauuuuuaauuauauuuuuugaguuguuuuuaguaguugcucaagguuuuagaauauauaccagaaccagcuucagaucuauacuagcuuaauucuugugacagacaaaaacaugacuacuauauaugucaauucccucccccauuuauaguagcauuguuacagauaucauaucugcucaugauuacaaacacaauauguggucaugauuacugcuuucccaucuguagucauuuccuuagcccaacacagcuuugcuccuacccacuuauuuuugugcuguuacuggcagauauauuacagauuuauuacauuucuuuguuaugggaucagcauuacauauauguauauacauauaaaauagcuugcuuuuuaauaaacuuauaacaagaaaggagaaaaauguuaauuucuuuuuuuuaaaguaauuauauaauuaccuuuucugaugcucuauuuuuuugugugcauucaaauuaccaucuagggucauuugccuucagccugaaaaaauuccuuugauguuccuuguaaagugggucagcuagcaacaaauuuucguuuuuaucuaggacagucuuuauuuugcuuucauuuaaaaaagauagcauuguuggauauaagauuuuugguugacaguuuucuucccucguccuuugcacauuuugaauauguucucccaacgccuucuggccuccacugcuauaagaagucagccauuaauccuacagugguuccauuuugagugaguuauuuucuuacuauuuuaaagauuuucccuuuuuaaacuuuuagcguuuuuacuguauguuuaaauugcuacauuuuucuuacuuagaaaaagauuuucaguaaagaugcuccaauguauggaauuauauccaauaagcccauuguuaguuaaaaauaucaaagucgaaaaugcauuuaauauaccuaccuuccuaaagaucacagcuuagucuagcuuaaagugcucaaaacacugacauuagcuuacacaguugggcaaaauaaccuaacacaaaguauuuuuaaauaaaguguucaguaccucauaugauuuauugaauaccacauugaaagugaaaaacagagugguuguaaggguacuugaagcacgguuucuacugaaugcuuuaucacuuucacuuuugugcuaucauacacuaaaaacuuguaagucaaaccaucauucguuuguaugggaaguuuucugccacuauuugaguguuuuuuucuauugcuauaucauuuucuauuguuaucuucuuucucuuccuccucuccuuccagaacucccauuacucuuaaguguuuaaugguaugugggauggugucuuauguuuugcugaagcucuacucauuauuaucuuaucucuguuccucaguuugcauaauuucuauugaucuauguucgaauucacuaaacccaucuucugccagugaagaagagcacugcuagugaauuuucgguuaauuauuuuuuucaauuccagaauuucuaauuguuuuuucaauaauuuuuauauucuuauugauagccucuauuuuaugcaaaauugucacuauacccacuuuuaccucuuuaugcuuuuucucuaguucugugaacacacuuaugauggcuauuuugaagucuuuucuguuaaaucugacauguggucucucucacacaggcaguuuauaaggucugcuuuuuuucuggugcaugagucauaauuucuuuuuucucugcaugccucauaauuuuuugcuagacacugacauuuuugauaauauaguauagcaaauccaguuacuguuccuuucuucuaccucccucuuucuuggugcuucuuacuguuucuugcuuauuuuuuagugacuagccgaauuauuuuagcaaagucuauuuccccacuuccccaaccuccacaaugcuaagccuuggauguugauccacagagagguacauuuuuggguacgcccacagucacccuggacuuacagugauauucuagcucuuaucacaccaagguguuaaacuccacuaacuguucuacuguuauuuaaaaaaaaaaaaaaaaaaaagcccuggguuuauauucuacaaauuaauugaaaucaaaauguggcucagguugggugcaguggcucacaccuguaauaccagcacuuuggaaagcugaggcagguggaucacuugaggccaggaguucgagaccagccuggccaacacggcaaaacccugucuccauuaaaaauaccaaaauuagcugggcuugguggcaugcaccuguggucccagcuaaccgggaugcugaggcaggagaaucgcucgaguccaggagguggagguugcagugagcugagaucaugccacugcacuucagccuggacaacagagcgagacucugucucaaaaccaaccaaccaaccaaccaaccaaccaaccguagcucauuugaaggaacaguuugaggucuaucugauauuucuucuugcuacaguagagcuucacuuagcugucuuauucuggucuuuucuauaguccucucccacaacuaccaccauuuuugagagugcccuuagcuuugaaauucuacacauuaucuucccaauuaaguaagcugcauucagaagagauuaagaacuauuggucuacuucuccccaccacaaaaaaucucugagccaagucucuaaagcuggggauggaaauaauugcaagauucucucagaaugaaaucccugcucuaggagcugaguacuuggcagaaagggggacagcaaccugaagacuucuaggcuugacucaaucauugcuucacaagccagcgcaacggcaauuuuugucccaguauucucagggugucaagcccaaaguacagccuucauuucauuagcaggggauggguguaagaagggagccucuaccucuaaagugcauuugcaauuauaauaaaugcaaaugauuuaaucacaacaaugaaaacacagagacagcacgaggagaaaaaagagaaaaaccaugaucucaauguagucuguuuauaaguaacuaacuucaaacauaucuuagguacguuaaaggggaaagguuggaaaagaauacauaccauuuaaacacuaaucaaaagaaagcugaacuggauuaacucaucaagugaaacaauucuguguauauaccuuaaaagacagcaucaaaauacaugaaguaaaaacgacagaaaugaaagaaaaaauauacaaggcccuaaucuuagagacuuuaacacuccugucucagccaucacaaaacuaguaggcagaaaauuagcaaagacauaacaccaucaaccaacuggaucuaacugccauuuauagaacauucuaugcaguaacagaagaauagucagucuuucuaauguauguucucugacccuaauggaauuacaacacaaaaauugguaacagaaagguaauuaaaaaaucaccaaacuucuuuacguugacuuguuccugucauugauuaguucuagcacgcuuuuuguauuuuuaaaaaauuacuuggguguaaauaaucaggucucucaauaagaaguuuuguuuuuuccuuucauaucucuaugccuauuauuuuucuugccuuuuugcaccagugaggacuuuuaauauaauguuuaauaggauuggugggaauagaacuugagggaaaggacaaucucgccuuuuuagcauccagucuuacuaucucuagguuuuuuguaauugcccuuugccagguuggggaaguucucucauuaacacaacacacuucuaacaauccauaaaucaaaaggcaagacacaagggaagcuauaaaacguuaaaaugaacaaaaaugaaacacaucuacauuuauggaaugcagcuaaaguagugcuuauagggaaauucauucccuuaaaugauuauaauuagaaaaugaguaaggucucaaauuaaucauccaaagugucugccuuaagaagccagaaaacaggccgggcgcgguggcucacgccuguaaucccagcacuuugggaggccgaggugggaggaucacuugagcccaagaguucaagaccagccuaggcaacacagugagacccugucuccacaaaaaauacaaaaauuaguuaggugugguaacauaagccuguggcuccagguacuuagaaagcuaaggugggaggauggcuugagcccaggaguucgaaacagcagugagcugugauugugcuacugcacucuagccugggcaacagagacccugucucaaaauaaauaaauaaauaaauaaauaaauaaauaaauaaauaaauaaauauuuuaaaaaguaguuuuauuguuguuguuguuuuuugggggggggauggagucucgucucacucugucaccccggcuagagugcaguggugugauaucggcucacugcaagcuccaccucccggguucacgucauucuccugccucagccacccaaguagcugggacuacaggcucccgccaccacacccagcuaauuuuuuguauuuuuaguagagacgggguuucgccgggguuucgccguguuagccaggauggucucgaucuccuggccucgugauccgcccgccuuggccucccaaagugcugggauuauaggcgugagccaccgcgcccggccuauuguuuugaugaugugcccaugucauuuuauuuuguaaaaguucuccaauacccuauuugcaugagcccaggaauucaagguuacagugggcuaugaucaugccaccacacuccagccugggugauggagugagacccaauuucuuaaaaugaaacauaacacccuauuauaaacuaaagccuacaucaucuaaguuacuuaauaagcagcaguuaagguuauuuuuguggcagaauauacacaaaauuuacuguuuuaacuauuuuuaagcauacaguuuguauguucacauuauauacauucacacugugguucaaccauccaucacuauccgucucuggagcuuugucaucaucccacagugaaacacaguacucauuaaacaauagcuccccauucuucccauccccauguuccuguagucacuguucuacuuucugucucuaugaauuugacuacugaagguaccucauauaaguggaagcauucaauauuuguuucuggcuuauuucacauagcgaaguguucucaagguucuuccacaauguacuacugugucaagauuucuuccuuucuaaagcugaauauaaaccacauuuuguucauccauucuacucaugcuggacacuugagucuuuucuacagauuuuaaaucccugacuuaaccaauaaaagguuugaaucacaaacuuaauuuccagguaaagagcaauguugaaggccaccuagcccuacagccuucuacuaauuaaaucacuugacugaaguuaccccaaacauagaauucuguauuuugcaguauuuugaguaagaguggcuaccaccuuaaacgguucacauuucucucuuccacguuggcaauuaucaccuguauuuuauuuagccacgacacacgacagcagaugucaugugugugacacaccucccugggcaaggagauuuuuguuuaaauuagagauggggucucgcuaugcuacccacauuggucuccaauuccugagcucaagcaauccucccauaucagucuccuaaguagcugggacuacagguccccaccacugugacuagcuccaauauuuuuuuaauugugguuaaaaaaaauauaaaauaaaauuugccauucuaaccuuuuuuuuuuuuuuuuuuuuuuuugagauggagucucgcucugucacccagacugcuggaguguaguggcgcaaccuuggcucacugcaaccuccaucucccagguucaagcaauuauccugccuuagccucccaaguggaugggauaacagguguacgggacucaccuggcuaauuuuuuuguauuuuuaguagagaggcgguuuugccauguuggcuaggcuggucucaaacuucugacuucaaaugauccacccgccucggccucccaaagugcugggauuacaggcaugagccaccgugcccggcccauucuaaccauuuuaaaguguacaguucagugacauuaaguacaaucacacuguugugcaaccauuuccuauuuccaaaauuuuucaucagcaaggccagauuuuuacaaaacucaaaagaacugcagggaacaaaagcaaagcgcaccagacuuuauuuuggcaugaucacugcaaaauaaucuuauguaagaauuacucaauuuaaauuuauaucaaaagauuuucauuuuuaauaaacacaauuauauguucaaucucauuuuaaaaaauuaagcuuuauucgacaaugagaaggcaucuugauuuuuuuucuugauauuaaaaaggcaaagcaggccaggcgcaguggcucaugccuguaaucccagcacuuugggaggccgagguggguggaucaccugaggucaggaauuugagauccaccuggccaaaauggugaaaucccaucucuacuaaaaauacaaaaaaaaauuagcugggcaugauggcaggugccugcagucccagcuacucaggaggcugaggcaggagaaucuccugaauccgggagguggaggcugcagugagccaaguuugugccuuugcacucuacccugggugacagaguaagacuccaucucaaaaaaaaaaaaaaaaaaaaaaaaaaaaaggcaagcagcugggcacgguggcucaugccuguaauccaagcacauaugggaggcugaggugggcagaucaccugaggucggaaguucaagaccagccuggccaacauggcgaaaccccgucucuacuaaaaauacaaaaaaggcaagcaagcaaacagguagguaaauuuuuucacauuuaauauuagaauucaugcaauuuauagaauuauacuguauaugauguuaauugcaaauuuuuucauuguaucauucuugcucauaggcaauacggacaaacaacucacacuuugcagucauccuccucuuauuaaaaguuuauucauugguaaaauaaaauucaaguaacuaauaaucacaaacacuuugguaauguauaauuaccacaacuguucaugguaccucaacaaacauuuacugguggcauauacuugugcuaaagcccagaaaaguaaaccaagucaguuacuuaaugucaguuauuaacgucagagcuagggaugucaguuacuuaaugucagggcuagggauggagcacagaugacuugguucuuaagaguccacuacuuuguacaaaaagcacuguuggccaagcgugguagcucaccccuguaauuccagcacuuugggaggcugaggcggguggaucacgaggucaggaguucgagaccagccugaccaacauggagaaacaccgucucuacuaaaaauacaaaauuuagccgacgugguggcacgugccuguaaucccagcuacucuggagacugaggcagaagaaucgcuugaacccaggagguagagguugcagugagcugagaucaugccacuacacuccacagccugggaaacagagcgagacuacgucuccaaaaaaaaaaaaguccacugcuuuguacaaaaaucacuguuaaaaacaggaccugggggccaaucucucuaaauuuuaaguauauuuugacuucuuuucuuugugaaaaucaucacauccauauacacaaaacgaucugaccauaaugcagucacugacuguggcuccuucuaucuugcggcaucugggauucuggcugaaagguuuuaccagugcuggugggaaccagugaguucuuccuuuccgaaguauggagcaaagccauguccuuugaguuugaacugguggagccaagaguuccucacuagucucuuuacuaaggaguuuuugguuuucauaaaaaucuuugcuuuuuaauuucuucucuguauuuuucauucuuuaguauuuccuccaucguagguggaguuauucuuguuuucuuuuuuuuuuuuuuuuuugagauagaguuucgcucucguuggccaggcuggaaugccguggcacaaucucggcucacugcaaccuccgcuucccggguucaagugauucuccugccucagccuccugaguagcugggauuacaggcgugcaccaccaugacuggcuaauuuuuguauuuuuaguagagaugagguuucaccauguuggccaggcuggucucgaacuccugaccucaggugaucugccugccuuggccucucaaagugcugggauuacaggcgugagccaccacacccagccucuuuuuuguucuucugaucuaagcuucccauucuguuggaauauccccuacuucacagucuaauuuuuuauuugcugcuucuacaauucuuuucucuugaauaguuuguccucaccucuccaguucuuguacucuggaauagaguaguauuuguucccaaaccaguucaugcccacaugcuccuauacuucuuuugacagugauauccacaaggcacacaacaaauccugagaccaacccgugcuguccacucugcucucagaacugcuagcagccaguaugcagcagggguaaugcuccagccacugauccagcccaccuacaaguauucuuucuagugauuugauaauaguguaagaaaacuuguuucuauaaaggaacuguucuuguuggaauaaaaaucuuacuacuucuaaaacucauauucgaucuguucaaagcaguaaaucaacuauccgaaaagugacaaacuacacaacuaaaaagauugauguggaaaaauguuaggacucauuacagucaauuccuuucuaaauuaucagacugagacgaaaucaggcaaauucuguaacaaagugaucuuuaaaaaaaugaaaaaaucaccaaugggccagaauauuaaaagcugaguccuuagcuguaguuauuugcugccuaacaaccuaaagagaaaaaagugacugugaaaaugacagauauuagccuauucugauuaucugaauaucccagaaaaauacauacuuuuugaccuguaaauguauuuuuaaaauuacaauaaacuuaaaaaaaaucuauuaauuugaauagucucugaaacuuacuaccugaaauuuuccccauaaauuauaucucacacuauaacuacucaauuccuauuaagguuucuaauucuagaucugccauagacacucgugguaucccugucccuuugaacuacagaagauugcuccaaggauaaauacauuugaaucuucugacacauuacuaagcauuaauuaaaagaauuauagucuuuucauauuacccaaaacucagugacagauuucuucaccucaugcauaauuaggcuuugaguauuucacauucaauucaauuaucaaugaauauauuaacguugccuggagacagcauguccacuagguagaacaacagcuuuuuaguucagacagaccugcauguuaaucaugguuauaugacuguaguggcuggaugaccuuaaacaagugagcuuucugaggacugucauacagauucaaugagaugagucuauguaaagagcccagugcccagcacagacuguuuauauaagaauauggugcagcagugauuaacagauaagcuaucauuauugacagaucucugacucuaccaccuuugacuaaaaucucagcaauaucccucugaaugucaauucugggcuucuacugaccagcuagagugcuagacaauuccaucugaauguguucgccaucuugcaaauucaaugucugaaaacaaacucaaauuauuacccaacuaacauaccacuacagaauuucuuaaucuguuaaucauggacaccuucaauugcucagucacccauagcuuaaaaucuaguacucauuuuugauucuccaugccccaucccucaccucccaucaaaacuggguaucauccaucaggcacucucccuucacagccaaguuuauaaaaauuacagauacuccccacuuauaaauguuuaucauaaaucaaagucauuucucagagcaagaguguuaacuaugccuauuaccaagagaugauaauaauggacuuguguggucauguaagucuuagcucucuagucuucauuaguuuuuucucugugcuuaguuuugagguauauuacuaaauccagcauguucgauaagcacaaaaacaguaagaauggugaaaguacuaacaaacagagguaaguguuggaaauaaaaugcagagacauauuaauaaagaauaagaaagcuucugcucccauaaaugggaucaauauuaaauagaaugaaugacucuaaaguacuugcaacaaauccugcaacauaugaagaugauauaccuacaugauaacugauaauaguaagagaaggaaauaaugauuggagaaauggaaaaacuuuggaguaugugguuagagugggauuaacacuagacagcggauuuuaaacucgaaucucaggccucuuuacacucuuaaaauuuauugagaacccaaaagagcuuuuauuuacaugaacuauaucuaaaaauauuuaccguauuauaaauuaaaacuuagaaauuuaaaaaauuauucaccuaaaaauaacaguacauuuuaagacaacauaguuuucaagaaacuaaauuuucucagacaaaaaaaaaaaaaaagaaagaaaaaggcaagaguagcacugauuuuugaaaaucucuuuaagucuggcuuauuggaaaucagcugaauucucacauguguuaagucuguuacaguaucacacuucagcugagcacaguggcucacaccuguaaucucagcacuaugggaggcugaggcaggcagaucaccugaggucaggaguucaagaccagccuggccaacauggugaaacccccgucucuaccaaaaauauaaaaauuagccgggugugguggcgcacaccuguagucccagcuacuugggaggcugaggcaggagaaucacuugaacccaggagguagagguugcagugagccgagaucaugccacuguucuccagccugggugacagagccagacucugucucgggaaaaaaauaaauaaauaaauaaaauaaaauaaaaaaauaacauuucaaguagguagccucuggaaaacuccauuguauaucuaagaauaagaaagaaaaauggcaaguagugucuuaaaacacugcuagaagacuguuuuaaucucacguacucucuaaaagguucucgggauccccaggagaguccucagacuacauuaaccacugcuuucaaguuuaauguuaaaaaucaggacacaggccuggugcgguggcucaugccuguaaucccagcacuuugggaggccgaggcaggcagaucaccugaggucagguguucgagaucagccugcucaacauggugaaacccugucucuacuaaaauacaaaaauuauccaggcauggugacacgcaccuguaaucccagcuacuugggaggcagaggcacgagaaucgcuugaacccgggaggcggagguugcagugagcugagaucacaccacugcacuccagcgugggugacagagcgagacuccgucuuaaaaaaaaaaaaaaagaaaaagaaaaugaggacaugguuaggaauuuguagacaagaacuuaaaacaagacuaagcaaggugaauggacugcuguuuaaauaaaccacagaaagacaguuccacaucugcaagauucuaccaaaucugcauagcaaaaaguaguaaaacaaugugaugugggaagugcucaagaggucuguuuugccauuugucacugaagauggauggguguaauguuuguguauuugaggcaggggucccuuaccugaacaaaucugcaacguagauauaaaaaauuuagguggcugggugcgguggcucacgccuguaaucccagcacucugggaggcugaggaaugugggucaccugaggucaggaguucaagacuagccuggccaacauggugaaaccccgucucuacuaaaaauacaaaaauucgucaggcacaguggcgcaugccuguaaucccagcuacucaagaggcugaggcaggagaauugcuugaacucggagguggagguugcagugagccgagaucccacugcacuuccagcuccagggcaauagagcaagacucugccucaaaaaaaaaaaaaaaaagauuuagguaaaagacgguggucaagagaauguuuaucuggccaagaaaaauagaagcuaauggguagcuucagaaguuagguuuccuugcagacuuuaaaaaaaaaaagguggggguggggcacacaaaacaagccaacuaaauuugcauaucuguauugaaggccuagaauuguggggaucguuuuguuaccauaggagagccagccuaaggauggcaaagcaagaacguauguccucaaggaugucacugaauugcuaauuuaaccaacucugaggcuguuuuuuguuuuaaauaaauguccguauuguuuaagccaccugauucgagguuuucugauaacauaaauugaauacccucauacacauggcccauagguacuucagcagaucccaagugaauucauuaucaucucucaaaaaugcauucuucuuuuucaaguacucuggucaaugacaggaccagcuccaaaaagcuaaaacccccaaauguccauguucuaaucccuugaauuugugaaugauaccuuuauggcuuugcagaugugaugaaauaucuuggaauggggagauuaucccagauuacccaggugggcccuaaauacagucacaagucuccuuauacaaggaaggcagauguagacuuggcacacacaggagaaggugaaaaguggggaagaggaggugguguagcaacgugaagaccagugaugaaugauauagucacaagaugaauaugccugcagcccacauaagcugcaagaggcaaggaaugguuucucuccuagauccuucggagggaaggagcacuugccaacaucuugaucucaacccaguuaugauuauuucaagcuucugugaggaaauuacuucguuguuuuaagccaucuaauuugugauaauuaauuacaacagccacagaaaacuaauacaauuucucuuccccuuuuccuccuaacacagaccuggucaccaagaccuaucucaaauccaucccuuccuuucuccacugccacugccucugccucugccuuggacuacugaaacagcauccugauugauuuccuugccuucagucucaccggccuuauauuaaucuuuacuguuauuuaaacugucucuaaaauacaauuaucugaguccagacacuuauuagcccacagcuugauaaucacgcugaacuaucaacaguacuugguacuuuucaguacuauccuacacucuaucacaucugacauggacugauuuaaauacauaaaauccuugagaucuggcagaacuauuauuaucucccauuacauugauggggaaauugaggcucagagaauuaaaugacuuggcuaagcuuacagggcuaguaacagcaacuuauauccugaugguaaacuuucucgcuauuuuauaaucucucuauuaugcuuuuagauacuuuaggcugcuaucucucccucccugcucugcaaaaugaacucuuugcccuaaacugcuuuugacucaucauuuuccauauguaucauacauauucccacucucccagcucuggucccuuuuuggaauucccuccucacugaucuccacaggucaaauucuacuuuauuuuguuuucccuucuaagcuaaaugucaggaaagccuuuguuguuuuuuuuuuugagacggagucucauucuguugcccaggcuggagugcaguggugcaaucuuggcucuugaauugcuugaaccucugccucccggauucaagcaauucucgugccucagcuuccugaguagcugggauuauaggcgcgugccaccauacccagcuaauuuuuguauuuuuaguagagacaggguuucacuauguuggccaggcuggucucgagcuccugaccuugggauccgcccaccucggccucccaaagugcugggauuacaggugugagccaccgcgcccggccagccuuccauuuuuaugucacuuucagauguacuuucaaauauauucuuuggaucuuaaaaucuuaaugaaacuaaagaugagaaaaauaaagauuagagaaaauauggccuaacagggauucaaauucagagccucugacuuuaauuaaauccuauccucauuuuaucauuaaaccaagcugucuuucucuacacugaacucuggugguaguucuguugggacucacugauccuguguuugauagcauaucaauuuagguuuaccaggguauacacucuaaucucuccaaggauuauuccaauauauuuauggaaucaaucacaucuguacuuccagcauagguucuuuaaaaaucacuuuaugaaugcuuuccugauauaauucauguacaauaaacugcauaguggacaauuugaugaguuauaacauauauaucaccaccacaaucaagauaaggaauacugccacaauuucuguaaguuucuuugcagucucaccuuccuguccuugccaggaauuaucaaugugcuuuacacuuuaguagcuccauuuucuagaauuuuauauaaaugggauuauauaguauguacucuuuuuuucuggcuucuuucauggacauaauuauucugagauucauccaugcuguugagcguaaggauuuuuguucuuuuuauugcugaauacuauuucauugcauggauguaacacaaucuguuuaucauuuaauuguugauagacuugaguuguuugcaguugggcuauuacgaauaaagccgcuaugcacauuuguguacaagauuuguguggacaaaccagcagauguucuuaauuauuucuguuucuauaccauuuauguguuauacucuuaauauggcuuauuauacugcagugauuccauaaaaaaagucacuauccaccaguauaauacuuuacauacaagugaucaguaaguaguuuacagauuuugcucacccaugggccuaaugagacuugacagaaaaggcugagccuugucuauauucuauaacugccuaaaagaguacauacacugguaugcaacaagaucauaagaaaaaaauuaaaaauuaaaaaaauaaauaaaagugugcauugaaaaauugcugaauaaauguucuugauuuacggugcuuauuuuugggauaagcguauuauucuuuuauguucaaucacauuauuauuaaaagcuuaauugcaaaugauaaacaaaacauauaaauuaguauuuuaagaguguaacauacacaacauacaaacguuuugcaggaaaccuguuaaaacaauugauuuaggaauggaagaaccacagcucaacguagaaacuucauguuaaacuuacauggaaaauguauacguguacucaaacuagugaaaauuacaacucacccaccccaccaaaaguuauuaaaauaagacguuucucacuauuaagacucuuuuuuacuuuacaaauagagcaguaccucauauuuuauauuuugcucuaaacuugucacucuuaucaaucuaaguaaaggcauuuucccaugauaugaaccaaguuuuuagauuagauuuacaugagaacucauauuugggaacaugcuuuuucuuuuucugaacacuacugaaaguguuuugugaucuuuauuucacacuaguuuacuucccuuaaguguuuuuuaaguuuucaaggagaauuucaaauggacuacuuuaucugaguuguaaaaagauaauuuuaggccuggaacaauggcucaugcauauaaucccagcacuuugggaggccaaggcaggaagcucauuugagccuaggaguucaagaccagccugggcaacacagagagaacuugucucuacuaaaaauuaaaaaaaaaaaaaaaaaauuagcuaaguguggugcugugcaccuguaguccuggcuacacaagaggcugaggcaggaggaucacuugagccugggagguugagacuacagugagcugugauuucaccacugcacuccagccgggaugacagcaagaucuuguaucaaaaaaaaaaaaaaaaaagaccauuuggccgggugugguggcucacaccuauaaucccagcacuuugggaggccaagguagguggaucaccugaggucaggaguuugagaccagccuggccaacaugaugaaacuccaucucuacuuaaagaaaaaaaaaaaaaaaaagaaagaaauuagcuggguaugguggugcacgccgucaucucagcuacuugggagguugaggcaggagaaucaguugaaccugggaggcggagguugccgugggccaagacugcaccauugcacuccagccugggcaacaaaagcgaaauuccaucucaaaacaaacaaacaaacaaacaaaaaaaccauuuuauaacuaguuguuuuucaaugaaacaaagauucuaaucauuuuacucuaugaauaagcccuuucuaguucagagauuugaaaaaguaauggagaguuaucaauaaaucaauuaaaucagaaacauuaaaugauuagaauuuccucuccuuguuaguagucaccaagucaugcugauuguuacuuucuacaucaagagaagauaaauuaauguacauugaauaacucccaccaagugucacuaucucacucuggacucacaaacucugguaaaaggauuuuuuauauccaguuauaggccgggcacgguaacucacaccuguaaucccaguacuuuguggggccgagauggguggaucucuugaggccaggaguuugagaccagccuggccaacacagcgaaaccccgucucuacuaaaaauacaaaaauuagcugggugugguggugcacgccuguaaccccagcuacuacucaggcgccugaggcacaagaauugcuugaaccuggggggcagaaguugcagugagcugagaucacgccacugcccuccagccugggugacagagagagacucugucuuaaaaaaauaaaaauaaaaauaaaaauaaauccaguguuaaaugaggagacagaaaaucaaauuaaauuguccauuucccuauaacuaaguuaacaaaaccaggauuuacacaaaggucuauaugaccaaaaaaaaaaaaaaaaaaaaaaaaaaaaaaaucuucaauucccaguuauuucuccccaccccauuauguuguuguuuauaauaauuuaacccauuuaugccagagguugcaauuauuugaauuuuugcaaucagaccuuagcgaugaccuugagcaggacagaaauaacucccacaugcuuaguguuccaauaauggaacgguaggcaaaacagguuaaucagaguacuuaagggauaucugcuauucacaucauauuauuuuaucuagaaagaaagacugaauagagggccuaucuaucuuauucauccauuuggcuccuuacaugagcaaguaaaauucaagucaguuuuagucaacuagcauuuaaagagcuccuuauuuucccuaaagaguuuuuaagcguccacaccaaguacucaagaguucaacugcauauacgcuuuaaaauauguauacaaguggaagcaacgucagccccgagaacugaguagcuguacugugugacgucgugaucuaggcacuucuuggacagcaaugucucaccugccaaugaaaaacuccugcgcaagaagaucaagaagcagaaacucaaacugcggcaccagaaccuaaaguugcaggggccucaaaucugacccugucagaaacucaaaaugcagaugugucugaagaaacaaugagagguagaaggguuaaaaaaugaaaacauucuaugaaugugggcuuaucagaagcuccaaauggagacaugucucaagaggcaguggaagauauaaaaccuaaaaaaucuccccagaaauccaccguauuaaccaauggagaagcagcaaugcagucucccaauucagaaucaaaagagaaaaauggugaaugaugcugggacugauacaaaaaaagcaaaaacugaaaacaaagaggaaucugagaagaaagugccgagacuccuaaagaaacagaaaauaacguagagaagccagauaaugaugaagaugacagugaggugcccagccugccccugggacucacaggagcauuugaggauacuucauuugcuucucuacauaauauugucaaugaaaacucugaaguuaaaaaaaaaaauggguuuuaccaacaugacugaaauucagcaugaaaguaucagaccacuucuggaaggcagggaucuucuagcagcugcaaaaacaggcagugguaaaacccuggcuuuucucaaaccugcaguagaacucauuguuaaaauucaugcccaggaaugcaugcggaguccuuguucucucaccuacuagagaauuagccaugcaaauuuuugguguucuuaaggagcuaaagacucaccacgugcauaccuauggguugauaauggguggcaguaacggaucugcugaagcacagaaacuugcuaaugggaucaacaucacuguggccacaccaggccgucugcuguaucauaugcagaauaucccaggguuuauguauaaaaaccugcagugucugguuauugaugaagcugaucguaucuuggauguuggguaugaagaggaauuaaagcaaauuauuaaacuuuugccaacauguagacagacuaugcucuuuucugccacccaaacucgaaaaguuuugaagguuggcaaggauuucucugaaaaaaggagccauuguauguuaguguugaugaugauaaagcuaauacaacaguggauggucuugagcagggauauguuguuuguccuucugaaaagagauuccuucugcucuuuacauuccuuaagaagaaccgaaagaagcucguggucuucuuuucaucuuguauguccgugaaauaccacuaugaguugcugaacuacauugauuugcccgucuuggccauucauggaaagcaaaagcaaaauaaauguacgaccacauucuuccaguucugcaacacagauuugggaacacauuguguacggaugugguggcaagaggacuggacauuccucaagucaacuggauuguucacuaugaccauccggaugacccuaaggaauauauucaucguguagguagaacagccagaggccuaaaugggagaagacaugccuugcccauuuugggcccagaauaauuggguuuucuucuacuugaaacaauccaagguuccauuaagugaauuugacuuuuccuggucuaaaauuucugacauucagucucagcuugagaaauugauugaaaagaacuacuuucuuuguaagucagcccaggaagcauauaagucauacauaugagguuaugauucccauucucugaaacagaucuuuaauguaaauaacuuaaauuugccucaaguugcucugccauuugauuucaaagugccugccuuuguugaucugaaugucaauggcaaugaaggcaagcagaaaaagcgaggagguggugguggauuugacuaccagaaaaucaagaaaguugagaaguccaaaaucuuuaaacacauuagcaagaaaucauccgauagcaggcagcucucucauugaagacaugccuuucuuucaucuugaauaacuguucuaaaaugaauuuuuuccccuugauuuaauaagauuuuuguagccuuuagaauuuaaacuuaucuaacaagagcauaaauugacuuggguugcaagcacugagcacuguaacuucuaucaagucucuuuuuauuuuugggauauaaaacaggcucuaauuuucuugguugcccaagagcagagcaagaauauuaggucuuucuugugauuauauaauauuuuaauuuuaaauaucccucccucauacacacaaauguauguuacuguuuuaauauaauuaaauuuuuguaccuuuuaaaaaaauauguacacaaguacuguggcuuucgccaacuuaccucugcacaagcaguuaacuuuauauaugucuugguaugggguugaauuggguucucuaaaaagauacguugagguccuaaaccccagugccucagaaugggaccuuauuuggaaauggagucuuuauagagguaaucaaguucaagggagaucauuaagguguccucguauaaaggggacauuuguagacagacaugcacauagggaggaugccccaugaagacaagccaaggcacuaccagaagcaaagagacguggaacaagagaugcuucccucaugguccucaggaggaaccaacccuaccuaugccugauuucgaacuucaaggcuccacaacuaugagacaaaaauuucuguuaacagccaccuacuucgucauaguuuguuacggcacccuagcaaacuaauacauguugcuuuuuaauaaacuaaauguuuugacuaaaagucacagauugucagaagagauaaaagcauucucaaauauauguuuuuuauaagaaacacacuuuaaauaaaaaaagacagauauggaagaacauauaucaugcaaacaguacguacaagaaagcuggaguuggcuuacuuuaauaucagauaaagcagacuuaagacaaaguauuaucaaagauagaggugaguaauaaaaaauguguaugcuucaaaauaaaacacugacaaaauuaaagggaaagauaauuccacaauaauaauugaugauuuuuuuuuuuugagauagggucuuacucuguugccuagauuagagugcagaggcacaaucacaacacacacagccuggaccucccgaacucaagcaauccucccaccuuagcuuccugaauagcugggacuacaggcaugcaccaccucacccagaugauuuuuguauuuucuuguagagacaggguuucauuauguugcccaggcuggucucaaacuccuggggcucaacgaauccacccaccuuagcuucccaaagugcugagauuacaggugugagccaccaugcccggccaaaaguugaaguuuuuuuuuuuuuuuuuuuuuuuuaaagacugagucucgcucugucacccaggcuggagugcaguggcaugaucuuggcucacugcaaccuucaacuccuggguucaagcgauucuccugucucagucucccaaguggcugggacuacagguacgugccaccacgccuggccacuuuuuguauuuuuaguagagacggaguuucaccauguuggccaagcuggucucgaacuccuaaccucagguuauccgcuugccucagccucccaaagugcuaggauuacaggcgugagccaccacgcccagcaauaguugaagauuuuaauaucaccucucugcaauuauagaacugaaccacacagacacacagacacccagacacacacacacacacacacacacacaaaaccaucaguaaagauaaaagaucugcagcuugggaaacauggugaaacccaucucuacaaaaaauacaaaaauuagccacacauaguggcaugcaccuauagugccagcuacuugggaggcagaggugagaggauuuguuaacccugggagguggagguuacagugagccaagaucgauccacugcacuccagccuggguaacagagugagacccugucucaaaacauuaaaaaaaacuguaaagggcaaucaucgucaccacauugacauuuauaguacagaauauacauucuuuucaagugcaaagugguauguucaccaagaaagaucauaugcugggccauaagacaaaucuuaauaaauuuuaaaggaaugaaugcacagaguauguucuuucaccaaaacagaaaaaaauaaguaauaaaauaucaagaaagcccuaaauaucuggaaauuaaacaaugcacuucuaaauaauaacccaugggcuggucaaauaaggaaucaacaaaggaaacuggaauauauuuuuaacuguaauucagcuaggcauaguggcacgcaccuguaaucccagcuacuugggaggcuggggcaggagaaucacuugaacccaggaggcagaggucgcagugagccgagaccgugccauugcacuccagccugggugacagagcgagacuucgucucggggacaaaaaaaaaaaaaaaaugauggucucuaaauaucaaugacuuaccaccucauacccauuugaaugucuaauguaauaguaaaaaaaaaaaacaaaauaacaagucuuggcaaggauguggagaaauuaaaauccuugugcaugguuggugggaauguaaaauggcauagccacuauagaaaacaguauagaggggcuccucaaaaaauaaaaaauagaaauuaccauaugauccagcaauuccauuucuggguagauacccaaaagaagugaaagcaaggacacaccaguauuuguacauuaauauucaaagcagcauuauucacaacagccaaaagguagaagcaacccaaauguccacaagagaugaaugaauuaaugagauguggcauaaauacacaauggaauauuauucagccuuaaaaaggaaggaaauucagauacaugcugcaacacaaacaaaccuugaagacauuaugcgagugaaauaaaccaauaauuaaggaacaaauaccauaugauuccgauuacacgauguacuuagaggacacucaaauucagagacagaaaaguagaagggugguugccuggggauguggggagacagagauggggaguuacuguuuaacgagcacaguuacacuucugaaagaugaagagaguucugaaagaugggugguggugaugguuguauaauaaugugaauguacuuaaugccacugaacuguacccuuaaaaaugguuaugauggcaaauuuuauguuacguguauuucaccacacacacacacacacaaaucaauggucuaugugucuaccuuagcuagaaaaagagcaaagaaaacccaaaauaaauagacaaaacaaagcacagacauaaauuaaacagagaagccauaggaaaaauuaaagccaaaacuugguucucugaaaaaaauaagcaaaauugauaaaccuuuagcuagaccaauuaagaaaaaaaagaggaaaaaagugaaggcgggguaucagaagggaaaccugugaaagagauagauacacagaauaaccagcauaguaggaguuacuucagaaaccaaggguacaagguauuucaaggaguggugauugacagugucaaaugcugcugacuggucaaauaagauagaaaccaaagucuauuugauuuagccacagaggaaucacugaugaccuuauaauagcauauaagaaaaaaguagaauuagaagcaagauugccauagaaaaagaaagaauauacagacaugaggaagugaaaacugugaguaaagauaauucaucauaaaguagcuagguucuaaaaauagagcaaggggguuagcuggacaaaaguaaggggucaggcgaggauacugauuuuuuacagaauggacaagcuagaaaauguuuuuuucccuuguuacucucucagauuuuuuuuuuauuaaaguaaaauauaaacagaauguuuugauuuuuguuggaaaagacacagaaaagagggaaagguuaaagauacaggaaacgggugauaacagaugguauaaggucccuagauagguagaaggaaaugggauucagaggaugagugaaaggauuagccuuaaacaggcggaggcccaggcuggggagauggggagaggaaagaaagaguacagcuauaguuaaguuuauugguggcguggugagaaguagcuagaguucuugucuggcuuuggcuuuacuccucuuucaaguuuuaagaggcagacuccugagagaaaagaugaugaaguagaauuuuuaagaaaaugaaacaugaaaaauaacacguggaggccgaguaugcuggcucaugccuuuaaucccaccacuuugggaggccaaggcaagcagaucacgugagcuuaagaguucaagaccagccugggcaacaugguaagaucacguagaugcgggcaucuacaaaaaauauaauaauccgcugcgugugguggugugcaucuguggucccagcuacuugggaggcugaguugggaagauggcuugagccuaggaggcagagacuucagggagcagagacugugccauugcacuccagccugggcaauugagccagauucugucucaaauaaauaaauaaauguggagaaaaaaguagaaggauguaugauaagaggcacugaagacccaacugcuuugaaccauuuuauauuaaaaguaguaacaauaggcaaggugcaguggcucaugccugugauuucagcacugugagaggcugaguugggcaggcugcuugagcccaggaguuugagaccagccaaugcaacauggcaaaaccccaucucuaguacaaaaauuagaugggagugguggagugcaccuguagucccagucacucaggaggcuaaggugggaggaucucuugaacccggugagcccaggagaucgaggccauaaugagccacgaucacaccacugcacuccagccuaggcgacagagggagacccugucucaaaaaaaaaaaaaaaaguaauaauaaucauuaguuuauaguuaauacuuacauaguacccaauaugugccaaguauuguucuaaguacgcuuuacauauuauguaacuuaauuuucacauaaacuuuugugauagcuaucaccagguaucuucauuuaccagugaggaaaaggcagcauagacaaguuaaggaacuagccacacaacagguaacagagucaagaguugaacccagcuagcaugcuaacuggugcuccuuacacuaugcuauacugccucucaaagugaaguuagguaaaacuaguggcggaaaguagaaagaaggaaaaaacaauaccaaguggacacaaagacaaagagaagcacugauuccuguaaauaaaaauaauucucuuggaagaauggguuaguuuuauacagcaugugaagugcaccaaagacaaaagaaaccguccugauucaguaauggaaagccacaaaaaggaaaugagcagugggaagguccaaagcagaaaguaagaagagcaaagagccaaagaaaaaguaaaacccaggaaaaauguaaaaaggagaaaaagcuguaaguagaagaaacacauacacacaacaguaaccaccaccaguaaaaaagugaaaugagggccgggcgugauggcucacgccuguaaucccaacacuuugggaggcugaggcaggugaucaccugaggucaggaguucgagaucagccugccugacauggugaaaccccgucucuacuuaaaaaauacaaaaaccugcugggugugguggugcgcaccuguaaucccagcuacucgggaggcugaggcgggagaaucucuugaaccuggaaagugcagguugcagggagccaagaucacaccauugcgcuccagccugggggaccagagugaaacuccaucacacacacccacacauacacaaaagugaaauuaaagcaaaguaaguaaaucuaagucccugaaaaacuuauucuuuauuuucuuaucaaagagcacgauuauuuaauaaaauacacuauuggauaugcuuaucugccaagaauaggcaaggaucagauaccuaacagguuaagauuggaauaaaagaaaauaauuuuuaaaaggaaucaucuaaaguuguuucagaagcuagaggguaguaguuccacaaaaacuagauuccagagacucacagucuuaguuacacguugccaagauguuuguaguuaugcugagugcguaaaaaacuaucaaaaccaaaucaauagcaaaucacuucagcauuaaaaaauacauaccaaggccgggcacaguggcucacacguuuaaucccggcacuuuaggaggccgagguggguggaucaccugaggcugggaguucaagaccagccugaccaacauggagaaacccugucucuacuaaaaauacaaacuuagcugggcgugguggcgcaugccuguaaucccagcuacucgggaggcugaggcaggaaaauugcuugaagcugggagguggagguuguggugagccaagauggcgccauugcacuccggccugggcaacaagagcgaaacuccaucucaaaaaaaccaaaaccaaaacaaaaaaacccaaaaaaacaccccccaaaaaauaucauuuaauaccuguagaaggauagcaauauccugaaguaaaagaauaucaaaauuguaaaaaggccagguaucaaacaucuguaauuuuaaguuuuuuuuuuaaagcuauauaaggaaaguauuaaaagggaagaauauucaauguggagacaaagaaggauguuauucucuaauuaauaagcuucagccacccauuucacucuugcaagacagaguuaucaacgugaaacaacaugauaauacaagucagugauuuacuccaggguaaguuauguaaaacugugccagccaauaucaacauuguaacuaauaauauuagugaaaaaauuaauuuaacacucaauguggccuucaagcauaauacaaaucuaauguauuuuuuuaauuuuuaaaggcacacauacaaucauuauuuuaaauccuauggcuuggaauauuucuagcucauugcuuaaaauggggugaaguauuucuacuauaaagaacaaagaaaaacuaauguaacuuuuagcuuaacaggagauaaauuuuaaacaauuauucugaaguaccaaggacuauccguuacaguugugaaugugguagcacuuaaaaagcaaaaacaccccauaacgcuuauauagaguguauucaauagggguuacaaaaugucaggaaaccacaggcggaaauuugauauaugaaauauuuauaagaguauuaaaaaaucauauuggaaggagcuuaauuagaagccuccuaaguaaugagggaacccucuuuacaacagucuuuaaugcuugaccauuuucagugauaaaagacuaggaagaguuaauaaauuuuucagaggaucaucguacacagacauggaggauacagcauguuacugguuuuuacacagcugccaauacugcuuuauaauaagaauauacauauauuuuucucuuuuuuaaaaaaaauauugauuuuuccagugcucuacauauucagagaaacuucucuagaaacaaacuauagaaaugaucccugaaaguacaguccuaagaauauauuuuuagucaguaacauuuuauuuugaaaacuuuuagauacagcaaaauuuaaagaauuuuauaccaagcugcaaaggaggaagucaaacuguugcuguuugcugaugauacaaacuuauaccuagaaaacccucaagauucauuugaaaagcuccuagaucugauaaaugaauucagugaaguuucaggauacaaaauuaauguacacaaaucaguagcacugcuauacaccaaugaugaccaagccgagaaucaaaucaagaacgcaaucccuuuuacaacagcugccaaagaaaaauuaaaauacuuaggaauauaccuaaccaaggaggugaaagaucucuacaaggaagacuacaaaacacuguucaaacaaaucaucgaugacacaaacaaauggaaacacaucccaugcucauggauggguagaaucaauauggugacaaugaccuuacugccaaaugcaaucuacagauuuaaugcaauucacaucaaaauaccaucaucauucuauagaacuagaaaacacaauucuaaaauucauauggaaccaaaaaagagcccacauagucaaagcaagacuaagcaaaaauaacaaaucuggaggaaccacauuaccugacuucaaacuacacuacaaggcuauagucaccaaaacagcaugguacugguauaaaaacaggcauguagaccgauggaacagaauagagaaccccaaaauaaagccaaauacuuacagccaacuggucuuugacaaagcaaacaaaaacauaaaguggagaaaggacacccuauucaacaaacagugcugggauaauuggcaagccacauguagaagaaugaaacuggaucuuuaucuuucaucuuacacaaaaaucaacacaagguggaucaaagacuuaaaucuuaaggccugaaaccauaaaaauucuggaagauaacaucagaaaaacucuucuagacauuagcuuaggcaaagaauucaugaccaaaaaaccaaaagcgaaugcaacaaaaauaaaugggaccuaauuaaacuaaaaagcuucuacauagcaaaagaaauaaucagcagaguaaagagacaacccaaagugguagaaaauuuuugcaaaguaugcauccaacaaaggacuaauauccagaaucuacaaggaauacaaacaaaccagcaaaaacaaacgaacaaacaaaaaccaccaauccugucaaaaaauggguuaaaaaaaacauagacaauucucaaaugauauaaaaacagccaacaaacacaugaaaaaauguuuaacaucccuaauuaucagggaaaugcaaauuaaaaccacaauuagauacuaccuuacuccuguaagaauggcuauaauuuaaaaauuaaaaauaauaaauauuggcaugacuguggugaaaagggaacacuuuuacacugcugguggaaauguaaacuaguacaaccacuaugaaaaacaguauggagauuccuuuaagaacuaaaaguaggcugggcacgauggcucacacuuguaaucccagcacuuugggaagcugaggugggcggaucaccugaggucgggaguucgagaccagccugaccaacauggagaaaacccaccucuccuaagaauacaaaauuagcugggcgugguggugcaugccuguaaucccagcuacuugggaggcugaggcaggagaauggcuugaacccaggaggcagagguugcagugagccgagauugcgccacugcacuccaaccugggcaacaagagcuaaacuccacucaaaaaaaaaaaagaacuaaaaguagaacuaccauuugauccagcaaucccacuacuggguaucuacccaaaagaaaagaagucauuaugugaaaaagacacauguacacacacuuacagcagcacaauucacaauugcaaaaauauagaaccaaccuaaacgcccaucaaacaacgagcagauaaagaaaacgugguauauuuacaccaugaaaacugaaugaaauacuggcuuuugcagcaacuuggauggaguuguaagccauuauucuaagugaaguaacucaggaauggaaaaccaaauaucguauguucucacuuauaagugggagcuaagcuacaaggacgcaaaagcauaugaaggauauaacggacuuuggggacuuggagggaagggugcaaguggggugagggauaaaagacuacacauuggguacagcguacacugcucaggugacgggugcaccaaaaugucagaaaucaccacuaaagaacuuauccauauagccaaaaaccaccugcacccccaaaacuaucaacauucaaaaaaaaaaaaaaucaaagaacaagcaaaaaaaaaaaaaauuauaguugaauaccugaauagccauaccuaaagcccaccauuaacauucuacuguagcccgggugugguggcuaacgcuuguaaucccagcacuuugggaggccaaggugggcagaucacaagguaaggagaccaagaccauccuggcuaacacggugaaaccccgucucuacuaaaaauacaaaaaaauuagccaggcaugguggcaggcaccuguagucccagcugcuugggaggcugaggcaggagaauggcgugaacccaggggaugaagcuugcagugagcugagaucgugccacugcacuccagccugggcaacacagcaagacucugucucaaaaaaaaaaaaaaaagucuacuguuauuguuuuaucacauaccuauccauccaucaauccaucuugauuuuuacucuacuuuuaaaaugccuuuuaaaguaguaucuaaaugcaguuucugaagcaaggggucagaaacucccgcaccuaugagaaaggaaaaugauauacaaucaugcguggcaugugucccucaaugauagaccacaaauaccacaaccgucccauauuauaauaccauauuauuuuugagacaagagucucauucugucgcucaggcuggagggcaguggugcaaucugggcucacugcuggaggaaucacauuaccugacuucaaacuauacuacaaggcuauaguuaccaaaacagcaugguacugguguaaccuuccagguucaagcaauucuccugucucagccucccaaguagcugugacuacaggugcaugccaccacacuuggcuaauuuuuguauuuuuaguagagacaggguuucacuauauuggucaggcuggucucgagcuccugaccuuaggugagccacccgccuccgccucccaaaguacugggauuacaggcaugagccaccgugcgcaacccuguaauaccauauuuuuacugcaccuuuucuagguuuagauaugcuuagauauacauauacuuuccacugcauuacaaaagccuacagcauucaguacaguaacaugcuguacagauacguggccuaggagcaacaggcuauaccauauaaccuagauguagaguaggccauaccaucaaguuuugucuaaguacacuuuaugauguucauacaaugacacaaucgccuaacgacgcauuucucagaacauauccccguugcaaucucugagguuguuacagcaucagucauguaguuccguauucauggugacugaaaauuuauucaauuuuuaugacuuguuacauuuaguugugagguggagcaaagcagcuaagugcuaacucuaaacagccuugaauuugaaaccugggucggccacuuauugugauacucuaggcaagucauuuaaugcuuuuagauaccaguuuccuuacugcaaaauaagauacuaguagcaaugucaaaguguuaaugugagauuuaaauaagauaauguauaaaauguuuagcacagcuggcauacagaaagggcauaacaaauguuagcauuauuaucaacacuguauuaguucauucagccuacacaacagguucuagcugcuacauggcuacacauacccaugcaacuguuuauaguauucuucuucaucaccuuauauguucuaagaaccuuggguaguguauguauuuuacugagauuaaagacagaaugagggugaauggguccaagugcaagcauucuccaucuucccacuccacucccuaauggaacuagauguucacucuguuauugaaagcagugauuguggaguccuaguaagggaaaaggagucaggcgggugggaaaaggguacagcaaaaagaaaaagcagauaagguauaagucugccuuucuucaugguccaagacacacagcccucuugcacaaauaacucacaagcuuucugcacucaacuuaucaccagacucucagcugacagaaaaaugcaaguuagcucacugcaaccuuggccuuaucaguacugcacauagcccucucugcagcacacagcagaagcaucauccuguaacaugcccagcaagccauugucuccuggcagucagcuucucucuugcugaucugcccguugcacccuugcaaccaaccuacuuucauacuuucucuaauaaaucugcccuucuuuaccuacaauugccuugguaauuccuuuaccaccugcaacgccagccucagcuagugugaccuaugacagugaggaugaacacaggaaaacacacuacaggcacaguuuugcuuuucagcacuugguugacaggaggcugauaaacugccuaauugugcucugcuuacuuuagaugaacacugcucccucuuaaaacuucauuugagaucacauaauuaugaauuuauaucaaauuugguccaacccaaacaaaauguguuaucuccacugaucacauauccaaaugccuuuuuaucuguacauagcauauuuaugccaguuuuguuguagauggagucaccugggcgcaguggcucacgucuguaauuccagcacuuuaggaggccaggauuacacuucaggaggccgaggcaggugaaucacuugaggucaggagcucgagaccagccuggacaacauggugaaaccccaucucuacuaauacaaaaauuagcugggcguggugguacaugccuguaaucccagcuacuagggaggcugaggcaggagaaucgcuugaacccagggggcagagguggauugcagugagcugagaucgagccacugcauuccagccugggcaacagagggcgacugcaucucaaaaaaaaaaaaaaaaaguuaaaaaaguagauggagucauaaaaccucuaccaacuaccugccucuuuaaagacaugauuuaaguaaaagcuacaguucuauuuuuauggaauuuuuauuuaaaaauaugguaucuaggccuacggcuacaggcuuacauguguaaucuuagcacuuugggaggccaaggcagcaggaucacuugagcucaggaguuugagagaucagccuggacaacauaaugagaaucuaucacuauuuuaaaucacuauuuaagaaaaagagcugggcgcaguggugugugccuguagucccagcuacucaagaggcugaggcaggaagaucccuugagcccagaaguucuggacuguaguauccuaugccgauugggugucugcacuaaauuaggcaucaacauggugaccuccagggagugagggaccaccagguugccuaaugagagaaguggcccaggucagaaacagagcaggucaaaacucccgugcuuaucaguaguaggaucacaucugugaauagccacugcacuccagccugagcaacacaguaaaucccccgucuuuaaaaaaaaaaaaaaguaagcauggaauccacuucucugcuaacuucuaaaaacuagucuuaguucucuuugccagaggaagcagaaucuaauuuuaaaauuuaaaaguacuucuauguggcuucacauaacauaauuugucuauugcuaauucuucugagcuugaugugagaauguaguagauacuaaaaggaguaugguaaagguaaacaauacuucaucuuuaaaaacuaauuuuaaugagguuuauccaaauauaguuuuuuuuuguuuuguuuugcuuuugagauggagucccgcuuugucacccaggcugcagugcaauggcgcaaucuuggcucacugcaaccuccccgguucaagcaauucuccugccucagcuucccaaguagcugagacuacaggcaugugccaccaugcccggcuaauccaaguauaguuuuaaaacauuauuuugacuucuacacuauguacauacuuuacauauucaaaaauaaaauccuaaguaaaaacugaaaccuaugaaccauaucaaauugguagcauaaccagagaaaaguauuucaagugacuuuugaacacaguacucauuauacauucuucaugcaauauagucuaaauacgaaaauaaaugcaaagaaaucuuaaacuacaugaagcuuauugguauuagcaauaccagcacuauaauuuuaaaaugauuuuauguauacagugggagaaagcaaauaaguuuauuauuuuuuuuggagacagggucucacucugucauccaggcugaagugcagugggguaugaacauggcucacugcagccucaaccuccugggcucaagugauccaccugcuucagccuccugagcagcugggaacacaggcacacaccaccacgccuggcuaauuuuuuuauuuuuuauagagauggggucucaucauguugcccaggcuggccuugaacuccugggcucaagcaauccuuccaccucggccuuucaacguccugggauuacaggcaugagccacugugcuuggccaguuuauuaacuguauuaaaaaccaagauuuucauuuaagacaagagacaaauauagagucaaggaagaaaaagucugcuuguuaaauaggaauuggaauaucacucugaacucaugauuaaacaagcaaaaaccuuuuucuuaguucucuccucucaaagcaccuagaagcaaugauacugcagcagcaacgaauaugccaaacauccagaacuugguuucuauauacgauuucucauuaaaaagaaccaagacucccuggauaaacagcucuuuccagaggugagcaaagaaaguauaagauaaacccuggaguaacucgugucagaaagcacuccaagauuaauggggagcaggggugucaagacacacaauagucagcuugaaaugguuccuacugaccaaaucugggacaauuuggucauuaaaaagaaagacgacuguaacugguuauaaaacaaggaauaaauuaaaacccaugagagucugaagugguaucauucaccccugccccaaaaaacaucauuggggguggcuauuucuccagcucuuuacuaugaauauugaaaaguaaagagauuaaauuuaacauuuaauuugcauuuuggggaagaacaauaguuuaccugcacuuaaugaaggaaaucucuuccuuacagagaaccuccaauaacugauuuaagcaaaagucaucaugggugcuaaaaaccacuaagcaaaagauugucagaaacuggguauuugcuuaguguccaaguuuuaccccaagauuacauauuaaucacaaacuggcaaaccacaccuuuacaacagaucaguagucagcacuuuaaucaaaugguuacauuuagcaucauuaauagugugggaaucugacauugugugccuccuauauuaugcaacaggagguacacagcaucaccuauuaaauauucuugccaaaggaaguuuuacuuuaagcuaauuaagccuuccuuuacaccuaacuuccaguuaauaggaaauucagggagaaagaggaauaaacgaaaugacauuaggagggcacaaauccagaauguggguauauuuuacaagacaacugguuuggucaauuacgugucagaaaaaaagaagggagggaauauucauccuauuuaauuuccccugcaaaaagaagaggggauggauacucuucauuuuacaaaaugacuaaagacuuaaucaccaaaugcaaucaaugcaugaaucuugacugacuacaacugggggcagaacccucaaagacacuuuggaacaacugaggaauuuugaagauggaguuguuaauuuugauaggcauuaauaaugauacugggguuaguaggagaaugucccuauuuuuaggaaacacaugccgaaauauuugaggauuacaguguuugcagcuuacuuucaaauaauuacacacauacagagaaagacaggaaacaauauggcaaaaaugcuaaucacugaguugguuauucauugcauugauuagcauuuuuauucauugcaugaauaaccgaucacaauuguauagaacgaaccucuauacgacuaaaauuuuucauaacaaaguuaauaaaauuguacuucuauugagaaguacgguagaaaguacacgaaaguacaucuauacuggaauuauauuuggguugaaaucuaaacuaucuuacuaguugugugcccuaaggcaaguuguaauucuucguaucacuaaguuugucacuucuauaaaauucaaguaauaauaucugcaucauuagguuguucugagaauuaaauaauuacaaaugcaaaaaugccaagcaguacugcacaaaaugaauaaucugguuuucauaauuaaucaguacauuacuaauaauccuaaaauacaaaacuaaaggacuacguucauuauauucacauucuaugauaaggggaaacuacauuagguaaaauuauuauuaauccacugacaguccaagugaaguaaugggggaaaugaagauuuauacaguauuuuuuaaacccaagaauuccaacugaacaccuagagaaaaggaaaucaaaaucgugcagcuugcuuccgguaucagccgaucuccaaauaaagcauuaagaaaauaaguggaaguuauggagaauuucuuccugacuucaagagauuaucuacuuacacgcugaaaaagaaauuaaguuuuugucuucauuuuuguaaguuccaaaaaaaagcacacaauuacgggguuuuauuguaaauucugcuuggauucauagaacucacauggacgcaauuuccuuuuaaucaguucuaacguaccugucauuucucgagguaaccccuuuuucugauuaggccagcaauaaaacgacuagaugcagagugauccucaggaaggaaaggaaaagagguguguguguguguguauguguguguguguuuguguguguguauauauauauauauauauuuuuuuaaagaagugccaucuuuuucuuucuguaccagagaaaaagcagaaggggaaaggaggaaaaaaaacaggucugagccucccggguucgaccaggugagagguggcaacacuccggccgcuccggguuaggguguugggcaaaugggcgugcaaaggacgggcagcucccuggaaggucgggguaacugcuccgggaccgcggggcccaaggccggucuccucccagaaggauuaaaugccaccgaggggaucccguggggugucucccggcgcggacuaggcugacagacccggcucuccgcucccuucggcgccaggugggggccacgcggugucagccacgggcagcgugcaggggccgucccccgcgcgaccggagcccgcccuccccuccccguuaccugcgggcggcggcgccgggcccggaggccugcugcuccuccuccuucucccgccaggcuggggcggcgaggcggcggcggcggcggcccggggggagggggcggagcgcggcucgcugccucucuccucccccgggaggcucaggggccccuaucucgggccgccgcgccuaggcccgugagcagccugugguggggcauggcggcacagccaccggcgugcccgcgagugggagugcgaggaggcggggagggaagcacccccagcgcucggaggggccagaggggaggagcgagggggcccgggagccgcgcgcuggcgaccguuggggacgguu

SEQ ID NO: 192040 - RNA, 58438 nt, Homo sapiens
cggucagguccagcacuugggagcugacugugcuggaggugacaggcuuugcgggguccgccugugugcaggagucgcaaggucgcugagcaggacccaaagguggaguugucagugggaggccggcugugcccaggguccuagggccacguuaugggggucgucaggccuaggccacugugccucagggcugcauggguggugagcagugggagggaugcgauggggggagugggcucagcugucugcuguggguguuuccucggggaccuggcuggcagggaccucccggccagcccagaacugccaacaugucugccagcacugccccuccauucccaguccuggggggaggcucugucugggcagcuugaggccugaccuacuguggcugcuuccucugcuccccagccuggguccugagggccuggcuuaagggaacugcugccagaaggcugggaguguaggcaguguucgggugcccagcugugcccugucugaccucauggccacccacaagcuggcaccccccacaggccucuuggggaagccuguacuuuccaccgccggaggcggguaccgcguggaagccaggcucaggcggacucauucuuuuugaacuuugggaacaggccugguacaggcugaguucucacaagagacacacacccgugucacugucuccugagcugugccggacccguccuacagacuccaccuccucuagguccuggcccuggcaucugccagggggauuuuaaaugaguugauauaugcuaagugcuuugaaaggcgccugcacggagggagagcuguauaaauauucacuauugguaauauuucucccaugcuguuacucuccaaagcugcccgauaauucuagaguggguuccggggacgugcccgcuguuuggggccuagaaaugaacucgggagguuguuuugcuugcugagagcuggucugggaaugccccuugaccguucccugcccugcuccuggcccacucccagacugcuccugugccuggccccauugcgcugggugggugauccuaagcugccccaugggcccugggcucugucaagacauggggagcuugccaggaguuggggccagaucccccagacuccaagaugguaaccgagguugugagggugcacauggaaggaagaguuagaagagugaauuggaaauugccagcuuggacuuugggcagagugggugucuuuagcuuggggauggguuguuguucagagacaacagggccgccuucucugugagcuggcggcccaggcugaggugccucugggcugccuucccuacgggaagcagugacuggcccucugcuucucaggaagagagugccgugcccccgccagccucccaaccucguuagacuccuagaauccgguuuucuggauagaacuaagaaucugcuccuuucuggacuuuuaauccuggaaagggcucccuuccccagcaggagcagagagaccaaacccccuuucugugcuccaucuugagcugucauucuguccuaacuccccacuggccaccaucugcccuugcuuugggggcuaccccaggucugacuugggcacguucucugggucucuccucagagaggcugcuccugggguugucccaauggaauugggaauucuucucagaauggcucaaagguuugcaccaucuguuggagggaagggaucccucuaucuuggacuaauacaaauguuuccgugccugccaaguuccagacccugggccgauagggaaaggagcuggcuggggggccugcaggggauggagagggagcuugggccccaaguggggucugaaguccaagccuacagauugccaucaaggcagccgcuagagccuagcccagcuccuggccccucggagauggaccuuagaugcuggagagcggggcaguccagcagugcagggugggacaccccgagcaaacagccccugcuuccugcccccucaguucagucgcacugggccggcuggacguuucccugcaacaggccccugcuggugguuuagcucccgcuccguguuucccucacgcugggauccuccuuccuacucaagacccacgaccuugaccugaagcuuuugguugccgggaggaaauggugaguguaggcagauuugggugacucuuguuauuaacccccucuucuuuguugcccccuucccagaggcuucuguaugaguguccugaguggcccuggauggacuacuggcugucccuggccucagaaucaccccaaccccugccacauuucggggagggaggugugugaaugauguccuuuauucuacagacugaggaaguggucaguguagcuucacgugagagcagcagcgugcgaugcccaggcccuagccaagugcuggucagcuuucugacuggagccccugagcccugcaggggcugaauucccccaaagguugcuuggguuguugcauuucgggguuagaggguguggguguccagagcuguggguuuuuaguguuggcugagcccuuuaccugggaccuacagccuggccacaaccccaucucuguuccccuguaccccacacugcccugugauaggaugugauaagaugguaggauugccuauacugaagcccugggugccacugcuggcccagcagggaggagguugcugcugcucgggcugaagugaggugugggucuggcugggccuccaguuucccaccugggccuugauugugaggaaggccuggccuggcugcagaagcccagaagcaccugaguaggagaguuccuuugucccaccugcagcucauucaagccugugcauggggguugggguccucaggaucuugcuuuccuguuuaggggaggcagccccaaagagugcugggaccaguuuggagagugcuaaggaaugcuggucugcagcgacccuacuugugcucugcguccucugccaacugcagcaugggugaacaucuguacaucuguccccauaaugaaaauggccucagcaaauaacaaaaauauuaccauuuagcaaucaggcacuuauuaaaagccuggcccaauaaacuuaaaaaaaaaaaaaagaugugcuagacacuuuacgucccuucaugugagcuucacacaacccuguaauuaagcccauuuauaaaugaagaaauggaggauugaaggauuaaguuacuuggccaaggucauacagcucguaagcagcugagcuaggacucaaauccaggcuugcuuccaaaaccuucacuuuucagcccaguucucaacugcccccuggaguuugcucauuuugccccaugaagaaacagaucccagcucaaaggcgugaagggguuugcucaaggccacaguguauuagugucaaagguggaacacaaacccugaccucugagugcucucccgaaccccacaucccggccgggccguacccugagcacacgcuuguccgcuuucucagcugggcggggcggggcaggacaagguucuucucccucccuccuucccuccuucccuccuucccuccuuccccgugggcccucccagccuccccagcccccaccucugcugcuuucccuuggcaauugcuuccaucuggccugccugcagcuccuauuccuuuggaaauguggcugccgcccacauggcugcaaggcaaccacggccacacguggggaaggggaggggcccuauggggucuaagcacagggaacccagccaaaguggcugcuccuggcgucuggcauccugauuccugccaggcagaagcaccuuggcugccuggcccuccuugaugcccguccugggcuggcucaaggccagagaggcucccaaagacccaauucuccuuccaacauggugagcuguuuugcccacagacaagcuccgcaccggcagcccucccugucucuuagagguugcucagguugggaggagggauuccuggcaggagagaauuaggggccagccgggguauacccuggguucccacuggguucugaucauuuggagggaagucaugcaagggacugacgagggcagaggcugagggauccgcggaguucugggcaggcgaggaggcagcugacuugcucaugacuguggguaugcgccaccacacuaggcuaauuuuucuauuuuuuguagauacaggguuuugccauguugcccaggcugguuuuuguuuguuuguuuuguuuuguuuuugagacagaguuuugcucuuguuuccuaggcuggagugcaguggcgcgaucucggcuaacugcaaccuccaucuucugguuucaaguuauucuccugccucagccuccugaguagcugagauuacaggcacccgccaccacgccuggcuaauuuuuguacuuuuaguagagacaggguuucaucauguuggccaggcuggucucgaacuccugaccuugugauccgcccaccucagccucccaaagugcugggauuacaggcgugagccaccgugcccagccgagcgugucugucuuguucacugguguauuuucuuaaugccuggaaugaugucuagcaaacaauaagcacucaauagauucuugugugaugagugauggaaaugcagcucagguaugcugauuugucuuugcugcaucuuuacuuugcuuccuccucccagggcaaagggaaaaaguuucccuuuugccaguugagcuguuugccagagaaaggucuggccccaucugugugcugccaccuugggggucucuguucagaccucagagaggcaggcaggaacccaggugaggaugggcaggagcuuguccccugaggagugcaugccccauuccacccaccacagggucggcuggccacauuucucuacccaucaccccucccuaguaaccuucaggucccugcagacagguccugaccucagcuccaaucccuaugucaguccucuccuuauuugaggcccaagaaagguaccccuacgguggaacccucacuuggguccugagagggagugacagcuuuggaagagcgagggguucacccacauuugccuccuccugaacagcuccacuuuuauuccuuguacauauugcguuuccacuucaauuuuuuuuugaaacugugacagaggguuucuuggcuuuaauuuuuuuuuuuuuuugaaaacccccauugaguuccaguugugaccccccugugguucucauuuucugguagcaugccguguggggucucaccuccucgccuuugcuucugcugcccccucacauggcuugggcauuguugguaaugaccuugcuagacugcaaauguccuucaguaucaacugaagccccaguccugggaagccuccguggccacccagcaccggcacuuccucccccuuccucccccugcguucuccacucccugcagguccuaugccugugacagggagggaacccugugcuggggugaccccagcauggaccucaguggggcucaggcugaaccaaagguaggugguucuggggguagugccugaggugguuguauggagcugugagauuuguauuccuagaagcagguuggaggcucucagcccuucccuccaugcauggccuuggauacagcuugcagccugccacuguagccuccauuuccuucuccgagaaauuaacacuucuuuuuuuuuuuuuuugagauggagucuggcucuauugcccaggcuggagugcaguggugcgaucucggcucacugccaucucugccuccuggguucaagugauucuccugccucagccucccaaguagcugggaucacaggugugugccacuacuccuggcuaauuuuuguacuuuuaguagaaaugggguuucaccguguuggccaggcuggucucaaacuccugaccucagguaaucugcccaccugagccucccagagugccaggauuacaggagugagccaccgugucuggccaacauuucuuccuuuuuuuuuuuuuuuuuuuuuuaagacggagucucacucuguugcccaggcuggagugcaguggcacaaucucagcucacugcaaccucugccucccggguucaagcgagauucuccuaccucagccucccgaguagcugggauuauaggugcccaccaucacacccggcuaauuuuuguauuuuuaguagagaugggggucucaccauguuggccaagcuggucucgaacuccugaccucaaaugauccaccugccucggccucccaaaguguugggauuauaggugugaacuaccgugcuccgccuggccaacacuucuuaaugggauaauguuucagauaacauccagugcccggacuccagcacucuauaaaugcuggcuggugugcuuuucugggauuccagggugggguccagagacugaagagggucugcuuucuggcccaggggaagaggggcagguggcucacuaggagcuguccuggcauccuuuguccccguccacuuaccaguuaugugaccucgggcaggucuugcacucuggcacucaauuagcaucuguguuaauugggguaagaguaucugccacgucucacagccuggugauggacaaacaaaacaaacauuuuuuaggcugggagaggccucagagguuggcugucauauugcaaacgagggagcagagacucagaaaaguaacuuaguuguuuaaggucacagagcaccucucuccccacaggcagggagccgguaauugggcugagccucaggaguaacccuucucucucugccucuccagccccuaccuuaugccuggcccauucagcuggucuguucuccaggccccuaggacugggugggcuaagaugaguggucuagaaaucccuccccagcugggcuggacugaaugaggggcuggccgaggagcggguguugauggaguaugggagauuguccucacaggcagugugggccguuucucuagaccuccugcccccaucuccuuccugucccuguuugagccgugcucuucuucuucaaucccuuucugucugccuucucuuuccaccccuagauuucucaccaucuucagugaucccuccuccuuccuuucugccuccucugcauucucuccuugcccuugcuucucugaucugccuuuuuucuccagccucagcauucagguuguccucauaguggaacugggacucuggggguggcuggguuggguugccuggaggccgggaauguucaggagagccuucauugggagcccaugggagcaggagucagcuccuccuguuggcagcuccagcauuuucgaacaaaaauggcucuuccaggaguugaguuuggcgaagagacagugccugcccaaaguaugcaaugcuuuuaucuuuagcucagcuccugagcccucaugcaacucuuuggacaucuuccugcaaaggacggugggaucuugucuuucuggggccucagggucuccaaagaugggcugacuaagcuucccuagccugggaccugaacccuccacccuccucucucuugagcucuuucucccaggggaagcugcucgaaugaggggaguuggccaacacaguuuucuacucucagaccccauugaggugagcacacaacaguguucugugugagggucuggauacacuccccacccucccaggcccggcaccgugucgcccugccccagcccagagcuugccucuguuggcuuugugacccucgcuuuguacuguggcuuuguucugccuuagggaccagcugguccccugcugugguuccacacaguggagacugaucccugaccacucauucagcugccuggcggcccuggggcaaguguuugucccccaucucccaaaauggcggggugcaggggcucccugcccggagucccaacccugccaaggcagagggaauggggaacagcugcgcuggcccauuccggcuccauauggauuugguuugacaacaaagcucccucuguguguucccaagccccuuacauaaccaggggcugugggcagaggaggaaaggaggaggagguggagauggggaccaggagacaccaggaugggauggcuggaaaggacacagggaccgggaggagagggcaggagacgagggccagagaggaggagagggugggagcaggagggggaagugcuggucuugaccucccaguucugccuccugcuuccuggggaggggaggguggaguccagccaccgacuucugcuuguggaugcuuugucuucuuuucuuuggaccuuucccaccaguccuggauaggcugaggaggggccgugggaccugucuggggugaggugaggucagguguugggcuggaugugggaggcuguuccuuggccgcagccuguaacugaauaaaugccauuaaaaggggaauccauuuccucccucacuccuggcuuccauugccuucccccaggccccagcccugguuccagaaucccucugaccacuccucuugugcucaggagggcagaauaacugcagccuuucccugugcccugccaggcuggucccgggcccccucucagcccacucauccagggaugcagcucuggccuuggcccacccccaucagagggccuguggcccugaucaccgcacuccccacucugugaccagacguucucuccugagcaucgcugacccugcagcuguccaaauagagcaagaagugaauguucucuuuggggcacagcuggacuggcagcccugcagggucaggugagcugccaguccuggguguguucucgggggugggggugggaggaucacguccugggcugagaucccuucagcuccuccugggcaggaggaaacagccaugcaggggcggccaggaggacuggguggcgggugguucugggcucucccagcuucgguuggggcugggacccugggggacaugcucuccuggguguucccaggcucugugucuggccugugccucaguguguggguuuucuggcaccaggcuuccuugggaagagccucugguugugcaccagcccugaggguggggcucaucccaggcugcaggggacugagggccgagcucuuccaccuugaggacaaggaugguuccucagggcugggaggaggaggaggcgcuggccaggaccuuagauuacgcagggcaugguguuggggccucacagaugauggagaagccagaguucaggcacuuggcaugaccccuggcaucgccuucaguugauuuagugucucugcccugggauauuccaugggacccugggcuggcuucugugugcagaggugggugugggccauagcccagaccuguugaaccaguuguaggcucuggaauccucuguccccagguagugaccaggcccugacaggccgguaucugucccucccaucacccucccaguuaugggugcagaugacccugaaauugcuaaagccucagggcuugagcccagaaagugugagcaggcugguggggcagcuggaggaaggccuugcagguuccuggauuugggugccgggugggcugagaggacagucccugucacugggacugggcacaggugcagagaggcugagacgggcccagaggacagugaguguguguugugugggcgccgggccaggaagugcccuccauggggcagcaggcucugcaguacccucggccaaauggccacaggcugcccugggacacucuccaggccugcuggggacacaccuguggggcucauaggcguggcugggucuccucucaggugccagaaucuuucugggagcugagccuggcugggcagagggcgaggagcccaggauuccccuuuccgugacuuuggaggaacgagguuccugagggcuggcacagccacucccugccccuuagaggcuccgggcugccuggugauagcucccagggaccugcaagcugacaaacaaagucuauacgagccagagcuggggugggaggaacccagugggccugggggagguaaagcagcagcagcugcuguagcugagcccggcccacggccagcccugaggaauggaggaagagagugcccuggcugggggagccccucaagcccuggaagcuguaugugggcaugggguggugggggcgugcagagaggaggaggacugagagcugggugugugugugcgcaugccugugucugugugaucugguucccgggugucugaguagggaccaauguguuugugcuggagaagccuguguagguuacugacauggggagggguggggcuugcuuuccucaccccgcuucccacgucuucauugaguccucaucugggggcccuguuccacucuccuucccgugugcagggcccuccccucuggcgagucugccucucacucgcucagccccuuuaacccugcuggcuccuaaugagacuucagguguggacccucgaacccucagcugcacaggucuggaaacauccuuguucaucaagcaccaggcugaccaugguguccgucucagugcccagcagauguucuggugaggggaggcgggagugcaaggucugccgagugaggguuccuuccgggaggaggcagggugagcgcagaaaccacugcuccaaaacucuuaaaagcagagccgagagccugaauucagaggcuguacuguggggcagggcuggaauuuguggcaccugcagggcugaacguugccuuugcugucccugcuuggggauuuugggguacuggguuuggauagagugugucaucugcagagggagcacuguucuggaaguggacucugcucagguguggggggccugccuguagggggcaccgugguggagauggagcaccgcucaugacaggaggcuggugucuggucaggcugagggauccgugugccagcccuucugggaaggcugaauggggcggaacuggucagggccuggcaccaacuccaggaggugcuacacccagacagacagauggaaagccaccucccuagaggccuccucccccuccccuucugcaugccaccacaccccagcagcgucuccugaggcugggccaugggugaaucugagucgagggcagggcagagugggaguggcagugccucugccugucucccuggccguggcagguccuuugucacguauggaccaggagaggugaguaugauugugguaguggugggggcaguggcugaggaccccucucuuugcugggcuggggcagagcuugaauggagaggggcugccuugugccugggaagggaggaccaggugucgcugguaccuuccagguccugaaugcuuguucugugccuagccccugcugaggcugcggacguuacaaaccaggauguguuuugaggcucaggacaccucugaggacuugcugcuguuacccccauuuaaaagacgaggacucugaagaucugaggugcauagaguguagggauuaaaaguaguucuggcugaauuuuaaauccugguuccaccauuuuugagcucucugaucuugggacccuuaauguauuugcucugugccucaguuuccccaucuguaaaugagaaugaaagaguaaucccacauccauugguugaaaacuucaauaagauuaugcauagcaggccgggugugguggcucacaccaguaaucccagcacuuugggaggccaaggcagguggaucacuugaggucaggauuuugagaccagccuggucaacauggugaaaccccaucucuacuaaaaguacaacaauuagcuggacauaauggcgcgcgccugugaucccagcuacuugggaggcugagcaggagaauccuuugaauucaggagguggagguugcagugagccaagaucacgccacugaacuccagucuggaccacagagugagacugucucacaaaaaaaaaaaaaaagauuaugcacagcaccugcagcacagccccagggaugauuuuuaaaagugaauccagggccaggugugguggcucaugccuguaaucccagcacuuggggaggcugagacaggauuaccugacaucaggagucagugaccagccuggccaauauggugaaaccccaucucuacuaaaaagaaaucccagauucugccaugccacaguguccaagucagucaccugcucgcagucggcccucaggcccuguggcuccuguuucugcugacuuguccagccucacagucuggggaggccuugggguccccagccugcgcugggacagggguauuauuccgucagcccuucuguggaacaaguagggaaggagugaugugaccuccguggcucuccugggacacagguuaguccugugggugaccucacuuuagagagggcuggccagcugugccggaauuaggaaguggguacagcuggacaaaagguggcuggagccagcucuacagaagccacaccugcucaugagaaggguauccuugugaguacaggggaaauggcauggagaaagacaaacacugguggguggcucugccagcuuccccuggggugcuucuggcgaugcccaggccuuugcacgcucagaucuuugcaccccacuguuuuaacuuggagaggagaggaggaaguuagcugcucugaaugguguugcugcuaaucucuacagcacuuuccuguaaauuaggaacgguaacacacacaccccucccccaccccguuggagaagcccugcaccagagcauacaguuuggcaaguagggggagggcuggagcccagccucacuugccacccuggccaggccgugauugcccagggugcauacuguggcuggugcucugccaccugcuguuucuguccucaggguaggacacaaggagggcaaguagggcuagucagugagaggcacaggugaugcguguucuagggcuugagaucagcugcuuccauuucaguaauugucuuuggagguacguuguuugcucaagcaaccucccuucaagauagugccuuuuucuuucucucucucucuuuuuuuugggggggggaggcagaguuuuacucuugucgcccaggcuggagcacaguggugugaucucggcucacugcaaccucggccuccuggauucaagcgauucucaugccucagccucccgaguagcugggauuacacgugugugccaccacgcccugcuaauuuuuguauuuuuaguaaagauaggguuuccccauguuggccaggcuggucucgaucuccugaccucaggugauccgcucgccuggccucccaaagugcugggacuauaggcaugagccaccgugcuggcugauagugccauuuuuuaaaaucccuauuuacccaguggaaaaccugagacccggaaaggucauucacacucccagaagugaugguugguccagaauucagguccaagugugagacuucaacauuuacauuccuuauuuuuucuucuuccuuuuuuuuauuuuaaucaaauuauuacuucaaaauguaucacacucaucaguuugaaacaguuaagcaguacaaaugggaauaugagagaaagucacucucccacccgcccucuugagaggcaauagccuuguuuugcauccuucugaguacucuauucacauaagauguaucugaauaugcauguaauucuuuugugaaagugcauuuggagaucacuguuuuacaccugccuuuuacaucuuaauauuaugcuuuggagaucaguugacaucagcaugcaucgauuugcauccuauuuuucacagcugcauaguguuucguugugugugccuaauuuuuuaaaacaggugccugugcauagauuucauguuuccaucuuaugcuguuagaaaaagugcugcaguaaagauccuaacagacaagucucuuugcaaauauaggaaacuuuucuguggaauaagcuucuggcacggaagccccgggguaaaggguauuuugauaaauauugugaaaugucuucccagaagguggccugguuuucacuuccagcauacaucugugagagguccugcuucccacacucccccagcacuguguagcucaggacccuuguuuuuugcuguuacuauuugugaaaaaugguaucucaaccacaccggaaguuuuaaauguagauaaaugucuuaugugccauuuauauuucucuacaguaaaguauauauucauagccuuagcuuauuuuuaaauuauguuccuucauuguuuggggagugggggguagacuugcaugaguauguuauaggcuaagggaauuaacugauaaguuaauauauguacaucuugcaaaugcacuucuuaguuuuuuacucuuuuaaguaugagcuugcucacuugcucucuguaucucacuuaaacuuuaugugaguguauuaaucuuucauuauuuagcuucugaauuuauauuucuucaaucuccauuccuuuuuuuuuuuuuccuugaaauggagacucgcucugucacccaggcuggagugcaguggcacgaucucggcucacugcaaccucugcaucccggguucaagcaauucuccugccucagccucccgauuugcugggacuacagacaugugccaccacgcucggcuaauuuuuguauuuuuuaguagagaccauuuuggucaggcaggucucgagcuccugaacucaaucaaucuaccugccuuggccucccaaagugcugggauuacuggugugaaccacugugccuggcccucguucuuuuuuuuauaugaaaauauuucaaauauguaaaaauuaauauaacagaccuccaugugauaaucagccagauuuaucaagugugaaccuuaucccauauuagauauuuuuuccuuuaagaaauaaaauauuacaaguauagaacuaaagaugugcuacuaugaucuauucuauucuuccccacauuccuuuuuuuuuuuuuuuuuuugagauggagucucacucuguugcccaggcuggagugcaguggcgcgaucucggcucacugcaaucucugccucccagauccaagugauuuuccugccucagccuccugaauagcugggauuacagacgcacgccaucacgccugucuaauuuuuguauuuuuaguagagacgggguuucaccauguuggccaggcuggucucaaacuccugaccucaugauccgcccaccguggccucccaaagugcugggauuauaggcgugagccaccgcgccuggccuauucuuucaucauacacauaagcacgcacuauuuacaaauauacacaaacuuagugcuguuuucugauucauccuuuaucuauuugcaacacuuuaaaaaguuaauguuauguuuucacauugaucccaguugaccuguauggauuaauuucuucaguugacauggcuauauaauauucaguugcgugaauguagcacagcuuauguagccaucccucuccugacgauaguuaaguuguuuccauuuuuugcuauuguaacacugcuaauaaacaugcuugaauggggugucccguacaagggaggguuacucggggcugugcccggaaaugcaaucgccagauuguaagguaugcacguguucagccugacuacauauugugaagugcucuucuaagccuuuguaucaacugguacucccaccagcaaugugugagaaacuauauuugguuuuaaucuguauucccugguuacuagugagccugagcaucuuuucugucuauuagguguuugaauuuaaucugugaauugccuuuuuguguucuuuuuuauuccuuugauuguuuugguggugguuaugauaaaaugcacaagcacaagguucuguugaccuguugaccgucuuaacccuuuuuauguguauaguucaguggcauuaaguacauuuagaaugugcuaccaucccgccauccagcuccagaaaucuuuucgucucgucaaacugaaacauccuccugcuagucaauggcucaucuccuuuuccccucaguccuuggcagccgccauucugcuuucugugucuaugaguuugacugcuuuugaguaccuccuauaaguggaaugauacaguauuuguccuuuuguaacuggcuuauuucacuuugcauagugucuucaagguugauccauguugcaguguaugucagaauuucuuuuuuucuuuucuuuucuuuucuuuuuuuuuuuuucugagacagaguuucgcucuugcugcccaggcuggaguguaauggcgcgaucucagcucaccacaaccucugccuccuggguucaagcgauucuccugccucagcuucccgaguagcugggauuacacgcaugcaccaccacacccggcuaauuuuguauuuucaguagauacagggugucuccauguuggucaggcuggucucgaacucccaaccucaggugaucugcgugccucgaccucccaaugugcugggauuaaaggugugagccauucacccggccgucuuuggauuuuauacagcaaaacuccauaauauuuccuuuacaugaauuuccuuucuuuuucaggcugaauaauauuccauuguacgcauagaucacauuuuguucauucauccauugauggauacuuggguugcuucccgauuagcuauugugaauaaugcugcuaugaacauggguguacaaauaucgcuuugauauucugguuucaguucuuugggguauauaccccgaagcacaguugugggauccuaucuugucucuuguuuucucuuugcuuccauguuuuuucucauuguuucgugggaauacugauauuauauauucaaguauuuguugauuacaugcacuguaccugacuuguuuaaagccugaugucuugaguacugugcaccccugugccuggcugaguaguggaggaacuuugaaagggucuguucuggagagggggugcugcucuggagaggcggugcugcuuuggagauggauuaaucaggaacuugggugcugauucuaggagguacugcaucuagaaagaugggagguggggagugcaacuuccccaauuuugccuuuaacuucagauccuuggggugggugcauugcuucuccugggauggaggggugccggggagccccugaccaggaccuggagcagguccacacaggcacuggauuuguccuuuacuuugggcccaggcugcacucuugauuccaccuccucacacuggcuucagcuuucucacccucagaauggaauucaaagccucugccccucccaggcagacaccaagguaugauuuucaagugguuggugucuugugacuggcagcugauaaacgggugauacaguguuucuauacaggagucugcagugccaggcugcaggggcggacgggagggggucgugguggguagccuguggagccugagggugggaacagagagacuucuuuugcuguagguggaagccugucuggcuccuuucccucaaaggucagacagcuugagagauguuuccauccucccaugcaugacccugaggcaguuagcuggucaguuacucacugugcucucugccaacucuaaugagccaggaagccuccccgugcccaggcgugcugugaucacaguguucaaugauggggugaggcugcagcguccagccagggacugugccgcaggggccagaagauaucugaccuacugucacugccucuuccacucuguuccaccugcacuggagcgaugcuauccgaugaacagauccauuuauuaauucaacacguuuguauugagagccugcugggugccgggcacuauugucaacauggguaauacagcagcaagcaaaacaagagaaacaucuuugcaagcaggggagggggccugcaguguuggguguguggaguuguugcugggaaguagagaagcugaguaagagcuggacaaagaggccaggcacaguggcucaccccuguaaucccagcacuuugggaggccgaguuuggcagaucacuugaggucaggaguucgagaccagccuggacaacauggggaaaccccguuccuacuaaaaauacaaaaauuagcuggguaugguggugcaugccugaaaucccagcuacuugggaggcugaggcacgagaauugcuugaacccgggagguggagguuacagugagccaagaucacacaccauuguaccccagccugaaugacaaagcaagacuuugucuccaaaaaaaaaaaaaaaaaaaaaaaauagagaaaaggaaagcuggaugaagagagauagccaagcccaugucuacggaaaagcauucuugacugagugaacgaaaguacaaagccucagaggagggagcaugccuagguagcccccuagaccuggugaggcuggugcguggggcagccuccauggagaggaguugggcaaggagggaggaggugcuggccaguagagcacgugugucucugugcgucagagcaaggacccgggcucuccccguaagugagaagaguccauggagguuuuggggcugaggaggaguuuuacagaugaccggucuguucuuggcacuugcaauuagcggaccgucuguauccgaguguugaucggguggauucuaacccugugggagaacuccccagcccguagccugcgcucacuguaccuggcaguuguauuaaugacgucaaaugcacaguccagcuugaguccccucuagaacgugggcagcggacacuaagccgagaggaaucgcuguggguuggcagacacuguggagacugacuccuggacaggcuguggaauguguggaagcagguacagcccaggcccgcgcugaaguucggcagggaagccagaggaguccgcagcccgggagaccuggccuacagcggagagagucaguccaugccaguggugggauguggcugcaaaaaauggucggauucauggaagucugguguccaucuggcaggcguuaguggucccacgaauacagcugugugccuugaacacauacugcagagcuuccagagagcaccagggcugugggggcuagagacugugucucgugcggaagcguggcugaggaggggcuugacaggcucuucgucacugugcggagccuucgaaggacuuggaugugcuugagaccccuuccccuaauugcuguguagggcagggguggacaucccggggaucguggagucuagggagccagucugcacgggaugguuuuagaagccguaggauguggggguucuggcugaaguagccagaauuccagugccagcuccgcuccucacgagcuguacaaccugggccgguuacugaccccuuucccaccuuaguucccuggcucuacaauggagguaauuaucguguugaacucacagggucgagaucauauuuaauacuugcacagcccuuagaagcaucuagcacagugguccucagcauuuggaaaugucuggaaacauucugucacaccuggggagugggauuuccuucuggugucuaguggguagaggccagagaugcugcuaagcgucccacaauacacaggacagaccccgcaacaaugaacugucuggcccccaaaguuaguggggcagagauugcaggauccugauuccuuuucuuccuuuuuuuuuuuuuuuuuuuugccccuggcuaugaguaagagauccugguuucgcacaaagugaacgugcaguacauuguuucaguuguuaauucgccaugcaauacaucguuagucacguauuauuguuugucaaauguguauaaaacaucugccacauucuuggcaguuuaauagaaucuagagauauaaagaaguuccugaccacagaguucauagccucacaggcaagauaggaaaacacagaauuauauaauacgaaauuacauuauaucauagagcauauucuauaguaaguuacuccgauuggcuuuugguauuaaaaugucuucaguuucagaggucccaggauagugggcaauauuugaaagccaguaaauauaaaauaaaauauauuaccugugugaaagagaauuuuucaggcacaauaauauuuuaaagaguuuauuuguguaagaagugaauugggaaacagaaaaccgaaagagguuuaguggcccaaugacaguuucagaggcagguguuuggagagugaauguaaaagcaaaaugaagaauuuauuugauuuaauugguugcaauuacaaaauugcuuuguuugguuuaccuuguuggaaguuuccuagucacauaaccauauguuaguuggcuacuuaugauuggcugaaguuuuauuugugucaaacagaagcauuuaccauaaauaaccccaguuaagauuugauuaugcugucuuuuaagcaagguuaaggcuguuguuaaggccucauugguuuuguuugguaaggaauuuuucaggccuggucuccaaauuuugcuuuaacaauuccuugcuucugguuauucucucagcaagcugauagugugacuagaugacacaguauuacucucuguuaccaccaccaauguagucacugggacaaagagucagguagauguuguugucaucaucaguagguagguuggggaugagaauuccauggccacaguuagcaguuacauagucaguguugcuuuccucaaguugaaugauccucaugguaacuguuugauauuugagcagcuguuggaaaucauuuagaacccuugagagaauacaaggcaccagggggguaaacauaauaauuauaaggagaauaauagccaaggauugaaaaauuccucugagcaaagauucccaggagccaagacuuaaccagcugagugaaucaauggagaaggcagugcccaucuaaugaaaaacccauguguguucuuuaagguauuuuaaguuuucgguaauaccugauuuguuaacauaaaaaugacacuuuuuuuuuuugagaucgagucuuacucugucgcccaggcuggaguguaguggcgcaaucucagcucacuguaaacuccaccucccagguucaagugauucuccugccucaaccuccugaguagcugggacuacagguguguaccaccacacccagcuaauuuuuguguuuuuaguagagaugggauuucaccauguuggccaugcuggucuugaacuccugaccucaggugauccaccugccucagccucccaaagugcugggauuacaggugugagccaccgugccuggccaacaccuucuuuuuuuuuuuuuuuuuuugagauacagucucacucugucuugcccaggcuggagugugcaguggugugaucuuggcucacugcagccucuaccuccuggguucaagugauucuccugucucagccuccugaguagcugggaauacaggcgugugccaccacacccggcuaauuuuguauuuuuaguagagacaggguuucacccaggcuggucucagacucuugaccucaggugauccaccucucucagccucccaaagugcugggauuauaggcgugagccaugcgcucggccagcaacaccuuucuaccaauuagggaacaaggucucccuuuuugagcaguuaaaguagcaagaagucuucuauuguacaguacuacugaggccaauucauucaucccagauuguacugcuuaagauaauucgaagugucaauuaaacuuuuucagaaguugguaaaauauuaauugauuuuuuucaauucacucaacugagagaaacgggcucuuacagaaguaugaaauccagaaccccuucguaagacugugucugggauauuaugauucucuuuugugaggggucacuuuauguacaaaugacucuaaggauuuguauggcaauugaagagucauaucuagucauuuuagguagaagauagcccacaccacagauccagacuggcuagguagaacaccuuuacauacuuuguugcugcauaaaaugaauaauucgguguuaucgauagaaagggucaaagugcauccuauuacccacgaguugggggugauacgaaugucaugguuauucuccgucacaucugcgucugcacagcgccacguugaaugguuaugguuucaauuggaguaggaacaaaaaacauuucuaugaauuugauaaaaugacuguaugccaucaucaauuagggaugauugguuuucuuuuuauuugagacggagucuugcugugucacucaggcuggagucaguggugcaaucuuggcucacugcaaccucugcuucccggguucaugcgauucuccugccucagccucccaaguagcugggacuacaggcaccaccaccacgcccagcuauuuuuuuguauuuuuaguagagacaggguuucaccguguuagccaggauggucucgaucuccugaccucgugauccacccuccucggccccccaaagggaugacugguuuucuuuccaaauaugaccugagcauugaucuguccaauaagcaagacuguuauguacauuauguaguggaucuauugaggcauacgauuuuccuguagcauuuccauugaaccaaugucuaguucuaguaaguucucugaugauaugguugaggcuuucauggucauguucagauuuuauauaugugucucauguaggaaucuagucuucauaaucugugucaaaccuaagaauuugaguacagagggauucuggaacacugcccagauuuggcccaguuccauucauguuuucugugcguagagauaaguuaccauuaaugacaucaaucguaguuguaggccaucccuuugccucuguugcuucuuccaagagcuacacugguugaucauaaauaucagccaacugccaagggaaggauaccaacccuuuucauaacgccauuuuccugaauugcucacucaaguguguaugggagcagguucuaauauuaguugugauucuuuccauuuaucuagaggauuacguagccaccaauugcuuugcuuaguagugaggauggcuucauguugagcaguagaucuuagaggauauucaguguggauaaugaaauucccuaacgaaaauaaaagugugaaccuuuugugcuaaaacaaaacaaaaacaagucugagucaauagaagggggccacauggagucuuguuucauugucuugggaaagcugugucuauuucaugauaucaucuacuuuuauggaaggauuucucuuggguauccuuaauuuuguuuuuauauuauuauuauuauuauugagacggaguuucucucuuguugcccaggcugcagugcaguggcacgaucuuggcucacugcaaccuccaccucccggguucaaguaauucuccugccucauccuccugaguaacugagauuacaggaaucugccaccacaccuggcuaauuuuuguauuuuuaguagagaugggguuucaccacguuggccaggcuggucucaaacuccugaccuuaggcgauccaaccaccuuggccuccuuaagugcugggauuacaggcaugagccaccacacccggccuguuauccuuaauuuuaaaucacauguggauugacaaguccaaaacucuaagagagcucucauuagcugugaaacauguacccaagguucaagauccugacauuuugcuacggugagaauaguaacugaaacugguguagugucuuucaauggggcucaagggcaguuguucucugcugucuuuuacaaaagagcuagucucggccgggcacagugacuugcgccuguaaugguagcacuuugggaagcugaggcgggcggaucaccugaggucaggaguuugagaccauccuggccaacauggugaaaccccaucucuacuaaaaauacaaaaauuagccgggcauggugacacaugccuguaaucccagcuacuuggaaggcugaggcaggagaaucgcuuaaacccaugagguagagguugcagugugccgagauugugccaccgcacuccagccugggugacacagcgagacuguaucaaaaaaaaaaaaaaaagauccaguuuccagauuccaggucacguaaggugggaucaucaauaggcaggucacagaaagccuccuucaccuggugggauauacuuuggcaucauacaucaagaccuugcaguauugagucacaucagagccaccaguagaguggauaaaugaaguucuguuaugaaaggcacaagucguucaguauuuauuuugugaagggccacuuuauguguuccccuaggggcugauguucuugccauaaaggucggugauaauucuuuuggccaagguaauucaguugacucuguuaauuuagcuaauuuuaguuuugugauaccauuucugcauucagccuuuccagaagagagagugaugagggcaaugauagugccgucaggucuguaaacucuuauuugguggauaaccugucaaauaaagcgaauugcccuagcacuagagaccuccucggcagguaggugggauuucaucuuucuggagccugagcaucuccaaagaagagcugccgcauggagcuucccugacuggugaccuccacccucuucucuccagagcucuuugacccagaggaaucugcaggaauggagggaguuggccaaaguagggagauuuuuacucagaccauauccaggugagcacacaacagccuuuugggcuugggcugaugcgugcauuucugucuguacaugcgugccuggaagugugcagaugagugugugagagaggguaauggccaugcauccuugcauagacaagaacauggggugcacuucugcaugugcacagccccuccccaacccgggccuguggugcuguccugccccuagcccagagcuggccucuguuggcuuugagacccuagcuuugcacuguggcuuugcucggccuuagagaccagcugcuccccugcuguggucucucauaguggagacugaucccuggccacccauucagcugccugagggcccugggaccaguguucauccccccaccucccaaaacagagguguguagggguucccugccuggagucccaacccugcaggauggagaaaaugggcaccaguuacugugacccauuccggcuccauauggauuugguuugacaacaaagcucccucuguguguucccaagccccuuacauaaccaggggcugugggcagaggaggaaaggaggaggagguggagauggggaccaggagacaccaggaugggauggcuggaaaggacacagggaccgggaggagagggcaggagacgagggccagagaggaggagagggugggagcaggagggggaagugcuggucuugaccucccaguucugccuccugcuuccuggggaggggaggguggaguccagccaccgacuucugcuuguggaugcuuugucuucuuuucuuuggaccuuucccaccaguccuggauaggcugaggaggggccgugggaccugucuggggugaggugaggucagguauugggcuggacuugggaggcuguuccuuggccgcagccuguaacugaauaaaugccauuaaaaggggaauccauuuccucccucacuccuggcuuccauugccuucccccaggccccagcccugguuccagaaucccucugaccacuccucuugugcucaggagggcagaauaacugcagccuuucccugugcccugccaggcuggucccgggcccccucccagcccacucauccagggaugcagcucuggccuuggcccacccccaucagagggccuguggcccugaucaccgcacuccccacucugugaccagacguucucuccugagcaucgcugacccugcagcuguccaaauagagcaagaagcgaauguucucuuuggggcacagcuggacuggcagcccugcagggucaggugagcugccaguccuggguguguucucgggggugggggugggaggaucacguccugggcugagaucccuucagcuccuccugggcaggaggaaacagccaugcaggggcggccaggaggacuggguggcgggugguucugggcucucccagcuucgguuggggcugggacccugggggacaugcucuccuggguguucccaggcucugugucuggccugugccucaguguguggguuuucuggcaccaggcuuccuugggaagagccucugguugugcaccagcccugaggguggggcucaucccaggcugcaggggacugagggccgagcucuuccaccuugaggacaaggaugguuccucagggcugggaggaggaggaggcgcuggccaggaccuuagauuacgcagggcuugguguuggggccucacagaugauggagaagccagaguucaggcacuuggcaugaccccuggcaucgccuucaguugauuuagugucucugcccugggguauuccaugggacccugggcuggcuucugugugcagaggugggugugggccauagcccagaccuguugaaccaguuguaggcucuggaauccucuguccccaggcagucaccaggccuugacaggcgggaaucugucccucucaucacccccccaguuaugggugcagaugacccugaaauugcuaaagccucagggcuugagcccagaaagugugagcaggcuggcggggcagcuggaggaaggccuugcagguuccuggauuugggugccgggugggcugagaggacagucccugucacugggacugggcacaggugcagagaggcugagacaggcccagaggacagugaguguguguugugugggugccaggccagggagugcccuccauggggcagcaggcucugcaguacccucggccaaauggccacaggcugcccugggacacucuccaggccugcuggggacacaccuguggggcucauaggcguggcugggucuccucucaggugccagaaucuuucugggagcugagccuggcugggcagagggcgaggagcccaggauuccccuuuccgugacuuuggaggaacgagguuccugagggcuggcacagccacucccugccccuuagaggcucugggcugccuggugacagcuucggggaccugcaagcugacagagucuccaggagccagagcuggggugggaggaacccacugggccugagggagguagagcagcagcagcagcagcugagcccagcccccggccagcccugaggaaugggggaaaagagugcccuggcuugggggggcccucaagccccggaagcuguaugugggcauggggggcgggggcagagaggaggaggacugagaaguggguguauuugggcaggugugugugugugaccaagcuugcgggcgccugaguauggacuaguguguuugugcuggaggagccuguguagguuacugacaugggagggccggugugagcugcagggaccggagagcugcuggaaggggcugucuaugccuucaggcucugaguguggaugcagcugggccuguucaggcagauucaccagaggggcuacugcgcagagccugggcccuggacaccuagaagggccccuccuccccucgucuucccucccucauggcccaccuuuacucugagggggugggcuuccugcgggggacaaacuggagagggacucucuugccgccuucucuguuccuggggacaggcugcugcaggguggagggcuugcuuuuccugcccacccucaucuuugccgaguccucgucugggggcccugccccacucucccuucccaaugcagggcccucuccucuggcgagccugccuugauacuccccggcucaaccccuuuaacccugcuggcuccuaaugggacuaaugggauuucagguguggacccuuggacccuccgcugcacaguuccagaaacuuguucaucaagugccaggcugaccaugguguccgucucagugcccagcaguuguucuggugaugggaggugggaguacaaggucugccgagugaggcagaggaaagggguuucugagcccagaucuccggugcuccaagacacucaaaaccagagcugagagccugaauucagaggcuguacuguggggcagggcuggaauuuguggcaccuguguagggacuccagggcugaacguugccuuugcugucccugcuuggggauuuugggguacuggguuuggauagagugugucaucugcagaggcagcacuguucuggaaguggacucugcucagguguggcgggccugccuguggggucaccauggacaggaggcuggugucuggucaggcugagggauccgugugccagcccuucugggaaggcugaauggggcggaacuggucagggccuggcaccaacuccaggaugugcuacacccagacagacagauggagagccaccucccuaggggccuccucccccuccccuucugcaugccaccacaccccagcagcaucuccugaggcugggccaugggugaaucugagucgagggcaggacagagugggaguggcagugccucugccugucucccuggccguggcagguccuuugucacauaugggccaggagaggugagugugauugugguaguggugggggcaguggcugaggaccccucucuuugcugggcugggacagagcuugaauggagaggggccgccuugugccugggaagggaggaccaggugucgcuggcaccuuccacguccugagugcuuguucugugcccagccccugcugaggcugcggacauuaaauaccaggauauguuuugagacucaggacaccucugaggacuugcugcuguuauccacauuuaaaagacgaggacucugaggcucugagagguuaaguaccugguccaggucaccuggucaguuucuuucuuuuuuuuuuuugagauggagucuugcucuguugcccaggcuggagugcaguggcgaucucggcucacugcgagcucugccucccggguucacaccauucuccugccucagccucccgaguaggggacuacaggcgcccaccaccacacccggcuaauuuuuuuuauuuuuaguagagacaggguuucacuguguuagccaggauggucucgaucuccugaccucaugauccucccaccucggccuccuaaagugcugggaugacaggcaugagccaccgcgccugacccaccuggugaguuucugagcuccagacaacucaucccaaauuucaugggugcauagaguauagagauuaaaaguaguucuggcugaauuuuaaauccugguuccacuauuuucgaccugucugauuuuggaacauuuaauguauuccuucugugccucaguuuucuucuguguaaaugagaaugaaagaguacucccccaucaauuuguugaaaacuucaguaagauuaugccaggagcugcagcacagccccagggaugauuuaaaagugaauucaggacagggcgugguggcucacgccuguaauuucagcacuuugggaggcugaggugggaggaucccuugagcccaggaguuugaggccacccuagacaacauaguaagaccuugucucaaaaaaaaaaagcgaauccaguggugucacucuuuguuaucaaugcccuccagugacauucaugacacccaaacuuagaaucugagcuuuuaggguggccugugacaucuauaccacguguccccguggccucccuggcacccccuuuccuuccuggcugucugccaccauauggaacuuucugugccuugcacccagccagcucagagucuugggcacuucucucagucuggaaccuucucuugccuaccccaucuucccauggcugcccuucauguaggccuccgguuuauagccggcuccucagagacaugguucuauccccccaguggccaagggcugguggcccucacucucugccccugugcccuguguuagugguccugugguugucauugccccgucaucuccaccauuuccuguuugccgugugucugugccccccaaggaugaaugccaugaguccagcaugucacccuguuucuguccugccacagugcucgagucagugcccucccugcuugcauucggcccacaggccuuguggcuccuguuucugcugaccuguccagccucacagucuggggaggccuugggguccccagccugugcugggacagggguauuauuccaguagcccuucuguggaacaaguagggaaggagugaugugaccucuguggcucuccugggacacagguuaguccugugggugaccucacuuuagagagggcuggccagcugugccggaauuaggaaguggguacagcuggacaaaagguggcuggagccagcucugcagaagccacaccugcucaugagaaggguauccuugugaguacaggggaaauggcauggagaaagacaaacaccgguggguggcucugccagcuuccccuggggugcuucuggcaacgcccaggucugugcacauccagaucuuugcacugcgcuguuuugacuuggagaggagaggaggaaguuagcugcucugaaugguguugcugcuaaucucuacagcacuuuccuguaaauuaggaacgguaacacacacaccccucccccaccccgcuggagaagcccugcaccagagcauacaguuuggcaaguaggaggagggcuggagcccagccucacuugcugcccuggccaggccgugauugcccagggugcauacuguggcuggugcucugccacugcuguuucuguccucaggguaggacacaaggagggcaaguagggccagucagcgagaggcgcaggugacgcguguucuagggucugagaucagcugcuuccauuucaguaauugucuuuggagcuacauugucugcucauacaacuucccuuccagauagugccauuuuaaaaaucccauuuacccaaaagaaaaccugacaccuggaaaggucguuugcacucacacaagugaugguugguccagaauucacauccaagugugagauuucaauauuuuuuuucuuccuccuuuuuuuaaaucaaauuuuauuugaaaggguaucacagucaccaguuugaaaaagguaagcaggccaggugugguggcucacaccuuuaaucuuugcauuuugggaggcagaggcaggcgugucaguugagcccaggaguuugagaccagccuguucaacguggugagaccccaucucuccaacauuuacaaaacuagcuggucauggugguaugugcguguggucgcagccacuggggaggcugaggugggaggguugcuucagccugguggguggcugcagugagcugagauugggccuuuggucuucagucugggcuacagagcaagacucugucucaaaaaaaaaaaaaaaauuauaaagguaagcaguacaaaugggaauaugagcauaagucacucucauuccagaccucugacccccaggacuuuucucuugagaggccauagccuuuguuuugcauccuucugaguaaaccuauucguguacagacauaucuggguaugcauguaacuguuuugugaaagugcauuuggagauauggauaucguuguuuucacccauccuaaguuuugaugcuauggauacuauguuuuggagauuagacgauaccagcacgcauagguuugcagccucuuuuucacagcuccauaguguuuccuugucugugagcagauuucaaguuguuuccaucuuaaccccuagaaaaagugcuguugaagauccugacagacaagucuguagaaacauaggaaacuuuguagaauaaaguucuggccaugggccaaauucccucugagagguagcucuaguuuuucuuccuaguacaucuaugagagcucaggucccucguguuuugcuguuaugaugaaugaaauaugcugucuccaucacgcuggaauuuguagauguagaugaccauaguuucuuauuugccauucauuucuuuacauuaagguaaauauucauguccuuuggcuauuuuuauuuuauuucuuuuuucuuuucuuuuuuaagacagagucucgcucucucucccaggcuggagugaaguggcuuaauccuggcucacugcaaccuccaccuccuggguucaagcgauucuucugccucagccuccuaaguagcugggauuacaggcaccugccaccaugccuggcuaauuuuuauauuuuuaguagagguggggguuuuaccauguuggccaggcuggucucgaacucaugaccucaaaugauccauccaccuuggccuuccagaaugcugggauaauaggugugagccacugcgccuggcccuuugccuauuuuuaaauuagguuucuuguuuuuuuuuuuuuuuuuuuuucugauuuacgugagcacaucauaggcucagugaauuuacugauauguuagguauagguugcaaauguacuuuaguuuuucagugucuuuuuuuuuuuuuuuuuuuuugagacggauuuuuguucuuguugcccaggcuggagugcagugcaaugacacgaucuuggcucacugcagccuccaccuccuuggguucaggcaauucuccagccucagccucuugagcagcugggaucacaggcgccugccaccaugccuggcuaauuuuuguauuuuuaguagagacgggguuucaccauguuggccagguuggucucgaacucgugaccucaggugauccacccgccucagucucccacagugcugggauuacaggcgugagccaccgcuccccggcucaguugucuuuuaaguguuucauuugucuucucucuacuccucccucucucucuugcacuugcugucugucucacuuaaauuuuauguaggugaauauauucaucuuuccuuguuuagcuucucaauuuauauuucuucacuaucucuauuaauaugaaaauaucucaucuauauaaauauuaauguaacagaguugcaugugauaaucugccagguugaacaaaugggaauauuaucucucauaugacguuagauuuuuuuccuuuaagaaauaaaauauugcaaguagagaaccaaagacaugccccugugaccucuuuuauucuuccccaucuccccagaauauaauuaucacuuaaaguugggugucaaccuguauuucauucuuucaucauacacacaagcacacacuguuuauacacauaaauaauguuguuuuuggacgcauacuuuguuuuugcaacaccuuuaaacauaaguuuuuacuuuuauuauuuuauuuaagauaggaucuugcucugucacccaggcuggaguauaguggcgcgaucauagcucgcugcaaccucucaucuccugggcucaagugauccucccaccuuaguuagccuccugaggaacugggauaaucacagucauaagccaccaagcccagcuaaguuguuuauuuuauuuuuuuauuuuuuaaauaaagaugaaaucuugcuauguuauccaggcuggucucaaacucuugggcucaagcaauccuccugccuuggccucccaaagugcugggauuacaggcaugacuuuaaaaaguuaacauuaugggccaggcgcgguggcucacgccuguaaucccagcacacugggaggccgaggcgggugaaucacgaggucaggagaucgagaccauucuggcuaacgcagugaaaccccgucucugcuaaaaauacaaaaaaaaaaaaaaaauuagcugggcgcgguggggggcgccuguagucccagcuacuugggaggcugaggcaggagaauagcgugaacccgggaggcagagcugcagugagcugagaucacgccacugcacuccagccugggugacagagcaagacucugucucaaaaaaaaaaaaaguuaacauuaugucuucaaguuuaucccaauugacccauauggauugauuucuucaguuuacauggcuauauaguauucagguagcacaguguauauagccauggcuguacugaugauaguguuuccaguuuguuuguuuuuuuuugcuauugcagcacugccuaauaaauauccuggaguggguuguacuuauauacuucaaaauggaauuaccagauuguaaaauaugcacauauucagccucacuagauacugugaagugcucuucuaagccuuugugucaguuuguacuucugccagcaauguggaaaugagauuugguuuuaauauguauucccuggucacgagugagccucagcaucuuuucauauguccaccaaguguuuggguuuaaucugugaauugccuuuuuguguucuuugcuuuuuuuuuuuuuuuuuuuauuucuuugauuguuuuggugguuguuaugguaaaaugcacaagcacgagguuguauuuaccaucuuaacucuuucuguguguauagugcaguggcauuaagcacuuucagaaugugcuaccgugcuaccaucccaccauccaucucccgaacucucuucaucuugccaaacugaaacaucccacccacuagucaagaacuccucauuuccgccuccccccagcccuuggcagccaccauucugcuuucugugucugugagcuugacuacuuuaaguaucuauucuaaauggaaugauacaggacuugucuuuuugggacuggcuuauuucacuucgcguaguaccuucaagguugauccauacugguagcagaauuuccuuucuuuuucaggcugaauaauauuccauuguaugcguagaccacauuuuguggauccguucauccacugauggacgcuuggggguugcuuccacauuagcuauugcaaagucaauaaugcugcugugaccacggguguacagauaucucuuugacauccuggucucaaauauuuuggggauauacccagaagugcaguugcuugauccuauccugucccuugcuuuucccuuugcuuccuuguuuuuuuuuuuucuuuuuguuuuaugggagugcugauauauucaaguauuuguugauugcaugcauuaugccugacuugcucaaagcaugaugucuugagcacuuagcaaccuugugccugcugagugguggaacaguucugaaaaggucuguucuggagugggggugcuguuucggagagcgaugaaucaggggcuugggugcugacuuuaggaggugcggcucuuggaaagacagagugugacuuccccaguguggucuccuuccuuuuccucaccacuucuccuaccuaaccccaagaaugaguccuugagucugucucaguagguggaucugcauucagugcagggcagagccuggguggcagugccucuccuugccucccuggcugcuacaagguccuguguagcaucugguguggacccagcagccaggaggagagcugagugugauuggggucgugguggggccaguggcaguggaucucucucuuuguugggcugggccagcgcuugaauugagaggggcugccaugugucuggggagggcagaacccagcgucacugacacccuccagauacagaguucuugcucuguguuuggcccauaccuaauguugugaaguggaaauacugggguguguuuugaggcucagaacaccugugauaacuuggucguguguguguguguguguguguguguguguguguguauguguguguauguguauauauaaaauuauuuuccuuaacaccacugaccugaaggcaguuacacguaauuuacaaaugaggaaucugaggcuuugagauugucaaggucaccugaccagugacugcagaggcuggauuggccugugggccugaguccguaccccuuuucacuggcuccuccuggaggccacauguaccuugcgcuuccuggggcuugguccugggguuucaucucagguugacccccguuaggaggaaguaaguaggaaggaaggagauuuccuggguauuaggguguccucaagccugcagcucuccugggacugcacagaguuuacugucggacaucaguucugauauggugcagcagacauggagcugguaagugguuaagaucagucggacaugacaaccuccaguucugcagaagccacuucauuugccuggggauaaagcagguccuugugagcucaucgacaugcauuuggcagaaagugcgcuggcucugccagcucccagugugagcuucuagcaagccccuugugccuuagaugcccaggucuuuucagaauaagccuggcuuguuuuaacuugaugcaacuugcugcucacagucaucuuauuguuugcugaugaauucagaccuccauucauuuaaauauuugucaguuaucuaccaugugucaggcauuaaauuuagugcuggagauacuaugggacauaagaagucccugcuugcugggagugcguggucuaauugguacuugggacagugugguuuaacugccacaaaguuaauaaagcagcaugaugugacagagcuggaugugggggagugaggaagcuucucuggacuggguggucugaaccccaugcagggaggaaacuguggcugggaggagaggaggccggaagagaggucugggcuugggucccaaccacugauuccagaucucucaacauuuguaacacgaccaacuccuguucuuuuuuuuuuuuuuuuuugagacaggcuagagugcagggggacgaucauagcuuacugcagccucgaucuccuggacucaggggguccuccugucucagccucccaaguaucuaggacuacaggugugugccaccacacccggcuaauuuuauuuuuauuuuuauagagacggggcagagucugcagucacaugccuugcaaguagcagagacaggguuuagucucgguagccagugccuagggcacaggucuuggccagaggagagaaggcucaggugaaccaguuucaucugaccugcuugcuaacucaaacauggcugcccaacugcgugggcuggcaagguaugugagguggguagcuggguggcccgccccuugcaggcacuggggcaggauaucaggggguccagaagagguuggguuuaggcagaguagaggugauugugugggccgggggagcaaugucaccuugaauguguuuccauacccagggcccagauggcucaggaggagggggauggggacggggagagugaggucuuuuugacuuugaugugcuuugacugcacaucagagucaaacgagucagaauaagcgggaccccuccacaggcaucucagcccuccuaauuuagccuuucugaaguggagccuugggagccgaugaagcuuaauaaacucuccuggugcuuccaguaggcacuugaggguggacaccaccgucuucaggucauaggaagugugagcuagcaggaauccuggagauuuucuagcccaacaguguccggucaaaauagaaugggagccagaaauacaagccacauguaauuuuaaauuacuuuuaaaacauuuaaauuuagccacgguuuuaaaaaguaaaaauaggugaaauucguuuuaauauuuuaacccaauauagccaaaaucuuggcauuucaacaugggaugagcauaaaauaaugaaggugauauuuuauucuuuuuuugggguacuaaaucuuugaaauccgguguguauuuuccacuuaaagcacaugucaguguggacuggccccauugcaaauacucaguggccugggacuggggugaccaagugggaugugguggggcuggugcaguccaccauucucacagcaggcaucuggggucaggggaggcagggcacuggcugugcuggaagcaggggauuggcugugcuggugggaagccagauuccagccccagacacugguaccuuuggcuuuagauccuuggggugggugcauugcuucuccugggagggaggagcgcccgggagccccugaccaggaccuggggcagguccacacaggcccuggauuucuccuguauccugggccuggcccugcucucuugacucccaccucgucacaguggcuucagcuuuuucacccugagaagggaauucaaagccucugccccucucaggcaggcaccaggauaugauuuucuuuuuucuuuucuuuuuguuugagacaggaucugacuuggucuggaguguaguagccugaucucagcucacugcagccuccaccucccgggcucaagugauccucccaccucagccucugaaguaauugggauuacaagcacaugccaccaugcccggcuaauuuuuguauuuuuuauagagaugggguuucaccaugaugcccaggcuguucuugaacuccugagcucaagcaaucugcccuccucggccucucaaagugcugggauuacuggcaugaggcacggggcccugcccuggguaugauuuucaagugguuggugucuugugacuggcagcugauaaacgggugauacaauguuucuguacaggagucugcagugccaggcugcaggggcggauggugggggguggguggguagccuguggagcccgagggugggaacagagagucuucuuuugcuguagguggaagccugucuggcuccuuucccucuaaggucagacagcuugagagauguuuccauccucccaugcaugacccugaggcaguuagcuggucaguuacucacugugcucucugccaacucuaaugagccaggaagccuccccgugcccaggcgugcugugaucacaguguucaaugauggggugaggcuacagcguccagccaggggcugugccacaggggccagaagauaucugaccuacugucacugccucuuccacucuguuccaccugcacuggggcaaugccaucugaugaacagauccauuuauuaauucaacacguuuguauugagagccugcugggugccgggcacuauugucaacaugggugauacagcagcaagcaaaacaagagaaacaucuuugcaagcaggggagggggccugcaguguuggguguguggaguuguugcugggaaguagagaagcugaguaaagagcuggacggagagagauagccaggcccaugucuacagaaaagcauucuagacugagugagcauaaaucgcaaaggcccagaggagggagcaugccuagcuagcccccuagaccuggugaggcugguguggguugggcagugauacgguuuggcuguguccccacccaaaucucauauugaauuguagcucccauaauucccaugugucaugggagagaccuggugggagauaauugaaucauggugguguucucccccaaguuguucuccugguaguaagugucaggugagccgaugguuuuaugagggguuucccuuuucacguggcuguccuucuuucuugccugcugccauguaagauauacuuuuuuucuucugccaugauugucaggccuccccagccacguggaacugugaguccauuaaacuucuuuuucuuuauuaauuucccagucucgugcaugucuuuaucagcagcacgaaaacagacuaacgcaggcagccuguguugggaggaguuggcaaggagggaggaggugcuggccaguagagcacaugugucucugugcaucagagcaaggacccgggcucuccccgugagugagaagaguccaugggguuuuggggcugaggaggaguuuuacagaugaccggucuguucuuggcacuugcaauuagcggaccgucuguauccgaguguugaucggguggauucuaacccugugggagaacuccccagcccguagccugcgcucacuguaccuggcaguuguauuaaugacgucaaaugcacaguccagcuugaguccccucuagaacgugggcagcggacacuaagccgagaggaaucgcuguggguuggcagacacuguggagacugacuccuggacaggcuguggaauguguggaagcagguacagcccaggcccgcgcugagguucggcagggaagccagaggaguccgcagcccgggagaccuggccuacagcggagagagucaguccaugccaguggugggauguggcugcaaaaaauggucggauucauggaagucugguguccagcuggcaggcauuaguggucccaugaauacagcugugugccuugaacacguacugcagagcuuccagagagcaccagggcugugggggcuagagacugugucucgugcggaagcguggcugagaaggggcucgacaggcucuucgucacugugcggagccuucgaaggacuuggaugugcuugagaccccuuccccuaauugcuguguagggcagggguggacaucccggggaucguggagucuagggagccagucugcacgggaugguuuuagaagccguaggauguggagguucuggcugaaggagccagaauuccagugccagcuccacuccucacgagcuguacaaccugggccgguuacugaccccuuucccaccuuaguucccuggcucuacaauggagguaauuaucguguugaacucacagggucgagaucauauuuaacacuuucacagcccuuagaagugucuagcacagugguccucagcauuuggaaaugucuggaaacacuuugucacaccugagaagagggauuuccuacuggugucuaguagguagaggccagagauggcugcuaaacaccccauaauacacaagacagaccccgcaacagugaacucucuggccccuccaagucaguggugcagagauugagagauccugguuucgcguuuugagcgugcaguacauuucaguuguuaguggaacaugcaauacaucuuuauucacauguuauuacuuauuugucagauguuuguaaaacaucugcuacauucuuggcaguuuaauagaaucuggagauacaaagaaguuccugaccacagaggucauuuaggcaagcuaggaaagcacagaaugauauaacacaaaguuacauuguaccauaaagcauauucuauaguacacuuaacucuggugggcucuugguauaaaaaugucuccaaucucagaggucaugggauagugggcaagacaugaaaaccuuguauaauauaaaauuuuguuaccucuaagugcugaaauuaagguauaaacaacgucucaugggaaccaaaacaucagucauuuggaaguauaagucaagccuucguaggagaggaaccauuucagcccgauauuaccagagugggauggucccagcgagcgggauguggaggguuaggauguuaucuuagucuguuuugugcugccauuaccaccaaguagguaauuuauaaggagcagaaguuuauuuggcucacaguucuggaggcucggauguccaagaucuagaggacacauccggugagggucuucuugcugcauugucucaugguggauggaagaagggcaagguggagagagagagcaggaaggggccuaauuguccuuuuauaaggaacccacuccuguaauaauggcauuaaacccauucaugagaacagagcccuugacccauucaugagaacagagcccucauggccuacucuuaugagaccccaccucacaacauuguuaacauuuaggaucaaguuucuagcacaugaacuuugagggacacauucaaaccauagcauucugccccaguccccaaaauggauguccuugucacauguagaauacauuugcuucuuaccuauaaucccaaauucuuauuuguuucagcaccacauuaaaaguccaaaguccacagucucaucuaagucagcuguggguaaaacucaagguaugguucauccugaaucaaauuccccuccagucaugggcugugaaaucaagcaaguugucugcuuccaaaguacagugaugggacaggcauaggacagauauuccauuccaaaagggagagauaggcaagaagaaaggggcaacugguccagacaacuccagaacccagcagggggaacaauaccaaaucccaacuugacaauaaucuucuuugacuccauguccugccuuccagacacacucggguagggacuugggcccccaaggccuccggcagcccugcuucccuggccuugcugggcucauuccaugcagcagcucucaccgguuggagucucaugcuugcagcucccccagguugcuguugcacacugguagcucugcaguucuggggugucaggauggccuuacucccacagcuccacuaggcuuccuggggacucucagcagcucagacuccacaguucugcugggcauugcccuacaggggcucccuggugguggcucugacccugcaaccagucucugccugggucccgagucuguccgcaauauccuuugaaaucuaguuggagggagccaggcccauagccccugcauucuguacucugguggcauuaggaccaugugggaugccaccaagacucaccacuugcaccuucuagaaugguaggucaagcugcaccugggcccauuuaagccauggcuggggaggcagaggagcacugugcccaaaugugggagcagagacuugagguggcccuggacagugagccacagguccugagggcucccaagaccuggcuuuugacauaguuccuucccucagauuuuggcacugccggagcugugaucacaggucaucucugcaguaccuuugggaucauucuuauuuucuugaugaauagccucuggcuucauucuuauuguacuaaucuccuuaucaaacuguggcucuggccaauacuaaucuccuuaucaagugguccauacuaauauucuuauuaaacuaucaaacgguaacaugccugcacccuugcuuuccucuccugaaaguucuuucauucucuacuacagggccggucucagaauccuuccagucucuaaguucuguuucgcuuuucauuauaaauuucuuucuuucuuuccuucuuuuuuuuuuuuuuuuuuuuugagauggagucucacucuguugcccaggcuggaguucaguggcacgaucucaguuuacugcaacuucugucuccuggguucaaaccauucuccugccuuagccucccuaauagcugggauuucaggugugugccaccacacccagcuaauuuuuuuguauuuuuaguagagaugggguuucaucaugucagccaggcuggucucgaacuccugaccucaaaugauccgcccgccucagccucccaaagugcuaggauuacagacgugagcuacugcgcccaacccugcuuuuauuuauaaguuucaucuuuaaauuauuuauuucuucucaaguuuuacaguauacaguuaaaauaagucauacagcaaccaaaaugcuuugcugcuuagguauuucuuccaccaaauagccuaguuuaucacucuuaaguucugccugcuauacaguuugaggaccuggacacaauguagccacauucuuugcugcuuuguaacaaggaugacuguuaugccaguuuccaguaccuuaaucuucagauauaucugagaccucaucagaauggccuucacgaucgauauuucuaccaccauucugaucacaaccacuuagucuaagaaguuucagacuuucccuacagaucuucuaaucccgcuuuauugccugccugccucccucccucccuuccuucuuuccucucugcucucucucucuuuucuuccuuucccuccccuccccugcuuuccucuccccucuccacuucuuggcaccaauuuucugucuuaguccauuuugugcugcuguaacagaauaccacagauugaguauauuauaaugaauagaauuuuauuuggcucaugguucuggaggcugggaaguccaagaucaaggggcugcucuggcaagggccuucuugcugcaucaucccaugguggagaguggaauggcaagacagaucaagaggggaccuaacuggccuuuuauaaggaacccaguuccacaguaauggcauuaacccauccaugagagcagagccccaugaucuaaacaccuuuuauuaggcccugcuuauacuguugcacuggggaucaaguugcagcacuuggacuucgggcaacacauucaaaccauagcaggcaccuuaauaaagguggaaaagggauguggcagcuacagugggagggaaaagguggcucccuuagugugcuugggaggaggguaagagaugcguuugcaguucucauggccgcagacugaaggggccugguuaccuaagggaccuuggcuucauguaaggagugcggagugagugaagcaagagggugauuugauccauaucauuucuuagaaggauaccauguuggcaguuucgaagaaggggcaugagugaggaaacaguuguggugaagagaccaguuaggaagccuguaacuuggggugggaucuggaaccaggcuguggcuccggaagaggagcuggagggcugcacugugaaguauuucucagagucuagacaaugugaccuucacacuggggcugaguuuuguaaaauccgacauccccaguuucaccuaugaugccaggccugugguaaggagcuuugcaagcauuugcuagaauaugagcaaauggagguagaacugauaauauuuaguaaccauggggggaugaaagagggagguguugggagacuggguugauaauauggggguugggagugaggagagaguccagcuuugaacaucuucuuccauuugaggaauuuaagaucauccagcuagaaaauuagaaauacuaggauggaguguggaagagaaauuagugcugaaaauaaagagcucgaaucaucaguguaugaauaguaguuaaaccucugaaaaugagugaacuuguccccugaaaauguguggcaggggagaagcgagguucaaggacagugcccccgagaaugccagcauuuaaaggguggacccucgguggcucacgccuguaaucccagcacuuugggaggcugaggugggcggaucgcuugaggucaggaguuugaaaccagcuuggccaacauggugaaaccccgucucuacuaaacauacaaaaauuagccaggcaugguggugggugccuguaucccagcuacuagggaggcacaagaaucacuugaaccuacaaggcagagguuccaguggguucgugccacuucacuccagccugggugacagagggagacucccucucagaaaaaaaaaaagaagaagaagaaaaaaaaaaaggugggccccggcagcagagccuacugucccggaggcaggaggaaaaccugaagggaaucuugaccuugaccuagaagccaaggaggaggcauggccaacaacaucaaaggccucugagcagcgcagugaagacugacaauagaccuuucuuaaguuuggcaauuagaaggucauuggccucagcaagagcaauuucagaauaaaaacaagaguggagggaguggcauaggggucgggggacagaguaggaagugaggguguaguagaggggaagaaguuugaucacugagggaaggagggagaugcagggguagcuugaggaggagauagagcagagagagguuugcuguuuauuuuaggaagaggagacuugagcauguuuauaagucagagaauagagaaggagaggugggagacacagggaaaagaggagucauugauugggaacuauucugggaaggugagguggaucuggugucuagguggaaggauuugggggaaagaggggagguaggagagucuagacguagacagcaggcagacaggggcuccagguuuucccuacagaacugaggacagugauggccgagcgugguggcucaugccugcaaucccagcacuuugggaugccaagguagguggaucacuugaggccaggaguuggacaccagcaugggcaacauggagaaaccccaucucuacuaaaaauacaaaaauuagccgggcauggugacacaugccuguagucccagcuacucaggaggcugaggcacgagaaucauuugaaccugggagguggagguugccguaagcugauggcaccacugcacuuuagccugggcgauagagcaagacugucugaaaaaaaaaaaaaaaaaagaagaagaagaagaacugaggacaguaagaguaaguggucgcuugugaucacagaaccagcaaguaaaccgcgagcuucugccccucuggucuucccagaccccuuccccggaacauuaagccauaucgcuuuuauggguccaggggcucugaggggcugggcaucauacugugccccugggggcauaucuaguucugccccacuugguugggcggguaccugcugaguacucacuguguguuaggcugugaaugcuggggcagcaggaggcaugguuucugccuccacugggccuuauuucuucaccuugucccccaguucugcccuuggguaaguucuguggcagaacugaccagcucccuucggccagggacaucuugguuccuggcagagcaccaagaagagcagauugucuuccuacccgggggcaccuuugcccagcaggucgggugagcuggccucuuggugagaggcugguccccuuggacaugaguggauucgaugccugcuuucccacccagguacucuacuguggcuuugcuccugcccuuuaugcucagagcuagaccagcaaugugggggagcugcuggggaaaggcgccauguugucuugagguagcagccagccccggaagcccuggaaugccuggggccacugagcaauccucacccucagccccacaaggggagggcguggcucgugaaauuccugauuggguauagcccagcaagccccaagacucgcccaguuugcuuagcgcaacacugacgcuguuuuggaaugaagacaagacaauguagaacuuuacuggggaagaggucgaagaagggcuaauugucuuguuguucaagacugguuagcgcugcucaccucugacgcugcucaccucugacgccaaagguuuuucccuggaaggcagcccuggaggauaccuguguaucugucuuucacaaaaggugaaaugagcucuuuguaguguuucccgcccaggcugcauuuuagaaucacagaggagguacggcgcugauuuguuuuacuauucccuauucaugccugggccccaccccuaaccaauuaaauaaacaucucggagaguggggccuagacuuuauauguuuaagcuccucaggucauugcauugugcagccaaugcugugaccuaugaauacaaaggaagaugaaacgcacccuggucaugcaaggaagauggagagagggagcagggagggugagagaggcugcaguucguaagguccugaaauguuagagcuggagggauccugguucggagcacugcaacucaaaagaguaguucuagccaugcagcaggccccauuagggagcugguuagaaugcaaauccccgccugcccugcaccccaucuggcacccucugagucacggcgugcacaucgagguuugagaagugugcuuucaggucacccacagaucauccagaccagugguucucaaccuuggcugcacuuuagaaucacccagcgggcuucagcgaauuccagugcugggcuagaugaauuaacccagaauuucuagguguugggacccaaauacucauuuaaaaaauuuuuuuuguuuaaguacuucaggugagucucuucuucagccauaaucaagaauaucaggcuugaccagugcuucucaaacuuggacagauagaugaaucgccaggguaucguguuuaaaugcagauucugauuuuauaggucuggaaggggccaaagaauccacuugucugggcucugggaugcccaugggacugaucuggccuuuuuugagcagugggaauaggcugacuucucaguuugacagcaaggaaacugcaggucagagagggaggugugaucguccacgguaaccaaccugauaugcauucaguacuuucugauguacucuacugugugccaagcagcaugcuacaugugggacuagagcugcgaacaggacagacccaauuccaacccucacagagcuuauaucccaacuggggagacagacagaaagaaaacaaguaacuaagcugaugacagaugggaaaagcuaugaaggcgaggagggccauguguagggaacgacucagagauugcuguggggugagggguagguaaggcacgccccuuucagaagagcugucgggggaguuacuaggacaauaccuuuaacuggggacuccugcugauuacaaacugaucacuuuucuuuacuggacaggacuaggcuucauccccucugggguuuggggauggugcuucugacucuccugaggcagucugacccuggucccugccuggcugucuccucugacucaagacucugauccuucaguguuuguggguucagagcagagccugggaaugagcccgcuggggagcaggacacugacuccaccauaggacagggcucaggaucauugguuaaugguuuguaaaauggaccaggccucauccagaugcuguccccagccccuaugaaaacauggaaaguuuccacuggugcacaaacacuagugcuugccucccuuuccugaucaaccgucggacucacaugggcuguuugugaaaaugccugucccaggccauacucaggcugaccaagguggucuggucuccagggaagggccgugaaauguauuuuuaggaagugguccaaaggacucuucugauccagaucaucaggaagcauggcguggauggaagaaacuggcacuuggcaucuggugccucuguguggcuguagaagcuacagaaaugucuucugcagugacugcagcguggcccuggcugagcuggugcuugugaggaagccucugcuugugugcaggggugaacagcagcucaccccuucccaugcacaguccucaccuuacuaccuucacccuuacuggaagcaucucuugacuucucuuuggccagccagacccucccagcucccugugcuccccauuuaaacaccuucccucccugagcuuagcccauggcuggguggggaggcgugagcacuguuugcauuuggucagggccuagaagggaucaaggaggccucaugaggaccaugucauagccccacccucacuccccaccccugaccugagcaaaccuguuuggcuggauugaugauggagaggcaggcagugaccagaccaagagacgccuuggaugguggagaauaggugacccucuguuggguaaaagaggacucaagcccucacacagugaguuggcuaacuuuuugucucaacagugggcggggguagcugucugccuccuggagcuggcccuuccugggucaaaaugcagaaggagauggugagaagaaccacaccagagaggcuggaguaggccagccuggcuugggaccgagucccgagucccuggcuggacccucgguuuucccuuccguggcagggcucaccuggauccuuaaugccgcccuuggaggaguuaggaggauccuggaugagaaaacucacccucaggaugauugccccagggagcagcuuccugcuuucugguggaagggaggggcagacaguggguguguccugcuccagugucuaggcaggagaguuugugaagcugaccggacaccuguggcucuuauuuccuagguggcccgaggcagccgggaugacagcucuccccaggaauccugcugccugcugagaaacauggucagcaagucccgugagugucauccgagggcucccccacccuggaggacaggccucagaagccgucuucagcaggauccugggaccucugggggcuguggagggacagacagggagccaggggcccuucucuucaucuugaaggacaguggguacaaucagggucaagcccucagccagggccaggagagggccagagacugcuucuguugaguuaggggucggagggacucagaagggggcaggugggaagguggacggggguuguaccugccuguugcugccucuagcuccucucugcauguguccugcaggcuggaagcuccuggccauguuggcucugguccuggucgucauggugugguauuccaucucccgggaagacagguacaucgagcugugaguucaccuuccauguccuuccaguggcucuugucagggacagggcuuagggauggagcaucauggagcgggggaccuaguagggcaggaagguuccaagagccggcacaugaccucaucccuucagcugcugguacggaguguuuccaugaggguggguggggguagggccugggaugucucacugggcccucacccagggagugcaggggcaggaagaccuggauccucaaggacuuggguuccaaguggaacuuaacuugagaugauuccuccccggcaccuugggaccuucaugccgugggagaaggcuuaggcugccuggaacaugggucccugggucugacuggggcuucugccuccuguccuuuuuucucuccaguuuuuauuuucccaucccagagaagaaggagccgugccuccagggugaggcagagagcaaggccucuaagcucuuuggcaaguaaguacuuaaggaugaggaggguagagcagggcauggagcgagcugggauugaggguuucacaguguggggaguagauggaaagagcagcuguguugguggacauggguuaggugaagccagggagggaagagaaggccuuauaauauuagucaugggccuaacccuacuucuggcaucaagauuaauucuguucucauccccacccggcuuucaccucugugcagcuacucccgggaucagcccaucuuccugcggcuugaggauuauuucugggucaagacgccaucugcuuacgagcugcccuaugggaccaaggggagugguaaguuccuacccggcucgugggaaccaugggcucacccugaccacguugcuuccuauucucugccguccacggccccagugcccaaguucugagccugacucggguaccagggucaggggaagaagaaggcagccagcgcucugaggagcaguggagggagggcaggcagccuucagaaugcuaucugucacaucagucccuccgccugguacuuuuuguagaggaucugcuccuccgggugcuagccaucaccagcuccuccauccccaagaacauccagagguaaggcggcacuccgacuccagucugggcaccuucuccuauuuccugcccccugcccgcuccccccacuccccacccccccgcucugugaaacagucauggacugguaccaucccagccaauucucaugguagccuagccugggcaucugggugcagagugggcagaggcugcucgaggguauugcaacaguggggcaggcguuucucauugauacacccccccaugccuucccuccacuccucugcccucuucugugcucugcgcagucuccuccucuuacaaagcccagggcuguaaagucagcaugacccuaagcaggaccacggggugaugccugcuucauggggaccaggggcugagggggccuaggaagugguccugagaugggcccaggcagauccagggcagcgagccuggguuagaguguggggugacauagaccacuccucuuucuauggcagccucaggugccgccgcuguguggucguggggaacgggcaccggcugcggaacagcucacugggagaugccaucaacaaguacgauguggucaucaggugugugugacugucucuuccuacuguuguuugggaacuggauguccgagccagggacuguagacaggcccaggaggccucuagugaugggaauccuccucccaacccccagauugaacaaugccccaguggcuggcuaugagggugacgugggcuccaagaccaccaugcgucucuucuacccugaaucugcccacuucgaccccaaaguagaaaacaacccagacacacuccucguccugguagcuuucaaggcaauggacuuccacuggauugagaccauccugagugauaagaagcggguaaguugggggacagacugggggcugaggccuggcgguggggacgcugcccgagucaggaccucacgcuccuugauguccgccuggcaguccuaaagaggcugugaggggacagcaugaaccgggcucccggaagucagcgccuuaggcugcccuccaaggguggugcucugauaagcugccccagcaacuggguauaaaagccugcaggcgucagguggcagcagccacaggcacccaugcuccaggcgugucugugacaggaaagcuuuccgaguagguguuugccugugaggaacucgggagcugagcaacccuccagcagccaucuccaggcugagggcagguuagagcaaugaggccuguguccaaacagaugguccccagaaagaguucacuacaucacuuugccauccggucacaggcugaacugucccaucuggcauuuuugucaaguguuuagacagccuaaaacuuuagucccuucuaccuguguggauguucuuggaagugguccaugguuuagacccuccacucuauacaccuggucaccuggccucccgagggggugccuuuccuccucucuuucccugguccucuccuggucucccaucuguggcacagacuucaccucccuuuccucucaccuugugcuccugaaggccucugccaucgcuuggacccccucgccucgcugaggaccacuggguuggauuugagaaacagggcuucacccgcuucugucucucucuucugaccccauccuccuaggugcgaaaggguuucuggaaacagccuccccucaucugggaugucaauccuaaacagauucggauucucaaccccuucuucauggagauugcagcugacaaacugcugagccugccaaugcaacagccacggaagauuaagcaggugaugaugggaagucaggccugagggcuaggauccugggcgggaaguaggagggaugauccuaugggcuuaggaagcccuggaaggaucccauaacagaggcggcgguuugcauuuucccuccaggaacacaccugucauuaaaguugcugcugcaaaggggagugcacacuuuagagaaccaaggggcauuuacuaaguggggagggauggggauggccuggaucagguuuaggggcuggugugagaggaugguuuuggcaggcgcuggucagaauuugucaacuggggagcugcuggaacagucaguggucugaucuguggaacaacuugagccaugcagaguuacuguuagauacuucaucugugaucuuaucuugaaacacuagucugaacgaguuauaagaguuggagcuaaacaguuugucuugcaugucaugauuugguauggugugucaauucagggagucaauguaguuuugcaaguuauggguuuuuguuuuguuuuaaagauagcgucucacucugccacccaggauugggugcaguggugcaaucauagcccacuguaaccucaaacuuccaggcucaggugauccuucugccucagccuccugaguagcugugagacuacagguaugcaccaucacgccuggcuaauuuuuaaauuuuuuuguagagaugggggucucacuguguugcccaggcugguccugaacuccuggccucaagugauccucgugucucagccucccaaaaugccgggauuacagguguaaggcacugugucugaccacaaguuauguguuauguguuucuucuuuuuaaccugauguccuugagccauagcaaguuaugguuuugagugcagugcccugguggucuucagcuggugggcuuuaacccacuuuguagcuucccaaguacuuccacccauaucuuggagccccucggggaggccgugugggauggugagagacaggcacuagcagacacagguauggcgcuuggcugugcuguguacuguguggggcuuggcaggucaacugcucagauccuuguuuuucuugccuguguggugggauaauauccauaaugaccuuuuaaggcuguuguaggaguuugaaaaauaauaaugauguaaaauaccuauucuggagaccgguacacagggccugcccuuuaaauauuugccagauuuugaauaaaugauuuuauuguuuacugaacauuuccuguuauuccauguucuguguugaauggcugcuuuugugacugcucaaugccaggccccgagucuucuugcuuggcgaggaaguugugcuccuugcucuaagggaccucagucuagcagaguaagaaugcagguugcacuguggggugauaaaauuccacaauggagaguuguucccaaugccguggaaucucagaggaggggcagacaucugcugagagaugucugggaggcuccccagaggagguggugcuggagccgggccuggaaggaucaggcagagagcuggggaaaggcauuccauuuggccagagcaggcggcuccuccagcacugaacuguuuccaguacaaguggcguugaagggcaacaaggaguuucaugccauucauaggauuacagauggagaggaggcuggagagggagaugagagagggcgaggaccugaacccagcuccuggcagugggaagggaaaaggaggagauggacucaacauuguguugguuguuuuuuuuuuugagauggagucuugcucugucacccaggcuggagugcaguggggugaucuuggcucacugcaaccucugccucccagguucaagugauucuccugccucagccucccaaguagcugggauuacaggcauguaccaccacaccuggcuaauuuuuguauuuuuacgaaaauacaaaacacaggagugcuggucucgaacuccugaccuuaggugaucuacccgccucggccucccaaagugcugggauuacaggugugagccacugcgccuggccuguauuagcuuucuguugcucccuaacuaauaccacaaguuuagccggcuaaaacaauacccauguacuggcucaugguccuguagaucagaacagcaggguguggcugguucucuguuuagggugucacaaggcuggacucggugugucaaccagacaguucucaucuggaagcuugggggaaaauuuugcuuccaggcucauucuugugguugaaauaauucgguuccugcgauuguagaacugagguccccauuuccuugcuggcugucagcuggaggcugggggccacgcucagcucuuggagguggcccacauuucuugaccguacagccuccaucuucaagccagcgacggcacaauagauccuuucugugcuucaaaucucugaccuccguuucugaucuugacacccggauuuaaagguucagguaauuaggucaagcucagcaggacagccucuccuuuuguguucaacugugccauauaaaguaacgucacguaaucgcaucauauucacgggcuccccacacgcgcaagggaggagauuacaugaggguuagcgucacugggguucucuuacgauucugccuuauauauuuuacagguggaauugagagauuucugaccaauucuggguuucuagcuuggacagccgguagggggcggggggugguaacauauuuaacuaauagagagagagugcaaggaagaggaggaauuuggugaguguaaggagacuguguccaggcagagcuggcuagaaggccauggaaguguggcucagcccagcuggaugagauaacacacugguggugaaagcaacaaggguggaaaagaagguccagccagggaguggaagaugagaagacaggagagcucagagagggagaaagcuggcaugucgacaggccugaugagguccaggaaaggcucccaaauggguaugggcagcugaaauugugugcaaagcagguugcugaagcggaggaaggcggggcuggagaagugagaauaucaggcugcccgucacuguggaugaauuaggcaugagcaacugagguucucagagcagccaguaaggugaaugggaaagguacugcuguccugcuuuaaaggagagggcagccaccauggcucacgccuguaaucccagcgcuuugggaggcagagguggguggaucgcuugagcccaggaguucgagaucagccugggcaacguggugaaaccccaucucuuuaaaaaaauagagcgccacccccauaaagggucgcacaguuagugcaugucagagcacccaggucuucugaaugaggucagguucuccaaggaggagggcagaacacuuccuuuccuuugaaugaguugcuuaacgcuuuuguaagccuugguuuucucaucuguaaaauggggcugaugauaauagcuaccuccaaguguuuuugugagacuagaugagauaauguuuuauaguagguagguaaaauacuaaacauagugucuggcacauaguguuuaaaaaguaacugauaugaugauggcugucauucugauuguuagucuuaucucuacaggccccaggccucccccagauguguggagcuguaccauccagaaugguagccgcuaggcacauguggcuauuuacuuauuuauauuuguuuauuuuuagagaugggggggucucacuauguugcccaggcuggagugcagcagcucuucacaggugcauucuuagcgcacgacagcccaggaguccugggcucaagcaguccucugaccucggccuccugaguugcuggaacuaugggcauaugcacuacugcacccagcacauguggcgauuuaaauuuacaauuuaauuaauuaaaauuuaauaaaauaaauucaguuccucagcugcacuggccccauuugcgugcucguuagcucguggcuugucuuguuggacagcgcagauggagaacguuuccgugacugcaggaaguuccacugcagagcgcuggcagagaugauggugggaggagcagggcucccacuaacacccuccugccccuguuccucagaagcccaccacgggccuguuggccaucacgcuggcccuccaccucugugacuuggugcacauugccggcuuuggcuacccagacgccuacaacaagaagcagaccauucacuacuaugagcagaucacgcucaaguccauggcgguaagugccuggcuugugagcauggugggccagggcguggacgggcagacagucagaggggcacugggugagugggagcagugcugagacccagagguggcucccgcagucagaacuggaaccgaggcaccuggacucccuggccagcauccuccauguucagccacaugggcuuugucuuccuuccaagagccagccuggggaagggagcucccaagaaguguggggccauugggaggggcagggagacuuuccuggggacagagaggucccugggagucccucaguuuauuuccuuggcugucuccacaggggucaggccauaaugucucccaagaggcccuggccauuaagcggaugcuggagaugggagcuaucaagaaccucacguccuucugaccugggcaagagcuguagccugucgguugccuacucugcugucugggugacccccaugcguggcuguggggguggcuggugccaguaugacccacuuggacucacccccucuuggggagggaguucugggccuggccaggucugagaugaggccaugccccuggcugcucuuauggagccgagauccagucagggugggggcgcuggagccgugggagcccggccagggcagggggcucguugcuguggcacccccucucugccagcaccaagagauuauuuaaugggcuauuuaauuaagggguaggaaggugcugugggcuggucccacacauccaggaaagaggccaguagagaauucugcccacuuuuuauaaaaacuuacagcgauggccccaccaaggccuagacacggcacuggccucccaggagggcaggggcauugggaaugggugggugcccuccagagaggggcugcuaccucccagcaggcaugggaagagcacugguguggggguuccaccgagaaggggaccucaucuagaaaagagguuacaaaccuaccauuaaacuauuuuuccuaaaacggaa

SEQ ID NO: 192041 - RNA, 6064 nt, Homo sapiens
uccaagaccuaaaaggcaauuuauuuaugaaauuuauuuucuuauauaaauuacuuauuucucugggcagacagccuucaccuuauugcacuaauagcacaucuguaauaucaagcuacaggacaagucuuaacaagagguuuguguucuucaauguagcacuugucuaccaggcacuguagaggggagugaugaggaaaagccaggacugcuuaggaggugaaggaugggaggggagggggucaucauacauccuucugacaauugguuuccucccaggaaggggaacaugcagagcuuacuucuggauucugggagugggaagaguugggaggccaagaagcccaaugcaacgcugcagcugagcuccuuuuauuucugagggaagcaaggacucaucuuuugcucauuuguaacaaaucacuccagccuagcugaugcuuugggguaaacaauggaguaggagucaucaucagaauuagaauuagcagcaauuaacaggcaauacacugccacagugaggcgggugucauccagguccuggggaccugcaggcuguguauccuagggagaggugccauucaagaccuggcgcuggcucuggaagagucucuuaaccuaaugcagcugggacucauuaggcucagacggcucuugaccacacuaauuauuagcaaagcucugguguuggguuccaaccauuggucaaagcuguaauaagacugagucuguaggcagagugaagggggugccugaguaggaagggggaggcccgcugggagagggucagugggcagugauuguaacaugauuaggccuuccuugcagauggcggcugugcugaacggggagugggguuggaaggagccacaagcccccucacucugccuuuguacuacacugaagacagguugcucacauacucuaaagcacauucuugauacaggaagaagggcuuguggggaaagcggcgauuugguauugggcaagagccacguuaagccuucaugagggcagccaccacagccuuggcauugaggcugcguaggucacaguaggucuggccggugcccacaaagacgauggguuugcuugugauguacgucauagaaauagcagcucccaccuaaguggagaaagaggacagcccaucaacacaagcccacuuuucacucacccucucaggaacaggaagcgcuggagccaagauuuccuugcagccucagcuccuuugugcaggacgcccauuccagccuccagucucacguuuaccuugucaucaaugguaucaaauuugguaagaacaaugccaucaaugagccgaggugucugagccauagaauggucagccaaggcucuguugaacuugaccuggaaagaaaaagugauagaaguguaagaaccaucuaaauugaccaaagcucaaguuguaaagggaacugggcccacgcucucaccagcugguccacggcuucauugccuacuaaggcuucuccuacaaacagcaccaaaucagguguauugacaguaaugaguuuggccagggcagucaucagaggggcauugucuugcaugcggccugccguguccaccagcaccacgucaaagccuugguuacgugcuagagaaagaaaguagucaacucugaacaccuggacuaccacucaugcucguucccagcuuccucucaaaaaguccuaguuugacuaccuguucacugucuugggcucuggauuugguuccaagguaaugugagaaaaacuugauuauaugcuuggccaucaccaaacauauucaggaaaaggaggacaacaggaugaaggugaccaaauucagguuucucugguuaagguauauuagcuuugccugcaacuacaucuguuauccaaaagcagagcauggcaaguaacugaucugacuuuuuacuguaauugaccaacgagucuguaguagcacaagccugaucuucugcaaauuccaagagaacccaaggagaaaaagggaccccaaauaagcccccacacuucccaugcacuguaccaaaagcaauggcuuccauggcaaugccagcagcauccuugccauagcccuuuucaaacaacugcaccauggugcggccaccaugcuucucuggaggguguagggcacucaaacgccggguguguguacgcagcugcuccacggccccagcacgaaauguaucacaggcagcaaugaggacacugaagccauucucuaacaaccagaaggaaaucugugaaaaagacguaagaaaagucaccuaaagccaggauuuugagacacaagaaguacagaaauaucagcgauaggcuggggaacugcacugaccuuggcaagauuaguagauuuccccacuccauuaacgccgcagaaggugacgacauaagggcgcuggcgacgcugggcauccaugaugucccggagcaugucuacacgacgcuguggcugcagaaucugcaccagggacuccuguagggcuugcuuuacuguggaagucaccgcugaaaggggagguggaggagguugcagcugugaaacucaaggaaugcucucaaaaaugccuaacaccuuucugagcuaaggggacuaaaacaguaaauuagacucuugucccagaaauccagaacagacgcacauuacaaggacuaacucacugaauccucucaauaacccuuaaaaucuagguuacagagguuuagagguuaaggaauuugccgaaagucacauaccuaguaagaacugaggucuaugcacuuaaccuacacauaagcacuuucucacuuagguaaguacuuacugcugaacguccccaucaccuucccuuccaacuuguuggcaacagauucacagagcuggacggcaaugucugcagccacguucuuagcugaggagagggggacagguaugucaguuccaugucagcaaugaccaaucuuuaugguacaggugagaaacgcuaggugauucugcucucaacuaccccuaucccgcgaguaugagucagcccgguccucagaacuuaccaaugagaugaucacgcaucuuguccagcacagauuccaugucuucacgacucaagcucuuugaacccacaaggcccuucagcauaccaaacaugccacccaguguucccuuggucgcacugcagggacaggagauuacacauacacauaaaaccaguaggcaggaguuguaucuuaccaguuuugcagaugcauauaccaacccccaccugaaauuccccuaccuagguuugguagaguuuugagcagccccuucgucaucagagcugcugcaguccagauccugaagcugccccccagacccagucccucgaaucuggaagauacggggaaaggauguggggucaggaacacuaaggucucugaggaaaacguccacauugcucuaucucuuucauuuugggaagcuccaaguauaacuuaccccucauucaaaucccaguaucacguucccacacucuacuuccucccaauuuguuguuaaagaucacuuugaccccuguuaccucuuaccagguugauguccucagacaaggcagccucagggguuccauugguggugggaguacuguaauccaacacuucuuuguuagcacagccacccaguucccacacccggggugcuuuuuugcccuucuccuuuggagcaucugacuucguggacuugcugcaacagguuaugauacaaagaguuaugguggagaaguaggaaaggaaacaugagccagagaccagaacucccuugcacccauugugucuagauaacaguauuuugagaguacuggagaaagagugcucacuuggacuucuccauaccccucccaugcuucugaaugaacuccucgcgcuuccugcggaucagcuccucuuuggaaaguucuacuccguucucaggacccacuggaagaccugacuuuucugcagggacugguuugcugguagccaaaggaccaucagaaccuguuggggaaaaaacucacugaagaaaaaagaagaccaaucccaaccacuagacaauggcuaaaagucuuccaaauuguucaaaggaaauuuggaccaaacaucuuggaguucauaaggccuggggauuauaggauggugaccauuugagugagaagcagguaagcaaugacaaaaggaaggaccaccucaguccuuagcaccguguuaacaccuuucaugucccaguauauccaaagaacucaaacuugccuuccuucuuggcccccuuuuuuuugcuauucuuugcuuuuuccuugggcuuuuccccccgugucucaaucauggaccucacagguuucuuggccuuuucagaaucuucaaauuucuucaugguagugggagcacggaucuuacugcucuccucugcuucacuaaacaaaaaggagaaugguuuaucuuucuaccccaugcagaaggaaaaauaacgguccagagaaaggacucucacacccaagaggacaaugagaacuggguagcaaauuaggaaugucuuugaacacaucaauuuaccaccuuugaaccaccuucagagaggucaucaaaucauggaaauaaauugauuuuagagaaggcaggucucucaccgaaggagccgcaggaagucauuuuggaaaucaaaagugccauuuaauaaacuuaaagcacuuugcuguuggaucucugugcgguacuugucccgaaacagccgaugcacgucaucuaucaauuugucuacauaugucagugucaggaucuucugaaaaccaaccuguuuaggggaagaaacagccaacagaucugcuuacauacuagccuagaauggagggacgccaacucaacccuggcuuucagagauagguucagcuaccuggccgguuucccuguccugagaggcagccaagcucccugccugggcccaguagcugcuguuuucccccaucuaccuuucuaguuuuuucaguuacgucaucauauacacuggcugcaauuaaucagaguucucuuaaaaaucagggcuauguuaacaaugcaaucgucccucuacaacaccccacuuaccacaaacaccagcucaaacugguuguccaguuuauacuugagugugagugccucaugggugaaggaguuguuaccuccccguuccuggagaaagaguaugucucaguguucagacuauccccagaaaacccagguuugggcccuggguuuggauaaccuuugggaaagagccaaacauuucccccaaacucaaaucuguccccaggacaagaggauguuggggcacuucucucuggcauuccaccagaaauaagauaaccaaguugggggaaaaagaugagagagagagcaagacacaugggagccaaaagggaaguagucauguaaacaaucagauuacuagcagcuauacaccauuuaguuuuguaaagguguuuucccaucuguuauuucaccuaggcucgaaacaacaaaaccaagcugcuggggauaaauagagggagcggaggagaaucccaaaggcgccggaauucggcuagaguugagacaccagaggcgggggccgucauuaaguugcgggguagucugaaggggacgagaaaacgaagcggaguccggguuacgcgugaguggucagugugaggugggcggggagggugggaggaggcgcggaauagagucgaaggggaccauggaucgggucaggaaagaagagccuggaguucugaucccacggggacgguaccugcagcagcacggaacgaaucaacgcguuaacggguccggugcaugagucgcuaacgcccuggaagcaccagagcacaagcccgcccuuggagaaaauggugaagaagucgagcauggcggcagcggcagaggagcuggggccggcgccgggaauucaggccgcguucgccgccgcuuccugcugcgccaagcgcgggacacgucacaccaguggccccggaaaucggcucaaccguacuuccgcucagaacgccgggugcccuccccaucuccgcccgggggcgcgcaggacu

SEQ ID NO: 192042 - RNA, 28542 nt, Homo sapiens
cuccugccaggguugggugcgccgcugaacggauggcugagggagccccgcggaucguuuaggaaagccggccaggugagaaggccguagaacguaacuugaaaaucagcggcaggugcaguccauggcguugauggggcugaacgaagugcaggaggcaaaacucuaaauggggguggagagcagagcuuagggccuugcagaggagggggcguggggcguggugugggggcuuccuggauggaaggaugcgaaggucuagggagggaggguaaggugggucuugagaacagagcgugggaaagacuggguccugggacuaguuauggaggggaaggcgcguaggaugcuggggugaugagugucccgcgcugagggguaucagagguggucaguucuuugagggugggaagaagagggaggugggacccgcuggaacgaccggaagggagaagagaguaaaagaucgugagaggguguggaaacguguguaggaaaacggggcuggggaaauugcagucugggaaacuagaggcaggguggcaggagaugccacagcuugcagggcacaguugaggagagcagguugguaaguguuuuaagaaaggugucuuugcucuuauuugcuuggcggugugcgaaagugaccaaagagcacgagaugaaaucucccuuacggcccugcccucaaugacuagcucguuuacucaaguuuucaaguagagauccuagcagucucauuuugguguguggcucguaucaacgcagugguguuaaguuuguuccuauuucaggcauuccagaaaacagcugcaaacccugagagauauggcuggauuguugaccuccuggaguaguuaggccuuuauuuuuaguugcaaaguaagcuuucccuuugggacuauacuuaaacacauuucuaaacugcucuucugggacaguuaauuauggagaacaugcuugacuucucaguguuggggcuagcauucuauaugccuuccaccuaguccaguguuguuguuguuuuguuuuucuccuuuauuccaauaauagugggaaaaaagauucauggaggaggauagacaaacguuuguuaagggauacacaaguacaacuagauaggaauaaauucuaguguucuauaggauaacuauuauuaggaguauaauuaacaacaaaaauacacaauuuguuguauauuuucagauagcuagaagaguggauuuugaauauuccuaagacaaaaaaaauaaggugaugaaucuacuaauuauuucccgacuugaucauuacacauuauauacauguaccaaaaugucacacuguacuccauaaauauguacaauuaugugucagucaaaaagaauaaaagcaaaacaucuugaaugguguugcauauccuuuguuauagucguuauaacuuagcucuugaucaccuuguaauuuaaaaaaguaggucugggcgugguagcucacgccuguaaucccagcacuuugggaggcugaggugggcagaucaugaggucaagagauccagaccacccuggccaacauggugaaaccccgucucuacuaaaaauacaaaaauuagcugggcgugguggcgcacaccuguagucccagcuucucaugaggcugaggcagaagaaucgcuugaacccaggagguggauggagguugcagugagccgagauggcaccacugcacucuagccuggcgacagagcaagacuccgucucaaaaaaaaaaaaaaaaaaaagauaguaguacugucuuauacaagaauaacuaaccuaugguagauuagugcuauauugcuauauaaauaauucauaucugucaugugauuuccauuuugaacugccuacagauagugucccucaacauuuuaaucuacuuuuuuuaaucccccgacucuucugcuucaguaggaaaaauucguuuucuuucccucuagauuaucaucugaugccaucaaacugucuguguaauuuaaucagucucuuaaaucagcauugucaguuacagagaagccuugagacagaugauuggaagcggguauagaucugagcagucguuacagucugauauaugggaugagaacacaguggaucuguguuuggguaccuccaccucuuuuugagugcaugauuguaccugcauuaguuaucagguaugcuguuaguugacccgacagccccauugggauuuggaaaagaaaaaaguuuauagccauucaguugaaguuuaaauuuagggcucgaaauuguguugauucagucgugacuucuauuuuuccucuuaaugccuuucacuucuucuuuuuuuuuuuuuuuccuuuuuaaagagaggaggucuggcucuauuguccaggcuggagugcaguggugugauccuagcucacugcagccuccaacuccugccucagccuccugaguagcugggacugcaggugcagaccaccaagccugcauaauuuuaaacaguuuuuuguggagaugggguuuugcuguauugcucagauuggucuugaacuccuggcuucaagcgauccucccuccuuagccucugaaauugcuggggcuugcacuucuggucucaauguuuauuuccugcuucccccccuccgccccugccaccccauauaguccugccuuuucuugagugcucucuuucuccauuuuauuauuuuucaguauuuccaaucuuuccuguuuauuuuuucaucucuuccuugugcuauacuauugcuaauugugcuuauguacuuguuagcugugaaggagugggaaauagaauuauggaugguuuauucugaccacuccauuuuagucuugacacauagaccugacuugugccuacuuccuugcaaguugaucauacuuuaggccaggcuuggauacuaguauuagccuugacccugucugguguuuuugcuagcuccuacguccuuuaugauucccucucaucauaaaauaugaaaauuaaguaaauugaagguguucaauaucuuguggucuugacuuuuucauuuuagcugaucgucguguguugccacccauucaugucaagaugacuaaguuuggauuuuugcgauuguccuaugagaagcaggacacacuuuugaagcuucucauucugucaauggcugcuguauuaugugagugugcaugugaaccucucuuucuuuggggauagaaagaagaaagucuagaaaaaaauugaaaaucgcuaucuuaaaaugccuuguucuuuuuagcagauuguuacauuuuuccauuccucauuaguauaauuuuaugaaggcaaaauaaaaggaauauaaaagucagggcuaugggccacaugcagugguucacgccuguaaucccagcacuuugggaggcugggguggguggaucacuugaggcugggaguuugagaccagccuggccaacaugaugaaacccugucucuacuaaaaauacaaaaacuaguugaguguggugguggaugccuguauucccagcuacuugggaggcugaggcacgagaaucgcucgaaccugggaggcagagguugcaguaagccgagauugcaccacugcacucuagccugggcaacagagcaagacucugucucaaaaaaaagagggcugugaucaucuuugaaagaaugggaagcaugcugugccaauucuguuuucucauaggguugaaagugauauuggggacccuuggauaacugauuuuuguaaaagacaauuaucuucaauuuagaugucuccuauaguauuuuugaaagucucuugagaguuuacucuguauuuuagauuuucuggcucuucaugaguccuagguguaauuuugcuugccauaccuauuacuuugcuccaagguuaagguuaguuauguguguauggugggggagucagcguauauaaaagaugaccauguaaguugaguuugguauuaguaggugaauguaauguuauaggcuuuuauaauuaguuaacugugaccuaugaaaguggaaaauguagaugccauugucaggggaaaguaaacuucucuuguuuccuuuauguggggaaagauggauaaagacuuuauucagggauuauuuuauauuuucugugaccucucuacuggauaauacugucuucauuauaauacuauaucugcuguucuuucauggcacauuaccaauaaaauauuaacucucugguuuuugcagccuucuccacucgucuguuugcuguccugagauuugaaaguguuauccaugaguuugauccgugaguaccuuugcuugaucugguauuauuuccuuugggaggcauucagguucauggguuucagauucaaauuucagucagcucucagugauagagaugugcuuucaguacauuuaagggaaaaaaaaacccuuaaauucuuccaaaggagauaauuaucuccuuuuaagacguauguguuggaguccagcacaguggcucacaccuguaaucccagcacuuugggaggcugagguggagggaucacuugagcucaggaguucaagaccagccugggcaacauggugaaaccccaucucuacaaaaaaaaaaaaaaaaguauguguuggaauugaccaaguaagucucugaaacucaaaaaaugugagaggcauugcuaguaugucugccuaucacuuaagaucuggcuaggcuaagagaauucuggcugcccaguuugguaaaaguuugugaugcagauugaaggaaaggguccugguguguauuccaggcucagaagagaaucacaaacaauggacuugagauucaugacauuuugcuguuuguuuguuuguuuagcaauuuaugugauagaaauugggcuucuuaguuaaauucuagggcaaugaaaaaacucaaaguuaucaguuugauaaggaauuuuguucauuagaugaaaaagauauaguggaauuccuuagugguauuaauaacuaguauuuacuaagcauucauuuuguuccaagcacuaauuuacagauuaucucuaaauccuuucagcaacccuuugagauguagguacuauuauucccuucuuagaaaugaggagacuccacugggcacgguggcucacgccuguaaucccagcacugggggaggccaaggcgggcagaucacaaggucaggaguucgagaccagccuggccaacauaguaaaaccccaucucuacuaaaaauacaaaaauuagcugggcaugguggcaugugcccguaaucccagcuacucuagagacugaggcaggagaaucgcuugaacgcaggagguggagguugcagugagccaagaucaugccacugcacuccugccugggcuacagagcaaggcuccaucucaaaaaaaaaagaaaaagaaaaaagaaaugaggagacucaggcugggagugguuaucuaagguugauuauucaguacguggaggaaccgugauuugaauguugguuugucugacuccagagacuguagucacuguguuauauugccuaaaguuaaggcuuauaacaaauuuggagggccaaaaucauagguucuugaaauauuauugguaucuuaaaaauaguauauucaaucuuguggaguauugauugaaaaugccugcaucuauuugcaaauuuauaauuuuguuuuguguagauauuugaaagcauuuuggaggcauuacaaauaauucuguuuggggccucccaaauucaguuuauauuuuuucucaugaaugaggagacauguccuuuuguuuuuucuuuuuuuguuugagauugggucugacugucacccaagcugaagugcaguggagugaucacggcuuacugcagccuugacuuguggggccuaagugauccccccaccucaguuucccaaguagcugggaccacaggcaugugccaccauaccuagcuaauuuuuuaaaaauuuuuuguagagauggagucucacuauguugcccaggcuggucucaaacuccugggcucaagcaauccucccuccucagccucccaaaguacuggcauuacagguaugggcuuccaugcccagccuacuuuuguuucuugaucccaaucuguuaggcuucuuucucagacccucugaaugagcaaauauugauguuagauaaucaaggaaugcaagagcaucugcuuugucgucaagagcuguuagggaccauaagggacuugacacuuccuuuugcagaggaggaaacugauucccagaguggugaaugcaguccagaccuauuccuacuaacuuauacuuccucucucacucugccucuccuacugguagcuaaaggacacaauucugacacauacugaugucugcaacccucaucucuucuguuucugacagucaccaaaauaacaucagugacaaacagaaggauagagauuucugccaucuguugcuucuguuuacuucagcuuucaaaacuugacugaccaaggaggaaauaggguuagagaggugggcagagaggacgguuagucaugauuauccauaguaauuaaacugucucuaguuugagacucuuuguuuauuuuugucugucuuccuuuuuuuuggaaacagggucuugcugugucacccaggcugaaguucaguggcucaguuauggcucaugcagccucaacuuccugggcucaagugauccucccaccucagccucccgaguagcugggauuacaggcacgcgccaccaugccuggcuaauuuuuguguuuuuuguagauugggucuuguuauguuacacaggcuggucucaaacuucugugcucaagcgauccauccaccucugccucccaaagugcugggauaacaggcaugaacuacuacaccggccucuucuuuauuuuuauuuauuauuauuauuauuauuuuuugagauggaguuucgcucuuguugcccaggcuggagugcaauggcacaaucucagcucaccacaaccucugccucccggguucaagcgauucuccugccucagccuccuaaguagcugggauuacaggcacgcgccaccacgccuggcuaauuuuuguauuuuuuguagauugggucuugucauguuacacaggcuggucucaaacuucugugcucaagcgauccauccaccucugccucccaaagugcugggauaacaggcauuaacuacuacgccggccucuuauuuauuuuuauuuguuauuauuauuaauuuuuuuugagauggaguuuugcucuuguugcccaggcuggagugcaauggcacaaucucagcucaccacaaccucugccucccggguucaagcgauucuccugccucagccuccuaaguagcuaggauuacaggcaugcgccaccacgccuggcuaauuuuguauuuuuaguagagacaggguuucuccauguuggucaggcuggucucgaacucccgaccucaggugauccaccugcgucggccucccaaagugcugagauuacaggagugagccacugcgccuggccuuauuauuauuauuauuuauuuuauuuuuugagacagggucuugcucugucaccaggcuggagugcaauggcaugaucagggcucacugaagcuucaaccucccugggcucaggugauccucuuauuucagccuccugaguagcugggacuacaggcgugugccacuaaguccugcugauuguuguauuuuuuuuuagaaacagggucucucuauguugcccaggcugaucuugaacuccugagcucaagugauccaccugccuuggccuacuaaaguauugggauuacagguguuaucuaccucacccagccuuauuucuuuuuaaauaagaaacuuaaggacuuacauauuuugggccuaaagaacuaucuuuccauuuaaagcucuuaagcauuuuaugucaaauauuuuucauguugucuauguaucuguguaucuuucuauauuuuuuuugagaaagggucuugcucuguugcccagucuggagcacaguguugugaucauggcucacuguagccuugaccuccuggacucaagcagucaucccacuucaaccuccugaguggcugagacuauaggugugugccaccaugccuggcuaauuuuuaaaaaauguuuuguagagacagagucucacuguguugcccaggcuggucuugaacugggcuuaagcgauccucuugccucagucuuccaaagugccgggcuuacaggcaugagcugccaugccuggcuguaaucuauauuuuuaugcuucuauauaggugacauaagaagcauuuuagauaaccacaugaguagaccuuguuaaaaguuuaaacacugauuaagaaaguuguguuaugaaguagguuaaaauuuuuucauccugcauaugaugguauaccaacaucuuuaaagauucucaucacuggaaauuauucaugugucuuugugugcaguauagauuuuuaaaaauauguuccugucacuuaaaagccagaaucuggccaggcaugguggcucacaccuguaauccaagcacuuugugaggcuggggcagguggaucaccugaggucaggaguuugagaccagccuggccaauauggugaaacccugccucuacuaaaaauacaaaaauuagcugggcauuguggcgagcgccuguaaucccaguuacuuucagaaggcugaggcaggagaauggcuugaacuccguaggcagagguugcagugagccgagaucgugccauugugcuccagccugggcaacaagagcgaaacucugucucaaaaaaaaaaauaaauaagaaagccaaaaucuauuggugcccacaucucaguggcuuugucuucauggugcuugaauucucugacugguccuaaugccuaccacaugucagcuuguugaaguaucccauuugauugcuuuguuacaauguuaggcuccaguuucauuuccuuuuuauuuauuuauuuuuuuuucugagauggagucuugcucuguugcccaggcuggagugcaguggcaaucucggcucacuguaaccucugccuccaagguucuagcgauucuccugccucagccuccugaguagcugggauuacaggcacaugccaccgugcccagcuaauuuuuguauuuuuaguagagaugggguuucaacauguucgucaggccagucucgaacuccugaccuugugauccaccugccucggacuccuaaagugcugagauuauaggcaugagccacugcacccggcucauuuccuuaugagaaaagcagugcuuuaguugagacaagcauggagauagaaguaaacagacuuaugguaguguaaaaugauuuucauggcauaauaucugauguuaaacugauuuuucauugaguaaugcugaauuucucaaugguguauccugaggagcaaaauucaccacaaauuuacaacaaaguuuauuucuugcuauagguacuuuaauuaucggacuaccagguuccuggcugaggagggguuuuauaaauuccauaacugguuugaugaccgagccugguacccuuugggacgaaucauuggaggaacaauuuacccaggugaggagaccagauguguuuuuuuuuuuaaaaaaaaaacagaaauauuuguaugcuagagaaccaguuucuuuuauuucuaauagcuuugucuugugacacuuguaauuucauccugauuacagguuccuaaaagugcaucuuacauaaacaggaguacauuuguaguagaguggagaugggugguuuuuauacauucuagacuucugauugaauccuuaggggagaaauuuauaggcuuacugcaguugcuauguuaguauuucuggugauuugucaagacuuacauagucacuuuauuguaucugggauuuucccuuucuuuuucccuuaaguucugguaagacaaccuaauggaguuucuucuuccuguuacagguuuaaugaucaccucugcugcaaucuaccauguacuccauuuuuuccacaucaccaucgacauucggaaugucuguguguuccuggccccucucuucuccuccuucaccaccaucgucacguaccaccuuaccaaagagcucaaggugaaggauuuggggugacaggaggcuugggaaugaauguuauugagccucucuaaucgaugcuggagggugggggacagagccuuagaaaggcagggagccagaaggugaagacagcuuuuacugggccaaauuaauuggcuucacuccaaccccuuucugcaauauguguuuuuuaucauuagcaacuguuuguccuuaugagaguacaguugaaagugaaauguaaauugcaacauaaagaaaaaaacauuuaaaaugcaaaaugugagguuuggauuuugaaguccucacaauguaagggagaggaaaaaaaaacuacaugaaacauuccaaaacgguuaguuuuuccuaccaggaauguacucagcaauuauuuguugauuuaaaaaaaauuuuuuuuuauuuuaaaauucuuaagccauuuggcuuccguaguagacuccauaaugcugacucuguuuuuccagguuucagcauugcugaccuuggcucccugggugcuauucuuaguuugugcugcgguguuagagagauaccugagaggugauaaacuaguaggggguuugggaagccugaauuuaguuuggaaaacuuuuugauccuucuccuugcugcccuuucccaaauuugacucuuucaacagacaagucuuuacuuuuuuggaauguggcuuauaucuguugcuccuuucuccugagcucaaagggugccuggugauauuuaagcuuuauugccuaagcuccuggcaucuucaguuuagguagauuaucacuuagcuuucuuggcuuuuuaacugaaauaauaauuuucuuccuuugauuguccuugcauggcuuuuagaggugugacugguguuccaaugauguacagauauuguuagggguagagacuuacgagcuuggggagauugguagccaaacagcccauucugggacaguauugauguuugacaucucacuugauuugucuguccucagcauauguguucucagugucagguuuggugucaucauggggaauuggucaugaaguuuuuagcuugcuugugcugugagcauuucuagcauuucuaacaucucacaucuaccuucgaaauuguuggacuguuuucugggcucauuauaaacagaauggacuaguggauccucuguucuuucucagcauuguauugguguuaaugucuuauuacccuuuuuuucuuacaggaugcaggggcugggcuucuugcugcugccaugauugcuguaguuccuggauauaucucccgaucuguggcuggcuccuaugauaaugaagguaagacuuuuaaaaugcugaagaagaucaucucaccucauuauccaacagagcuucacaaagugcagucuaugguuuagcaauaauaaaaaugguaacugggugagaauauuagaaaugggcaggaacggaucuuggacaagcucauguucucuucccaucauccuuuccagaaagguaguugguaacuuuucuuacaagucuuugguucaucucugcacucauaaaauaguuaacuauuguuuuaacauuauaaucauuugcuuuauuuuccuacauaaagggaguggauguccuuaaaauuuuaaugacugauugacuuauucucaauucaacauacauuuguugaauguuauugggaaaacauaguauuaaguguuagguaaugacuaagauuacuuugugcauaauuauaagaaauuaaagagauagguaaugaauaagguuauauuggcccaucaucuauuaaggaagauuaaaauggacauguaaauauaacuccagugacaggagauaguacuaugugccaugauaaaaauuugaacagaguacuucaggaauguaguggaaggagagauuuggggcugagcuugguggcucacgcccuguuauccaguacuuucagaggcugagguguguggaucauuugagcucaggaguuugagaccagccugggcaacccugucacuauaagaaauacaaaaauuagcugggcaugguagugugcgccuauagucccagcuacucuggagacugaagugggaggaucgcuugagccugggagguugaggcugcggugagcugugauugccacugcacuucagccuaguaauagagcaagacccuguuuuuguuguuguuguuguuguuuuuauuuuuauuuuuuuaagaaaaaaaaaaagcagacuggagaaucaaggaaggcuuuuuagaagugguugagggucaacuggguccugaaguugggacuucauuaggcagauaucaaggaaaggggcaauuggggcaugaguauuauauguuaagacauagaggcaggaugaugaaugauaguauaagaugucuuuagaacuauacuagcaggauguuuagugcuuggaaagaaugauaauaauggccaauauuuacuuaauguuuauuauaugcuagguacucuucuaagugcuuuacaggcauuaauuauauuuguuuucagaacacuuuuaugaaguagauacuauuacuucuucuuacaugaaacugaaacaaaaggaaguaaauaauuugccuaaaauuacacuauuacuugguaguagauccaggcagucuguuccagaacaguauucuuaaugacuauacuagccuggccucuuguugaauuuuugguguguccuuucugcagggauugccaucuuuugcaugcuacucaccuacuacauguggaucaaggcaguaaagacugguuccaucuguugggcagcuaagugugcccuugcuuauuucuacaugguaacuuuuucuacauguuuucaauuuuuaaaguucucuaaauacuguauuuccuauggguacuuauuguuugaccaacuuucuuuucugguagguuccccuaaauuuuuuucuuuuccaguauauuuuuucuguucauacuuacguauacauguagacuuccuuaauugcuuccacuugcucacauaucccuaaauccucugugugaccuuacaguagauugcauuuagauuaauucugaggcuugagucccucucguuaugugaucaugacaucagcaaccacaagggagcaggggauugaguuacagugauggguuugaacuugauuuuauauuuucuuuuuuaaaauuuauuuuauuuugugugaccuguacauguaaggacuugauuuuccuguuuaaaaaaaaaaaucaguuauuugaacucuuuaagccauuuggcauaaauaaaguuauaguuacuauaaguguucuuuaaagagucacaggugauauccuacaauauaguggugguggucugaggaggcauacucagaggaacuguuuuuuucuauuccaucauaggucucgucauggggagguuauguguuccugaucaacuuaauuccucuccacguccucgugcugaugcucacaggccguuucucucaccggaucuauguggccuacuguacuguuuacugccugggcacuauacuuucuaugcagaucuccuuuguggguuuccaggugagcccuugacugaguaggguuuucagcuucuacuuuuucuaugcagccccaacuagacugauuuaucuuagauucuguuaagaagaguacgacuuauucacagccuuuauauugaacuacuuguguuaguugaagcaacagaauuacuggucauuaaaguuugcauccaggagucugcuaauauuugcuccguggaguuugaauuccauggcucuuacuuuggcuuuaaguuugugggaaggggagggauauuuaguugaguugaguuuagaugagugaucagaguuaaaauuuccagucuucuuaaugcagaugaccccauguaguagcagagauuccugaucuuaauggcaucuaauuguaagugcuucaggaaguaaagcacaaaccuuuaaccacauugcuccacaggguuaacagacaacuguuaaaucaaagaauaaugugguauguuugauuucucuugugaaauuaucaugaaaaugcaaaccuuaucuagaggucaacaaguauuucuuuacugauuaccuacugcagauuguccccaacuuaugaagcgugacuuaggauuuuuuggcuuuagaauggugugaaagugaucugcauugaguagaaaccguacuuccaguacccauacaagcauucuguuuuucacuuacaguacgguagucaauaaauuacaugagauucucaacacuuuauuguaaaauaggcuuugugcuagaugauuuugcccaacuguaggcuaauguuaaauguucugagcauguuuaagguagucuacgcuaagcugugauguuccauaggcuaggcguauuaaaugcauuuucuacuuaagauauuuucaacuuaaaauggguuuauggggauauaacccaaucauaaguugaaaagcauuuguauaugcaguuugcuaaucacuugaaaauguaaaaagaauaaaaaugcggucauaguccuuaaggaaguuuuggucuucuuacagggaaagaaauacaggcagcugucuauauccgauaggcuacaguucuggaagugugguucuugaaucaucaucacuagcagcagcagcuagaaacuuguuagaaauaaaugcaaauucuagagccccaacacagaccuacugaaucagaaacucuggagguggggcucagcgaucugugcuucgacacuccuaccuccuuggugacuacgaugcccacuagcauuugagaaccaccgaucuaaggcaaagaaugauuaagugcuagaagagaacuaaugugauauggaacauagagaggagugauugauuucaguuuggcagauugggaagagaugauauuugaguuggaccuugaaugaugagaauuuuaguggaugggaauuuggggaaaauuacagucuaggcuaaggaaauaaccugagcaaaagccagagaugugauaaugauaguguaucuuaugcuuuagggggcugcaaauauucuguagaaaauauggcuggugaauuaaacccuucccuagauuggcccugauuccuucggggccucagaacucauuugaccauuugguuugaacuagauaagaauaaugcaggccugcacuggacuuacucauuuuuuuuccuuaguauuaacauacauauccuuuuaccuacagccuguccuuucaucagagcacauggcagccuuuggggucuuuggucucugccagauccaugccuuuguggauuaccugcgcagcaaguugaauccacaacaauuugaaguucuuuuccggagcgucaucucucugguaggcuuuguccuucucaccgugggagcucuccucaugcugacagguagggaaggcucacagcuuuuuuccuuuuuucuuuuuuuuuaagauggaguuucgcucuuguugcccaggccggagugcaguggugcgaucucggcucacugcaaccuccaccucccagguucaagcgauucuccugccucagccuccugaguagcugggauuacaggcgccugccaccgcgcccgccaccacgcccagccaauuuuguauuuuuaguagagacgggguuucuccauguuugucaggcuggucucaaacucccgaccucaggugauccgcccgccucggccucccaaauugcugggauuacaggcgugagccacugcacccggucaggcuuagagcuuuuacuauuaaaugcagauggguacagacauagaauaaacuccaaaagacaggguauuuucugaacacaaaagauuauuuuuuucuuauuucuuuuuucaucggaagcauguacaaucccacaauuuuacauucaauccacuuuucagcccaguguuuggauucagcauagcagaaaauaucuuguuggagcugcucuuaaucacaccuggugaaaggacuauaucuuaccuugcgaaucuuucuccuuuuucuuucuuuuuuuuucuuuccuauugauugggugggagaagucauuauauugcuuaccauacccuccaaaguggcacucaucuaaucccauggaaacuaaaucauagcuguuuaguugguuggaaagccaaauuuuccuucuuuuucucuacuuugcuuucucagagaugaauuugauuuugcucaagucuaucuauugacuaauucagagcaggacuugaggauauaguugauuuaaucucuacaguuggccuugguuugaccaaauuuggccuaaaacccuuucagguagcauuucugccucuguucuucucuccaaguuuauauacagccuggcuuuauucugcuggcagugcugacaaaaguacucucagguuugaaagaaaggaaggagugaaacucucuaaguauugguggcaauuaagcaaaaaccuaauccuucucugucacugagaaucuuauuaaaaugggaaguugugauucauuuggaucagauguuuguuugaagaguguguguggaauauuuauugccucuuugcugcuaggaaaaauaucucccuggacggggcguuucuacucgcugcuggaucccucuuaugcuaagaacaacauccccaucauugcuucugugucugagcaucagcccacaaccugguccucauacuauuuugaccugcagcuccucgucuucauguuuccagguauguggccucguguucugaaauggccuuguucauaagaaucacaauuugauuccaaauuugcaagcuacccucauucguguuuuguuuuucuuugccuguuuauguuguguaauacagaggacggcuaagcaaauuuucucauguaugaagcugagcagaagucagaaguucaacaguuguagauauuggcaaguucagccucacaguuuucuguucauuugucauuuguguuauaaguuaaaauuuaacgguaauuuuuacuccgguuuuguuuuguuuuguuugaguacuucugucguacuccuuccccuuuacccuuguuuuuccucuuggaaguauugaagucccauaaugaguacugcugauuguaaagccucaucaaucucuuaucuucuggccaauccagauguguuuuagaauuuaccgguguuaguggucuuuuucucuuaaaaaauaacuuuuaccuuuuuuuuuuuuuuuuuuuuuuugagauagagucuugcucuguugccuaggcuucagggcagugguacaaucucagcuuacugcggccucugccuccugggcucaagccauccuuccaccucacccuccugaguagcugggacuacaggugcacaccaccaugcccagcuaauuuuuguauuuuuuuuguagagaugggguuuugccauguugcccaggcuggucuugaacucaugggcucaagcagucugcucaccuuggccucccauagugcugggauuacaggcgugagccacugugccuggccaacuuuuacuuuuuucuuacugugaaaguaauuuguguauuguaaaaauauauguaaauaaauagaaaaagaugcugggcacaauggcucaugccuauaauccuagccaguuaggaggcugaggugagaagaucacuuaaggucaggaauuugagaucaaccugggcaacacagugggacccacgucuuaaaaaaaacaacaacaggccuggaauuguaguucacaucaguaaugccagcacuuuggaaggaugaggugggaggauugcuugaggcgaggaguucaagaccaggcugggcaauauagugagaccccugucucuacuuaaaaaaaaauaauaauaauaaugcgcgcacacacccauacccacacacacccauacccacacacacacacauacacacauauaaaauaaauaaaauuagcugggcaugguagugugcaccuuuagucccagcuacuuggaaggcugagguggaaggauuacuugagcccgggaguuugagaccagccucgguuauacagcaagacccccaucucaaaaaagguacauauucaggaguucucacuacccaucucuagccacuguuaacauuuugauguauauuuaucaaauaagaaugagaucauaguuuuuucccugauuuuuuucacuucauaaagaaucaaauuucucuguuacuuaguauuauuuuauagaaauacuuaaaauguaucauuuauuaguuuuuuaaaguacagagaugugucaagauguguaagaaggcaaguaguacauaaucucaugcagcaauauuuuaauauauuccauuuuauaaauauaguauaauuagcuccuuguuuuuggacauuuggguuguuucugauuuuuuugcuacuuuaaagugugcuguaguaaacaucuuugcauguuucuaugauuguuuuuuuaggauaaauuccuggaaguggaauugcuggguuaaauguguggaaucauccagucauauaaugaagauacuuuaccuuguagguuucaaccuacaggacucagcugcuuauuucuccuucccucuuuuguaguuggccucuauuacugcuuuagcaaccugucugaugcccggauuuuuaucaucauguauggugugaccagcauguacuuuucagcuguaauggugaggaugcccucagucugguagacuuuuucacucuaacucugaggugcuuuuuuaucugucuggcagaauucagaaaguacugaugauugugcacaugcuucccucugagcauuugagggaaugaguuguaaguuguugauccuuuccaggaacguaugggacacucauacauucugguugugggguccaacuuucuuggauucguaacuuuguauuauagaagcauuuuugcacuuuguuggauaauaugacccugggugucuuaaaacgggagaugauauuuuuuucuugaaggcuugggaguauuacccagugcuagauuguuagaggagggauuugaauuuuuuuuuuuuuuuuuuuuuuuuuuuuuuugagacagaguuucacucuuguugcccaggcuggagagcaguggcguggucccggcucaccacaacugccgccugcuggguucaagcgauucuccugccucagccucccaaauagcugggauuacuggcaugcaccaccauacccagcuaauuuuguauuuuuaguagagaugggguuuuccauguucgucaggcugaucuugaacucccgaccucaggugauccacccgccuuggccucccaaagugcugggauuacaggcgugagccacugagaauacacacauucucuuauauacuuuaaaucaucucuagauuguaauacuaauaacuaauacuagguaaaugguuguuaauacuguauuguuuagggaacaaugacaagaaaaaagagaggagagauuuuauauauuguaguaaaauaguguuucucauauuuuuuuggucucaaaccacaguuaugaaauauacuuuauaucauuauucaagacacacaugcauauguacaugcauauaauugaaacaaaguuuaagaaauacauacuaauacugcaacuguuucaaguauuuucucuuucacuuuuuguggaggucauguuugaugaaaaccccuaaauugaugucuugaucuacuaauaggcugaaaucuguaaauuguggaacacugauuagacugaucaugcuuccugucucuguuaggugcgucuaaugcuaguguuggcaccuguuaugugcauucucucuggcauuggagucucccaggugcuguccacauacaugaagaaucuggacauaagucguccagacaagaagagcaagaagcaacaggauuccaccuacccuauuaagaaugaagugagaagcaauguuaagaguagacuugggaaacucuguguguguguguguauguguguaugugggcagcggggggugggaggaguaaaguagagcacuguccuagguggucagaauuaacucauauagccucugacuuauuuugaucaaucucaucuauaugaaugugucuaagaaguuguccuguguugugugaauuuaguuugguuaacuacacaauuaauucuuuuuccuuguuuagguggcaagugggaugauacuggucauggcuuucuuucucaucaccuacaccuuucauucaaccugggugaccagugaggccuacucuucuccguccauuguacuaucugcccgugguggggauggcaguaggaucauauuugaugacuuccgagaagcauauuauuggcuucgucauaauacuccagaggugaagauuugggaggggugggaauuguggguuaggggcaaaggggaagacauuugauguuacagugaaucauacagcuuuuagauggguggaaagcugggugaaacuggaacuuugcaacucuagucuugaaugagccuuaaaggugaaccuccauucaauucugggaucuuuuguaguuacucuuacuaguaauuaucuagacuuugcaugcacacuuuuauugauaugaugauuuuaacaugagguagaacaucccaguuauaaaagaagaaaaaaguuauagauaaauaauacauguucacuuuagaaaaaucagaaaauugaaucaagaagaaagauauaaaucuuguguaaagugaucaccuuaugauaacugcuuuuaacauuuuaauuuauaucuuuugagaaucugaagugauuuccuuuacaauaacuauuaggaauaucauuucugagacaauuuguuaggaauaaaaacuuuuaagagucucuuaauucuuguccaucguaucaugugauuugaguuuccaccccaucuuuauaguaagugauuuuugcaauucuguuaaaagguuauuuaagaaaauugucuaaugacacuaggcuauugauguggcuacauugcacagucucccacaccucccaccccauuauguuaguauaaagugaccugggaugaaguguugggaauguugguuuguuauuugugcugagauuuuauaauuguauauaaauggaagaccaggugccaggauuuauuuucugguuugacaugcauuacuuugugaagaaauugauuaguuagccaggugucacuucugucagaccaaagaugccuucucuguugcauuugauuuuuagagacagugagaagcuuguuauuuccauuucccauucuacuuucaggaugcgaaggucauguccuggugggauuauggcuaucagauuacagcuauggcaaaccgaacaauuuuaguggacaauaacacauggaauaauacccauauuucucgaguagggcagguaagauaaagggaugaucuuugaguguuugguguacaaggucuaaugggaaaugugucugcaugaggggaucauaugacuugggauuuugcucugagaauuguacauuuguuuuuccaggcaauggcguccacagaggaaaaagccuaugagaucaugagggagcucgaugucagcuaugugcuggucauuuuuggaggccucacuggguauuccucugaugguaauauacuugauucuguuucuagcugcaggacauagauucuaagaaaacuagaugaauauccuaguuuucuguacuuuuacuaauauuuuacuaagauauuuuucuuucaugggaaguuccuaaguauuugcaacuugagguuuggguauuuugauuuuuuucuuuuuguaacaagaggacauaaauguaaacaauucuuguguagguacagcaugcuauaugauugucuaaggcauagaaguaguuccacaaccaguaauaaaaccaagcugaauauaaggcucaugacaaugaacuuaagaauuagcauuuuuuuagugguuuuaagccauauaaucauugaccagcuuagaaauguuuuauauggccugacagcguguaaaaaaagagaacauuuuauauauauauaaaauauauauaaauaaaaguguguguaaaauggagguuaccaugugcccuaugauuauuggcacaaagauuuuuagaagaaacauccaaauauaguuaucugccuuaaaaguuaauguaaugccuguuuacacuuuaaaaaguuaagcaguucacagccgggugugguggcucacaccuguaaucccagcacuuugggaggccaaggcgggcggaucacuugaggucaggaguucaugaccagccugggcaacauagugaaaccuugucucuacaaaaauuagccaggcguaguggcacaugccuguagucuuagcuacucaggaggcugaggcaggagaaucgcuugaacucgggagggagagguugcagugggcugacauugcgccauuggacuccagucugggcagcagagugaaacuguuucaaaaaaaaaaguuaaacaguucugaagguuuauaauaaaaagugauaguucacugcccaaaaaucuaagcccccuuaacaucaguccccagaagcaaugauuccugcagcuauuucuucuaguacuuacaugcauauuucuaaauacuguguauacaguuuccccuccauauccguggguucugcaucuguggguucaaccaaccacaaauggaaaauauuugugaaaaaaaaucauaauacaacaauaaaaaucauacaaauaaaaaauacaguauaacaacuauuuacauagcaucuacacuguauuaaguauuauagguaaucuagacaugauuuaaaguauauagacagaugugcauagguuauauacaaauacuauaccauuuuauauaagggacuugagcauuugugaauuuugauauucuggugggaggggauauauaaguuagacuuuuuauuuuuuaaagaagauaauacgauaaccauuaaaaaacaaugcagaggccgggugcgauggcucaugccuguaaucugagcacuuugggaagacucuugaggucaggaguuugagaccagccugcccaacaugaugaaaccccgucucuacuaaaaaaauacaaaaauuagccacaugugguggcacauacuuguaaucucagcuacuugggaggcugaggccagauaaucacuugaacccaggcagcagagguugcagugaguugagauugcgccacugcaccccagccugggugacagagcgagacuccaucucaaaaaaaaagaaaaaagaaaaaugcaaaacacuguuacugucuagauccaugaaaacauguaugugaagaucauaaaagaagauaguguaguugucccucuguauccauggaggauuguuuccaggacacccccaccccuauccucaccccucaccaggauaccagaauuuguggaugcucaggucccuuauauaaaaugguuuaguauuuguauauaauauacacacauucucuuauauacuuuaaaucaucucuagaugauaauacuaaucccuaauacuagguaaaugguuguuaauacuguauuguuuagguaacaaugacaagaaaaaagucuauccaucuucauuacagaugcagucaucuguuuuuuuguuuugugaauauuuuugauuagagguuuguugaauuuauggaugucaaacccacagauauggaaggccaacuguuuugguuaauuuguuacacugaauuuauuuuucaaggucaaauuauucauugggcuuuacuaauaggaguucuguaacauuugagaggcauaauaaaaauaaaaaaaguugggccuggcccagcuucuuuuuuuguagacaaccauaucuuuugaacaaugggcucuccuugaugcaguuccuaucaucaucaucauuauuguuuuugagacagaguuucacuuugucacccaggcuggaguucaguggcacgaugucugcucacugcagccucugcuucccaugcucaagugaucuucccaccucagccuccugaguagcugggacuacaggcacacaccaccaugcccggccaauuuuuauacuuuuuguagagauuggguuucgccacauugcccaggcuguucuugaacuccugugcucaagugauccgcccaucucagccucccaaaaugcuaggauuauaggugugagccaucacacccagccauuccuauuauuuucacucuuccauucauagagcuuaugagguuuuugcuucagacauaccugccaggcagcuacaauacuauuguucuaucauagccgagcugauguucuggggguuuauuuuuguuccuguuucuggcgcuaugaucuaggcaagucucugugccucaguuucuccauuuguaauaugaagauaagaaugcagacacugaacgaagauaguaauauuauucauuggauguuuaccaugugacaaacaacuuacuaaaugcuuuacauguuguuacucauaauaacagcccuauuguuguagauacucuuauuuuucuaauuugacagaugagaaaacugaagcacagagagguuaaauaacuugcccaaggucacccagcuagaauuggcagugcuggaauucaaacuuaggcaguuuggauccagagucuguucuuaaccaccgugauauccccucgaacucuuugcaguagugcaauaggaaucuuaucuuuuuuuaugcauuagaaauauuuuuaauacuaaccauccagugaaacauguagcaacugauuucccuaaagccugugcaagcaauacaguaaaugaugaacccuaaaagagauaucaugaguugaugauagugucaauauuuauuaagcaugggaguguguuugacacagaaauguugacuucucauauaccugcuuuggaggucuauaauuuugcagcuguuggucaagaaugagaagacucaugucuugucuaccuuuuugguaaagcuacuacucuuuagaucagucgugcccacugucuaauagaaauaaugggaaccacauuaucauuuuaagcuuuauauuagucacaucaaacuaaguauaaagaaacaggugaaaguaauuuuaauaauuuuaacugaauagucauaucaaaacauuauuauuuaauuuaacauguaaccaguauacccccuuuugggguuuguuuuuuuuacuaacuuuucaaaaucuaauguguauuucauacuuaccuaguguguauuuuauacuuacaguacaucuuaauuuggacuagccacauuucagcugcucagcagcuauauguagcuaauugcugcuauauuugauagccuagcccuagcuaaucuauaggaccaaucucaguuguggcuuaagucuggacuaguagcguaggauuucaggaguauaauaauuucucagaaaaguuguauauuuugacgaaaaaugcuuugcccguauguuguccucacuauuuuuacaaauuagaguuaaaugauaccaauccccauuaaaaaaauguugaggaauuuucuuagaaauacuaaccugcuuuaacuccagcaacuuuugugaugcagcaguucuuuuuuuuuuuuucuccuagauaucaacaaguuucuuuggaugguccggauuggagggagcacagauacaggcaaacauaucaaggagaaugacuauuauacuccaacuggggaguuccguguggaccgugaagguucuccagugcugcucaacugccucauguacaagauguguuacuaucgcuuuggacagguuuacacagaagccagugagugacucauaauaauauuaauaacaguaguaauaauagugauuacuaauacacaguauuuuccauaugccaagcacuaguaagugcuuugugucuguuaacucauuuaauccucacagcaaccccaaaggcauauacugauauuauugucauauuaccuuuauuuuuguuguuugcauauuuuuuugagacaggguuuuugcucugacacccaggcuggagugcagugguacaaucauggcucacugcagccuugauuuccugggcugaaggaguccuccugcuucagccucuugaguagcugggacuaaggugcacaccacaaugccuggcuguuuuuaaaacuuuuuguagagaugaggucucacuauguugucugggcuggucuggaacuccugagcucaagcaaucuucuugucauggccuccugaaguacugggauuacagaccugagcuacugcaccuagcuauuguuauuuuuguuuuguuuuguuuuguuuuuugagaugaagucuuguucuguuacccaggcuggagugcaguggcacgaucuuggcucacugcaaccuccaccuccccgguucaagcgauucuccugccucagccucccgaguagcuagaauuacaggugugcucuaccauccccagcuaauuuuuuuuuuuuuuuguauuuuuaguagagacauuguuucacuauguuggccaggcuggucucgaacuccugaccucaaguaauccacccaccucggccucccaaagugcugggauuacaggcaugagccaccgcacccagccuguuauuuuauauaugaggaaauugagguacaaauagguuauuuaacugccuagugucacauaacuaauggcagagucaggauucaaacugacaaagaguggcuccaaauucugugcuuuugaccguuacuuuuuauuguccuuaaggguauuacagugaagacaggaacaaaagggaaagaaagugacuuuucguaucuucugaugacuacauugagaguuauuugauuagguuaagucucuccuucugacuucaauuucuugauucuguacuagggagaauuucugacaugaaugcaggucuuugacuucugguaggcuuuuuucucugauccaugcaaggguugcuaguguauuagaggcucuaaaugacaauccucaggaauagagggccuuggaagucggcucccuaugucugucuuaucagagauaagacauugacuggcaagcaucaucuugcauagaacuuaagcuaggguaacacuugauuugcccuuacuaccucaugcccuuuuuugcaggcucuacucucaacaaauugcaggcugaggaauaaucaucaauuaguagaugguuuccugaauccauauacugucucucuaggaaauuagcacuguagaaagaaguguguucuuuuucaucccucucuagagcguccuccaggcuuugaccguguccgaaaugcugagauugggaauaaagacuuugagcuugauguccuggaggaagcauauaccacagaacauuggcuggucaggauauacaagguaagcagaugcuauacgucucagaaagcaacuuuuauuuuuggagauugguuucaaugcuuauaaaaugggacauauauuucucaaauagggaaauuucucaugacaccugugcuugaaaaguagcuugcaaacucacugaaaauuuuacuuauuuuagauuguucuuagagaguagaugaucccagucugccaucauuuuggcgguuguugcagugauacuuuuccagcuggggcuugacuaaaccaguuucugugauuaucaggcucacggguggggagagugcaggaaauagagaaaaaguucacauguuuauauuuagcuacauuuucuucucucucugaagaacuuaagguauauagagucauauagaaccacauaggaguauaucucucauauaagaaaagauugagaacccuugaucuauguggaggguagaucaguaauauugguccucacagagguauuccaaaaggcuaagcagagagaaucuagucucuagucagugcuuguguauucacagcccuaaaccaggcugcagaacccaacauaauccugcccacucugggugaauccauuuuaguagaaaauuucuccaaaguugaucugauuguaaauauuaaacugacaucuuuauguugcagguaaaggaccuggauaaucgaggcuugucaaggacauaaaugucacguccagcucugauaugcuucgcacugagcacaucacauuuaggacguugaagauuuuuuuuuuuuuuuuuuuuuaauaugcaguuuguaagaacaaaacuggauggcaucagaauugucuggaaguuuugucuugggcaguaugggcugggccaaaugaaaugauuuuuauaauucuaaacagguuaccaaaugaaaugucauggcuuuacuuuggucaauuaaaggggggaauuuuuuuaaaaaaugugccuuauuuguuuugacuuauaacugauuugagggaggcaaaagcuaugcuaggcugccagaaggacauaagcagaccuuguccauucucuuagcucccuaaauuagccaaauagagacuucuuucucaaaucaggaaaacuaucaaagaccaauucagauccuacauuuacagacaguuuugucauaacccuuugcauugcagcaccuaguacaauuccuuggaaacagcguggcucaauaaauuuuuauugaaugaauaaaugugggaccagaagagugcuagaagagugccuuucugggcuacuaugucucuguuc

SEQ ID NO: 192043 - RNA, 153028 nt, Homo sapiens
gggagucccggguccccuucccacugcgcgcggauuucccucucugaggaaguuuauccuugugccuucuggaggauuucucucuagcucgacucacucuggacugacucgcucccuggcuuucucaguucguuuugggagauaacuuguuuugcuccaagccgcauccguugaccccuuacagucggauggucuagaugacugaauggaguuuugaguuggacuuuugugucccugacggaguugggccugaucccagagcacuggggguggggaggagguguuacuguaaaaugcaaguuggauaaaaggaggaccucucgccaagggccccaaugaguggcacacagucuacuaucaccgacagguugguaugaauuccuccuucguucggccucccggaaucgggcccgaccuagcaggggagucggugauugcagauugccuuuggccagcgaaguugacaggcagaggaaagaggguuguuucggagcugugcaguuagccugggguugcugccgaguuauccaguugauuggcuuuuggaaauguaauuuuuccggagagaaacuucccuuccgauucucagagaagggggaggcaaaaccaugauugugguuuuccgccuguagugugcauuaggauuguguacucgucuggaaaucagaggagaaggucauuuuaggugaaggucggugccugaagucggcucgguauugguguauuauuuaucagcuuuagccguguccugcaguagauucucaagacaauuacauuuuaggaauuucuaccugugaacuuaauguugagccuacugcauggugaucugggaacuugaucucuuucagauguugaccugcacgguguuuaauuauuaucuaauaacuuuccagaauguugacauuaccaguaaaucacagguucuugcuggaagcaauguccaggagcugaagaaaugaggguaaaucaugggguuugcuuuuaauucuuguauuuaaauauuucgucuuccagaaacacuuggcguuuaagagauauaagccguaagcauaguguaagcgcgcagcugaauuuguugaguucugugucuguccuuuauagcaccuaccaguguugcauggugguggguggcgaauugagcuagaccaugugugguugaagugcaguuugcuuauccuaaguuacucuuguuuauaggguaagggauaaaaagcauauugauuccuugaccacauuucauucucaauuuaauuaugacacugcaugcuagucccaaauuugucagcuugcuuuauuuuuaagucagucuucgaauuauuacaccgugaaaaaauagaucaaguaacugaauuagagggccaaagcucuuugaugaaaagugcaacaauagugcuucugcacaaaguagucuuaauuuccuaauaagaguuuuacccaauuguaagacucauuuguugauuuuaaaagggccaaauuccauuaucauaccauaacagcuacuccagaaacagaacuuccucuuccuguugaugcuuuccagcaucacaugaauguucacuuaaaagagucuguuaaauauuuaaaguauuuauauuuacucuuuguguauuuuucaaaguggguuuucauuuucaaugaaauaauuuuuaacuuuuccaagaauacacuuaagauaaguauugacaaugcuuaucuuacuuucuucugguuauccccauuuuuuuccuuucaggguguuuugcuucugagaaaucacuuuuacggguguggggauaauuguuuuccugcuucauucaauucucgcucuuucuguugagccuguaaacaaaagucuugcuaggaacuaauguaauguugguuuucauugcgaugcugagguguuuaauuuauggaaacagaacggacucauuccacacacaagugagugaaaagcccucaaguaaugguuuuucuucagcauugcuucucagggauuuuccuugucuucucguuaucuuggaaauagaaucuuggaauuuguauccucuuuauaacguagauggcauauaaacauucaauaaauaugaaauuacugaaagccuguuucuuuucuuuuucuuuuuuuuuuuuuuuuuuggccaggcacugugcaggcacaagagauuacaaaaugaauauuguaagauuaaucugcaaauugguuugggcauuaauguuuuuugaacugguucaggugcugcugccuaauuuuacauuuuuuuuuuuuaaagaaaagaccuuggaaagccaauuaauaagcacugcugagaccuguuucguaggauuuuuuuuuacuagggucuuuuuuuauuaagaauuauucuuauuugaccacauuuaaauauauuuuguaaauauaaagcauccauuugcuguuaagagaguaguuguuccuaauaugaauauauguuggggugaaaucuggagguacugguuuaguauuauuucucugccaaggugucuuaacaaaguuacgaguauauaauaguuucuagcuuucugucagcccuaccucauccuuuuuucguagugucuaacucuuacuguagguauauuuugcugacucuagaacuguuggaaaauuaacagcaccaguguagcuuuuuagauagagauccuuucaaguuugaagugcuguaugugguauggcuuuguuucguagagugugcagaaccaccaggccagcugugugaguuagaguucuuucauuguggugcuucugacuacagagucugucuguccucaguugaaaucagacuagcugguuuugggcguuguucuguuuugcaguuuguggcaggcgacacauggcugaacaagauaaggguuuuauucuuguguuagggacgugcuggggcugggauggaauucagcuauguuuaggcucugauuggucacuuuggauacucagaacucuguuacauccuguuauuauuuugcaguuaaaucaacacauuaacuugcucucuucucuuucccuucaucuuuuacuccccaguccgcaccccuuaaaaccuaaaacucaaacuuuuuaaaagacuuuaaacucaaacuauguucaugguagcuauuacuucuauguaguauauccaaacagcuuuaaaaaaaaugguaagcaauuuaugagcccuggagucuguaguuuucaucguuuagaaugagcacuugacaaguguagaaaugucugauugcugcuuuuuagucugcauugauugcugcauucagucuuaaaauacauccuaaucguuuccaauccuccuacaugucuuucuuguaucccugagaauuuagggguccuauagcaauuggaauuucuucugagagguagacaggagagaaugcccuuuuaguagacucaguaaaugauuucaggccagugucuauaacauugaauuuucagggacaguacagguaggaaaguuauaggguucuuccuugaaauaaauggacuuuuguuuuggcuagggcuuaugaauuuuguaguuuuugauuuauagauaaagacagguuuuugauacaauuuuuuuaaagcacugaauucagcuuugagcuguuuaacuuaagcagauuuuuaaagugaguguggaaaccugugacuuuauaugccuguacccaguaauuaaugauacuuuucauuagugauacuuuuucugucaaaauugcuguauaaugguuuugauuaaaaaaaaaagagcuacucauguuuauauguuauuuucaacguugcaugagucaucucucggcaaggugaaauuauuuguaaccuuuucuuguaaagucagccaguccauaaauacaaaauugaaaugggggccaaagaucacaguguuaguuuuguauucaguuuuaucuuugccuuuuuaguucaguauaaaaucuugagucauaaagguaugcaauaguacauucacuuguacaguuuuacaugagucaacaugcagaaucuaaaguaacuuuuuuugaaaguacaguguuguagucuuccugauuaaugguacauuuauaugauguucauauucaguaaggugacaagagaagcuuuauuugaaaucauuacaaaaauauguuaaccuuggaauaccacuuaacacauuggugguuuccgguuguuaacauguauauaccaucgaguuaacauguagguuuuuuucuuuuuugagucuugcucugucacccacgguggagugcaguggcgugauccccucacugcaaccuccgccucccagguucaagcgguucuccugccucagccuccugaguagcugggauuacaggcacccaccaccacgccuggcuaauuuuuguauuuuuaguagagacgggguuucaccauauuggccaggcuggucuugaacuccugaccuuaggugauccacccgucucggccucccaaagugccgggauuacaggcuugagccaccgagcccagugguuuuuuuuguuguugcuguuguuguuuuuuaacuaaguuugaguuuucaguuuaaaaaaugaaauuugaggcaaacauucauggaauccauaaauggugaauuuuacauauguuucuguggagcauugcgauuccagggaaaacaguuggaaaauauuucauuguacauaugugguugccucuucuaaaugucauccagugguggguaugaauugcuucccaaacugauacgggucacagaaacagcaagauaacauacugguucccagagguaauugaagggacucuuuugcaucaugguugucugacauuauuagaaauguuucuuauauacuugcuuguuuccuagaaauugaccaugacacauuuucaagaauaguagcuuaacuucuuuuggucuuuucuguuaaaacuugguuuugaugauguuccugagcuuuauuugaagacaugcuccuuucccuuauaauaauuacagguuuucaaaauagugccaugugaguuaaaauuuuuaaaucaacaaaauuauauuuuugccuucuuuugaguaaaauaccaucauguagguaaugauauccugugguaguauaauucuuuaacauuuacaauauuuucaguucaguacagggcagaucaugcuucugucauuuacacuuuaagcuaauucauacaguuuaagucaagauuuuaagucaagauuauaaaacuagaaagggcagacccaagauuuuaaccuagauuuucuggcucucaagucccccauuguuuuuuuucauuuuaaauuauugucuuucuuuguacuguauuuuucugugcuauuuuccuuuaguaacucuccagcuugaugaagucaguuggauuuuucucuuacagcauaguuucuaguaccuuacccauucuaauuuuaaauaucucuugaggauaaagcuuuugucacuuccucaggagacugaagcacagucugauagaucuugcugucaggaaguuuuuccugaucuuuacgucuaacuuuucuuuuaaguuguccuguuacuuguauguacuugcuguaccaggcuaaauaaugcucuccucccauuuuauguuuguaugauucuaaauguuucagacgguuauucauuauccuuuccgguccccuucccuuacucuuugcuuagccaagcuguaugcuuucuguugauccauugucuaaaaaucagcuuaucuuaauauuucauuagcuuuuucucaguugcucuccuacugcaaaaauauggguaaagagauucucaaggucauuuugauucacuuuuauuuuagauagucuuuaggauggauaugagauaugucacagucaaaugaaacaaauuuauacaaacagcaugauuaccaaaucaacuaauuaagcaauuacucauguucuaaaaggcuuuuuuacaaagcgauucuuucaaauaugaguacccucaauguaacaaauguuaucaauucuaugacaaaaggguaggguauagaaauaauguuagccaccuuugauggaaaaucaucuuguugcaauaugaugaaauacaucaggaaguuguuucuuauuuuuuccagugguuuuucaguucguuaucuuaaauuguaggucaaaacauuccucgauguuugguuuauuuuuaccuuauuguuuugucuccucuuauuuccacauguuagugaaauaacaaugcuuagcaguauuuuuuuuuucaguaaaauggauauugugaaaauugaaauauuuuacuuucuugcuguuguauuuacaagaauuguuaaugacaagacaguguaacagaaaaagugcauauuuagauuauuauaaaaucuguaagacuguagaccuuuugaauacuuuauuagcauauuuucuuuaguacuauuuuaguuucaaauuauugagauagauguccuuguuuuguauuuugcuaauauuaauauuuuguauuuugguaauacuaaaauuugcaaacaugccaaauuuagagcauuuuacuuuuucaacuuagaauaucuggaaucaucaagauagucauauagggaagaccgcuauaagacagcuucuaacuccaauagaagccuaugaagcuagugccuggucagaggcugugccuaaauugcaugaguauauagugucgacuuuuaguaaaagaaaaaauacacuaacuuuaccucuugaauuagcaugcaccaaugcaguuuagauucauaccgaaacaggaucuuuuacuaauucaaaugcugaguccugguuuuugagaucacagucacaugacaggccuggguggcuucucagugucuagagacaagcaaaucuacuggccaaugaaaaguagguuuccugucuuggacugcaaguaacaauucaugcagaaauuggaacuauauaagagagccugguuuuaguuaaugcuuucaauuagcugcuugucacacugcuuuuucuuuugguguuauauaacacauuagagucauuuaaagguacacucugauacuacaguuuuugucaaauauuacauauaaauguugauuuuacauucauauacucaaaagaucaaagaggacuuuguagaucuuuuauggauucaaaaaaauguagauuauuuuguuguagaaaaacuggccaggcgcgguggcucaugccuguaaaucccagcacuuuggaaggcugaggugggcggaucacuugaggucaagaguucaagacuagccuggucagcauggugaaacccugucucuauuaaaaauacaaaaaugagccggaccagguggcacaugccuguaaucccagcuacucgggaggcuaagacaggagaaucacuugaacccgggaggcggagguugcaguuagccaagauugcaccacugcacuccuaccuggaugacagagcaagacuccgucucaaaaaaaaaaaaaaaaaaaaaaaaaaaaacuggagacuucaucagccucugaaggaaugauaccugaaauugaucuuguaaugcagaaaguggcuauauguuauccagaagaguaacagauaccccaaauacacuugcuaacacaagaaauccugugaaggugcuuagacauacccuuccauagauuuuagauggguuaucugccuauguuccagacacaagccgauauguugugguuugcccaguacagucucugugguuuacugagaggaagugguucuugugggugaaggucugaucuuuucagagauuguugguggcauaugcacugucagccuauuuccuguuuuauuggcuguuuagcaagaccuucuuagggcaagugcugcugaagagguauuuaaauauuuuguauuggcaggauagaugguuauaaugauguauuauuauaucacuacuucucaggugauaugagaguuaaaugaauguuugugaagugcuuugagaucuuaggaugaaaaguacagacauguucuuagucauuugcagguuacugcuauguucagauauugcucucuugaaguuaaaacuuguucauguaguaaaguguuacucuauuaaacuugauuucuguaaccauucaaguguuguuuuaucaccacaagagucaugauuagaauuuuuccccuuuuuuuccuuucuuucaaugcuccuuuaugauuuuacccuagaagaguuuccuuaauagauuccuugcucuaguacugguuaaggcauauuuaccaaacuuaacaccuagcaagcuuguccaaccugccuuauuuugcuguuguucuucuguuuuguuuuguuuuaggcuuucagcagccugaagccaugguuuuuaguuucugucucuagugauaaaacggaaagagggaugaggaaggggcuuuacuggcccauccagaaacagaaacuaagaacccaugacuguauucucucccuugaacaacuguaacuagagcaaaccucuuugccaauuuaacuggcauacuaaaauaaugaaauugugagaauuuccuuugagauuaguaacuguaccauccauauacaaaacacuauauugcuuugcugaaaccugaaagugagcaaacugauagaaaugcauauaacaggccgggcguaguggcucacgccuguaaucccagcacuuugggagaccgaggugggcgguucaggaggucaggagaucaagaccauucuggcuaacacggugaaaccccgucucugcuaaaaauagaaaaaauuagccgagugugguggcgggugccuguagucccagcugcuggggaggcugaggcaggagaauggcaugaacccaggagguggagcuugcagugagccgagaucgcgccacugcacuccagccugggcacagagcgagacuccgucucaaaaaaaaaaaaaaaaaaaacgaaauggcguaugucauacuccuaaauauauauauauauacaguauuuagccuuggacguuaaaaaaauuaacaaugaaugggggaaggcuuuauuuaaagcuaaauuguuagcuaauacgugaguucuucaaggguauaagaauaguucuuauucauuuuuaaguaauuaucgguagccuuauuauauuuuuauuuuuuaauacugaaaagcagaaggaagaaaaauaaauggcccaaaugauccaacuacccagauguugcugcucagguuaaacgcacacacgcauacacacacagaaaauucaaaucauauaaaaugguauaaaaaaaaguauuccuacacaccuguuaguuuucauaccuucuccucauagguaacaauaguuaauuuuuuugguuuaucuucugaaacauuuaaaaauauauaccagccuauaauuuuauuuuuugcaccuacuccauaauaaguguaucugucuucuuuugcuagguuaugcugcuguagcaacacuaucaaauuucaguggcuuacaacacugcuuuucuucuugcuuaugcuacaccuugucagcuguggauugacugcagcauugcuucacguuucuuauuuuggaacccuggcucaaggagcauccccugucugggcugugccauuauuguggaugagggagagagcaagaaaacagaugcagacauacaauggcucuuaaagcuuucacucagucauguuguaugucacaucagcucacaugucaguggccaaagcaagucauauggucagagcucacugucagugggguaaggauguauaguccuuccacagguggcauugcaaguugcaugauaacagauaaggcuguauaauccucuuaaggaaaguggagguuaaauaauuuggaacaauaaauaauauagucuacaucaacaaguucaguaaaugcuuguuaaauggguuauuuggagucuaugaaaguuucuuuuuuuuuagugggaaauucaaacauaaacagaaguacagagaaugguaugaugaaccucccuuguucccuuuauuacuccagcaguuaauguacggacaaucuugguuuaucuguuuucuuuccccccuucucacuagauuauuuugaagcaguuuuuggauaucauaauuucacuuacaaguauuucacuaaguauuuuuaagagauaaagucugaacgugugacuucucauaguaaauuauuacugucugauagggugagguaauaguacuauauagacugacaggugucaagcagcagagcacguucauagagcguaucuagaauuugacagccugaacuuguuuugauuucauuuugaguauuucuggaggaggcuuacaacagaaugccaucuacuuuuccagccucucccuuucuuucuuucuuuccuuccuuccuuccuuccuuccuuccuuccuuccuuccuuccuuccuuccuuucuuucuuucuuucuuucucuuucuuuuucuuucuuucuuucucucugucucucucuguuucucucucucucucucucucugucuguguguguguguguguguguguguguguguguguguagcagaagcagguaauuaaccucuggaaaaaauaacauugcaacagauuugauuugcagagguuucauuucucacugagccucuguuggaaugaugccaguugaaaggaaucccagcucuuaauggcuccaagucuucugggagcucucagugauguuauuuucuuuggagaagaacaucagaaucauuuauaaaaauccuguguucacccaugccauuugcucuguggagaaaggaucuaucauaucuuuaagaugaucucuaagaugauauaaaaguaaagaaauucaucuaucuaauuuuaguuuagaaaucauuaaugccaauuucagcugcucagguuaguuugucuugaaggccugaaagccuccauuuugauucaagaugucguagauuuuaugagcauucaguauaaccaguaaguuugucauuuccaugguuguagggaauaugagacauucuguuauggaucuaggauuaccguuucacaggacauucuuuuuuuggggggauuguuagguaauaaacagugggacacaaaauaaacagauauaaucucuucaguuuguagauuuucaggugacaaugagguggcagaagaggauuugugcagauuaggaaauaaauaauuauuguauauaacaugauggaaauauuuuaguauaguaccacuaucaaauuaauuuuguuuccuuaacuagcuucuuucauuguguacagagacacuuauauuaaaguagucuuuauagauauccaguuagcuuuaguuuuuucuaauuacauuauauugcuagucucauuucagaguccauguaggaacuacaguagaaaaguagcuaucauuggcuuguaaauaaaauuacuuaauuuugaguuuuucuugggaaggaaaaaccaguuuuacagaauuaguggaguugauucugguuuugguuacuugugacaauauagucuauuuaaaauauaaauaaauaaaaauuugcccaagaagaauaaguuugacuugccaugauucauacuguuuuucuguuguuguaucacaauugagaacauuaguuucagagguaauaguuugucaguaugggucgaguagcucuaauccaaaaauccaaaaucagaaaugcuucaaaaucugaaacuuuuugggugccaugugccacagguggaaaauucuacacguaaguacauaauacaaacuuuguuucaugcacaaaauuauuuacaguaguguauaaaauuaccguuaggcgggggccaggcaugguggcucaagccuguaaucccagcacuuugggaagucgaggcaggcggaucaccugagguugggaguuugagaccagccugaacaacauggagaaaccccaucucuacuaaaaauacaaaauuagcugggcaugguggcacaugccuguaauuccagcuacucgggaggcugaggcaggagaaucgcuugaaccagggagguggagguucaagcgagccaagaucaugccacugcacuccagccuggaaaacaagagcaaaacaccgucucaaaaaaaauaauaauaaaaaauuaccuucaggcugugcauauagaguguacgugaaacauuaaugaauucuguguuuagacuugggucccauucccaagauaucuuacuauguauauguaaauguuccaaaacacaaaaaaauucaaaaugaaacacuucuggccccaagcauuuuggguaagggauacccaauguguaccuuuguuaggauaauauacuuguaccuugguuguauuuuaguugcaauuguuaguugcacaauuugggggaauguuugaggucucuauaguaguuacuguauuuaccaggaagcccugcaugauuagaauucuugagacaguguauaaaguuaaauuggguguguugccuggaugugaacaguaaaaaaggagaagcuucucaccauacaauuauagcuuaaaaggaaccagguacaauucuguuuccaaaaauagaaaguaagucaaauauuauauggauauguaauaguaauuauauuaauuuugacucccuggccgacuuuuuuuuugaagcuaucauuuuuugucagagauaaaaaguagcuuuuaaaggaaaagauaucucagcccuuaauuauguguguguguauguguguguauguauuuauuuauauauuuuagcccuuguaagagaggagcaguggaagggaacugaaggagcaugauauagagaaaagagccuggguuuugguguguugcauuuguucuguuacuagcugggagaccuugggcaaauuuaccucucugaucagcaguuuaauuuuuucaucuguaaaaaugggaagaauaccuacuuugcagaauugucgugacgauuaaaugagagugugugugaguaccuagcacaucguaagagagagcucaguaaguuauaguagcuguuauuguuuaaacuucaggaauuagcuagguuuugcuagaacuuucaucugugcuuguaagaucuuuuugaauccauauguauuuuuagcagcuguggcuaagauaguuuuuuucccuugcugugauaauauuccuuaucuuuuauauuucaggcuauuguuagaauuaaaugcguuugcgagugaggaauagauuuaagaguuauuucaauucagaccguggaacaucucuucacaaaauggguuaguuuggauuggcaguauacuuuuaaaucugccuucgaucacucagaauuuguccaguucuguauuuauuaacaucaguuuguuuauuuauucaguaaauauugaaugccuguucuguguaggucauugucuuggcaguuauuuugagcucuugcuaccugcugaauuauaucuuaaaaugaagaaauuuacaugauagagugauauuuauucaucugugcugaagauuaaagugagaaguauguggcaggcgcgguggcucacgcuuguaaucccagcacuuugggaggccgaggugggcggaucaugaggucaggagaucgagaccauccuggcuaacacggugaaaccccauuucuacuaaaaauacgaaaaauuagccgaguaugguggugggcaccuguagucccagcugcuggggaggcugaggcaggagaauggcuugaaccugggaggcagugcuugcagugagcugagaucacgccacugcacuccagccugggugacagagcaagacuccgucucaaaaaaaaaaaaaaagugagaaguauguguauuugggggaaguuguagaaugaaauaauaaugauuaaauugaucuuauuuccaaauuuuaaaaaugugguuacuuucuaucacauacugucuuuuuauguuuuccuuuuuauuuuauuuuucaguuuaguuauauuucagugaacuauuuagaccaaaauggaaaagacauugguguaaguuggaaucuaagaaguuuuagauguucauugcuuuugaacagaggaaguaacauuuuauggauugggcauuguuuuagucacuacuugaaggagaaccucuuacucauuaucagucucuuggaaauagcaacugauuaagccuauauauacuuugugcauccagugaaaaugugauaaauaugaugaucuuuuggucagagaaggauucuggaaacugcaguaguuugauuaguaagacaguguuuaaaucaugauuacuuguugcucuaauauuuuagacuuugaaagaugacaagaugugauguaggugacaaagagcauuuuuaaaaaugggugaaauuggccgggugcggugacucacgccuauaaucccagcacuuugggaggcugaggcgggcggaucacaaggucaggaaaucgagaccauucuggcuaacacggugaaaccccgucucuacuaaaaauacaaaaaaaauuaccugggugugguagcaggcgccuguagucccagcuacucgggagacugaggagaauggcaugaacccgggaggcggagcuugcagugagccgagaucacccuacugcagccugggcaacagagcaagacuccgucucaaaaaaaaaaaaaaaaaaaaaaaggugaaauuuaggccuaucaagauacuugggauguaggaaaggaauauauauauauauauauauauauauauauauauauauauauauauauuuuuuuuuuuuuuuuuuuuuuuuuugagacaaagucucgcucuguugcccaggcuggaggcuggagugcaguggcauggucuuggcucacuugaaccuccaccucccugguucaagaaauucuccugccucagccuccugauuagcugggauuauaggcacccgccaccacgcccgucuaauuuuuguauuuuuaguagagacgggguuucaccauguuggccaggcuggucucgaacuccugaccucagaugaucugcccgccucggccucccaaaauacugggauuccaggcaugagccacugcgcccggccggauguuacauuuauugaguacauauuaaguacugcucacuguuuuagguacuuccugugcauugucuuuuuuaaccuuucaacuaagcuaaauacuguugucccuguuuuaaaacugggaaaaaugagccucugagagguucacuaauacccaagcugacauaguuucuaaacagaagacuugggauuauuacuccgaugcucgcuuuuuugaaacuacuggucacagucguuugugguuauuggcucaucuagaucaaucaauuggaugaaacccagaaaauagauuuugucuucaacaauaccauuaaagaguugccuucacauuaaaauuuaauaacuacaucuuauccuuuguacucuuaaucaccuguuuucccuauuuucuuuuccagauuucugacaugagggauuuugucucauuugcucuaaagagugaaccuaaacauuguguuuagguuuguuauuaguugcuuuaaauauauacacaucuguaaacauugaacuuuuuugaugccucaucuguguugcuuauagaucauuuuccaucauaauuauuuuaaaguccuuuuaagaaguuuaaggccuaucucauauauguaauauauuaauaguagauaaucaggccuuuggaagcauaaaugauguaaguaaguuggguugcaguuuuuucuuaucaagaaucugcguguguuuaaguggcaguggagauaauauuuuuauuugcguuguuauaguguuaucuuuaucauuuaguuuauauuuucugccauuuaaagauaaaaagguuuuaucuuuuauagcuauagagucaucuucugagccuuaaaacacuuguguuuuuuuucuuuucgccguguggguggggaaagggguguguggcaauggcccugugcuuugccucugccugaguuacaggcgugcuuuguuugccuggcugggguuugugucucccaugcucaggaggguggaaccaguuucccagggccugggcccuaccuauugucauucuccccauaaggggaucuguuacguguacuugugggaccacacagugcucugggcagauaagccucuuccugccuauaucagaaccaacauagcccacacacaucugggaaagcaugccagggucagcaccccaggcgcccuguacucccagcccauuccccuucuucuucccacucaccuggaaucccugacccaaggcucuaccuauugguucuaauauucugguggacagaaucuaagaguccagcaagcucagaaucucaggaccuccucaucccuuuaggaaccaucaauuaaucucaugauuucagguugaaccacuggagucaauuucagaaguuuuggucuaucucagaaccuucagaucacacucaaaagcuuggggacagccucagaaccuugggacacaucucagcauacagggucaucaaucuuagaacuugaggucugucucagaaccuucaugcgaaacucagaaucuugggaagucccaggaccuugugcccgguauuauaccauuggaucaauuaucacagucgcagaaucuugagguccaucuuggaauggugcagucagccugaaccgugggaucaaguucagggacaugagaacaaucucagaaacuucuggccaguccuaggucugaaaaccuucaaaacagcaacagacucuugcgguccaucucaaaacuugagauuguggucuaaaagggacccucaagacuauccauccagucccuuccuggaauacaagucaccuccacagccucccugaucucgcugucuagucuuugcuaugagcccuccucgauagggauaccuggccccuacccacugccugccuugcuucuggauggcuccagcuacuaaaugaugucuccaaaaugugagaaucugaaaucugucuccuuuuucccacaucagcccucugagaccucugcagagauuucaaggcaagacccauaugcucaggguaagcuuugucccagacugcccacacuggguuccuccccugacuuccagaucuccacccgcccuucugaacacuguuaucugcaacacaguuaccuguuuaugcauuucaauuuugagccuauaggauaucucauacugcaaaggaaaagcccauugggaaugucugggguggagguggaugcccaacccugugcugggugaugcugggggaaucacagcaggauacagagccccagaaccccauggggucccagaggaggagcccagaggaggaagcgggaccauaccuggaggggcugccucugaucuccucagagacuaggggugcagugggaggagaagauaggagaugccuagagacccuggccccacagagaugccugugagaagagggaagauuccuguuucacuauucucaagagcugggagaggcuucugagagagaaccuguaaucccagucggcccaauuacagauaggaaagauaaggcucaaagagggcucaguccuaccccagagugguugggugagucaggacuaacaaguccucuuucccauuccccugacaucauaacucuccccaccaugauguuauguugcugcauuucagucuucucacuggccaucuucucacauuccagcuugacacuaacuaggaaggagagagaccaugggggucccacacaccccauaugagccaaagugaaaaacauuguuacuuuuaaucucauuucuucuuuguaaaugauuuuuugucucugaaauucugugacaugaaucaguuuagucacuuuuuaucuuauuaaauggagagaaaaauugcuuaagagauauuuagguguguuguuuuuuaacccuuuuugguuguaaauuguuuucuuucuuuguuuuaguaaccccagaaaaucuagaagaaaaucuagaagagagguaggcagaucauugguuuaaaaaaagaagcccaccaacuaaaucuuuuauugaguaaaguauuguuucuagguagagaaagauuagagaauuguauugagaauuuuacuagguuugggauuuacaaagaggcuaacaugcaaaaggcagugcucuucgaaggagucguauagauguggagacuuuauagcccuuagggagaucuacagacauccgcuaugcugaguucugggaagcugcuuuuucccaugcuugcagccuccccgugggguaaaggucuguuaguuuugcauaaauauuuaccauaucucauuuuagcuagcauugcuuccucacacuguuagcacuaaggagaacuuugcuuauccagcuugaaaaauuuacugugaucgauaugacuaaucuggaggauguucugucaucuuugagcauugaugaaguuaaaaagucagauuggcaaaaauaaugagggggaaagcaaccgguucacaguugacaaacauuugcccaugcuuguuuucccauauuuauuuuuuuaaacgagaagguuauuacacaagcagcauuucagucuugucacacccaauaaauuauuguugcuuuuauauguuuauuuguauacuagucguuuacauuugcauuuacuauacuuuuacaacuguuuccuuauuuuguaaccaugaacaccagcuucuacauguaaagccucauucuagguacuuuauauacaucauauuuaauagauauaauaauuguacaaggcaaauguuauucccauuuuacagaugagaaaaaaacuuagauucaaagacauugauugacuagaucaguauuucccagcuauaaauuuuuuuggaaccagguuuuaaauucaagucuuuuagcggggcacaguaccuguaguccuaguuacuuaggaggcugaggugggaggauugcuugagcccaggagcuccaggcugcagugagcuaugauugugucagucuacuucagcaugggcuacagagugagacucugucucuuuaaaaauaaaaaauaaaaaaacccagaucuuuuugacucuugauucauuacauuugcuacuguacccaauuuuauguuacuccaaaugaaaauauucagccaaagaagguuauuuaaucuauuuuaagauaaauuacaggaguaauuucuaaguuguguuacagggaauauccaggacacuuuaauaggaguguauuuuuuugacucaugagcccuacaacauucaggcauucaaggccaaagguagaauguaaaaugauauuaaaaggcaaccuucagacuuugaguuuauuauuuuaaaaaagauccagcuuauuauggaaaaauggccuaauccauuuuauuagucaaaaacaauccaacauuugcaauuucaugugauucaggcuaggagcaaucuaucaguaugacugcgucuuaaaucuugucaauauuugauaggauucuacuuuaaaauuuuuguguuuuugugucucuuaccuucuacuucuccuucacuccaugucuuuuuuaaaauuuuuuauguuuuugagaccgagucuugcucugucucccaggcuggagugccguggcaugaucuuggcucacugcaaucucugccuccuggguucaagcgauucuuguggcugagccacccagguggcuaggauuacaggugugcgccaccacaccuggcuaauuuuuuuuuaaguagagaugggguuucaccauguuugcccagcuagucuugaacucuuggccucaagugaucugccugccucagccucccaaaagagcuaggauuacaggccugagccacugcgcccagccuccccuuaucuuuuugcauguacacuuugucuuuauugucaucacuaagcuuuuaaucuuuccuuuguuaccccaucuagguccucugcucucccucaaccuuuuacuuauuucugguugagcccuuuugucauucccugcaauuuucugaccauguaguagauacccaguaggcuuccuggauuacuugguuuuucuguauuuugcuaaaaaguuacuccaaagaugauaccuucuauuuggaccuuucccacccuuuauauaccuaucuaggagguaguaacccaaccauuaaucucuccaugcaaaauacauguauugacuaaaaauuaugugcuagguacuguaauguuuccuacccauuauuuuacuuaauucucacaauuacucugugagguauucacaggugaagaaagagaaaguuuaaguagcaugccuagugagugguaaaacuuggauuuuaguaugaaucugucugacuucccaaccugcacuguuuuuuuuuuuguuuuguuuuguuuuuuuugagacagucacccucuguugcccaggcuggagugcaguggcgugaucucagcucacugcaaccucagccuccugaguagcugggacugcaggcaugugccaccgugcccuucuaauuuuuguauuuuuaguagagacgggguuucaccauguuggccguggcugguuuugaauuccugaccucaagugauccgccugccucaaccucccaaaguacugggauuacaggugugagccaccaugccuggccccagccugcaugcacucuuaaacacuauccuauacugccagauauggucagaguugaaucagauacuguuucugccuuuuaggaacuucgagucuaauagaggaagauagagaacuaagugcacagggcacaguggagacugaaaggagaaaaaucauuacuuuuuggacagaucacagacagcuucauagaggagaugaauauauuugcugaauccuggaaugugggauguaguuacuggacagguaagggauagaggaacaauucagguaaaagaaacaaucagguuuuuuugagacagagucucacuccaucacccaggcuggauugcaguggcaugaucuugccucauugcaaccuccaccuccuggguucaagggauucuugugccucggccucccaaaauacuggaauuacaagcacgugccaccgcagcuggcuaauuucuguauuuuuaguagagacaagguuuugcuguguuggccaggcuguccuugaacuccugaccucaagugauccgcccaccucagccucccaaagugcugggauuacaggcguaagccaccgugccaccaaaauaaggaauauuaauaaggacauagaggugaaauagcucacauuuucaggaacugcauauaguucagcauggcuagagcauggagguugaugauggaugggcacagcaguugguaaaguuggagugauaggugguaccagauuauggaaggccuuuuaagucauucuaaggaguuuggauuuuaaccucuggauuguagggagccacugaaggccuucagucagagaggcaguaagcguuauguuauaaaagauucuuucggugguagcgugaagaaaggauuagucuugagcaacaguuucaggggcagagaaaccaauagugagacauuuuucaguaauccauaugaaaaaugauacuaauaaauuccuaaacugaaguuguaacauauacuuaaaagcgaagagacaaaguuauuaagaagauacuaagaauaccagcagggugaaagguguguggucaaaguguggggcuuucuggguuguguccuuggguagggguugguaauacuuagcaagauagggaauguaaaagggagaaggcaggguuuuguuuuguuauuuuuguuuggcugacugauaagauggaagauggagaagagaacagacauaguaagggauagauuuaguuuaaguuacuaaaucuuuaguuuaaguauucacuaucuguuguaugauagauuaucccaaaacaauaaacuugcacuauccacuaugguaaccacaagacaaauguggcuauuuacauuuaaauuaauugaaauuaaauaaaauugaaaauucaguuccucagugacacuagccacauuucaaauauucacuagccacaugaagccaguggcuacaguacuguugguugaucauagaacguuuuaaauuauugcaaaaagcucuuuuggacagugcugccaaacauuuaucaacgcauaguuuacuaagaucagaaaucggugagcaacuuugcugggugguucugcuucaagguuucucaugagguugcaguccaggugucugcaacuagaagcaagggcuucaggaaucugaaggcucaacugcaccugguggguccauuuccaaggugacuuacucaugcuggucaagugagugcugauuguugguaggaagcccuagcuccucuguugguagguggacuucucuguggggaugugugaggcagcuggcuuugcccugagugagugauuuuagccagagagggagguagaagccauuauaacuuuugugagcugaccucaaaagucacacuacaucauuucuauaaucuguugguuacacaggucagcacuauucacugugggaagaaacuauacaagggcaugaauaccaagagucaauggggcccauuuuguuuuuuugagauaggaucucacuguguugcucaggcuggggugcaguggugugaucauggcucacugcagccugaaucucccagccuaaagcagucucucaucucagccucccaaguagcugggacuacaggcaugccaccaugcucagcuaauuguauuuuauuuuuauuuauuuauuuauuuuugguagagauaggguuuugccauguugccuaggcuggccucaaauuccucggcacaagugaucugcccaccuuggccucccaaagugcugggauuacaggcauaagccaaagugcccagccuauugguggucauuuuggaggcuucccaccacaaauacuuacggaauaucuggguacaaauaucuaguggacaacuaaauguauaggaaugaguucuuagcuagugcuauuauauuugugaugguaguugaagaaacuugaauagguguagaucaacaaggaugagauugaaccagaaagacaguuaauauaguaucuugggucacauguuuggggaggacagaaguacuuucaaaggcuggaggaacagcuacaggggaguaguaguagaacaggcaggggaguacauuauaaaggaaacuugaagggaugaaaguugaaaguagaauguaauuaacauuguucaguaguuaaauaagaguaaaacuuaacagagucauucuuucaaaaaauauuucuugaauaccuguguggggaaccagagaaagauugguagauaaauaagaccaagucucuaauaacacguaauacuaucugaggagacaaguuugggaagguuucuuggaggaagguaauauuuuaagguagagacucuuuaaaggguaaggaggugaguuggguauuuuagggguguggugguagagauauggauacuaaaguggacauuucaggcuauguuagauguggaacacugcuaggauaugaaguuuugugaugagggaaaguggugagaaaagaggcuggaaggccaauuagaguagucuugaauacaugcauguuaaggaacuugccuuuauccugcugacuguuucccauacuuaaauuuggauacuacuuuagugauuugccauaggcuuauaaccccuaaacuguaaguuacuaaacauuuuucuuuaauauuacucuuuauuauuuuauuuauuuauuuugagacaaggucucacucugucacucaggcuggagugcagugaugcggucauggcucgcugcagccuugaccucccaggcucuagugauccucccaccucagccucccaaguagcugggaccauaagugcauaccaccacauuggauaauuuuuguauuuuuuguagagaugagguuucaccauguugccccaggcuggucuugaacuccuaggcucaagcgauccgccuaccucggcuucccaaagugcugggaauucaggcgugagccaccaugccuggccaguaauauuacuuuuuaaacuuagaaaccauuuccagagggaacuucauuguauuguuauaaauagaaaaccaguauuguuugcuacauauaaaagagaauagaaaaaauaugaaugauuauuacguuaaaaaaauuaaaaguggaauguagcaaugcauccuuugauauagaaaaaugcccacuuggaaauaaguuccucagugagaauacuauuuuuggucaguuagcaauaaaagggccuuugcuugaauaguguuugguuucuaccuaagaugagauuuuaaggucauuaagacaauuccauuuuuaaauuuugauguuaauaagcaccaagaaucacaacucucaagucugcguacuuggaaagaucauaauacaguuaauggucaacuuuguccaacuuuauuguuaauucaagcacuaauaaaaauuaagcccuuuuguuccaagaagccaucuaaaguaguuuauagcagggguccccaaccccugggccagggcugcacagcaggaggugagcugccagggcgaaagagcauuacugccugagcuccaccuccugucagauugcuggggacgcauuagauucucauaggagugcgaacccuguugugaacugcacaugugagggaucuaggcugcacacuccuuaagagaaucuaaugcccgaugaucugagguggaacaguuucauacugaaaccguacguacacucaaauccccaucuguggaaaaauugucuuccacuaaauccgucccuggugccaaaaagguuggggucugcucaucuauagaaucuauucuucugagugugucaaguuauuuauuggacaucuggaaauggagaagggauuuuuuuugucuacucuuugcugccauccaguuugggaaaauucucgcaaaaauuuucaaaaauuucaagcaucuuuuacaauuuucgaaauauuuccagugaguuuuucagaggaauccuuaacugguccuuucagagaggaaaaaaguauccagcucaccuacauaucucauaguucuaguuucacauuuaucuuguucacuuuguuuuguacguggaauacguaaacuugucaggauaaauuuagguuguucacauaaguagauauauuugucaagauaugcuuauuugcagagccugucucaggcaugcacaugaucucacaaacugaagauuucuuccagaaauauuugaaauuuuuccugcagcucaaaaggaugcaugaagaguuuuccacucuuuuugccaaacucuauauguagccccaauuuugaaguuacuuuuauaagguuuuaaauaaaugguuuugaacuguaaugacuaacaaaaggcaugugaaugauagugcuagagaugcugccaccaaaguaccaagaaagaauaucaugcuugaugauaaaauaaaagcuuuggagugucucaaauuggcugaauacauuuaaugagcuauuagaggaaacaugguaaagauggauggucauuuagaaauucuaaaguccuguaauguugaggaagcuaaacauuaucaaaucuuggaagaaguaaucaauauaggaagaagaaggaggagaagcaauacuuuggauacuaagcaauaguuucaauacuaaguugaaauuacuuagcuaaccucaauuuaauggacucacuacauuuccucugcagaacaugacuuuuacccagugaguuaaaugcuugugucucauggcuauuuuguagugugucugaaugcuucuacuucguccaguugaauuguauaaucucaacccguuguacuugaauuggaauuagaugauuuaguuaaauauuaugaaaacugaaaacugaugaaaucugagcaccaaaaagaaaguuauuucuauaaacagugaguugugugugcuuuggaaauaagaguagagacuugucacugaaaaaaaauucugucaaauuagacguguauacaaaacaauuauuauuuggaaaguaucuucuagauuauuaugaaugucuuucguuucuugcuccacucuaaggaaacaggaaauaaaucauagcugauauauuuuaggacaguuuauaccagaaagcugaugggacacuccaaucaacagaccccuacuuaaagaaacagccaggcgcaguggcucaugccuguaaucccagcaguuugggaggccgaggcgggcggaucaugaggucaggagaucgagaccauccugacuaacacagugaaaccccaucucuacuaaaaauaaaaaaaauuagccgggcgugguggcaggcgccuguagucccagcuacuugggaggcugaggcaggagaauggcgugaacucgggaggcagagcuugcagugagcugagaucgcaccacugcacuccagccuuggcaacagagcgagacuccgucucaaaaaauaaaaaaagaaaaaaggaaaaggcuuugauccuacauuuuaaaauuggcaaaugaauguacauuuacauaaguugaaauaaaguuuaagguuuguaugaaugguuuuuaauuauuuccugcuuuaacuauucuuuuccauuaaaugaccaaccacugguaccaguggauuggauaagacaguuggcacugcguggauaaaggagguuuaaagaaaaggaaacaugaaaugccuucuuuuugaggcugcuacaauaaccaaguuacaagugugcugauuaauuuauuauuccuguuuccagaaaugucuuauuuguauuucauuuuuaauauuuuuaaauuuaauaguuuacauuucccccacuaguguugccuucuauuuguagcaaguuaauacugguuuucuauuuauaauagugagauaaaguuuccuuuggaaaggaauguuaccuuuaaagaaaaacauuaggugacuaauaauuuggugcuuaugugacuguggcaaaucaugaagauaguauuuuaaguauggaaaacaauugcuaaccagcaagauaaugucaaguuccuuaauaugaacucacuucuuggccuuugucuaccuucuccagcuucaugucuuaccacuuucccuuauuauggacuucauguugaucaaguggaggcucccucuccucaaggagagucccuaggccagauucagaagaugguugguagagaggggauuugauagcuucugaggacagugcuuuggauggagaaauaucaugcaacuuaggacagugcuuuggauggaggaauaucauggaacuuuaguuuuccagcuuuauugagcuuugccugugauauucacuuguuuggggggcuguuuggagacagggucucacuacauuguccagacacaaucaccauguacugcagccuugaaguccugggcuuaagugauccucccauuucagccucccaacuagcuggaacuacaggcucgagccacugugccugacucuuacucacuuuuuuguucccaauaccuggaagaagaucgucagucuguaaauauuugaaaucuaaauaaggguuauggugcuguaguauaaggccaaaucuugggcaccaaacaaaaaaaaauuuagaaaaaucccuuagcccaucccaugcugugcugggagcuucaucuuucuuuuuaauugcaauuuaaacgaucuacugcuacaagaggguugugguaaagcagaauuucuuauacugugcaggugggcauguaaauugguuuaaacuuacagaaaauaauuugacaauauaguucaaaagccuaagaaauguuuaaacuuuuugaauuaguaaugccaauuuugguauauaucucaagacauuaaggauauacaguuuuagcugucauuuuauacaaagagaucacccacaccauuauuuuaguaggggcaaagaggaaccaauguaagucuggugccucugaagagguagaccuagaaacugggaugacaaggaacucccaggggacugcuguuaauaaauuacuuuaugucauuugauaaaauauauguaagcauuaaagacauuuucaaguaaaccuuagugaggaaauuguucaugaucugugaaaaguaugggauaaaacuucaaauauaaugccaguuacauuuuuaaaaaacauucaugugaugcuuuuaaaaagacuucuaggacauguaccaauuuuuuuuuuuuuuuuuuuugagccaagucccacuuugucgccuaggcuugagugcagugggcacaaucacagcucacuguagccucagccucucaaguagcugauacuacaggcacacaccaccaugcucagcuaauuuuuuaauuuuguguagagacaagcucucacuauguugcccaggcuggucucgaacuucuggacucaagugauucucccacauuggccucccgaaauggugggauuauaggcacgagccacugaaccuggcauguacuacuuuuuaaguguuucuggguugugagauuauagaugaauuuuguuuuauucuucacacucauauguuguuuucuaggcuuuuaacuauguguauauauauauauugccuuugucaugagagacacuuuuguuuuuaagugaaaccucuguuuaguuuuuauuuauuuauuugaucuuuauuuuaauggaaagguaacugugcugguaagcugauagaugauuggaaggaauaauucuugagacuaggaaugcaaaugaaagacugcugggagauaugagaagcuccugaacuagggcaguggugauaggauuggagaggaauaucgugaucaguaagacauaggaauaaaggaaaaagagggauccaggaugacucccaaguuucuggguguuuaaauguaauacauuugagaugaaaguuuggcucuuaaaaaauauucuuauuuggggaauguuuaaauuuagugaggucauuaacaacuucagauuccuuuuauacuucaauucuuuaaauucuauauguugccaaagauccuacuucuaauuuguuaggguuaacaagaagaaagaugauaugucugugaagacauguuucugacaucugucacccuauggauugccaguugauagaccugguugucuugauaaguauuagcugacuccccaaccaguuuauuugcaccacuucugaagcaauaagcuugguugaaaaagggcaccucccaaguagggaaggauaauuuuuaggucaaauuauagaaauugcauguaucccuguuaacacuuccaacaccaacaaaaaaauagacaggaaaaugacccuaccagcuaauucuccauuauaagacuuugaagaaaagguuccauuaaaaacagaaaagaggcugggcaugguggcucauaccuguaaucuuaacacuuuggaaggccaaggugggagaauugccugaguucaggaguuugacaccagccugggcaacauaacaagacccugucucuacaguaaguaaaaaauuacuggaugugguggcauaugccuguggggccagcuguuugggaggcugagguggaaggauugcuugagcccaggaguaucaggcugcaguaagccaugauugugcuauugcacuccagcuuggugacagagugagacccugucucaaaaaaauaaaaccuugaggacccaaauuugauuuaaauuuagauguacuaucugcuuugggagaguuacuuuauuauuauuuaguagagacagggucucacuauguugcccaggcuggucuccaacuucuggccccaagcaguccucccaccuugggcucccaaagugcugggguuacaggcgugagccaccaacccugcccuuaaguuauuuuuuugaucuuuucaugacaugcugugggcaauaaaauaauacagugggugaucuguuguugcaauucaaauauggaguuccuuuuucuuccacaaaaguauuggcugauuucuuucuuuuucuggcugugagcaacagguaaauuaacaugaccauggucuguccccagcgucuugacucagauuucuuaauuugaacuuuuccaucuucuccacuccaagaucacaugacaacauccaacaucaguggauagaaauaauuagaggcuggaugagguggcucacgccuguaaucucagcacuuugagaggccgaggugggcggaucauuugaggucuggaguucaagaccagccuggcuaacauggcgaaaccccaucucuaccaaaaauauaaaaaauuagcugggcgugguggcacacgccugcaaucccagcuacuugggaggcugaggcaggagaauugcuugaaccugagaggcggagguugcagugagccgagauugugucacugcacuccagccugggugacagagugagacuccaucuaaaaaaaaaaaagaaauuuaauaagucacugcuacacuggcaaagaaggguugaguaguuuuaagaagcuuaguugcuguccaacagucuuauugcaucugauucuuuuggugcuugcuuacucaaguagggaucacauagcaugggaaggaaagagcagaucugugauucuguuguuuacaucucagaauugugguuugugaauaguuuugaaauuuuucuuauaguuuugggagaaauuuguuaacggaauuuuuaaggauuauaggacagcacaaaauaauuucucuuguuuagaugcuuuuaauaauaaaaaaaaucuguuaggauacuuuuuccuuuuuuuuuuuuuuuuuuuuuuuuuuuuuugagguggagucucgcucugucgcccaggcuggaguacaguggugugaucuuggcucacugcaaccuccgccuccuggguucaagcgauucuccugccuuagccuucugaguagcugggauuacaggcgcaugccaccauguccggcuaauuuuuguauuuuuaguagagaugggguuucaccauguuggucaggcuggucucaaacuccugaccucaugaucugcccaccuuggccucccaaagugcugggauuacaggcgugagccaccacgcccagccuagaauacuguuuaaaugauaaaauagcugagugcagugguucaugccuguaaucccaacacuuugggaggcugaggcaggaggauugcuuaaggucagguguuugagacuagcccuggcaacguagugagacccugucucuacaaaguaauuucaaaauuggcugagagugguggcacacaccuguaguuccagcuguuugagaggcugaguugggaggauugcuugagccugggagguugaggagguugaagcugcagugagcugugaucgugccacugcaccccagccugggugacagagcaagaccucgucucaaaaauaaauaaauaaaagauaaaauaagaccgaaagauuucauuaugggauagagaagaaaacuaauauggaauuuaagauaauauucuuauauuugaguggccucuuuuuuugagacagggucucacucuuauugcuuuggcugggccacagcggcaugaucuuggcucacugcagccuggaccuccugggcucaagcaauccucccgccucauuguccauacugucuagcuaucuccaugauaacaacaucaucuuauaucaugacuacugacuaaaauccuuaguagcugggacuacaggcacaugcuacaaugucuggcuaauuuuuuaauucguuuauagagaugggggucucccuauguugccgaggcuggucucaaacuccaggccucaagagauccucccaccuuggccucccaaagugcugggauuacagacgugagccaccaugccugaccugaguagccuuuuuauuuaaagggaaucggcauuuguuuauuaccugguauguucugaguaucaggcuguguacuuaaccucacuuaauccugacagcauuccuauaaagcagauaccuaacaauuauuugugaggaaauuaagguucagugacuuuccauaaauuugcuuauggucacacaauccauugagugcuugugccagguuuuaaucucagucugaccaauaccaaaacucauuuuuucuauguauguuucccuuuuagaaagauuuuauuuuuuuaauuuuaauuuuaauuuuuuaacuuuuagguucgggguacaugugcagguuuguuauaucaguaaacucuugucauggggguuuguuguacagauuauuuugucacccaguuacuaagccuaguacccaaaaguuauuuuuucugcccccucccuccuuucacccuccacccucaaauaggccccagugucuauuguucccuagaaagauuucauaaguaaaugucaucuagccuguaaauuauuuuuguuugccagcauuuauaauauagguggucauucuuuaggugcugaaacagaauugguuuuguccuuagugucuggcugucuccaaugauaacaacaucgucuuuuaucaugacugcugacuaaaguacuauauucucaaaucuucuuuucuucuuuuuuuuuuuuuuuuuuucugugacagggucuuacucugucccccagucuggagugcaguggcaugaucucagcucacuguagccucugccuccaggguucaaguaauucucccaccucagccucccgaguagcugggacuacaggcgcacacccgcacaacuggcuaauuuuuauauguuuaguagagacgggguuucaccauguuggccaggcuggucuugaacuccugaccucaaguaaucugccugccuuggccucccaaagugcugggauuacaggcaugagccaucccacucggccagaucuuuuguuuuuaauugaaaacuuauaauacauuucagagauaaaggagagcuauuucagaacuggugcuuauugguaaguuuuaaagaguuaaagucagugaacuggugguauaagccauuuaaucauuauguuuaucauuuuauagauacuaaucggaguaaugcaguuucaacaaaaguaguuuauuuugggguauacaagaauuuuuauucuuuaagcuaauuaauucuaaauuuaaaagaaggaaaacaccugagaagcuugcgcucuuaguguuacuacacagaagucucaauguagcugcaacaucugauuuuaaaauuuucuuuuuucgucuuauacuuggaauauuucacaauaaaguaaaaagaaaaugauauacauccauguaccugcuacuuaguguuaucuuuuugggggacgaggcaagcaaauaaaaauuagagaugaagucgaggcuccccuggguauuuucccccgauccuguucucuucugccccuuuccagaaguaaacaucauaguaaacuugguguuuguugcuccuaugcauguuuuuauacuuuggcuauauguuauguaucuucaaacauuauggaaauuuuugcagauuuuuaaacuuccuaacauuugaauucauguucuauauucagcaauguguuuauuaacaaaauaucaauaaaaauuacuaauuauaacuguuacuauuaauaaugaauauuaauaaaauauuaugaauaugauaugagguagggauugaguuuuauucuuucauguggagaaucagucgucuagccccauucacugugcagucugucuuuucccuacugauggguagcacuauccuugucauacauaauguuuccauuauuuguagguuuguuucugagcuuucuaaucuuuucccuugguuugacuauuucuguaccgacaccaaacuguucagauuacuuuagcuucauaagcaaaguaaaucuccuuaccuuguuuuucuucuucaaaauuuucaucgcuauucuuagcuuuuucuuuuuccauaugaauuuugggaucagcuugucagguucccuuaaaaguuuuauuuuuuuuuaacauuguaauugcauugaauauuuaguuuaguuuggagaaaauaggcauauuuaugauauugucuuccuauacaugaacgugguuuuuccuuagaaauuccagauauucccuuauggucuucaauaguaauuuauaauuguauccaaaagucuuaaaacuuuuuuggcuaagcuuauuucuagguacuuuaugauuuucucugcuuuuagaaugguuggucagucucuuucuuucccucuccuccucccucacuuauucuuuuccuuccuguuucuuccuucccaucccccauuccaaccuccuuucauuuuuuuuuucucucuccuucccucccuuaucaccuuuuaauuuuauauuguuuuggcugacaguucuauuuaagguaguguguuauagagaaaaguauauggaacuuagagucaaaauugcuggaaaugaguccccgcuucguccuucaagaauuauaugauaauuaagucaacuuuucugagccuaauucucuuaaucuguaaaaggagaauauuuacuuuuauacugucuaccucacagaaucaagugagauaugugcaugagguuuuuuccuaauuaaaaauucagugcuaaaaagaguucuuucuaggggaaaaaaaugccaauuucccccaacuaaaaguauagacauuuauuaaaacuguaucuuuagggcugggugcgguggcucaugccuguaaucccagcaauaugggaggccgaggcgggcggaucaccugagguugggaguuugagaccagccugaccaacauggagaaacccugucucuccuaaaaauacagaauuagcugggugugcuggcgcaugccuguaaucccagcuacucgggaggcugaggcaggagaauugcuugagcccgggagguggagguugcugugagcugagaucgugccacugcacuccagccugguaacaagagcgaaccuccgucucaaaaaacaaaaaacugucuuuaaagaagaauaccuuaauacauaaacuuauuauuuugacucuuaaagauuauaacccuuauaccccacuuccuaaaaaaggaugugaaaugguuuaaagggcacguaaacauacacucaccucaguuaaagauguuaaaaauagaaaaucaaguuauuacagugagaucagugcaaauaugauaauuaugagggcuaauacagccauuguaauuaagccucucugcuuucaggauucugugggaauaagguaaauaugauuugguucuauuguuggauguauuuccuccuuugagacaaaccuaauuuuacucccauuaaauuaaaaaaauacuguccaccaagguuucaagacaauauugggaacaauaucugcuacaacaguuucauaagugaaagagcacuuuuucaaaugguuuuuugaaugaccguuacuaaaaaucugaggggaaaacagaaagcagcacucaccaaaacugauuucuuuggaaaaacuaaaccaagguuauuuagauagcuuaugaucuaauuugucaggcacugagcugguuuauaaccuagagcagugaugcuuucaacauuuuuguguuaacacauaugaacuuuugaauacuaaaauuuuugguaauauguugaaacuuccaagggaacauuagauaaaguaauaguaacuauaagguaaccacuaguacaguaaaaaugccuucuaguuacaaaugaauccaaagcaaucucuauuuuacuuaacacuauuaagcacugcagucugaguuugauuagaacuguuuacucucugaucuccucugaucuuuuuuuuuuaauucaggaaccaaaauauuuauauguucuaauauagauauaccaucuuuaacauuggcuugaaauuauguaaugccucuggauuguaguuauuugugcuucacuauacccugucauauacuggcccaguacaaaguucuuucugacaagccuuucuaccaguguguuauuaacuaguuugcuuuguauaaugcaguucugcucucaaauacaucuaggcaaguaaccaaaggaauccuagguuaacuuucugcauuugaaagauguauuuauggaagacugaagcuuauuuuuuauaugguaaggcaggugcucaguuuuuauggggcuuuuuuucccuauaauuuuucaacuuuuuguaaaaagcagacaggauuuaugauaagauaggccugaguucagauccaggcucuaccauuuguuagcugaacaaccuuggaaaaguuauauagcuucucuaccuuagcuuuugucucuuuauccccaauaucucuuaucaugucuacuucauaggacuucagaugugaaguuuuuaaaaauuaucaaacuguaacuuauugauaauuuucugcuuaaggucacucuaacugaggaaccuaccccuagaauuaaaaauaaaugcacaaaauaagcuauuaauaauaaauguugaaaaaagcuauuccguauuaccaguauaaucuaaacugaaacaagauuuuuucuuagaaguaauuuuuucuaaguauaacaaugcuuuaaaauaaccauuauauaaaauuucugacauagauaaaaauuagaauagcuuaaugaaccuucacugaccuguuaccagcuuuaguaauaaaauacaguuuagauuaauccuuuucaaccauauaagauauaaagugacaaggccccuccccucucccaguuguuuaauaugauuuaccugagguagccaccauuaacuuccuuuacacaaaugaaaucaccccauaggugcuguuuuguagcuugacauuuucauuuaacaauauacuuuuuaaaauauguuuuauuuccaugugaguaccuauguucuguggcuauacaacauucuguucucuacaauguucuauauaauauuauggcagcaaaacacaaaagagugaaaugagggauguuuguuuuauccacugcuguguucccaacaccuagaacagugccugcacauaauagaugcucaauacauauuuggugaaugaauuaacaucuaguuaggaaauguauuucuaacuuggaaauguauuucuauuauugguacgauauucuauuauauaauuguauaaugauuuauuuaacuaguagaauaaugauggaugguaggacuuuggguuuuuuucaccuuucuauguuuuuuucccccuucuauguuuuuuucccccauauucucuucagggagcaacuauuaucuugauaaugguggcaauuuaagaaacuacuuugagaaaauaauuaaaauaugaaaaauggauuuuuuguuuuuguuuuugagacggaguuucgcucuuguugccugggcuggagugcaauggcgcgaucucggcucaccacaaccucugccuccagguuucaagugauuccccugccucagcuuccugaguagcugggauuacaggcaugcaccaccacgcccggcuaauuuuguauuuuuaguagagacaagguuucuccguguuagucagguugggcucgaacucccgaccucaggugauccgcccgccuuggccugccaaagugcugggauuacaggcgugagccaccgcacccggccaaaaaauguauuuuuauggacacccauagcuaaaugucuuuccaucuaguggcugguuaaccaagcaugguuccuccuguuuccuuucccuaugaucauuucagaguauaaccauuguuuaguguaggagagauguuaugacuuuuagauaugcuuuuuuucauaaaaaggaauugccuaguuagaauuuuuuaaagauaucucacaguucagcaguuuugacauugcuggggaaauuuuauccagggauacagaagaaacguucauucauuuuuauuuaagcaccuauaaaaaguagggggguacuucuggcaauacaguuggguuacuguuuguggcuaaauaugugugugaacauuacgacauuugaugaaaacagcuucauugagcuacugagcucuccagcugauuuuucuucuuggccuuaaagguuuacaaggcuaagaaucaaucuccucugggguagauggccuuacggauuuuaaauauguguugugauaaaagugauuuuacucuaauacagcauaguacaaguuaacuuccaguaugcagaauugaccucgugaauuuuaguuuaaugaucucaguucucaugaacuugcaaacauagaaaaaaaauaaauauuuuuaaaaaacuuuucuuuuuaaauugugaaaaacguauaugaugguuacagcaaagauuaugcuuuuaugacuaauucauuacauugagucauacauauuaaugauucaaauuacuaacauagcucuauuaaauuaaaucuaccauacaguauacagguauucuguacuuugaaauuucauaaauuuuuggauaucaacucucagaaggguauacuaguaauuugcuuuuacccacaaaaucuucagauuugucaacaaaaugaacgagauugguauuuucacuuuaguuucucagugaaaauaaagaauggguagaugaaugguccaaagagcuaagagagaagacuuaauuuaaacucaaauaaacaugcccagaaugacccucucuuuuucugcccuuccuccugccacaguuagccacuguaugucucagguuuuaggcaaagugagucuucuuaucauggaaacugugaacauucauuaacaacugguuuuacuuugaaacuuaaacagcaaacaccaaagagugaauuguugguauaauccaugggagucuugagauugacgucagaacaccaguacagcuguauaagcauugggaaguauuuuuaacauccguguuagaucaucuuuuugaccuuuccuuuuauguuuucucuuuuuccauuaaaugguuaaaaaaaagagcuuuacaauauuuucuaccaacacuguaaugauauucuuaaaaaaagcacccguacaauuauuuucuuuguuccuuuccccuuugcaacuuuccuuuaccuguaguguuccaaguucugaugggguggccuuuuuuuuuuuuuuuaaauaaaaaguuuguuuuugagaacagggcuagauuugccgaaaaugagaagcuagaaaauaacauauaccccauaggcaugcucagaguccccuauuauuaacauauuacauuugugugguacauuuguuacugaaccaguguuaacauuaauauuaauuaaagucuguaguuuauucagauuuccuuaguuuuuaccuauuguucuuuuucuuuccucagaaaccacauuauauuuaguuugucauguuccuuagccuccucuuggcugugacaguuucucagauuuuucuuguucuugaugguuuugacaguucaaaugaguacuggucagguuucuuguaggaugccccuauauuagaauuugcuugauguuuuucuuacgauuugacuggaguauggguuguuggaaggaagaucacagagguaaagugacaucuucaucaacucaugccaaggguacuuaccgcuaacaugauaugugacuauugaugaugaccuugaucaccaaaauaauguuuaucagauuucuccaguguaaaguauuggaauguucugguaggcauauccuaguuagguuaauugcucugguaauugcuugggcuuuaguuauuaaauaaaucaucauauugguauacugcucauugaaauguuaaauuuuuuuuuuuacaaauaauguguucagaguugagaauuagauuuuuuaaauguucagauuguauuuucaaauuguauuuuugaaauaaagcuuuccuuuccugucgaauucuaaagauuuuguuuaucuaagggaacaacuuagguucguauuuuaaguaggaaguuagagagccuggucaguuuaucugcaauuuaaauucuagacacugagacuuauuuccuucauuuuaucuuuuaaaaaauagacugagauauaauuuacauauaaaauucaccauuauauuauuguuaauuuuuaugggcauaaguauuuauauuuauggauuacaugcaauauuuugagacagggauacaaugcaugauaaucacacuaagguaaaugggguaucuauuaccucaagcauuuauucuuucuuuauguuacaaacauuccaauuauacucuucuaguuauuuuuaaauguacaauaaauuaugguugacuguaaucacucuguuauaucaaauacuagaucuuauucuaucgaacuauauuuuuguauccuuuaacaaucccaacuuccccaaccccccacuacccuucccagccucugguaaacaucuuucuaucuccgugaguucagauguuuuaauuuuuagcucccacaaaugaaugagagcaugugaaguuugucuuucggugucuggccuauuucacuuaacauaaugaccuucaguucuauuuauauuguggcaagugacgggaucucauuguuuuauauagcugaauaauacuccauuguguauauguaccgcauuuucuuuauccauuugucuguugauagacacuuagguuguuuccaaaucuuggcuauugugaauagugcaucaauaaagauaggagugcaggccucuuugauauacugacuuccuuaaguucacucauuuuaaguguguacuucgaugagcuuugacaaguguguauacuuuuuaaccaccacaaccagcauaguuaagauauauaacauuuccaucaccccaaaaaauugucucugcuuucugucacaauaguuuugccuuuucuacuucauguaaaugaaaucauguacaguauguaaucuuucugugucugucuucucugucucuuuuuuuuuuuaaagacagucucuguuucccaggcuggcuggaguacaguggcgcaaacacaguucacuucaggcuuaauauccugggcucaagugauccucccaccucaugcucccaaguagcugagaccacacaggugcacagcaccacaccuagcuaauuuuuuaguauuuuguagagauggggucuuucuguguugcccaggcuggccucaaacuccugggcucaagugcccugaccccugcgaagugcugggauuacaggcaugagccacuaugcccagccuuucuucucuuuuuuuaggcuuaauacuuuucagaugcauccaaauuguuucauauaaugguaguuuguuccuuuuucuuaccauaauaguauuacauugugugaauaagucaguuucuuuauccauugaccuguugguggagguuuggauuguuuccaguuuuuggcuauuuugaauaaaucugaacauuuuccuguaaguuuuuguguggcauauauuuuucuuucucuuugguaaacaucucagaguagaauugcugagucauaugguaaauauauauuaacuuuuaaaaaauucuuuuauuuauuuuuuuagagauggggucucacuauguuguccaggcuggucuuggaucagccuugguuagggauccucccaccucacccucccaaagugcugggauuacaggcaugagccaccacaccuggccuugauuaacuuuauaagaaacugccaaauuguuuuccaaagugccucugucauuuuacauucccacuagaaaugucgaagaguuuuacuuguucuacauccucaucaacacuugguaguaucagucuuuuuaauuuuagucauuguagugggugugaauggcaucucacucuacuuuuuauuugcauuucucuaaugaugaaugauauugaggacuuuucauuugcuuauugaccuuuuguucucuuuugugaagugucuguucaagucuuuuaagaaguuggcuugucuuugucuuauugagagguaagguauggguccuuugucaguuacauuuagaaaauguuuuucuuucuguuuguggcuuguccuuuuauuuccuuaacaaugucuuucaaagagcauaaguuauuaauuuugaugaaguucagucuaucaacuuuuuauuuuguauucaugcuucuuggucccuaucguaaauaucuugacuuaacccaagguugcagaaaauguccucuuaauuuuuucuagaaguuguauaguuuagcucuuauguuuaggccuaugauucauaucaaguuaacauuuguauauggugugagguaaggauuaaaguuugugcguguuuuggcauguuuuccagcaccauuugcagaaaagacuguccuuuucccguugaacugcuuuggcaucuguguuaaaaacuuaauagacugucugugcauaguuguauuuaugguuucuuuauuauguucuguugaucaauaugccugaacauauugauugauuuauuaccuuagcuuuaagucuuuaaauaagguaauauaagucuuccaauuuuguuguuuuccuaaaaauuguuuuggcucuucuagaucuuugcauuuccauaugaauguuagagucagcaugucaauuucuauuuacagaaaacaggcugagauuuugugguuguguugaaucuggaucagaauguggagaauugacaucuuaaauuaggucucccaauccauuggcauaaucuuucucuccauuaauuuaguagucuucuuuaauuucucuauaaacauuacauaguuuucagcauacaggguuugcacaugguuuguuaaguuuauguguuuugagguuauaaauagcauuuaaaauuaauuuuuaauucuuuauuaauaauauauagaaauacaauugauuuuucuauguucaucuuacauacuguuacuaaacuugcuuuuuggugcuuuuuuuauauagaucucuggaguuuuccauaaugucauguuauuaaaaaguuuuacuuucauuuaaaagauguaagccuuuuauauauuuauuuucacugucuuacucauuuggcugaaauguuaaaagaaguggugaaagcagacauguagacaucuuuucauuguucucaaucuuauggaaagcauucaguauuuuaccauuaaguacgauuuuuuuuuuuuccauacucuaucaguuuggggaaguuaccuucuauuccuagcuuguaagaaauuuuauaauuaacagauauugaauuuagucauaugcuguuucuguaucuguuuagaugaucauauggcuuuucuguuuucuuucuuuuuuuugacuugccaggagguauuuucaucugaggcuuuucuuucuuagacuggugauacagugaauuacauugauuuuugaguguuaaaccuaccuggcauucuuaggauaaaccccauuugguuuauccuaauggucucuuuauuauguauuauguauuauucuuuuuauuuauugauagauuugguuuacuaauauuuugaugauuguucuuguuccuuuguuccuaagggauauuuguguuuaguuuucuuguaaugucauugccuuguuuugauacugagacaguguuggccucagaaaauuuuuugggaagugucauguguuuucacuuucauuugucagauguagaauuguuaucucuuccuuuaaaugcuugugauaauucaccagugaagugaguuuucuuuguggaaauguuuucaaccagcaauuaaauucacugcccccugagaguacccacuauucugacuucuaguaccauagacuaauccuuaaacuuuuuuuggauuaauuuuuuauuuagagaaaaguugcauaaauaacacagaaaauucacguagaguucccauauacccuacaccuaguuuuccugauugcugacaucuuacauuauugugguauaucugugaaaacuaagaaaccaaccuuaguacauacuguuaacuaaacuucauacuucauuuggauuuuuccagcuuuuucauuaauggccucuuucuguucuaggaucaaauuuaggauaccacauugccuguaguuuucauguuuccccagucucuugguuugugacaguuucucaguuuuuccuuguuugucacgaccuugccauccccgaggacuuuguagaaugccccccagucugcguuugcugcuguugcucgguauuagacuggguuaugcguuuuuggaaagaauccucuuuuccucucaucaggggugcaugauguccacguggcaucacuggugauguuaaccaugaccacuugguuaagauaguguuugcuagguuucuucacuauacucuguuuuuugggaacacauuacuaaguccaacccacacuuuaggaagggggagauaucuacauacaugguuugaaauucuucuguaaggaagauuuggaucuuuccccacauuuaucuguuuauucagucauuuauaucaguauggacucauguauguuuauuuuauacuuugaguucuaaugcuagguuucuuuucuuuugcuuaaauuguuccaacuuuggcuauugggaagguuuuccgguuacuguuuaugucccuuucauaugccccuauccuuuuguuuuuugaacaucuccugacgugguacuagaagaugcuccaggcucaucuuguauuuucuuugcaucagcuguagaaucagccauuugaaggaacuagcauuccuuuuauuuaggaaccaaaauguaguuacuaggugugcucauugcuauuggaguaucguugcuuuuaggcccucucaggggacagagcuagguaauaucugugugaauacuaacccauguauacacauacaucucuaauuguuucuauauguaucaguuggcauauauguuaaguuaaacaugaguugauauugaugucucugauuauaauccauuaccacaagguucacucuaguccuccuuuuuaaucugugacuuccuugucugaccauaagaaaccuggcuccagccaccccauuauccauccacuuauuuuuucaaccuauguacacaugaaaagcaaauuuagaauuauuaccccauaccccaugaguacaguauuuauguacaguuucuuuugucauuagccuuacaauuucaagucaaaacaccguguuccaaaguuuguuagguaagcuccuuuuucaccgccccuucagugaaguuaugucauacauuuguaaugcaguuaguuucauuugucgcaauccacauuucaucuugggauccucugacguuuugguugauguuagugguuguuguuugguuaacauuuguugaaguucacucuuuguacugugccauucuguggguucagacaaaugcaacgggucauguauucaccacccuaauguacagcgcagauccugcacccuaaaugucccccugugcaucccguuuguagucaaacacucuccucuccucuagucccuagcaacuacuaauuuauuuucugugucucuacuuuugcauuuuccagaguguuguauaaauggaaugauacagucuuuggauuuuuccauguaguaaaauacaugaaaaauccaaagauuguaucgggcuucuuucauguaguaaaauguauuuaagauucauccauguuguguaaauuaauaguucauuuguuuuaaaaauuguuguacuauuccauuguguggaugaaucauaauuuguuuuuucauucccccauuaaaggccauuguaguuacuuucaguuuuuggcauuaggaguaaagcugcuguaaauguccauggccagguuuuugcauggauauaaguuuucaagucccuuguguaaauaccuaagaguaugauuguaggucguaugguaacucuguguuuaacuuucgacugcuuuuguucuuuauagaaauggaguugugcaguaugugcuccuuuuuaaucuagcaucuuucuuuugaauuguuuaugacauuuaucuguauauuuugaguggucauaauucauuugcauuauugauuaauauucuaaugugugaauaaacuacaguuuuaaaaauccauucuacugcagauggacauuuagauagcucuaguuugggacuguuacuaacagugcuguuuaggaaccuucacagacauguauuuuugugaacauacauauacauuucugccuaguuguggaauucgcugguacagcuuuagcugauuguaccaaguaauuuucuggagugauuguaccaauuuauagucugaucagcggauguaguuucuaggugcuuaaugucuucaugaguacuguauguauucauucauucuauuucucucucucucucauugugguuuuaauuuacauuuccuuaaaguugagcaccuuuuuauaugugcauugguuauuuggauauucagaaaaauuaagaaaauuguaaauuucuucugggcucugaaagcauugggguuuggaauaagggguggcuuccauuaggaaaggcaguaagggggccgggcgaggcgguucacgccuguaaucccagcacuuugggggccgaggugggcagaucacgaggucaggagauugagaccauccuggcuaacauggugaaaccccauuucuacuaaaaauacaaaaaauuagccaggcgugguggcgggcgccuguggucccagcugcuugggaggcugaggcaggggaauggcgcgaacccaggaggcggagcuugcagugagcggagaucgcaccacugcacuccagccugggcgacagagccagacuccgucucaaaaaaaaaagagaaacagugucuuugggggagagccagguguuggugaaggcagcguuuggagugcauucugugaagaaguuaagaguguagugguguuugguuucuuguagcaagaguccuagagcagugguccccaacuuuuuuggcaccagggaccgguuuuguuguagacaguuuuucaaugggacugggaggguguucgggggagggcaguagugggaugguuucagggugauucaagcacauuacauuuauugucuaccuuauuuucauuauuauuacauuguaauguauaaugaaauaauuauauacucaccauaauguagaaucagugggaacccugaguuuguuuucuugcaacuugacggucccaucugugggugaugggaaacaaugacagaucaucaagcauuagauuuucauaaggagugugcaaccuagaucccucucaugugcaguucgcuauaggguuccugcuccucugagcaucuaaugcugccacugaucugacagaaguggggcucaggugguaaugcgagugauggggagcagcuguaaauacagcugaagcuucacuugcucaccuccugcuguguggccugguuccuaacagaucauggaccaguauugucuguggcccaggaguuggagaccccuguccuagaguacacagugaaaaaguuugauagagaggggaacaguggaagauuuuguuagauaugucacaugauuaauggaugacuaaaguuuuguuuggugaucuaggaugauagagauguugagacaugaaauuaguuggcuucaaguucuaagcuguccugugugagaaauugccucaucagccaacacaggcuuugacauauggguagcuucguguuucuuaggauacuugggcuggucagaaagugccaagcaucagagaaacugagaccucgguauagguggaggaagucuaaugauagccacagucaguagccuagucugauuuguuuuuagcaaaucuagacuauuuucuuaaucaguaacuacuucuuuaguaacuacuuacaaggcgacugccuuugccaagguauauguucucugaaagcugauucuucauagaucacuaacuguaguuuugagguucugugauuuccuucaaaauucacagaaccuugagcuauaauuuauguggauagagugauuacugggauuuaacuuaaaauuagauguauucaaauguuuuaaggaauauguuuuguaaaacaacauguuuuucauucguuacuuauauauugaucccagaaauugugugccugcaaauugucaaguuggguugaugcuucagaaaaggaaaguagaggcugagucuucuuaguauagcaaugcauuuuuuagagcaguguuugaggcaaauuauuuucgcaaaauuacauggcuucuagggauuagauugcaugaguuugucucuuguuccucccucauucuacuguaagaggccaggcugcuaguuaacagaaugccagacauaaugccuagggcauaguuugagaccugggaagauucacaauaaucaaacacaaacagacagaguagcaugaagaaauuucaauccucccagucuugcuuacagauuuaauuaggcuuauuggggcagaaaauauuuuuccuccccccauguuuaaaucuguuucuccucuacucccaccuccugucccagauucucuuugaagggguaauacuagcaacaaaaggagauuuuuuuuuuuuuuuuuguaaauccuaacuuauuugguuuaucuggcuuuaggaaaaggagcaguaacaacaaccgaauuuuaagguauuugagggacuccauuuuuuggcacuguauuugggaaauucccaauuuaaaaaucaugcuguacucaagaagaaaauuaggguuuuuuuguggcuuuauaauuggaucuuuuuugcaaguauuuuuaauuuuaugagagguauuuggccuguucugcuagagaauuaucagccaaauccuugcuuucuuuauauuauauauauuuuccugagugauauucuagggaaauguauauggaugcuguucucugucuuuccauuagcagcgcaguguugggcuucgaaugaugaugguagaugauugggggugggagaagaggugggguuucuucuuaucaucccucuuguggucaguaaaaucaucugacaaaugccuuuccaaggaugucgaauguauauauaaagaaaaagcuuaggauugcuaagggagugguauuuuggugaggauuucauuuucuucuacuccauggaaacgagccuuuugagcuuuugcuugucugcugauuuguccggugauccagguaaucuacugcagucuuuguuuucugggucguguauaaaauggagcaaaaugguagaaaaauagcuucagugaaagggauguaccuguuaacaggaauaaaauagaaaggaaaaggauauuuuuacauuguucauuauuauuucucacaacagcuuuuaggauuuuuaucauguuuuaaaaaaccuaauuugaccuaaggaagaaaauuccuaguuuugaaaacccgugccuuaauugcuuagcuuuagaacaaagguuuuuacauccagcauugcaaggauaucuuuauucaaaagaauaggaugcagcauucuuauguuaccuuuuuagaacugaauuggcauaaccucucuugaaucuuagagacuuugacguauuauucugugaauugugauuuaauuaucucaugcuucaggaugguuguuucccuuugauacccaagagaccauggaugggauauaggggguggggauuaauauuacagugggggaagggaguguuuuuacagaguaaccuuccuguuuuugcauuggaaacuaaauugaaauauauaaucauuggaaaaggugguauccauggcaccaaucuuaucaacuugaauuauuuuauccuuuguucaguuugugguauuuuugcucuugucagcugaaauguugauuauaaauuugaagaagcugccgaguugcugugauggcacuggaauugcauucugcuuucuuuuucuuuccaauuauagcuguaaauacaggaaccaagggaugaaugugaaaagaaguaauauaaaaugcugaagauauuuuugguuuucucuugaaaguauuuuucauagugagaauuauuuucuuguggacagaaagagcuaggacccuaauuuaugacauuaaaaagcauuuaagugcuacagacuucucuauuuaggaaagacagacugaaaacauguugaagcguacuauggagcuuucaguuaaguugauuauuuccaucauggugauaugaguuaucauacuguuugccacauuuugaaagcuguuugacuccucagaaguauuaacaaauuaacaaauucuuacugagcauuuacauuaugcuagguucuuuagauguauaucagguuuauagucuaguaaaggauauaaaaaacucaugcauaugauguaccauuuuuggugcaagcauauaaguauugcaguguuauauauuuauguacugacauguagguguuuuacauaagcuacuacauuuaauccucauaacaaccuagucacgaaauuauugucauucuuguuauccuaugcacauuaguccaaacaagcaaacaaaaauugucauucucuuuuauagaugagaaaauuuacauuuugagagauuaagugauuuaccauaaguaacaaagccaugaagugaugaagccugggucagucagacucuaaagcucuuuccacuguuuguauaugaguagauuaaagcauuuuaucaugauuauuugacaucacaaauagugaugccaugagugaaaaggagauagggauccuaaucuuuaaucuaugccaagaacugagugauugagcaaaucauuuaacaucgucuguaaagugugaggguuggacuaggcaaccuugguucaugauucuauucaguguaagagauuuucacauauggucuauggaaacaauucucauuacuuuaguguuuuuauuauauuuaguuuccauuacucauccuucauaaugugcuguacauguuggauugugugugguggggggggagggugauagagugcauaucaucuucuaacauauuacauacaauauacauuuauuuauuaagauuauuacugucugucaucuuccuucuucccuucccccaaauaugucacgaggaccuagacuagagccuggcuacauaguaugcaguuauaaacuaauuuuuugaaugaaugaauaggaauaauagacuuguauaguacauuggcaaaauauauaaguaacuucauaauucuuaacaccaaaagauucccugggggccaaaauuauuaaucuuucuauuacagugauccuuuaaggaacuaaguguaagaaucuuaaaaagaagaacaccuacgaaacaaucaaguguagucaaguaaucugaaguuugcuggaauucccccauacaaaauuauugguaguauagaacuugcuaaccauagguuuguuuacccaguguucuauuugaaaguaguuuacuaaagcauuccauauaagcaaagaaaaaaagcagcaaaguuucuuuuuuguuuaugugucacuguauagucucaaaugcuguaaauuuacagugaguagaaaauauucagaccauugagucuuuugcuuaaaagauauuucguaagguauaacauaacguuuacugguaguuuuguuucauuuaaacauuaggcuucuugagaguuuuaacaguuuuauugaaauguaauugguguauaauaaacugccuaugguuagaguauaauuugauagguuuugauguauauacacgauuaggaaacuaucaccacaauugagaaaauaaacauauucaccccaaagguuuccuugugcauuuucauaauuucuccgucccuccaccccuccucaccuauccccagguguacccauugacuugucuuugguccuuauagaguaguuugaauuuucuugcuuucuuucuugucauuauagauuaauuugcaugucuuuuuguaagugaacucacauaguuugugcuuuucuuauguggucucuuuuacucugcauaauuauuuugagauuugucuguauuccuguguaucaguaguucauuucuuuuuauugcugaaugauaucccauuguguggauauaccacaguuuauccauucagcuguugaugggcauuuggguuguuucaaguuuuagacuauuaggaauaaguuugcuuuggacauucauguacaaguuuuuguguguacauaagcuuucaucucuuagguaaacacccaggaguggaauggcuggauuauaugguagguauauauuuuaacucuuuaagaaauugccagacuguuuuuccaggugacuguauuguguuacauucccauuagcaacauuccaguugcugcacaacuucauuaauaguugguuuugucagucuuuuuaauuuuagccauuuuacugugugugugaugguaucauauuguaguuuuuauuugcauuucaucugaugacuaaaaauguuuaacauauuuucaugugccuguuuuaucauccauacuucuuuuguggauugucuguucaaaucuuguuuuuaauugagcuuuuaauuauuggguuguaagaguuccuuauauguuugggauauaagugcuuuuauuuuuuuuuuauuuuauuuuauuuugcgacagaguuuugcucuuguuucccaggcuggaguucaauggugcaaucuuggcucacuacagccuccuccuccugaguucaagcgauucuccugccucagccucccaaguagcugggauuacagguggccaccaccaugccuggcuaauuuauuucuaguuuuaguuuuaguagagauggaguuucaucauguuagccaggcugguuucgaacuccugaccucaaguaaucugccugccucagccucccaaggugcuaggauuacaggcaugagccaccaugcccggccauaaguccuuuuagguauaugauuuagaaauacuuucucccagccuguggcuuguauuuucauuuuuuagcauccucuuucucucuuuaauacuuuuauugagauauaauucacauuuccuugagcaaaaguuuuaaaguuugaauucuaauuuaucauuuuuucuuucguagauugugcuuuugcuauaucuaagaaauauuugccuaacccaaggucacaccucuuugcuucuaguuuuauaguuuuggguuuuacuuuuaggucugugauacauuuucagguagucuuuuauuuuuaauuuuuguggguaccuaguaaguguauguauuuauggauuacaucagauauuuugauauaggcaugcaauguguaauaaucacaucaggguggaugggguaucuuucaucucaagcauuuaucuuuuguguuacaaacaauccaguuguacucuuuuaguuauuuuuaauguacaguuaaacuauuuuuuacuauaaucacccuccacuacccuucccagccucugauaaucauccuucuacuuucugucuccaugaguucaguuguuuuaauuuuuagcuuccacaaaugagugagaacaugugaaguuugucuuucuguugcuggcuuauuucacuuaccauaaugacguccauuuccauccaucuuguugcaaaugacaggaacucauucuuuuuuauggcuaaauaguacuccauuguguauauguaccacauuuucuuuauccauuuguuuguugauagauacuuagguugcuuccaaaucuuggcuauugugaauaaugcugcaaaaaacaugggagugcagauaacccuucgauauccaggaguguccuaaaucuaaggaugugucauauuauuuuuucuuuauuuuuuucuccuccugcuguuccgggucucuacaguguccccuacuccuuuguuuuauucgcacaccuggguagugccuuuccaaucaaaggauaguugggucugcauuucaggucugugaucuuuauguuuagggaaauccguuuccuggucaaagccuaccagacuuccuugguaucacuccagaauuuaacagauuuggcaaguauguuuuuuaguuaaugguuugagaucauaaucauuuccuucaugcuccuccugccuucuauuuuugcuuuuaauauugaggaaugcuaauggaauagauuugcuuuugcucucucccaucuuuaccuggaauugaacacauauuuauugaaggaaugagugguuugcaggaauguugccauucagguggagacauguuucucuuuaaauauauagcuggcaaguugcccauauggcacauagauauuaacugaauuauccacugagcucugggauuaggagauacagauuguguaggauugggaguucuuucuauuggcuuaucuuuuccuaaaacuauguaacgggauaugaauaccuuucuaccuaaguaucuugucauuauacuagaucuaguuuucugagucucacuugugaaagcuuuugguuaacuauuaauaaaaaacuguacaaagggaagaugauaaugguuucucuuguaaggugguaguccagggguugaaagcaaggguucuaguuagacugugagguuuugaaucuaagcucccucuucuacuaguuauauaacuuguauauguuacuuaacuucucagaaccucacauuucucuucaauaaaacaaggcuaaacauuuuacuuauagaauuauuguuaaaauuaaaugaauuaaugcauaaaaaguacuuaaagcagauacuguaaguaugcaaguaaagcuacucaaguuuuagcuauuauuguaaccauuuuaauuguuaauuauuguucuuauagauaauggaugauguguuugaagcuaucaccuagcacaauuucugacuaccaaauguaguuugaggcuuuugaguguuuuucaccuaaccauucuucccaaaugaauauuuuucagggaagcuaaccccaggaaaugugacacaauuuacuguauuguuccuuaccucuauaauguauguuuauucuagcugguucaucucuuccuuauauacaaguuccacagaaugauuuuuuucuaauaagaauuaagaaaccuuuguucugaugaugagcuuauuuaaauuuggguuuaauuugauagaaaauuaagcuguuuccuuaauggggaaucuggccaaucaccauccuccacccucccaggguagaauuuuuuccaggaauuaaauagcucuaucuagcagggucuuccugccuuuggcaguagagcaguacaaaggccacauugagcauagcugcuggggaaacccuuuuuccuucucuagccuauaaaugcuguucugucucugugaaaagcccugacaucagcucuuggaaaaauccaaauacuuguguuagaacaaggcugaaacacuugccugggcagagacuaauggcugaacuauaguucuaaguuuaccagauugccucucaguauuguuaugcuuuaaaaaacaaaacaaaaacuguaaguuucagacauaaucuagagaaauuaggauagaaaggacaacuuaauagcgccucccauucuuugcuaguuucuucuuauuuuucucuuuuuucuaaaaaucuaccuucaagauaaugugaaauucuugcuugaggagugagggagagaaauaauauaucaauauuauaaacuuuaugcaguguuuuccacauauuagaugcugcauaaguauuugauguuugagacaaaauaaacuguaaacagacuguacuuaacuuccuuaguguucaaauuagaucaugauguaaaacucuccagugguuuuccauuauauuaugaauaaacucuaagccuguuucuguggcucacauucuuacauuagcuggccccugucuacuucuguggaucucauuucagcacuacuuuacuacucucuuggucauuuucuaugcuuaagccacagcggacuuuguauuucucaaauacauuaaucugcuuauccuuugugacucuuguacuagcuguuuccuuuaccuguaauucuguggcccacaucuucccauggcuggcuccuucauuuaagucucagcuuaaaugccucuaaggucuuuuuugaauaaacuaaauuaauguauuuagucaaauaauaucuuuuuuuaauagcacuuaccacgauuugaaauucuuugguacaauuauuuuuuuguggaguuuaucuuccuccuguggaauguaagcugcuugagagcaaggaccuuaucuguucauuaacguaaccuccagugucuugaaccuccuggcauagguugguguuuguguaacuuuguauguacuuggcugccuguaacggaaaacacaagucaaacugacuuaagcaguaacgcauuuacuggcucacauaaaaaagaaaucuagacguaggcuucagagauuuuugauuuagggacguaacuaugucaagggcucagaugcuuuccaucuuuacacucuugccaucaaaaucauccucauccuaaacuaguccuuaaagaugaaugcgaaguagcuguuaaggcugcuugcuucuucacucagguucagugggagggagagaaagaaguuucacaucauucucucaagaauaaggaaauacuuucauagaugccaccagugaacuuuguuucuacuuuuauuggcuuuuuuggaaccaauugcuuacccaagaauggaauuacuguuaggccaaaaaggcccaucacuguugcuacagaugggguuggcuugaccugagucaucuggacucugagaggaauaguagauaacugaauaaaaucggaguucucuuaaaaggaaggcugugguuucugggguaacuuauauccucuguaguucucaauaaaaauguauggaaugagugaauucauguaguaaaaauguauugaauugucaggcguaugcucagcaccauaauaguuaaguagaauacaaaaucaaauagaaugugguccuugccuucaaauaauuuaaaaucuagugagagagccaaauuaacggaauauuaaaauuguuuuaaaaaucaguugauuaaaauaauuuaaaagaugaaaaagagaaaagggaaacaacagaugagacaaauagcaagaugauagacuuaaauacauuaguaaucacacuaaagguaaaugguccaaacaccccaauuaaauguauagacuaucagauuagaugaaacagcaaagcccaacuguaugcuacaagaaacacaccuuaaaauuaaaaauacacauuguuuaaaaguaaaaggauggaagaagaugugcccugcuaaucuacauuaaaggaaaacuagaccacauuaauaucagauaaaguagauuuaagauuauagaauaucaacagggauaaaaaaaguaauuucguacugauaaaagggucaauuuaaaaagaagacauaucuaggcauguauacaccuaaugacaaaacaucaaaauucauguaacaaaagcugacauaacugaaaggacaaauagacaaaucuacaaacauugucaguuauuucaguauccguuuuucaguaauugaucaaaguagauaaaguaagcaaggauauagaguacuuaaacaauacuguuggccaguuugauuuaauuacauuuuuggaacauuccagccaacaaccaaauacuuuuuuuuuuuuucauguuugcaagcagacaugggacauuuaccaugacagacacaauucugggcugugaaguaaauuucaauaaauuaaaaggauucaagucauacaaaguauguuuccuggucaccauggacugaaauuagaaaucaauaaaagaucucuggaaaguuuccaaauauuggaaaauaacacaauucuuagucaaaguggaaauaaaaaaggaaauggcaaaguauuuuguauuggaugaaaaugaaaacacaacauaucagaauuuguugguugccauuaaagcauuacauaaaaacuuauagcauuaaacaccuauuagaaaagagagaaggucuaaaaucaaugacaucagcuucuuuuuuuuuuuuaagacagggucuuacucuguugcccaggcucaagggcagugguuugaucacuacagccucaaccuccugggcucaggcuguccccaccuuauccucccaaguagcugggacuacaggugugccccacuaauuuuuuuuaguagagauggggucucacuguguugcccagacuggucucaaacuccuggguucaagcaauccuccugccucggccucccaaaguacugggauuucaggugugagccaccguaccugaccaauuucauuuuaagcaacuagaaaaagaagagcaaauuaaaaccaaagcaagcagaagaaaaaaaaaauagagaugaaagcaggaaucacugaagcagaaaacaggaaaacaguagcgaacauuaaccccaaaucugguucuuuugagaaaauuaauaaaauuauuaaaccucuagccagcugaucaggaugaaaagagagaagacacacauuacuaauaucauaaaugaaagaggugacaucauuacagauucuucagauauuaaaaaaaaauaggggaggcugggugcuguggcucacgccuguaaucccagcacuuugggaagccgaggugggcagaucacuugaggcaaggaguucaagaccagccuggccaacauggugagaccccaucuuuacuaaaaauacaaacaucagccggcauuguggcgcgaaccuguaaucccagcuaccugggaggcugagggaugagaaucgcuugagcccaggagguagagguugcaaugagcugagauggugccacuacacaccauccugcccaacagagcaagacucuaucucaaaaaaaaaaaaaaaaaaaaaaaagauaagggagcauuaugaauagcuuuauggcaauaaauuuaacaauuuagauggaaugugguugguaauuuuauaaauuccaacaauauauauacaauauguaaauauauauuacauauacauaaaacaggaaaauacauaaaauauauaugcacucuguguguauguauguguguguaaugaccggguaggguuuaucccaggagugcaagauugguucaccuuacaaaaaucaggcaauguaaguaaauggaugguaaauggugguaacuauguuucucacugucucaaaggagcuaagcaagagagaagacuggaaugaaccugauggaauuagauuagaauuagagauaucaguaugaacucaugcugagcuuaauauagauacagauauauggauagcuacagaaagaauuauagauauguuguauuagucucuucucacacugcuaaugaagacauauccgagacuggguaauuuauaaaggaaagagguuuaauugacucacaguuccacauggcuugggaggccucacaaucauggcagaaggcaagugaggagcaaagucaugucuuacaugguagcaggcaaggagagcucgugcaggggaacuccccuuuauauaaccaucagaucuggugagacuuauucaauaucccaagaacagcaugggaaaagacccccccccuucaugauucaauuaccucccaccaggucccucccacacaugggaauuaugggagcuacaauucaagaugagauuuggguggggacacagccaaaccauaucauguguauguauaccccaguuaguauaacacauucauuucccugcucucucugcugagagggccuagaaauggugacaucucaguagcagugagcgcacccagcuccuggaucuugguuacuaaauaucacucuccaauaaaauagcuccuuggagaaaugguugacucuaaggcugcaauagggaaaaugcaaguugaaccuagagugccuuauagugccacaaacaagaaagugcccaaacagaagggugagagcaugucaguggcauaaacgggaagaauuugagcaagagaauaaauaacguaguauuggauuagaacucaaagucuaaaauaaacauacaugagcccauacugauaaaaaugauuacauaaauacaugggugagaaaacacaaaucuuccuuacaggaaaauuucaaauaguauacguagauuccuauucccaggagauggagcuuaauccucucagaugcuaguguggauugggcuuagugacuucuucaaagaaaaaaauauggcaagggaaaaauaauaacuuuacagggagacgucgagcaaccacucccuuaaccaaaugaccaaaguuaacauuacuaguguuaagucauauuggugucauauauccucugaugggugaugaaaaggguacuucaccccugugguauuccaaaaauagacccacguauauauggaaaacugauuuucaaaagugcaaaaggcaauucaguuucaacaaacggugcuggaacaauuggauuucaauuggauaucacacucuauauaaaaauuauuacaaaauauauuguagaccuaaaaguaaaauagaaagucacucagcucuuagaagaaaauguagggguaaaucuuugugauuugggguuaggcaaagauuucuuagguaugauaccauaaacaugggcagugaccuaauuuccaaauaaagucccacagguauggaaguuaagacuucagcaugucuuuggagauaacacaauucaaccugcaacaaauauaaugguucccaauuaggacugcuuucauguuuaauacagagaaacugagaaucucuauaugaguuuagugcuuuucacauacuaccuaagaaaugcaucuuccacauuuacauuuagucuuccaauguguugguguugucauuaacaaaauacaaauucuccuaaaaauauuaugaauuguagcuuugggcauuuauucaguuuguggauaguauaauaauugcuauuauguguaucccuggguuuuguuuguguguuuguuuucuacuuucaacacaaauagggagagagucucucucaccgauuucgugccacacuuugucacuugggcauuaaaauaauuuuacccuggcccuuugucuuacaaggucuguugccaaaacaagcuucuucagcuucugcugcuguuuccauaaagauuugacaugaguucauggaauugaucucggggacgaguguguccucucuuuucuguuuaccuaguacccacagaaacuccugucauuucuaguccaaacucccaccuggauuccuuacuauaaaugaauucaucccaaggaagaaaucaagggggaguauagaacuuggguuacaaggauauuuguuauaacauucuuuauuaugcugaaaaauuagacccagccuaaauauuuacaaaagggaacuucuuaauuaaauagccauaucacaggauacuuugcaguuaucaagaauuauuuagaacuauguuuuuuaaaucuuuaucugauuuggaaguucaauauauagaaugaauaaaaaacaaagcagcucugauaugugggaagucuagagccccaucuacacacucccgcucugugagggaccucuuuuaaaccucuagaauuuuauagagcacaguuuaaaaccagcacuguagugaaauauuuaauauguaaacauauguugauauuuuaugaaguuaaaguugucaauauguccaguaugcuuuaauuuuuaugaaaauaaauuuuaaacauuguauacagaaaucuaucucuauuuugggaaagaaugggaauauaugcauaacaaugcuggguguugggauuaugggugauuuuuguuuacuauuuugucuuuaguuuuuaaaaguuuauacguguacuucuuuggacauaaagaaagugagacauuucuucauauugaaaaggcagagagaaccauugcuuuauaggaaacuacaguuuggaaaaacggcagucucauuacucaaucccuugagagaggaauuaucuugaaaauguuauaaaaaauauuaguaacagauuuacuagugucaguggucuuguguguuaaguauauuaggauaagccacauuuguaacagcuaacggagaaaacauaacugaaugucaguguuacacagugaacuuuguagagcagugauucccaauucugagauguuguaagaggaaugucagaauuccuaaaacacucauccuccaaccuuucaaauucagugcuguggugagccauuguuacugauaaggguauaucccacuugugauuucuuuguuuugggucaagaaaagcuuuuguagaagccaguguaaaauggcaugcauauaauuaauuuccucaucuuuuccucauaaaaucagagguccuuuuaucgauggugguuugaaagucugggguauucagauuuggcagcagaaaguguguuuuuuuugugugugugugauaaacuagguggauugcuaauucugauugaggaauucguaauguuugacaccagaaccagagcacuugugaaaagaagucucuuuaguacaaaaccaaaaauuuaauuacagcauuuguuauaacuauagccaauaaaaguauuuuuaaugaaaaagaauuuccgcagaagaaaaugcuuucuauuaaugcagaagguguuauauagaagauuuaauuguaaugauauugguuaugauccguuuuuuguuuuaucuuuaccuguauuuuauauucguauaaccucuaaauuuuacaaauuacccauaauacauuucuuauauaauuaaaaaaauucugaguacagaacaggaaauauguucaaucuuuauuccauuagaguucuacuuggaaaguauuaauauguaagguuuuuauuucuccauaagaaauagaccuauauagucaggcacagugucucaugccuguaaucccagugcuuugggaggcugaggcuugaggauugcuugaggccaggaguuugagaccaaccugggcaacacagcaagaccuggucucuacaaaaaaauucuuaaaaaauuuagcugggugugguggcaugcuccugugguccuaccuacuuaggaggcuaagguaggaggauucccuugagcccaggaguucgagguuacagugaccuaugauugugccacugcacuccagccugagugagagagugagacauugucuccaaaaaaaaaaaaaaaaaaaaaaaaaaaaaagaaaagaaagauaaauagaucuaugucuaguuaauucgaggagaugguacacauuuuuagagcacaugagaacgaaguuuauacuuuucugauuuucuggguuuccuugaugauuuuuuggcaaauccuugucuguuuagcugucuggcauauguaugacugugguugggcuucuuuguacucaaccaaugaaugcauaccaacuguaacaccugaagguaggaucaugaauaaauacucugugauuugggguuaguauaguuuugguuguuuucccuucuccugagauuucagaaauaaaagauuccuauuccugugauuuuuuuggcacacaguaagacauauuugauacauaagauaagucauuauaauuaacuugucgaaucacuuuuucuugcugcagaaugauauuuuuaugaaugccuuagguuuuuucaauaaaaaaugcaaccaaacugcaaauguacugugauuuaaagugguaaugucagaauuuaaauuuugaguaguacucuuuuuuuaaaucauagaaugcucuauguuuauucaaaaaaguaaaauauuauuagacaguauuuuuuauuuuaauuuugcauuuaaauaaaguucucaagcucagacugaaaaguaaacacuguauguuggagccugucucaacgacacuuaaaagcuaagacuuucuacuuuuucagaaguacauuuguaucuuuuggcaaauguguagaaagcagccuguccuaacaaauuuuguucaccuguucucacuucaguuuauagauuguuaaacauuuaaucauaauauauuuuauauacaauauuuaugugaaaaaugcccauccuugauuaaggggauuuuuuucuacucuuauuuuuauuauuuuuaccaguauauucugaaguagagaaaugugaaaugagaugaagauuuaaauuccuagcaaacagaaucaugcauugccccuguuuuauaaguaaugagaucauuuuguagaguccaguuuauuuacauuuguuaaaugauauuaauaucucuuccauaagcaugaauuuggugguuugcaugguguucacugaggugaggauacuuguuuaaguauuuugaggaucucauacuuuccuagcaguucuuuuuacuugguuuucugaagugaauauagucuuuaaaaaaaaguauaagguacuaguaaucagauacucaugaucacaaaugaaagugguggagaaaccuuuuaaggaauauucacaaaagugauaauuuuccagauugucaaugaggaaaugaaagucucuaauaagcugucacauuaauugugagcugcauuucucagucagcaacaacuaauagucaaucuauaauagcuccagcagagggaaugaaaguaauuuagaaaaaaguuuacuauuugauuugucaaaguguguccaggaaguaagagagccuaaccaaggggcuguugugcauguaagcucuucaguaaaaguggugguguacuaagcuauauuuaagaagguaauuugagauuuuauauuacaugcuagugaaucauuuuuggauuuugcaccagaacugagcucuuuggucccugccugucugugguuuguguugcaagguccagaggcuuaaaacaaagaacaccaugggaaauucuccaugagucauuccgucagcuguagcuucuguuuuauaguccuucggauauaacuaguguuuuaaugccagcucuccuagccgcuuuucaugcuuugguucuauaugcuaauaaaaaaguauggcaguauggcuauuguagauaacguucagacuuuuuuuucucccgauuccacaauuuuuaguucuucuaauggcucuaagcuagaccaauuauaaauuguaacuggugaaaagauuuaugacuguuuauuuuguuguaguugcgagguaagcgaguggucacuuaauacuuuugguucugugaaucuuacuguccagagaacuaaagauugaauuagcaguucagcuggagucagcacuaugugcuaaaucccuauacuuaagagcucuuauguauugcagacaaauguccucuuagcuguuuuguuauuuugugaaaaauaauaauaauagagcaaggcaguuuagauucauaucaguuucaaauuuuaaguaccauguuuuaagccauucuaauuguuuuguagaaacagauaaauuaaaaacuugauuuaaauccagcccacaggaugccuuaaucaccuuugauauuuuaaaggagaugaggaaauaauggacuuuuuugcuaguaaguggcagguauggucaacacaauuucacuacauuugaaaaaaaucacuuucccugcuugccaggaaaauuuaaagugcagauuguaaccugaucuuuuuucuuacaguguaacgucugagaaguucaaguauugacaugaauuuucuaugauaccacuugguaaauuaaaucugugguuucaucacuggcuuugaauuauauauuucuaugcauuuuacuuagcuaaaaacuuauuugaauauuuagucuuuaaauuuauuuuuucuuuucugcuuauuugaauacauaucaccaacauucagauuuuauuuuuguuuuucuuaauaguaaauacauaagugguuacugcuugcuaggcaaugcuucuuauuuucuaauuuaauccccaaaacaaauuugugagguauagguagauguauuaguaauuauguuuuagaggagaugcuuaaagagguuaagcaacuuguucaaguucaaauaccuguuaaauuaugaaacuagaauauuaacccaguuacauuuguuucugaggagucuuuugcccccaaggccuugaaauuuuagggaauuuucauuuauagcaaucaauaauacuauucccaucccacccuguccauuucugauuuucaauaguauaguuucugcacugauauuuacaucgucuuacgaugguugagccuuaaaauuaccugcauuguugucugauuugcaauucuuugucuaguaacucuucucacuggaguggguuccaauaaaauggugcuguauuucacucaaaaucaaguugcaguguuuuuuccuccucauuuuaacaucacuaaaaucagaguguaucuacuaauggaauucuugauaauucuaaauuuaauagguaacauucuuugacugcuaauaaaaucuuaaccacuauccaauguaagaaaaauuuguuuaaccaucuccccuucauuucaaccauuccuuauuaagaagaaccaacuacagucucaaaugcuccuuuauaacuaagcccagggaagacauaucuaacacccuagaggagagagaaaaggguaugaauuaagguuugagugugauaucagcauuucuucucauauggcuucagaacacuucucacugaaguauugucaaaaggcucuuuaugcacugaaaucaauaaaagaaaaaaacaauuucuagcaggcuauuuauuauaagcaaauaugugacgacacaaaacuuucugguccuuugcaauuuuuuaaguccaaaagaaauucuguuuaacaauauuaaaggacuauuccaguuacaaaauuguguguuuguguaugcuuauuagaauaauuaaacuugguuaaaauguaagucuuacucuaguauacauuauuuauuggguaaguguuauuuaacuaccaaaucacauuucccucuacacuguaauaacacaucgggaagggccaccuagggcuuuaaaauuagaacucagaauuuaacaaggaaaagguauucugaguugagugaauaaauguauucugaacguuuaaggccuuugguuaagauuucuaaaauguagcugugcuuaauauacaaaaucaaaaguaaaggcaggccaggcgcggcggcucacaccuguaaucccagcacuuugggaggccaaggcaggcugaucacuugaggucgggaguucaagaucagccuggccaacauggcgaaaccccgucucuacuaaaaauacaaaaauuagcugggcaugguggcacgcagcuguaaccccagcuacucgggaggcugaggcaggagaaguguuugaacccgggagguggagguuacagugagcugagauuucaccacugcacuccagccugggugacaaagcgagacuuaaucgaaaaaagaaaaggaaaaaaaaaaaaggcaucuagccaccauaucccagugauucaaauuccugauaauucuuugcuuuauuaaucaucguucuucauuuuggaauuugacuuuuuugcuaucuguuaauagaaaaauacacacacacacauauaaguaaacacaguauauucauuguugaccaaguguccaaguuaucaauaugauauuuucaaaaaccaggcacaguuucauuaggcaccuguaacauuaugucauagucacauacagcuguucuacauaauaucgauccaaaagauauugucaugauuucaugauuagacuacacaguggacagggacuuaaaaauauaggaguuuuguucaccagaauguauuucaucagacuaaugguugaacugauuuguugcuuaugaccuggccacuuuguagcuuucagaccugccuuucuguagcaguugauaguauggauuaucugaucuuccuucccuucugggacaggcuuuucucuuuucuaauucauuuucuuaaucuccuaccuccauucucaaucaugcagaugcuaguuucucccccauauuugagccugagcauuuuuucaaguuuccuugguguuuuacauuucagugaccaucaguagguugauaacucaaaucugcaacuuuagccccaggcuuucuuugagguucuagcuuucuauuuccagcucucugauuacaucugucucaauauucagcaugugguagggauuuugcaaaacuaugggauuaucuuggugacuuuccuagcugaagcagagagaacuaaugaaauagccaagaagguucuugacauuguuacuuaugcauauaagcauauauauacacacauauguacacauauauuuauuugcuuuagcagauacuuuaaaguagaauucaaugauuagagaaaaaauuaugauuuuaauauuauuugagacguucuuaaucuauacuugaaguaguaaguagauuaugauaagcaaguuggacugugggcgugguccuuguucauuuucucauuccguuuuuguccccauuuuuccucuccuuuuucauuaccuuguaagagaaaauagcucaggaaacggguuuacaaucaguagucugggaacuuccgggauucuuuaccagcaucccccuggauguugcagucccugacgcaagcagcauuguuuuaggguaggaguuuuuauaauggcugugaggucgagugccuaagguugauaaauggcaguuguuauccuuugcagaaacucaguuggaauccuuucugucaacuuguauguucaucuguaaauuaagaaacauguucccauucccucccucuccuaccucaacaguuauggacagacugcuuaggaacuccuauuucugaagauuucguggucuuuuguaaagucaguuuguucucuagagcagugucaucuugucccagaacccccuuuacuuacuaccacuacuucuuuguaaguuaacaugcuaucacugauuaggaaagguuuuagauucuuagucuuuuucuauggaucaauuuugguuuaaauaggugucgaagggaauuguaagucagcuuguauuuuggagguuuuguuucuaccuccaugccaaaugaaauguagucauugaaguaucauuguauuauguuuauuucugucuuuacuaauaggcuuuuuuaaaacccuaguuuuacugauguucuuaauaaaguacgguuccuauuacuaaauaaucuuuacauaaaaugccauagguugaaauaauuuaaaagacagaaaucaaaauguaggaugauauuugagaagacuuagauuagcauuuauauauagcaucaaacgcuuaucaagaagcuuccggcaguauucauuuaaaagagagagaaccaggaggaaaugcuguaguucuuucagcuuauaggacccccccagaaaaacaaaacaggaaagugcccuuuguuuucuacuuuuggaagguauuuuuuguaaccgauaauuacuuuaauguuaauuuuuuucuagauaaucuguuauuaaaucuaaaccuaauaauugaggaucacgaugacauagaucaauagugcaguaaucaacacccagauauuuugggaaguagugugaagugaugggaaggaaggaacuuucccuucuaggaaaacagugagaauaauauuuuaauggcaaaauauuucuuuuugucuugauuuuuaaaaaucuauaaaauggaaaguauaucucuucauagagauuucuuuuuuucaagauuaaacgagauaauacauguggaaauaaugcauagcauuugguaagcccuuuauaaauuuagcaauugcucuuauuauugggauuuuuaaaaagaaaagcuauauucuaggacagcugaugguaaaugcacuggcaguuuaagauuuaacaaaguaguuaagauacuuaaacaugguguucaacuucuuauuccuccagcuuauugauucuugcuauuggaaaguuaccauaagauuuaaaucucuuauucugguucaguaggaugaauaaauuuaguaacaaaaucuuacaaguaaaguaacuacaucuauccuuauuuuuucuuuguuucagguuuccccucaaaaaaccuauaagguaaguuugcucaauuacacuucauacucaaguuuagguuauauuuuaauuauaagcaucccuuugaaauuaugguggauuuuugugguuuuugagaauguguauucaaguaauucaaaauuucaaaauguuuuacaaauuuaaaauguaaaagauguuacuuuuucuggaagacagcauuguuuugauaauacuucuaauauaagcauuuaaaaauuuuguucaaaaggauauuuaaggucacacugaagagacuuaauuuugaagucuauuugugacuguuuugaauuaugaguagcuuaggaggugaaaauagaaugcuaguuuuugauguguuuuaucacuugugugacuauaauugccuuuaguuaauguacuuugguacuaguuuagucuuaauuacuuuauuuuuuauuuuauuuuauuuuauuuuuugagaugggaucucacucuguugcccagccuggagugcaguggcgcgaucucagcucacugcaagcaccgccucccggguucacaccauucuccugccucagccucccgaguagcugggacuacaggcgcccgccaccacgccuggcuaauuuuuuguauuuuuaguagagacggaguuucacuguguuagccaggauggucuggaucuccugaccucgugauucgcccgccucaggcuccgaaagugcugggauuacaggcguaagccacugcacccagccuagucuuaauuacuuuaagacagugaagaaaaaaauccaaaauguuaaaauguaucuaugccuauauccaugucuauauauuuauucauuuccaggucuuaaaugccucuuccucaguauuuuugcuuucagcauuucuucuguuaucuuaucauaaauauuauuuaaaauguagguaguaugucauuccuaauuauuauauuuuaucauuuuuagugucagcauaguccaggauccaaugcuaaccuuggcauuucagugaauauguguauguguacauauguauuauuguuauggucuugucacccaaccauuaucugaucaguguaauuggcuaagccauagaaguaauaauaauaauaaugucauugguccuuaaagugguuggcuaagacuucuguggcuagaacuacaucagcaggcuuaaaaugaggcuugccuaaggcugcuuuuuaaauguuaaaccguucucaugcaugcucuauuuaugcagugauuuugaacuugaucauaguauauguagaguuggagaauggguuuaauuccuuuuaggcacuguguuuuuuuugucuguuaaauggaaaugauaguauugaccugugaaaaccacacaaaaaaaauguaagcaguuacuucugagaauaaaagagacuuuaaugcugaauacuauuuuuaauuauuuuaagcaguuuuuauaaucaaguaaauagacuguguauaaccaaaacuuauugaaaaauguaaauuagagaggcuuauggugcuguguaaaguaaacugauuuccugguuuuucuuguaagauccacuuuuagaauuuuaaauuuuuuauucuaaugauuuucuugcacuaagcauuugauuacuuugcuuuaauuuaggcauggaaguauuuugaaccgagagucaccaacagauaagaagcagaaaguugagcgcauugcaucacaugauuuugaccccacagguaaaacacuauucauucuuucaaagaguauugagaguagugaaguucagaauaauagagcuuaagcuacccgaaacacucaggaauaguuguuugaucuguuuuaggacucucacauuccuccaauuauaucauaauaaagccuuugcauuuaguaggaaugcaagcauuuuuaacuuccaacacuguacauuccacuacagaaguaucauuguagaguauauuguaucuuuaaauagugauaauaauagaaaugguuauauaauaauuggagauuuggucagaucaagaacucaguguuaaguugaaucaugguauaagcaguaauaugucauaaaaccaaggcucuaacaacucgacacuugcguagucaucuaaaaauucaauugugauuauggugaauuggaguuuuagauaaaucaguuucacaaauuaaugauggucucauuuuagaguaaacaaaugaauagaaaucccuuucucuucagucaaaaaguauucugaacuuaaagagcugucuuucaaccuaagcagugucgaucuuuccuaggguugucaccuuaacagacuuucagauugaucuccuuuuaaaacaucuaggcuuuuuccuuuugcuuucuccuuguaagcuuacuccauauuugauucauagaaagugcuugguaaucuugcuuuuuucauuugaaacugauauauauuuuuugugcacauacuauuuuauucaguugccugucccuuugacaagagacgaaguaaaucccgcuaucucagauacauaaaaauaauguaucuauuuuuagguauuuuuacuuagaaauauaauuuuaaauauuuaauagagaauaguauguuuuauuuaucuaagacauuucauacuuuauuaguauaaacuccuuuauuuugaaaaaauauuauaaauauuaucuaggaagcacauagauaaucauuuucugcauuuuggguaguagguaaaaugaaauuccaaucaucaauuuaggaggcuuugguggugggacuauguauuaugucacuuacagaucuccaugaagagagaauuuuccauucugaugccuaauuuuguagucauggggcucagaggcuuucauuuacaugauuagguauugucuugccaauaaggucaaaaguuucugcccuauguucagaaaaauauaaucuuguuagguuuauuuuguaucuacaucugugcugugcccaucuccaaagacagauuuaagcaaagauguauacaaugcuucauaaugagaucauuauagcuuuuagugcuuuugucaucucuacaauuaucaggugauauauuuuguauacuauucauguguuguuuuguuugaacauauuuuuauugcacugucuuuucuucgauaaaucuuuaaaauaugucauuaccugugcuguuugugacuauucuaagugcugucaucuguuauguucauacuuuguguuugcacgauuuaacuugaucaugauucauucuuuuuuccccaugaauuuuuccccuuacauugucuccauauuuucuauaucucucuccuuuucucccgcucuugugcagauagcuccuccaagaagacaaagucuaguucagaggagaguagauccgagauauaugguaagcuaauguagcuaauucagccuugcccuuuggagcuugcuucaugguguuccuuuucuguucuuuuuuuccuuucuuucuuucuuuuuaaauaacugcagccuuucuugugucugcugugcauggcaugaucuacugcagggaaagggagccugggguuuuaacguggcugugauguggaagcuuaagguugcuagaaacuaacauuguagauuaagaguaggccacauugcccaucuucucccgucuuguuuaugguaggaaggugauuaucucuaauauguuugggucagguuccuccaaauaacaugaaugggcuuugaauucuugucaucuucuucccacaucucauuugcagaguuuggauuaugaagaauuugaggaauuaagucuuuuccucuaaguauaauacugguguaauuuagacguauuagcaguucuuuggaauuuuuauuucauuuuuuguuuguuuauuuuuaauugccucgucauguggaaaagucauucuuguauaauuuauccacgauggcaaaaauacguaaguauuuuaucuucauagcuugaagaauuugugccuuugagaaguuucucugaagcuuaaucggaaugggaaaauuucagaaugguaccuuuuaaauaaucuuaacaaagagcaaguuuaaccugaguggucaacuuuugcagcagaugauugaaaugcuaauauuucuagacuguguccugucuuccaaagauacaauaaccauguuugugaaguucauaccuauuuuuccuuuuccuuugcaguuuuauuugcccucuuuccuucuuuuggagucugauuaggguuuuguuuugggguuuuuuuuuuuuugguuuuuuguuuuuugagaaaagugaauaagagaggaauuaccuggagcuaagauuuuaaaaauaauuucugaaagacugauaaauuauuucuuuuuuuaggaagauuccaaauuuggccucgaagggaaaucaggucaucuuuaauagagccacaaaucuauagagcagaagcucccccaggugcagauagauguuuccuagcuugauauauaggagaggaaaaaauacaggaauugcccuccccuuuuuaagacauuugauaauucacaucugcuggcacuugagcccauaucagauacuuuuuaguauuaugaaagcucaguguuugguucuaaaccaguuaauucuucuauguuagauauauacacauaguucuuuacuuggguuuuugugaccagugcuuuuucuguguauaccuuuuacaguaguucagcaguaaauguauacugugccuugugacacaucaaguuuacgcuuuuucuuccuuccagaguauuuuggcuacugauaaguaagaacuaccuaauuccuggagacuauauuucuguucuauauaaagagcuuucuauaguuuauccucuccuuaggaacaugaacauuaucuuuauagcucuauucuuuuucgguagccuuugcaguguucuauuucgucuuccucuccauuuuccuagaucugcgauguguauuuagaagcuuguuguaugcuuuggaugaagacuaacaauuuaggaaccucugacuagaaauacuauacuaauauuuuucuuagcagugauagaaacauuaauacuaguucaggcaugccauuggcuugguagugauagaaacauuuuaagugguaauugggaaguaagguguggcuucucuguguguuuguuuuuugagaacccuugaaauaccuuuuuuggaaggaacugaguccacaaguccucaaaaagcacucaucggagggaugaguugauuagaacagaauuagcaugcuaacguaaaucucuuugacauuacaaauauuuuaucaccugugugaauagacgucuuuagauuacguacaguuagcauagaugaaaaagucucucuggggauucagaaaagcuugaaacuacugaguagaaucauagcaacuggugacauucugcuuuaguguagggucuuauuauaagcccacuucaaacuuuagagauuauacauugcuuucucgggguaaaauucauuagcugaguacuuaacaaaaaugcuaguuacucacauauuauuuauuuuaaacuuucuuggcuuuuuuuuuuuuuuuuuuuuuuuuuugagacaagaucucgcuguguggcccaggauggaguauaauggcgggaucaugacucacugcagccucaaccuccugggcucaagugauccuccuaccuaagacuccaaaguagcugggacuacaggugcacaccacugcacccagcuguuuuguuuguuuguuuguuuuuuuaauagagaugagguuguugaaggaaugauuugccaggggaaaaaaaaaaaagaaagaaauaguagagacaaagucucgccauguugcccaggcugaucucugucuccugagcucaagcaguccucccaaaaugcugggauuaaaggcauaagccaccgcaccuggcuucuuagccauuuuuagagcuacuuugugaacuagauuuacuuugugcaucuuaaaaggaaaccaaguguuugcuuuguauugacuuuuuuuguuacauuucugcccagugcggucaguugguuauuuauuccauuuccccuuauuugucccuuucuaccuguuagagucuauuaaacguguauggaugcguuuucugaucuacaauuuuaauaauacuuaauuuuauuaauacuuuuguggguuacuguaggaaaugagagauucagcaagggaauucugaguuagaccauagcugcugcuuaaccgcugucauggugucugaacagauuccugcuaacaguauuugguucaagaaaauaaguuaugucuuuuuaaagcugucuuaguguguucaggccacuguaacaaaauaccauagacugcuugguuuaagcaauagaaacuuauuuucucacaguucuggagguuagaagaucaagaucaggaugucagugugaucaggucagaagauucccuugcuggcuugcagauggcugccuucuugcuguuugucucacauggccuuuccuccguguuugccaaugcccuuucuuuaguuucuaugauauuacaucaaccugguucuuuauucuuuguaauuauuuugucucucuuuauuugauuguuuuuucccuccuguuuuauacauguaggcaugacccaaguuucuguccccaaucuuucuuccagucuccagucuaagugucccauaaauucagagugaccaaacuggaguucaucauuguucucuacagcuggaaaucagucuuccucuuuauuucccuaauucuuauaaugacacugucauuuuuccacucaccuagucuuauauuuccuuaaaguuauauuugacuucuccauuuuccgucguccccuguggucagcuauuugccagguccccuugauucuaccaucacaauauuuuucauccuucacucuuugguuucaaccccacugccuuguccaucauuuuauuagacuauuauaauagauucguaacuuacuuuuauuucaguuucacauugauucauuaacuuuucuccauucuauauucugccuugacuugucagauuaauauuacuaaaguaagaauuuggucauucacuugcuaagaaaguacagguaguuauuaagauaaugccacaauuuguuuccaauuuauucuacucugauucuccuucagcguuucauuuuccaaaacauguuuuggcauucuuccuuugcacaugccauuucuguugucuugagugaauuaccaccuauaacuuagaauccuacucaucuuucaaggcuuaauucaaguacugccuuuuccuaggauugcccagcuacuuuuguuguuucugaauguugacaucuguuuuguauuuaauuacuuauauuuauguuuaucuuuacaucucccauaaugcugaacauauuggagacacucauuaagugaguuuugaaugaaugauuguugagauugacauaggaaguauuuuaguagagaaaauugauggaauaagaucuucacucauccuaauugaaucuuucuuuccuucugaaaaacuugaagauagaagaaaauguaacuuggagacauuuuucugguaguggucugaaagaaugaaaucagcauacuuggaauuuaaggcucuucuugcuggcaagacugugcauuuagaaucaagaagcuucuuaaucaaaggauuaucugaggucuuacucauaaaacauguaugucuggcaccaguuuaaaaugagcuguuuuuaugagguugcacauggcccuucuccacucccuucccugaagcugauucuuaagagcugaaaccuagagaaguuuggucaugaaauaaaauaaaaggugaagaaagacuaaugugcuuucacuaaagucaauguaauauggaagauuuaacagguuaucuuacauguuuaacacuccauuuucauuaauaugccccacacccuauuuucauuauaggaguuauggccuucuuucaggaacaguuauagaaugacacuucauuuuuuuuucacuuucaaaauaugaucauugguaauuaucuauugaguaagaaggaagcagucuuuuuauguugguuuuaagugccacauuguaauaacagaaaaaauaugucuuuuguuaugauaaggaaauaaaagaaauggauaguauuuauguaaauuugauauaacaucuuuacuucacugaugagaugaagcaugauaucagguuuaucagcuucuaggcaaaauaugauuuuuaagagacaggaaauaaaguuuguuuuguaacuagaggaguuauuuugggguagauggaaaaaucaaauuauuauaguuggaauuuugccagggcagaagguuaauuagcguucuuauagaaauguuccucuacuuugcauagucuucaaggcugugauuuuuuuucuaauuagaaaauguuugaguauuuuauuuaaaauuuccuuuguguauaaaauucaaauuuauuuaauaacuauuuagugagcacccauuacaugccaggcacuauacuaaggcauagagauacaaagauauaagugacucuaccuacuuucugguuguucacagucugguacaaaagaauugcaauacauuuugauaagugcagugauagagauaugcacucauuuaccauuacucuauaugcacuuaaaaaaacagcugugaagaaauacucauauggcaccaagaacaaugggacggaagaaguauuacuaggacuaagucuuuuguuuuuuugaaaaacguguuuauuauuacuguuauuuuuuguagagaagaggucuugcuaaguugcccaggcugugcucaaacuccuggccucaaccaguccucuugccuuggccucccaaaacguugggauuacaggugugauccacggugccugccugucaggauuacguuugaaggaaguuuaacuuuuuauaccagucucacugguuuuacuuuuugaacacucugccugugucuaugcaaagugcuggcauauagcacauaucaaaguaauuagguggccuuacagaacucauauucacagauagauacauuuguauggaaguuaugauuaauaaucuuuauaccagaugauaaaggauuuagcaacaaaacaaaaccauggacuauaugaguuguagaaaucagaaaaaguaaaagugaugaaagcugguuuuuggguuuuuuuuuaauuaaugaaauuugaagauugcuauuuuggaguuaugagucuacuuuuaucuuuggcuuucucuguaacauacagggccuauuuucuguaccauuuucugauucuuaaacauugucauuuuuuucuccauuuguuuucaguauuguccugccaggauuuuauguucuuugagaacagaaacuccaaguagucuuggguucuucacagcaccuaugaacugcaguguuaaauaacuaguauggacagaugcucaaugcaaauuugcuaaaacaaacaaaagaaguaggauuuuuguguguguaugucaaaaaggauaguacaaagauaugauaauguagccaguauuggugauuuuaguucuacagaggguggaauuuuucccucugugguagguuaaaacagcuucuggucaacaaauagaauauuucucugaagaaaaagggaaaacauuucauuugauuuugaaugagagggaacauaauagauuugagcauuugaaggacuggauuucugaauuuugaaugguaggauggcuucguuuucaguuaauuauuaccacagaucuaaauuuaugcagacaccacagauagacaggacagaauaguauuguuaauuugaauuuuauagauucugaauugacuguauguguaacacuuuuuauauuggucuacugauuuaaaguacauguuaaaguacaucaaucucacauuagcagguaaauauaaaauaauaaauguggcuaauacaguggauuuggggagaagaaaaaauugaauaggaugugugcauaguucuuuuuccuuuuccucuuuauucuuugucccucaucuccuuuugcuguagaauuaagagggaagguuaucagacugagacuguuaugaauuggagauaagagauuugcuguauucugaaguaauacuaauagguuuucuugauucuuauuaaucuguuaggauucuaggcauauuuauaaaauugacugugcauggugcuguuuuuuucucuccgaugaccucccuuucugagcuuccuuucaucucuagacuugucuacuugucugaauuucauuaauucauaagcaauuuuuuuaaguuuccuucugucccagaauacaugcaagguucugagauaagauugugaugaagauacagccccugcaccuuuggagcauaaaauccaaugaaagaauaaaaacaaauacaaaucagugugaguaagggugauacaguaggaguacacagagggugcagugggagucuguaagaggggcaccuaacuucaguaugcauauuuaggaaaagcuuguaagaagacugauucuuuucuuaaggacguccagcugucucucaucuucuaaagcugccuauaacaagaagcucugcccuuuuaaauuucccuucugucuuccuuacccauccaaaacuacuuuccuuguuugcuaaaaaacaaaacuuagacauaaaucauaauugauccucuuuuuuuuuugagauggagucuuuguugccaggcuggagugcaguggcgcgaucucggcucacugcauccucugccuccuggguucaagcgauucuccugccucagccuccugaguagccugggacuacaggcacgcgccaccacgcacagcuaguuuuuguauuuuuaguagggacaggguuucaccauguuggccaggauggucucaaucucuugacuucgugauccgcccaucucagccuuccaaaugcgcccagccagaauugauucucuuaaggaucauuugcauuaauugauaggaguuuauuaacauaaaaguacuuacaauuguacuaguagcauggauagaggagaaaauccaaggucaaccuccccuuaaucauaauaaaauaauauuuaacguguaggaacccuuaauauuuguuagacauuaagcuaacuacuuuauauauuuuuuuauucaagugagaggugcaaacauagcaaacuccuugacuccaaauacccguuucccucauguuuuacagguguccuguucucugcaggcaucugaaaaaaggucuauuuaagaagcccagguugcuuagcacugcagucacccauauuagaaaccuuuaauucauuaauuuucagcuuuugugaggugaggugggagaauggagaagcacgaauauaguaugaaaaaacguauucaguguuauaauugccuugauuucuaaagucacaguaucuaauuuauuuugaaauuucaaauaacuauaagggagguugugaaauauuuguuuccaaaagcaagcauggauuuuaaaagguuccuguaaaaugcugcuuagucuaauaauuuuuuuuuuuuuuuuuuuugagauggagucucucacucugucacccaggcuaggcuggagugcaguggugcagucucggcucacugcaaccuccagcucccagauucaagcaguucuccugccucagccucccaaguagcugagauuacagguaccuaccaccaugccaggcugauuuuguuuuaucauguuggucaggcuggucucacuccugacuucauucaggugauccaccugucucagccuaccaaagugcugagauuacaggcaugagccaccaugccuggccagaaucucugauucuauuuauuauaugcuagaauuuauaaagaaugcuuuuuuuaaacuugauuuauauauucauauccuauuuuauagguguccuaauuacuugaaggaaguaacacugaacagauaacaaagguugaauucuaauguguuaucaccugaccucauuacaauuuauuguuuugugagaguggugaauauguuauuuaguauuuagaagucucuagaauuuagggguaacacauuuuuaaauguugaaaaucaacuuuauugagguaaaauuuacauaaaauaagaugcacuaauuguaaguguaugguuagaaaauuuugacaaaugacuaugcauacucauguaaacauuaucuuaagaaacagaacauuuccaucacugcagaaaguuccuucauuucauuuugcagucauucccacuccucuuccgugcuucuccccuaggcaguugcuauucugcuuuuuguuguuuuaguuuaguuuuuccuuuucuauguuggagucauguaguguuuacuuucuuacauacugguuucuuuugcuuaccaugauguuuuuauguuucauccauguuuguuguaugaguaguccuuuucuuccuuccuaauacauuguauggacauacgacaguuuguuuauccauucauccguugauagacauuugaguuucuaguuuugggcucuuaugaauaaaacugcugugaacauuuguguaugucuuucuguggacacaaauuguucuuucucuucagaguaaaauuaauggaucauaugcaaauauaugcuuaccuuuauaagaaauuuccaaacaguuuuccagaauguuagcacauucccaccagcaauguuauaauguucuaagaguucuaguugcuccaccucuuugcuaccacuguuuaugauuagccagacuaguugguguauagugguaucucauugugguuuuaauuuguauuuuccugacgacugcagcuguuaagcaccuuuacaugugcuuauuggccauuggucuaucuuuguaauguguuuauuuaaguauuuugcccccuuuaacauuugucuuccauuauuggcuggagaguugcauauaaucuggauacaaauucuuuaucagauauccauauugugaauauuuucucugugguuugccuuuucauuuucuuuuucuuuuucuuucuuuuuuuuugugacagagucucgcucugucgcccaggcuggacccgccucccagguuggacccgccucccagguucacgccauucuucugccucagccucccgaguagcugggacuacaggcacccgccaccacguucggcuaauuuuuuuguauuuuuaguagagacaggguuucacuguguuagccaggauggucucgaucuccugaccucaugauccgcccuucucggccucccaaagugcugcgauuacaggcccggccugccuuuucauuuucuuaccagugucuuuagaauagcaaauguuuuaaauuuuuguccaguuuccuagguuuuuuuucuuuuaugguuuauaaacccacccuaaggucuuuuuuuaauguuauaaaauauuuuguuacauguauuuuaucuguuuucuuuuucuuucuuucuuccuuuuuuguuuuuuuaauacccuaaggucuugacgauuuccuuuuguguuaucuuaugaaaaauuuuagcuuauguuuaggcccaugaucugcuuuaauuuuuguguaggucaugaguucaaggguuaagguucauguuaagcuacaguaggcucauguacucaugaugugucauuaucagcaaaaauagauauguauauacacuguguguauauauauauaauuuguuauauguauauguuuucuaugagccauuguacacacagucuauauauauuuuuuauuaacauaucuuuagcauaucguuugguugguaaaucagacuuauauuuaaaagauuguggcuuuuuguauaaaaaucuuuagaaaaaguuuuuauuuucuauucauuaucuuuguguuguuuuaccuguuuuauauauugacuucggugaaaugcuuagauccugcaaagcugaaaauauauguugucucuggcuaacacagaguucaagaucuucagaucuggucuaugauaaaacagcccuggguacuaaucaggguucuacccuggcaggacauuucuauuccucuggcuggggcccucuuucucucaccuugcccugacaguuuucauuugcuguuuagaagaaacacaaauucucccuuaggaaucagguaaguauaugaaagagaugaaggaacugguugagcucacagauucuuuaucuuuucuauuuuuuucucuuuucuguuucuguuuucuauaagccaggguuuuucuucccccugaacucuuccuuucucuucccuucuuuggggaauaacuucagguacucuguaagcaccuccuuucuuuuuacuguuuuccugaguauauuuucuugagagugagacuggauuucugcagaauuuuccuugagaugcuccuagccccauguccuaagaugguugauuuuucuuggguuaaacaccaauuaggguaccaaaaacucagggcaguggggcagggggagaauuuuuuuacuacagagaaauagcauggaugugaaugggcuuuccuucuagcugucucaugucuaauacuuaauauuuugcaguuugccauagcuguuuuuaauauuggagcaauucuauuauacuccgccagugagaaaacaguaugugugacucugugguguucuuguguuugcuuuguugauggugguuaguguucuuauuuuaccauguggauuuacaugugcuacuuuuuguuucuccagauggaacacaguuuauuacuaauauauaauuauugucuuuuccuuucucuguuuucucuuccuucuuguuuuacacugugguucuugugcaggucuuguucagcguugcguaaucauccagaaagaugacaauggauuugggcugacggucaguggagacaauccagucuucguacagucugucaaagaaggcaaggcauuuuaaaaaacaauuuaucacucaguaaacagaguaagaauagaaaagcuuaaauaauggcaauugccaagaauagaauaauuacauagauugcaggucauguggacuauugugcuagauucgucuaucaugucauaguuacaggaaggaguuuacuccaguugauuuuuuuuuguacuuguuagaaagaaaucaguuuuuauuuaguuuuagaaaucaugugacuccuuggucaugauacuuuauuguccacacaaaaguuucugaaauuucaguuuuccauggcaccacugauauuuuggcaaagacagauuaaagagauagcuauggcuucagaaauaccauuuauuuucccaaaacaacagugauaauauuuucuacugcuguuaccauauauugaauacuuccuuuauguugggugcuauaauuuugagguagacaauuuuuuuauccccauuuuauaggugauauugaggcuuagaguaaagaaacaucaaaucaguccaaggucacacaacuagugaguggcagaagcagcauuugaauguaaagucugacuuuacagccuuguuuuuuuuuuuuguuuuuuuuuuuuuggagauggagucucccucugucaccagacuggagugcaguggcacaaucuaggcucacugcaaccucugccuccuggguuaaagcgacucuccugccucagccugccgagcagcugggacuacaggcacgugccaccacacccagugaauuuuuguauuuuuaguagagacgggguuuuaccauguuggccaggauggucucgaucucuugaccucgugauccgcccgccucggccucccaaaggacagcccauguuuuuaaccaguuuguuauacugucucucugucaggaagaugaucaguaaaugcaaaugaaucacauuuuaagcaauuaauuucucauacagauggagcagccaugcgggcuggaguacagacaggugaucgaaucaucaagguaaggaauaggcuauuauagaauuuacgguaggauuaaaaaacaacauauauuggucauauucugauuuuuuucacuuggauuuuuauaaaaagcaucauacuucuauguaugauagaucuguugacuauacaaacuuauuucauuuguuuuaaaauuaauacuacccuuuacugaaggacguaauaaaaggauugaaaauaauggaggaauauauguucuugaguaggagaguaauucaggguuggaaagaucauuucugucuagauuagucuguuauuaagcaauucucaucaaaguacaaguugaacauuucuaaucugacaccugaaaugcucccaacucugcaaguuuuugaguaccaacaugacaccaugaauggaaaauuucacaccugaccucaugugaugggucacagucaaaaguugguuucaccagguacaguagcuugagccuguauuaccagcuacucaggaggcugaggugggaggauugcuugagugcaggagcugagacugcagugcacuuugaucauaccugagaauagccacagcacuucaaccugggcaauauagugagacccugucuuuacaaaacaaauaaaaccaaaccaaaacaaaaaacuugguuccaugcacaaaaguauuuaaaauguauaaaacuaccuucaggcuauguguauaagguauauaugaaacauaaaaggcucauauuuaaaccugggucugauccccaagauguaucauuauguauauacaaauauuccaaacuucaaaaaaauccaaaacacuucuucugguaccagguauuucagauaagcgauaccugaccuguaugcaaauagaauuguagugguagaugucuaucugauuauucuuccagaugaacuuuauaaagauauaagaaucacuaaagauaaaaacauguuauauguauguguauguaugagaagagauguauaugacucuaaucuagauauagaccuaccaguggaacacaacagagagacuagaaauagauuuugaauucagaucaguagagaaagaauggguuaguuaguaacuauucuuuaaauaauugacuaauuugauuacuuaaaaucaaauuauuacauaagaaaacauaccaugaaaaauaauuuggaagaaauaucugaaacguaucacagaccagauauccuuaaauuuaaagaacacuuuuaaauuauaagaaaggaauaaauauucuaaaagaaaaaugggcaaagaauuuuaucaggcaguucccuaaaguaacugaaauacauaacauauuaaugaggauauggccaaccucacugauaacaaagaagaagaaauuaaaaugauaggugaaaaauacauuuggcugucagaaaauuuaaagauugguaauacacauuuaguauaguuuggguaugguaaaaugacuauucucaugaguucguugugaguauaaauuagguaaaaccuguuuggaugaaagucugugaauauguaucaaaagccuuuaagaaaguauauaacaugugacaagcaauuuugcuuuuaggaacuuaucugaggaaauaaguguacaaaugugaagucguguguacagggaaauuuguacuggcuuuauuacauaacugugcauaaacugagggacagagaaauaaauuauauuccauuugcagcuuuugaaaagaauggauuaggucaguguguaucuuuauugaaagauagcugccguacagugaaaaaaaaguuuuauuuuuuuuuuccaggaaaaagccagucguaauguauaauguuuaugugucucuuugguguguguauacuagaaaagugucuccaaaauuaaaugucauagcuaacaguaacugccucauggggcaggaugaguauacuuguacuucuguuuuuuacacugauauauuuguauuuuagauaacuuggaucagagaauuaaucagaaaauuaauguuaaauccacauuugauaguuuugccuugauuuguuugguuuaauucagaaucgggauaacauuuucuacauuuagccggucugaaaauuaauuuucuuugugaagauuagaucaugguugaaaaacuaaaagcaaauugaauauuguggaaauacuuauuuuaaaaauuauuuuuuauuauuaauuuugacaaauugaugacuugguaauuaaaagcaaagagaucuuuucuauuuguaugagcccuucaccgugaacgauuuguaaaucuguuucauguuauguuuugucauuugucauggugaauaaguuguacuguuuuguaugucaaggccucgguuuauguuuaaguucauuuuguugcugaauaugcccuguagaaucauggugugaaaaugaauauugaaucaaauacauaaauauuuuaauguaaugugauuacuauauuauauugguuauauuauguaugauaauucuugaagucauuuuauccauugucucaauagaauguaucugacauacacuacuuucguuuucuuacaggugaauggaacucuggugacucauucaaaucaucuggagguggugaagcuaaucaaauguaggugaauguuauucuuaguuuuaauuguuuucugaaacccuuaaaguaaggagcagcaaauuuccuguaauaggccaaauaguaaauauuuaggcuauguggacuauauagucuacugccgacucugucauuguaucaugaaagcagccauagacuauauguaaaugaauggguguggcugagcuucaguaaaacuuuauuugccaaaagucugugauccugguuuagccccuuggcuggaguuugcugaucccugcauugaaggaaaaucugaggugaaaacucuuagcuuacuaauagcuaucuuuugucaacuccauuuauaugguugauuauaauauuccugucauucuugguaauauuugauacauauauuugaaagaaaugcaugagucaccugagaggaaggagguugagaagucagacauauggccugaugaacugaaauggaacuuuaaaaaucaucuagcacaaucacuuucccucagauaaguaaaugauuauauaauccagaguagcgaucuucucuuggaaaucuuuaggguuaagaauuugugaucuucagguuugagugaauagcccacuuggacuuaguucucuguggagaaacaggcuugaagcagugggagucugcagcuaaccucccgucacuugcagggucaaagguggauucacgaaccucgagcuggcagugaguuaugggcaagccaggccucagccacucacagggccucaguuuucccaucugcacagggagaagggaagguucaguggcccugugagcuuugcuagcagguggugauggggugggucaucugaaucugagucagguggaaucuuccccaaccugggcuuugguuucauuuuguuguuauccuuuaaccuuaccugcuuuccaagagagauuuuauguuuucuugguuuuuuuuuuuuuuuuguuuguuuguuuuuaggguagggucuuguagaaugcaauggugcaauuauagcucacuacagccuccaacuucuggguucaagugauccucccaccuuguuuuuuguuuuuuguuuugucuuguuuuuuugguagagacaggguuuugcuguguuccccaggcugcugucaaacuccugggcucacccaucucagccuccuaaagcgcugggauuacaggcacgagccacuauaccuggccaagauuuuauauuuucuaauugcuucacauacugaauggaaaauagcaugacaguuauaacagaaguaaagaaagucacaugagaguccaccaccuaaaauauaacuuccuuuuucuuuguucuggccugguuugggccguauguauuuguuauuguaucucuuaaaaaaaaaaaaaaaaagagagagacugcuugaacugaaugaaauuuuuuuaaaaaaggaauuaaaaaaagaauuuaugaucuucugcaucagauuauuccacaguaaaguagacuagaaauaagagauaguuguuugugaucaaucagaaucacuacuguuuuauuuaauucuguuucucuguauuggguggauggacaucuucaaaagaaauuuaauaaacuaacuuuuuucuuggccuuuuuacugcuauguuaagcaacuaugaaauuuuuuaaacuuuuucaucagaguaccagugcuccaaauggucacuuugaucagcguucuuuaguuuaaaagagugcagugaucaaaauuagauccccauacuugaauaaacuugaccacuuauuuaaugagaaugugauuuauaaauuguuaugugcugcauaaauaugguuuauguuaaugaguuuaugccugauguccauugagguguauaaaaacauuucuuuagcuuucuagguuauauuuuuugcucauuccaguauaaauuuuacuuaaaaaauuaaauccugggauucuagcaauaaauuacuuacccaauaguaagggcauagcuaaaaacuuaaaguaaagcauaaaaaccucugcauauccaaaacugauguaaauuugacaucacaucuguaaagccuggguguauguaacagaguuccugcauguccuacuuucuaauguguauucuggauauaauaaaagugauaucaaaucagagcaguuuagaaacagcuaaagaaaggaagggaaaagcuaggaagcuauuaaaaccaaauacauaggcaagugagauauaauagaugacuuucugauagagagcaauaagauugaagagccuuagaaaguguuuauauguaaaauuccuccaaauuauaacacuugugaguauuauacauagcaaaacuaguuuuuagaacaccaaaacacugugaaauaauugauaaugauuuccaugggaggguuaaauugggagacaagugugaaauacauuuaaaaguucuauugaaauaucuaagaaaaaaguuuugccauaucuauuacugacucugauuaugguguuuuuuuuuguuuuuguuuuuguuuuuguuuuuugagacgaauucuuguucugucacccaggcuggcgugcaguggcgcaaucucggcucacugcaaccuccgccucccagguucaagugauucuccugccucagcuucccuaguagcugagacuacaggcaugugccaccacgcccggcuaauuuuuuguauuuuuaguagagacuggguuucaccauguuagcaaggcuggucuugaucuccugaacuugugaucugccugccucagccucccaaagugcugagauuacaggcaugagccaccaugccuggccugauuauggugauuuuugcugucuagauucccgccccccgcaauaugucuacugaauuccuguccauuccuccaaauauuuucuacuaaaauuuacuacuuauuauugauuguguuuuucccuguuauuguggaauauuuuuuggucauacucauuuuguaaaguuaauuuaaaauugcauuuuauguucuagcauauucacuaaacccugccuaguuagugucaucuuaaaauaugaagaucuaggccaggugcugugucucacaccucuaauccuagcaccuugggaggccaaggcggguggaucgcuugagcucaggaguuuaagaccagccugggcaacauggcgaaacccuaucuuuaaaaaaaaaaaacauugcagcuacuugugggggcugaggagggaggauugcuugaacccaggaagucgaggcugcagugagcugagaucgugccgcggcacuccagccugggugacaaagugagacccuaauuaaaaaaaaaaaagaagauuuaaaaaauuuacauuuaagaaauuaauuaaacauagccacuaauagaugguugauuuuaacacuccucuaaauaaagaaaauauauaauauauucuuggaguuauaaauuuuauuugcuuuuaaguaauaucugaucuuacuaguaguaacuugcuaucugaaaacggcaucauucuuuuggauuuuuagggcagucauaaaagagaaaugacaaauuaguuuuuuuuucuguggagacaugauguagcagaugaugggacugucuuacauaacuggaucuuuuagaacuaucgaagauuaaguaguaaaaugguauaaaaaguuucuugacaauguuauuuucccuucccuucccuuuuuccgucuccccaccccaagcugguuccuauguagcucucacuguucagggacgcccaccugggucgccccagauuccacuugccgacucugaaguagagccgucagucauuggacauaugucucccaucaugacaucuccucauucaccuggagcaucugggaauauggagagaaucacuaguccugugcucauggggguaagaauggggaaauuucuuaguuaaaugcucagucuuauaaggauguguuuacuuuauauggagaguuuucaaguauucggcugaugaacuaauuaaauuuaagauuuuagaaaaugauuuacuaauauaaaaauuacauaauaggaaugauuagaauauugucauagcagauuuaauuuaacaaguauuagacaccugccauauguaaaacagugugccacccacagaaauauaguuaagguacucuauguucaagauuauagucaucuuagaauguguacuuuuaggagggcggggauuuuuguuuauuuuguuuacuguuacguuuccaguaccugaaauauugcuuagcauguagaaggugcuuaacaaagcuuuguugauugagauuaagucaagaguauacaaguaacuauaauacaaggcagaauguagacauuaugagggcaaaaaaaaugcuaaguucuaugaggauucaaaggagggagaaagcacauagaagaagaacaauaaauagaaggagccaaaaaagcaucaaauauuguggagaaguagcuaggauuuuugguugguuggugccuguuaaggaugugcauagugggagaugaacuugaaaauaguagguugacuauauauuuugaaaagucacaucucccaagcuaauuuacauguaacuagauaagcaguaagaauccauucaauguuguuucuuuuuaagcaaaagaguacaugauuauccuaggauuauaggaagacuaauuugguaaaauauuauaggguugugaaacaaggagggaugaugggugaugaauuagggagcugucuucauauuucagguaagagguacugggaguuugagcuaugcauggggaucgauaguaaagauccaaaugagggaaaguaaaagauacuauucuuauacuaagacaacuucauuucuccaauaucaauauuuaguguucucuugaauccaguuuaguaaaaaugaaauagaagggcagacauuuccuuguaguuucuuguaagugucaugucugaaagccuguccacauaacccggaaguaaaaaccuaauagguauugauaauuggagccgaggcagaacuuuguaugccacauuuucucuauuuauuuuagcuucauuuugucuauacugguuguuguuuguuuuuuaucuuuuucuuuucuaggaggaaaacaaugugguucauaaccagaaaguagaaauucugagaaaaauguuacagaaagaacaggaacggcuacagguauuaaaugagaaguagggcuguuuacaggccaauaaaaaugugagugggcaugguugaguugguguuuaucagucacaaucaagcagcauuguaaccaaugccauuaguuauauuauugauuaagaauggacuauuucuguaucuuuuuuacauaaguaauuaauucugaaaauauuuuuauaacuuuucaguuauugcaggaagauuacaaccgaacaccugcccaaagauugcuaaaagagauccaagaggccaagaaacacauuccucagcugcaagagcaguuauccaaagccacaggcucugcucagguagcaucacuauuacaagugcuacccaacuuuuugcaggagaauuuucuucugggaaugugucagagaauguugcaguugccuuuuuuaaaguuauuuuucuagcguaggacaacaggauguccuguuaaggauguuacagaaguaaugauuaacaaaaauaaaugugggcgucugauuguuugcuugcucaugagaucacauuucuuuguuccauaauaauuuaaaaaagaauugagugcuuuugcuuugaugugacaaacuacuaaaauguauuuagauauauauauauauuuauauuuuuugugguucauucugccaucuuaaaacagaauggcaguugauauguuuuuaaauaggaauuuaagaauuuacaacaacaggcauugagcuaaauauauggacaagcauuuucuuauuuaaucugcauaacaucucugagguuacuuaugguuguuuuccuccaguuuacauauauacuuagagagaguuagagagauuaaaugacuugucugaggucauauagcugcaaaguaauagaacuggaauucaaacccagucugaggauuuaaaagcacauucauacucuuaaugacuauauuuuuauuguaauuuaaaaauagauuucaguagaauuugcuguauaguuauaagcuauagagauaauggucucauaagaaaaaaaaagcucagcauuuauauguuaaccagacuuacauucuguaauauucagauuugggauauguaaagcaccuuguacuucaucuuaaagcaaaguagauaaauugccuauacauuuaaaauagguaaaagcuguuuuuuugucacuguucccgaguuaaaucugaagggaaggcugcauauucgcaaaagaauucuuugagaucaucuagccuaaucugcuuacuuucugauuuaaaaaaauuauguuauaauugagaaaccuagggucuaaacugguuaaaucaccuauacaaggccauacaguauguaagguccccugacauccugguuuaguguacuuuucauuccauuguuuuuuucauuaccuucagucccaguagcgaugucacauuuugaguguuacaccucaguaauguugacaguuuuauguuauuacuaggcaaauauaauauucuuacccuguuuggacagcaaucuaaaugcuuauaaccuggccaggcgcaguggcucacaccuguaaucccagcacuuugggaggccgaggcgggcagaucaucugaggucgggaguuugagaccauccuggccaacauggugaaacuccgacucuacuaaaaauaaaaaaauuagacaagcuugguggugcaugccuguaaucccagcuacucgggaggcugaggcaggagaauggcuugaaccauggaggcggagguuacagugagccgagauccugccacuacacuccagccugggugacagagcaagacuccaucucaaauuaaauaaauaaauaaaugcuuauaaccugaucuaaaugcuuauaauaauuuauguuauaguauuauguccuagaauuggccauugauugacacucugaagcauuggaagguaguuaacaagaaacuauaggguaauaaccuuuauuaaugggcagacaauauaaauuauauaaauauaaauuacauaaauuaacaaaccauuuuaucuuuuugcuauauuuagaaguuugaacuuacauucuuuuuaccaaaauaucacuugcccugucuuuaaggucaugacauuuuagaauaccggaauuaguaguuauuuauggauuuuacucguagaauuuuaaacauacuugagcauaucagaauguccaacuuuuaguagucuccauguagauuguaguaccacuauuucuuuaugcagcaaguaaugaaaguuuucuuuuauguguuugugugcgcguguuuuucuuucaucuguuuuaggauggagcuguaguuacacccuccagaccuuuaggggacacccuaacagucagugaggcagaaacagauccuggagauguacugggcaggacugacuguagcaguggagaugcuucucggcccaguagugacaaugcagauguaagcuuucaguuuucuaaaucuuuuuucuucuguauucuucuuuacagccccuuucuagauuugauuuuaagugaugugaauuagaggugucuuagcacuuuuuaccauccccauuuuuaauguaccaauuugauaaacagaaaucugguuacuguuauauauaagcuuuuaauuccagaguucacuuuuucccuugaacacccauugccaacuguuucuuuuacagggauggaauuucccagcaggcaucuuguucguggguagagaaguuacuaaugccagugcauuuuuacugaaccgagagaccaacuguugauaucuuuaagagcauguuaauauuccauuuguggucagagugacucagucuugaaucauggggcacuuugccauuaccaagaggaaaaaccucaguccuguuagauaggcuucaguuaauagcccagguuuagugacagcacuuucuugauuaacccagaaacugccagaugaacaugacuaucuguuaagaugauaauaaaacauuuuaagcugaauaugauguaacaccauagacauaugaauaccuaaaagcuaaguucaguauuacuuacccagcaauacuuuguaaauuguaugcagugguaggaauaaugacuuaaauguagaucacccucuuuaaaagugaugagggaagaagucugaacgaauguuuuguaauugugggucaugaaaucaauuuuguggguuguauuucuuuuuuaaaaaaagaauaggaaauacagugcuuugcauauagaagaggugucacuucuugggacuuuuguuacauauacacacaucuacuauuuaacaaugugaaguuucucucuuauugaagguuguuguugggggauuguuuuguuuuguuguuuuuuaaaaaggaagccguggucuaagccaucauucaggcuaucucuugaggcuuaggcccaaugacccaguuccucaugcaaaaaacaaacugaggauuuguggguuuuuuguuuuguuuuguuuuguuuuuuaagguagugauaggagucuugugauuggguuagcuaaagguuuuaauggaaaauuucaauuugggcucaaggaaaaaaugguagucacuaauauuuguuggguauaugucccauacacggugauaagguuuuauguuccuuaguuaauucucaaaacagccuuaugaaguaguacuguuguuacuguaacuuuacaaaagaaaaaauugaggccaaagggaguuaacuaacuuuccaaacuuauucaggcaauaggugaucuacuuccaccuagcuccaaaauaccaguaaucgaaauauaaacaaaagcacugagguuugaaaaugcguaacauuuugagagagcagugagaauuuuagggcaaccuggcauauuaggguuauagauggaauggcuagagauuaucuuagaagccaaaucaugaauccagguuauaaagggcuucaacuuguucuagcaguacauaccgcuuuugggaaugcuuuucguacucuucuuuuuguuuuaguaaugcgucuccucgcuguuuucauggcuugucccuaccaugagaugggaaguuccuugagagcagagggacugucuugucugacuuuauguuuccaaaguguagcaaauuguaggcauucagagcaaaugauacgaaugagaaauuugaauuuuaucuuguauuuagaggaauguuacaauaaaacaugugacuuagaaauauaaccuuauaaaagagugaauuguuggcugggcgccguggaucacgccuguaaucccagcacuuugggaggccaaggcaggccagucacaaggucaggaguucaaaaccagccuggccaacauagugaaaccccgucucuacuaaaaauacaaaaaaaaauuaacugggugugguggcacacgccuguaaucucagcuacugcagagucugaggcaggagaacugcuugaaccagggaggcggagguugcagugagccaagaucgcgccauugcacuccagcaugggugacagagcaagacuccaucucagggguggguaaaaaaaaaagagugaauuguuuaguauagaaauaggcauuccaaucaauuaagacuguuugacauguaauugauacuuaguauuugaauacaugaaaucaaugaauaaagugggcuuuaucuugcaugcagaagagagacaccaucagaaacauaucuguggaaaaugauuugguguaaagagggagaucuguaagaaaagaagacugcuuggcuuaauaggaacuuuaacaaaugugugcugaauggauaauaguuagcauuuauucaguaccuacuuugugccagagguuguacccaaugcuuuacagauacucuuuuuuaacacucauaauaaucuuaaaaaagcaguaucaccauuucauagaugaggaaacugaggccaaauaaauaaaugaauauuguggaaauccgagugagaaaugauaaaguccaagcuaggcuaucuucugaacacagaacacacagguuuaauuucuacaagugucugaggcuaaagauguguugcuuuuagcuuauggauuuccauguuuguuucaauuuuaaguauggaggacccggucugcuuuuguuguuguuuuaacaguacuuugagucgcgguuuuacauuuuaucuuuugaaucagugcuuuuaacuuuuuucauugucuucucauuuuuauaaaauaauuuccuggugguguuugugaaaguucccugcuuuugcuuaccuuggagaaggcuuuaaagaaugcccugauacccaguucucacaagagaagcaacuugguaacaaaucaucaucugaaauucagagcaucuaucauuuugauuuucaguuugugagugauauuuuugaaaaauuauuuauuuuggaaaauuguuaaacauauucaaaaguaaagacuaacauaauccuccucaugucccugagaaccuagucucagcaguuuuguuuguacccccuauuccucacauccuccaaacaccagauuaaaguaaauccaaggcauucguuuauuaauaugucucucucuaagagauaagaaguuuuuaaaauauagcuauaauauucuuauuaaauccuaagaauuaauauuuucucaauacacaauuuuauuaccuuguuuuauaaugaucuuuuuacaguuuauuugauucaggauccagucaaggcuuucauauugccauugguuaauaagucauuuuaagucuuuauaauuuauaauaguuuccuucuuuuuuuuccuuggccauuuguuguugugguuguuguuaaagaaauugagucagauguucaguaaaacaauccauuuucuaauuauauuuucauggugucguaugacauguuccuuuaucuaaauuuucuuaaaacuccuaguuaaaucuacaagucuugaucacauuagguuugauaguuguuauuuggaauaauucauagaugauacuauguacaucucauuauaucacaugaggaugugaauggcugucuuacugugguuguaagcuuaagguguuuaggugauaucaacaugauuuccuucauuauaacguccccugucaagcuuuuuuuuuuuuuuuuuuuugagauggagucucgcucuguugcccaggcuggagugcagugacgcaaucucagcucacugcaaccuccgccucccggguucgugccauucuccugccucagccuuccgaguagcugggacuacaggugucugcuaccaugcccggcuaauuuuuuuuguauuuuuaauagagacaggguuucaccguguuagccaggauggucucgaucuccugaccucgugauccacccgccucagccucccaaagugcugggauuacaggugugauccaccacucccggcccccaagcuuuugugaaauguuuucacaugccauuuaugaucaaaaugccuagauccauuguuuaauucagaguuucaaaaggauauuauuauaauuuugucaguauuucuguauuuauuacauggaguuauguuacaaaaaaugauuucccuuacuagcuaauagguuacccuaaaauacagcuuauacagaaaauguaggguaaauacuucucuugauucuuuucagaagaguuuuuucaggagagaugauacucuuacaaacuccaaaggugacaagugggaaggguauauguguguaauauuuugaacucauagauuucaguaugaguuacucuuuucuuuuguuggugggagcccccucaaauuuucuccuguguucuuuugacaugccccuccaauaucuuugauagcuuucuugcuuuuugugacagaauuauucuaaucuuuuauauaucuuguccaagaccugaaagucauucauuucuccaagguggggcauacauuugaaagugcuguuuucucuugguaacagaaauaucugugauaccaccaagauaucuugcuauaugcauagguaaaauguaucuucccuauuggcacucguuaggucucugguuccucauuuucauugcucuaaagaaugucucccguugcuuugggguguuccucaucuccacaaagugaguuucugugucucauauaguucauauuuuauacagaaguucucaguauuuguggacagcaucuguggauucagccaaccauuuaucaaaauauucagggauagaaaugcaucuguacugaauaugcacagacuuuuuuccuagucauuauccccuagacaauacaguauaacaacuauuuauacagcauuuaugcuguauuagguauuauaaguaaucuagagaugauuuaaaauauauagaagauuugcguaugcaaauacuauaccauuuuauaucagggacuugagcauccauucccccacaaacacugaagaacaacuguauuagguauuauacaauaccauauaaauguauuaaaauccaccuuucacaugaagcgaguaacagaauaguagaagcuuaauuguacucauaaguagggcaaaaugcuuuuagcuuggauagaaaggauaguuugagaagguaaggauuaaggaagauaagagaguuugauuuugacauaaugaguuugagguaugcaguauaucuaauuauuugguagaaaaguaaccuccaggccuggagauuagguaaaauuguuuuguugauucuguauuguuuaucaauauaaaauugaaaaggugagagaauaagugacuugccaaaguaaggaaaaaguagcagaaccaagcauuuuacgaaagauauuuaguaguuguaaauacaaauaugaaauucagaacaauuuuuuuuucacacuuuuuucccucaucuccuuuuggugugccuauugaaaugaacugaagaucuuguuuuuuucauuagagucccaagaguggcccaaaagagagaauuuaucuagaggaaaacccagagaaaagugaaacaauucaggacacugugaguaugaaauccaugcaaugauagugcugucuuuggcuuuccuuauacuuaaaguaugguauagacacaucugauguuuacauauuuuauuuuuuauuuuuuggaaaaaaaauuaaaauuuauuaaagaaacuuaauaaagauuugaauaagucaagagauauuccaugguuuguaaguauucuuagguuccuucauauuugucguggugguaacauaaaauguacuaguuuaaccauuuuuaaguguauaguggcauuaaguauauucacauuguugugcgaccaucacugccaaccaucuucuccaacugcaauuugguacccgguaaacacuaagucuacauuucccccuucccccuagccccuggcagccaccauucuacuuucugucucuaugaauuugacuacuuuagauacucauguaaaaagaaugauacaauguuuauccguucaugacuggcuucucucacuuagcauaugucuucagcuuucauccguguuguagcaugugucagaauuuccguccuuuuugagaccaaauaauauuccaugacauguauauacaccacauuuuguuuaucuguccguuugucaguggguacuuagauugcuuccacuuuuugcuauugugaauaugcugccuugccuucaguuuuuguggguguucaucaagaagaagaauuguuugaucuuacguauucuuaauugcaugcuuuuaagcacucugauuuuaucuucuaauuacauuuauuuacaguuuuguaguaaaagauacaacagcauuuugucaucuuuuuauuguuagcaacauaaggacuauugaaaaaucagagacaucaaaucaguuauaaaaucaaaauugucugacuacugcucgaaacuaauuuauguuguuucaccuaauuucuuuuuuuuaauuuuuuaauuuuuccuuuuuuuaaagagggaguuucgccauguuggccaggcuguucucaaacuccugaccucaggugauccacccgccucagccucccaaagugcugggauuauaggcaugagccacagugcccggccaguuucaccugauuuuuuuuuggaauauuaaagccuugagguuaaagaaaauaauaagaguuguuaaaaggcagaauuguguuuaggagacucaauauguaguguugcaacacuaggaggaaaaacuacagguacauauuauucacucaguuuaaaacuugcggaucuguuuauacaacuucagcuauagccacuauaacugcugugcaaaugacucucaaaucauaggccuacccuucuuugcugaacuccauccagaucuugcaauguuaaacugcuguuagauuuaagccaaacucauuuuuuuccuauuucuuccaaaauuuuuauuccccaauccuauauggucuuuaauuuuaguacuuauggucuucagacauccuguauguauguauguauuuauguaugcauguauuuauguauguauauauguaugaaugagacagagucuuacucuguugcccaagcugcaguacagagguuaacuguaaccucaaacuccugggcucaaacuguguacccacuuuggccucccaaguagcuaagacuauagacacacgccaccacgccuggcuaauuuauuuugguuuuuuuagagaugggucuuguuguuuuucccaggcugguuucaaacuccuggccucaagugauccucccuccuugaccucccaaagugcugcgauuacaggccugagcuaccgugcccagcacccauguuuauuauuuuauauauuaaugccucuguacugccguuuuugugcugaaucuaacuuugugaguugacaaauggaggagcuauugcaugggaaacuaucugacaaucuacaauuuauucuuagaauuuuguuaucuuuguuucuauagcaguguuugugagauuacuugaugauuuuagagcauuguaucagugauuuuucaaucaagagugauuaugccuccguggacauuugacaaaugucuggaaacgcugcagcuggcaucuggugggugcauagaggucaggggugcugcuaagugucuuagaaugcacgggcuagacccuacagccaagaacucucuggcgcaaaaugucaacagugccgcaguugagaaacccugcauuauacauuuaugaaaauuaauuaaaaaugaaaacauagaguucgaugauagccuucaauuauguaucauuaauggaaaucuuggguuaguacuucucagguauauuagccucucugcuaacuuugucuuaccauuucugcucuuauuuuuccuuucuccuauugucuucauucacuuuuucuuuaauuuuuuaauuguaaccauuuauguaagccaacuuuauuuuuuucuguaagaaguuuuaaguauguaugaauuaauaaaagaauguacagaaguguacagaaaguguuaaagucagauaaccaaguguauagugagcaaaggauauuuacuguuuccaaggggagugguuuuuuccccccaaaaaaaacucguuguuguggucuuuuucucugccagagugguacauggccuugaaaauuugugaaccccuacuuugaaaauaaaguacuucaaaggaaauaaacaaaaagaaaucucaccauuuaagugaaccaugucuuuuugauggguuggcuuuauucuuuuucuaaauuugaccaccagguaauuuuucuguuucuuuucccugaauguugccaggacacucaaucacuugucggaagucccucaacccguauagcaccucauauuauuggagcagaagaugaugauuuugguacugaacaugaacaggugaugacuuuuuucuuucuaaaaaauagauuguuacuuucugcaauaucugauuuguugcaaaaaugagcacguucuggagauuaagauaacauuuguaaggauuugaagcuaaaucuuagaaccaauagcuccuuggguuaauugcuuauuuuagcuuugaccaacagaaaugaccuugcuuuuaaagccagugagagaucauuaauauauguuuaaguacuucauuuuauugggguugaguguguuucuuaaaauaguauuuuuaaaaaaaauuucaaaucccaguucauuggugcuauaaaggaauaugauuagcuagauucuuguccuuguauccugugaucuugcuaaauucacuuauuauuucuuggugcuuuuaaaaauaagucuuuuggaguuuucuacauagauaaauauguugucuauaguuuuuauuuccuuauuuucaagcuguuuaucuuuuauuucuuguucuugccuuuauugcacuggcuaggacuuccacuaugagguugaaucagagugacaagacaugcuugccuuauuccugcuauuagggagaaaacacucagucuuucaucauuaaguaugauguuagcuauaaguauuuuuuagaggcucuuuauaagguuaaggguuauuagguuaaggaauacuccugguuugcugagaguuuuuaucaucacuggauguugaauuuuguggaaugagauuauuaugugguuuuucugauugucuauuaauaugguaaguuauguugauugauauuagaauauuaaacuagucucgcauuccuggaaugaaccucaguuggucaugauauguuaucccuuuuauauauugucgguuucaauuugccauauuuuacugaggauuuuuuacaucuuuguugaugaaggauauugguguguuguuuuucuuuuuguaauaccuuugucugguuugauaguuggggguaaugcuggucuuuagaaugauuugggaauaugaaaauugugaugcuaguuuacauuauuauuguuuucuguguucaguauauuuagggauuauacaaauauucuaggauuugucuuacuuaaaaucauacaacuucauuucccaccauuucugcaauuagcccagaagaaaaggauaaacagcuauuuuaugauugggcaaaaagccuuccacugcauuucuagaaauguuagacuguuuuuuacauacugauuuguauacauccgagcuacuugauaaucgucuccuaaauuuccguucucccacaguggucuuucuucuaaccuauccccaagaggugguuaauguucacagaaagagauuccauagcuucuguugcuaauaaauuuuagugaaguuuuuuaaaucuugaauuuuuuauagggagaucaaagugaaauuuggauagcuauguucaauugagccuacuuugcauuuaguauuuguauguuggaguuacugaugcauaaucauuucuuccucuagaucaauggacagugcagcuguuuccagagcauugaauuacuaaaaucucgcccggcucauuuggcuguuuucuuacaccauguaguuucacaauuugacccugcgacuuugguaauauauuuuacaaucuagcagauucagaguucuucuguugauucaugugccauagaacuuuuccuagcuauacaacgagugggcagacuucuuucaguuuuccguauaaagacagauacaaaagauaauuaaaacauuauuuuuaaagacuugguuauauaguaauaacuacauuguuuauggugaccuaccuguuccagacauuccuacucaauggugaccuagcaaauuacauuuuucaugguuccucauuuugucuuuuucauuccuuucuccacuacagcucuguuaucucuauucagaccuguauaaacauaccaauuccaaagaaacucgucgcaucuuccuugaguuucaucaguucuuucuagaucgaucagcaguaaguugccaaguuaauguuguaaucuuugccuuaguacauggaauuauuguccuccugcuuccuaucuucccucccauguuuuuggauuuuacugugcuuucucacaccuguauuauauuucaauuauugauuacucuagacuuuuuuuuuuuuaucauuucuaaaguaguuuaggcauaugaauucucacaguagguuuuaggggauuauauauauauauauacacacacacacacacacacacacacacauauauauacacacacacacacacacauauuuguguuuuuugcaugugcauaauuagagugaggaaaugaaaaagggaauacauauauauuaagacccaaggaauaauacuugaauaacugaacucuggguggccucuuugaaguuuggaggcauaauuuuaacuaaaaaguggcagaaaagauuucacuuacacugaaauaaaugaugauaacguuauauuuugucauuaaaaguguuaauaagguuuuuaaaguaguaaguuuuauuauuagucuuguuauggguaaauagcaccuagcccuuaaugcauacuggauaaucaugccgcaggucccuaguccuuucacauuugcaguucccuuagacgacugccucaugcuuuuucccuccuaaaaccuccaucacuuccuuuccuaguccuuucucagcugauaaccuugaccuuauuguuucucugagaaauuuaaaguauauagaagagaacuucuaccagauguaucaucugcccucauuauaccauaccauguacucuacucuuucuccugaugcuauggagugacugucuuuuuuuuuuuuuuuuuugagacagagucuugcucuguugcccaggcuggagcacaguggcacgauugcaccucacuggaagcucugccuccugggcucaagugauccuccugccucagccucccaaguagcugggacuacagguguacaccaucaugccuggcuaauuuuuguauuuuguagagccgggguuucgccauguugcccaggcuggucuugaacuccuaggcucaagcaaucugccugcuucauccucucaaagugcugcgauuacaggcaugagccaccgcaccuggccuugauuguccaucuuuuauccaaggccagcucugcuccaguuuacaguguauuuccuuauaccuacucaaagaucuuacucuaacaauuauccucccuucuccugcaucaucgguuuuauauuuucuacagauaaucauucacauuagucugcaaauguuguuauuuucccuuucuaaaaacaaacacacauuuuggcucuacuucucccuccaacuccugccccguuuucuuuguaugccuuuacaaaauugucuguacacuuucacauucaauuaccuacucagugacuuuccuaaccaaccuacuuaaaaucucaacccuuucacuuugucacuuuuucuauuauuuuuguccauagaacuuuuauuuaguuaguuaguuuguuuacacagucagucuucugugccugcagcuuccacgaauucaacuaaccaugguugaaaauauucaaggaaaaaaacaaaagccaauaccacaauaaaaaaugaaacaauuuuuuaaaaauauaguauaacaacuauuugcauagcguuuacauuguauuagguauuauaauuaaucuagagauuuaaaguauacagcaagaugugcauagguuauaugcaaauacagugccauuuuguacaacggacuugagaguucgcugauuuuaguauccauggggguuccuagaaccgguaccccauguggauaucaagggaugacuauauuccuacucuccuacccugaauauaaguuuuauuaggccagauauuuuuauucuguuuguucacugcugugucccuaacacugaacaguuccugggacauagcggggucacuuaaguauguguuaagugaauuaguguucugauccuacucccauuguuuaaaauauuguguuauuuuuauuaaaauaauuuacuuuccuaaaaaaaugacaauauauugaagcauguuugaauuuugcauuucuuaagagggcaccaagcuaagucaaaacuuuacauuuugcuacacaugaucuauauaucaauauuaaaguauaagaagaauccuuacacuuugauuaauuugcuaauuauacuuuuaugcuacagcucacauuuauuucauauauacaccaucauacagaaaugagcuuuuauuacuuuuuugcacuugagcuagaaaugcuuuuaagaaaguugauuugagcuacugccugucaaagagaaaguuuuaaaauccauuuuacuuuucuucaaaugaauauaaagagaucuuacaauuuuuagcggugacuuauuuucaaauuuaaaacuucagaucuuauaggauguguuuaaauucugaaauuguaugacuuaaauagguauacaauacaaaauaagcaggaagagguuaagauauuuucucuuaaugcaaaauaauaaaguauuccccuccauuaguuugggggugggggaaaacaacagacugguaauuauuaugcaaauauuauggggaaaauccuagcuaggaauaaguaaauucuaagauagucaccuuauuugguucaguagcaagaacuguagaugguugcuggagauuuaaaacuccaaaaacucaacauugacauucaauauuuucucacugggagugugacauugugagggcucuuaaacuuuacauaggaaaacgauuaggaauauuauuggucuucagaaugagcaucucaaauauaggaaagaaaaaucauggcuauaugugaguacauuuuucauaugauaauauacacauaauuuagguuuuaccuauauugaucuaaaugacauauaacugauuauauugaccaaugauucuaggaagccaaagccaaagccaguauauucauuaagugugucacagaagcauucagucaucuagcuaaacgacuguagacuuuuccuuuauagcaugauccucgggaaaagggcucauuuucaaguuuaaacgauagaauguucuggaguugugaaaugugaaugaauaaaugagcuuguacuugauugugcuuguagaguggguauccaaguuguauccccuuacuuuacagaaguacuuauguacaucuucaaauaucuuuagcguuguuacaccuuuuguuugcauuucauuuuagcaccugaaaguuucuguuccugaugaaaugucugcagaucuagguaagcuuggagcacuaacauccuggagaauuacaucuuaauagauauguagcucagcucaucuguucagguuuuaucugucacauggugacuagucgaucaccugaaucacaacagaaagacagucuauaauacauuuaaagaguaaaugaggccgggcguaguggcucacgccuguaaucccagcacuuuggaaggccaagguggguggauuaccugaggucaagaguucgagaccagccuugccaacaugguggaacccuguuucuacugaaaauacaaaaaugagcuggcaugauggugcaugccuguaaucccagcuacuuaggaggcugaggcaggagaauugcuugaacacaggaggcggagguugcagugagcugagauuaugccauuaacacuccagccugggugauaagagcaaaacucugucucaaaaaaaauaauaauauggcugggcgcaguggcucacgccuguaguacucccagcacuuugggaggccgaggcggguggaucacgaggucaggagaucgaccauccuggcuaacacagugaaaccuugucucuacuaaaaaacaaaaaaguagcugggcgugguggcgggcgccuguugucucagcuacucaggaggcugaggcaggagaauggcaugaaccccggagguggagcuugcagugagcugagaucgcgccacugcacuccagccugggcaacagagcaagacuccaucucaaauaauaauaauaauaauaauaauaauaauaauaauaauagaguaaaugaaaucagaauucugggaugaaauauacgaacugcccugaagaacuucccucuggcauauucuaaguuaauuuguacgaaguagcauugcuauguugccaauuguauguugcccagaacauaccuuuagauaacauaauuccuuucauuuaugaagaaaagagaagaccugagcucauuccugaggaucugcaucgccacuauauccaaacuaugcaagaaagaguccauccagaaguucaaaggcacuuagaagauuuucgguaagcuuagugguagauagaauuucauaugauuauucuaaauuaauuuuuuuaguuaagaaaaaguugcucauuaaauacuuagcuuagcacuagauaaaccauauggucuuauuguuauuaaaacauaaugaacaucuggagccaaaggguuagaguggaacugagaguccagacucuccauuccaggcacuugcaggaucugagcucagugcugugucuaugcuaaguguguuccuuuaagauauuguauguguucuuggagucauugcuucuagaauuuuuuccucugguauccuagaugacauggacccauaaguggaaaagugacauuuuuccuguuccuagaaaccauagcugugaagacugugaugaagcguccccagaaugagguaguuuuucuuuaggcuaccucaggaaacuucucuauucccuucaggcagaaacguaguaugggacugaccuuggcugaaagcgagcugacuaaacuugaugcagagcgagacaaggaccgauugacuuuggagaaggagcggacaugugcagaacagauuguugccaaaauugaagaaguauuguaaguaauagaaguauauguggaaaugcccucucugcugagauacuaguuaugcuugaaguguccuuuggguagguuuagaaaaacugucagauuguguauguggagccguuuauuuugucauaguacuugagaaacuggauuuuuuuuuucuuuuuucugauacuuuuagauaaauuucuuguguuccuuuuucuggguggugguaaauggguaacucuaaaacuucuaaucagugaucaaaaacagguugauuacuuucauuauuuucaauuuauaggccuuggaaauauuucuugccaugaagcauauacaguuggugacaugagggugaaacagauaagguucuuuaggggaucaggguucuuuugguauuuuauucuaggguguggcccaaagcauuuggcucuguucuguuauuucagguaucugaguuaauaacaauuuuuaaggccaggcaugguggcgcacuccuguaaucccagcacuuugggaggccgagcgggcggauuacguaaggccaagaguucgagaccaagcuggccaacauggugaaaccccaucucuacuaaaaaccccaaaauuagccaggcaugguggcacuccuguaaucccagcuacucagaaggcugaggcacgagaaucacuugcgcccaggaggcggagguugcagugagccaggaucaugccauugcacuccagccuggguggcagagugagacucugucucaaaaaaauuaauuaaacuuccauauuucauuuuuaaauuuuuuuuucuuuuuuuuaaggaugacugcucaggcuguagaggaagauaagagguaacauaacuguuuuuuuuccccuagaauuuuaagaaaaaaagaacuauguuuuuuuccuuucaguccuaaauuacaauuuauuucuuuuaacuuacaaauacaguuuguggucucucucugguggcuuguauguuauuugacuaauauucuacuguuguccugaguagaauucucuucucugugcaaugacuaguuaguucuuuaguguuuguuugauuuauuucaauaauuccaaccuugggguuuuggaaaucauuugaugucuuuauucuaccaacccucccuucucagaagucuuaauuuacuucguccuuucuccuccagcuccaccaugcaguauguuauucucauguauaugaagcauuugggaguaaaagugaaagagccucgaaauuuggagcacaaacggggucggauuggauuucuucccaaaaucaagguaagaaugaaauaauguaauagcauguucaggccuuagggcuucuuuacauuugguugcagugucuuccaucaucuuaguauuuacuuaaucagcaaauuaaugcuagucauacaaacauuuauaagauacugucucuguucucaagaaacucaaaauacagugagaaauccagacauauaaacuauuauuagacaaugugaaaagugaaauuagcaguuuacaaagagugcuauuucugauucuguucaugccuuauacuuuccuuuuacuuugccuaaacuaaauacccccuguguugcuacauaaucgucaugaacaucuuuaguggcaguagaguauucugucaguuuguaauuauuuguguuuuuguuuaguguuuacuagauuguaaagcuguaugaguacaaggaccuucuuuauuauuguauuuucaacuguuagcaaaaugcuuaguaaauauuuguugaauggaugaaugaauuguuuagaauaaguuccugguaaaugugcuauaaaacuacccuuugauuuuccaaagcugucagugauaaagaguuugaagaaaacaucuugaguuugagguguacacgguacugugugcgaacuuuuaauuagugcucugugugcauacacacguguacggguuuucauuuacacuuaacaauuucuuugaacuaaccauuagcauuacacuaugaaaaucgcaaaagaaauuuacucuguuacguaucucuuauuuuuuguacuucaacucuagcaaaguaugaagaaagauaaagaaggggaagaaaaagggaagcgaagaggauuccccagcauccugggacccccacggagaccaagccgucaugacaacagugcaaguauguugaaguuugaagugcugcauuuucaguacuccaggcccucuucacaucagaggcuucuucagcuagaaugaauuucuggagaaaggaguuguuaggaugauuuuacugaauucccaauaugccuuguuuccauucagcguuauuucugaacuaaguacccccuauguugcuacauaauugucauaaacaucuuucgugggcugggcguggugauucacgccuguaaucccagcaguuugggaggcugaggcaggcggaucacaaguucaggagaucgagaccauccuggcuaacacaaugaagccugucucuacuaaaaauaccaacaauuagccaggcgugguggcaugcgccuguagucccagcuacucgggaggcugagguaggagaauugcuugaaccugggaggcagagguuguagugagccgagauugcaccacugcacucaagccugggugacacuggagcgagacucugccucaauaaaacaaaaagaaaagaaaaaaaaaaaacgaaaacacacaucuuuaguggcaguauucugucaaauguccguaacauaguuuacuuaccucuucugauucuguuuccauucaacuuguguuuguuaaauuaaaaaaaaaaaguguguauagaucucuccaccacacugaacgucucuuuauacauauuuacuuagucuccauauuucuaaaauuucuccaccucuccauuguacuuuauuuucugauuucccuuucaccccaggcccaauaaagagagauaagcucacuugagauggcugcaggagaaauagggauggugguaccauggggaggggucaugugaugguucuuaucucaggcaguagcacauuugaaaauacugaagccaggugcggugacucuugauuguaauuccagcacuuugcaaggccaaggcgggaggaucacuugagccugggaguucgagaccagccugagcuacauagugagacccugccucuacaacaagaacagccaaaauaagcuguguaucauggugcauguguguagucugagcuaccugggaggcugagguaguauugcuuuagucuggggaguccaggcugcugugagccaucaucucgccacuaaacuccagccugggugacagagugaaacacugucucaaaaaaaaaaaaaaaaaaaaaaagauauuggcaugguagaguggugggaguaggauugugauagugagugucccccacaaugacgaguucucccucaaaugccaugagugccucuuguugagaaacauugagaaggugugaaauuuuuagaggaaguuaaagagauggaggauuucacagaugcuaaccgugaguuccaagguauacaaaagaagaauuugaggaauuaagagauuaggguauaaaaaguugugugaggguguaggaugcuuuggauauugaacaccugagugggagucuuuggcuucuuguggugacuuugugaacaaggauaauuagcaggauggggauuggucuggauggucuuugagguacauuaugaugaugaaggugugaguguugggggagaacuggggugggagcuuacuaagaacucacaaaaauaaagacuucaucuucauucuuacaaaugaacacagcuccaugucucucagcauuccuccucccucuguccaccauuccucuccuucuuuucucaugacccuucuucuuucccuacauccuccucuuccucgcuuucgucguccugccucaccccuccuccaucuccucaucuuucugcucuaccuuccucucccuuucucucuuuucuucuuccuuccuucaucugucugucuguauguuucucugcauaacaauccacuauauauauuuuuuagggucuaccauguuucacacauuuuaccagauucuuuuacauuguccuuuuuugcuuuuagcuaauuugcaaugcagauuauuuuauuuauuuuauuuauuuauuuuugagacggagucuugcucugucacccaggcuggagugcaguggcgcaauuucggcucacugcaaccuccgccucccggguuggagcgauucuccugccucagccuuccgaguagcugggauuacaggcaugugccaccacgcccagcuaauuuuuguauuuuuaauagagacgggguuucaccauauuagccaggauggucucgaucuccugaccucaugauucgcccaccuuggccucccaaaguguugggauuauaggcuugagccaccgcacccagccgcaauacagauuauuaaccaucauuuucugaucaguuggcagagccauggaacuacagaaggcgcgccacccuaagcacuuauccacacccucaucugugaguccugaaccucaggacucugccaaguugcgccagaguggguuagcaaaugaaggaacagacgcuggauaccugccugccaauuccaugucuucuguagcuucaggggccucuuuuucccaggaaggagggaaagagaaugauacaggugagcuauuacuguaguucagcuuaacuaagcaucaagauuuuaaaacaaacacacuaacugaaaaauagaguggcaaguuaaucaagacuaaaucccaguuuaauuuaauuuugacauuuuaauaugcuacaaccaauaagaaaucuaugccgaaugauaacuuaaguucucauuuguccaaaaaaauauuuauuaagcucucugucaggcauuagcuuugucccggauguuaacaugcaauaauuauacacagaugcuugccucaugcagcuuucucucuugagagcgauagucacaaauguaaaaaaugcaaauugugccaaguccaaucaagggaagguaaagggaguauugagggaacuggucaguaguuagaggcagauguggguaucuaaagaagacuuuuuaaaaaucugagauuaacuagagguuuuauuuuucaauguuaauaggaagccagcugaaagaaaggguagaauaugugggagacaguauauaaguaguagaacagaguugugaggagagaggagaugagauguagaguguauguaaaggguaagacuauuuacugagagugagaguucagugagaagagcaagggaauuugaagaguaaagaaagauaugaagcaaucguagguaauugggcaaggagcuuauuaccaugucuucauccuuguuugggaggcgguucaauuucugguggugacaugaucaagaaugaggcucugggaguggucccugaggugccauagaggaggcuacuagggaugaagacggcaaggaaccaagaagccaggaguuugaauagcuuaauauucauggcuagugacgucaccaagugugauuuuuaucauggagaggaaaacugugagccaccagccaaagguuuagcauugcuagaugauugauaugaggaggaagagaaugugauaauauccagagcaugagagccucaguggagcaagagauuauacaggaagacaaggucgggugcaguggcucaugccuguaaucccagcacuuugggaggcugaggcggguggaucaccugagaucaggaguuggagagcagccuggccaacauggugaaacccggucucuacuaaaaauacaaaaauuggccaggcauggugacaugcacccguaaucccagguccucgggaggcugaggcaggagaauugcuugaauccaggagguggguggagguugcagugagccaagaucgugccaaugcacuccagccugggcaacagagugagacuccaucucaaaaaacaaaaacaaaaacaaaaaaaaacgacaagauaaugguccaaaaaucauauugaggaacaagaaggccauucaucucaucuccacccugacauacaccauauaagacagaaauauuaguuucugucucagagggcuguagcagaagagguaagcugcugggaauaggcagguuucuacauaaggccaagaaguacaagugacauuuggagaaaauucuggggauuuugucaaauauggaacucugaagauguuagauuggguauaugcacugauauuucauggcuccugugacuuauuaaaauaaaaacaugguagguggcggaugaacagaaaccauaaagagaaagaaaguagaggaagggaauguguuaucaggaaauaagagauuuuaacaaauacuugggagauugaaagcagacaagaguguaaagaagccaggcaugguggcuuacuccuguaaucccagaacuuugggaggcugaggcaggaggauugcuugagccuagaaauucaggaccagccagggcaacaugaaaagacugucucuacaaaaaaugaagaagucagccagucauauggcaugugccuguaguccuagcuaaucaagaggcugaggugggaugaucacuugauccuaggaagacaaggcugcagugagccauguucuugccaccguuaaugcagccuggaugacagaaugagacccuaucucaagaaaaacaacaacagagaaccacaagauaaaaccauaaaggaagccagagcccacaauuuguuuaaacaguccaagauagaacccagucugcucauuggaacccuggagagacuuugggcucagaguuagcauauguuaugcagugcaggaauaagaaaaagagcaaaaaugaugaacuaauugcaggucuauaaucaaaauaguuauaucagcagcuucuaaucccugaauuacagaguaugagcagucucugucacuuguagacuagaagaaaaaaacagugcucuuuuuuaaaauaauucagugaauuguguagggagaguuaagucccuccgcaguauugaucgcuuggaguucugacauuugggaguccaaagccugacacuaggcaugccggcaacccacugugcucagagagcucucaacugaaacagaccuauuacuauauagcagcaaaagaaagccaagucagcuacucacuuucaucauuaaacacgaacaucauuacucacccuugucagagucaagacguaagauaauauauaaugccaaacauaucagacaaugacauaaagagagaauacaguuaaacagaagaauuuucccuacaagagaaagauaaucugauaauagacaagaacuuaagaaaauacuucuaaauuagguaguauacuuggggacauuaaagaaguuauuaucucuauaaagcaagaauagggagcauucagagacaaaauauuuuuaauacaacuauuaaacacagugacaucuguuguauuaucaauuucugugugauaaauuaccccaaaacauaauggcuuaacacaaaaaaaauuuaucucgacuuuuugguggaugaaggacuccagagcagcuuagcugcgugggucucgguuggagucugucauaaaguugcagucaagauauuagccagucaucagaaagcuuaacuggggcuggggaacccauuucugugcccacucagguggcuguuggcaggaggccuuagcuccucacucauggccuuggcuccuugccacauggacuuuuccauagagauacuugaguguuccaugaaaugguagcuggcuuuucccgaguaucccaaaaaagagagcgaaaaggaagccccaaugucuuuucugacuuagucucuauaggugcacucugucacuucugcaaguuagaaacaagucacuaaaucuagcccauacucagggagggaggaauuaggcuccaccccugaggggagaaauaucaaaaaauguguggguauauuuucagaccaccacagcgaucagaguuuaaaggaaaaaaaagaagucccuaaaauuaaagucaaggaaauauuuuagaguguacaucagaaauaugaaaggauagaaauuugagagaaaagaauuauauagggaaccacuacagagagccaacaucugucucuuucacaaaaagucagcugaggacauggagaagagaugguuaaacaacaggagaaaguuucccagaguugaaaaagaauacccaucuucagguggaaagggcucacugagaaccaucuauagugaaugcuuuuuaaaaaauccauuccuaacauguccuuugaaacuguagugcaccagggauaagcuuucagaggaaaaaaaauggggauuacacugcaucacauuccucaucauaacacuggaugcugaaauacaaaagagccaugccuucaacuuucugaaggaaaaugguuuugaacuuagaauccuguauccauccaagcuauucaucaaauaugaagaaugaauaaagacauuuucagauacacaagguccacaguuuaacuggaauguaccuuucccuuugaaaucauuugaggauacacauucuagcaacaugagaggaaaaauuaagaaagaaaauguccugggauccaggaaacacuggaaacacccaggaaaguggcaaagggcaauucuaaaaugaugguuguguaacaggccaggagagccacugcuccagauuggaacacaagaacaucacagauaagaaaauggggauuuuaggcaguggauaguaugaagcagcagaggaaauaguuugagacuugauagaauuauauaacuuugacagcaauaaaagaaaagcauuuagaaauguuaagaaaaacagaauuguucaggaaaauaagucaugauuuaaacaugaagcaaaauaaaaaguggcaugaucuuuagcaauugaugguguguaagaaagacuuuaauaaauguucuauuugaaguggcccauggauugcaucauuggaccgguaggaaaaaauauauaauccuaacuaguauauuucuuaaucuggcaggaaugauguauauauguauguaguagacgacaguauauauaugucauaagcauucuuucuugguuuucagacuuuuagaauaacccuaccaggcaagcauggaguaguucauuauggcugcagguuagaauauaaauguaaaaaauucuuuuaaugaugcaaguaaaaauguaguugaaagaaauggaagguagaaggaaggaaauacaauuagagggaggauguggacacugaauaccuaaucugacacagaagagaguugagauacuaacuuuuugauagaacaaaaacauagacaugucauuuaaauuuagguaguaacuaauaacccagcuaguaauaaugauaaaacuauuaaacauugggaagaaaugguagaaaagugaaaguggaaaguguaagucaacaaaauccucagaggggaaagaaauagauauuaacuaaagauaauaaaucaugaaaaagagguuauuuguaguuggaccacuguaauaacucacauuugaaaacaugaaaaaggauugauacugggaguagaaaaggauaagaugggaaaauguuguuccucaucauauacucuucugcacugugugaguccuugcuauuucuuacguuaauuuuuaagaaacaguuuuaaaaauuauuuuucugaccaggcaugguggcucacaccuauaauccuagcacuuuggguggccaaggcgaaaggauugcuugagcccaggaauucaagacuagccugggcaaaguagcaaaacccuaucucuacaaaaaaauuaaaaaugagccaggugugugugguggcacgcaacuguaggccccgcuacuuggaaggcugagauggaaggaucauaugaggcugagaugggaggaucaugugagccugagaugccauaauuuuguauauuaaauuuuuaguucuagugaaccugcaguuguuuaaauaagaauguagcuauggauuaggcugaagcuguucugggaacuaauuuuuuuuggugaccagugacuuuauuaaguauuaacacucuucaaaugucugacuuuugucuacaggaucaaagcaaguuggagaaacaucagcaccuggagacaccuuagauggcacaccucguacucucaauacugucuuugauuucccaccaccuccauuagaccaagugcaggaggaggaaugugaaguagaaagguaauucagugaucucuuagagaagcuuagggcauuacuuaaaguuuuuaaauuauaugcuauuccuauacuuaguagcauucuagcacugaagccuggcauggugguauguaccuauaaugccagcuacuugggaggcugaggcaggagaaucaaucacuuaaacucaggaguuugagaccagccugggcaacguagugagcccccacuucaaacuguaaaaaauaaaauaaauaaauaaauaaauaaguugggugcauaaaagaacuaaaacaccauuucagaacucauaacugaaauguagaaagguacucaaauuuucuucaauuuauuuuauauuaaauuauuacaauaucccaaagaauuauuuaucaagcugcuggaguuuaaccuagcuuugaguaucuuugguauaaauguauugaucaccauuuuguuuucauguuacucuuuacuuuccauuguuuuagggugacugaacaugggacaccaaagcccuuucgaaaguaaguaaaucuuaagcagcuuucaauaaaggcgcauuuuaagaaacguaaccuuuuuuccucuaaaguuucauuuuaaaggaaaagaaacccuguauaccaaucuguuauguaguauaaaagaaagcucuuaagaaacacuggucauucaaaagcuguauuuugaaguauguauaaaacagccauuuguaggagaggaugaaauuucagugcuaagucagauucaggaaucugauuagaauuuauuguaauauaaagauuugugcuguuucucauuguccaccuaaagucuucaaauugaauucacucuuuuuucuucauagguuugacaguguagcuuuuggagaaagucaaagugaggaugaacaauuugaaaaugacuuagagacagauccacccaacuggcagcagcuuguuagucgagaaguguuacugggacuaaaaccuugugaaaucaaaagacaggaagugauuaauggugaguguaaucaauuuguuguuguuguuuacaaauacugaguuuugucagagugaauuaagucucucagccuuggaguuugcuucaaaguuucuccuagccuuuuguuuuaaacaaagaggaaauuaaacuggacagauaauccuugaacucaagaaaaugcaaauguuucucugauucuuauugauaauuuaaaaggaaaauguguuaagccuuaaagauauuuaagauucauagcauuauagaucuuaaaguugaaaagucauugcaacaacuaaguuauuuuuaugcauagauuuuaaaugaggaagguaaagcccagggagauugaauucguuaagaucauacagcuaauaacguguaaggaaaaaaauucaguuccuggucuuucuguaucgaagugcaguguucuuuauuuacccuagcauguaugugauaaauguguggcaugggugcuguacccuuuacuauccuuagcaugugauaugaauaaauaucuugucucugacaauacugagacauaaugaaauuauaagccugaccccagaagugaguguuuauaggcaaauuagauaaccaaaaguacuauuauuucuuaagagggcucaaguuaaaggcuauaugauguuggggcuuacaguuuucuuaaugauguaguugugauagguggguauuauuguaaacagcuggauguguuugggaauacacuaaaaaaaauaguuuugaaugauauuuuuuauuugucaguauucaacucucagagccaguauguaggaaaauuucuuggaaucagaaugacuucagagauauuucauccuuucuaaaugauaaauaauuuauuauauaauucauuugcuacuucacuccagcuaaagacuaugauugaucccauggaauuguucuaaguaaggcaacauuucauaucucuuuccuguucagaauuguucuacacugaaagagcucauguucgaacacugaagguucuugaucaaguguucuaucagcgaguauccagagaaggaauucugucacccucagagcuacggaaaauuuuuucaaacuuggaagauauucuucaacuucauaguaagagaaauuagcucugaucuuugccccuaacauuuccaauagagaaaagauugugaguuuaaaauuuuguaaauguacccauguuaguauuccugagauuaugugugagaauguaagauaaauaaaggaaugauuggaacuuugacuagauccuuuuccucacaaucaaucuuucauguacaaugugucaacauagggcuuccagucuaaagucauugccuaaggugaaaaacaugaauagucaaauucaccguugaaaauuuucuaucaauuauaguauauauaucucuuuaaauauauauauccaauauaauaauauacguauaaauguguuuuguaaauaguaguguaugguauauaaucacaugguucgguaauuuuuaggaauuguuuuuauuuuuuugagauggagucucgcucuguugcccaagcuggagugcaguggugcagucuuggcucacugcaaccucugcccccuggguucaagggauccucccaccucagccaccugaguaacugggauuacaggcgugcgccaccacacccagcuaauuuuuguauuuuucguagagauggguuucaccauguuggccaggcuggucucaaauuccugaccucaagugauccacccgccugccuuggccuccaaagugcugggauuauaggcaugagccacugccccggccucaggaauuauuuuauuguuuuguugcuuggaacacuugaauaaguauauaaaaauucuaccuuguugacauuuuauugguugaagucaucuuggacuuuuguggacaguaauaugauguuccucucauuuauaggucacuauuucucuaugacccuuaauuuuuuuaucuuucuuuuucaugucaucacuaacuaucaacaucugcuaacuaaauugaugccuuuuauuccuuuguggauaaucuuggguuucacaggcaugcauugacaaguucaggcuugauuacauccauugccugcacacuuaacacauuuugagaggaucagugaacagaauuacuuguacuguuuaaauucaaguucuuuuugagcaugauuauagauggagucuugagguucaaugaauauuugaugcaaccaccguguauguaaugugcuaguuuccaaaaauguuuuuuguuuagcaccuguuuuucagauagagcuuauaauauccagauguguaagcacuauguccagauuuauauuuaaggagauaagaagcagcuguacuacugugaaaaucgucuuuauaaaaaaaaaaaauuagcuacucuguacuaccaguaauucugucuacacugaauguguuacuaacguuuuucuaucuuuuuaucuuuaguuggauugaaugaacaaaugaaggcuguucgaaagagaaaugagaccucuguuaucgaucagauuggggaagauuugcugacauggguaaggaaauuuucuguuucuuuuuaauauuuuuauggacacuugaugguuagauucaaguugaguaacuaaccuuuccaaauaugcaaacucauccauguugcaaaguuaaugcaaagcugagaaaggucaagcaguagauuccauuucaagaaaccaccuguuuugcucaucuguaagaagcagacccuuauccauuaaaagucauaccaugagauugcagugauucagucacaccuucaggcuccacuguaauccuaguuuuuuugcaguuaccucuuccacugaagucuugaaccccucgaagucaccuaugaggguuggaaucaacuuccaaacuccuguuaauauugauauuuugaccuccuccugugaauuaugaauguucuuaauggcaucuagaauaaugaauccuuuucagaagguauucaguuugcuuugcccagaccaaucagaggaaucaccuuaugaaauauauuucuuaaauaauaagacuugaaagugaaaauuacuccuugguccaugagcugcagaauggauauuguguuagcaggccugcaaacaacauugaucuccuuguacaucuccaucagaagucuuuaagugaccaugugcauugucaaugggcaguaauauuuuaaaaguaacuuuuuuuuuuucugagcaguaggucuuaacagacaugcugucaucuaggcuuuguuguuucauuuauagagcacagacagaguagauuuagcauuauucuuaagggucccaggaauuucagaaugguaaacaaucauuggcuucaacuuaaagucauuggccccuaacaagagagcuggccuuucuuuugacaugcugaagucagacauugauuucuccucucuagcuaugaaaguucuagauggcaucuucuuccaauagaaggcuauuucaucuacauugaauaucuguuguucaguguagccacuguaaucaauuaucucagguacgucuucuggauaacuuacuauagcuucuacugcuauaucagcacuugcugcaucacuuuguacuuuuauuuuuauggagaugacuucuuuucuuaaaucucaucaguuuaccccugcuaccuucaaacucuucgucugcagcuuccuuaccucucagccuucauagaauugaagagaauuaggggcuugcuuuguauuaggcuuuggcuuaagggaauauuguggcugauuucaucuucuuuauacagacuaauaggcuguuucacuuuccucuuguucauuuguucauuggaguagcacuuuuauuuccuucaagaauuuuuucuuuguguucacaaguuggccauuuggcguaagagccaaaucucagcuuuugacaugccuuccuuacuaaacuuaaucauuucuagcuuuuaauuucaagugagagauaugugacuccucacuugaaccccuaaagaccauugcagcauuguuaauuggcccaaauucaauauuguugugucucagaauaaggaggcccaaggaaagggaagagaguugggggaauggucaguugguggggcggucagaacacacacaacauuuuuccauuagguuugccaccauaugugggugcaguucauggugccccaaagcaauaaauaguaacaucaaagaucacugaugacagaucaccguaacagaguaaaaugaaacagcuuaaacuauuaugagaacuaccaaaauguggcacagagacaugacaugagcacaugguuuuggaaaaacggcaccaacagacuugcucaggguugccaucaaccuucaauuuguaaaaaauggaguaucugcaaaguacaauaaaaaugugagguaugccuguaccuguaaaaaguugaggaaaagcagaauggugguuuguaacugucacauacaaagcguuaauuuagaagaaggcauuggccagaaaucauaaaagcaaaaaucauaaauaggccuuuagauuuuacucuugcuguuuaaauaaaaucauuuuggaaaguauuuuuccaguauuguuuccuuaagaucacuuuacauacacagacaauccuugacuuacuaugguuccaacuucgacaguuuuuuuacuuuacaguggugggaaaguaauacacauucaauagaaaccauacuuugaauuuugaauuuuaaucuuuuccggagcuuggcaauaugugguauguuacucuugaugcugggcagcaacagugagccacagcuccuggucagccaugugaucacaggguaaacaaccacucuacaguguacuguacugcuagaugauuuugcccagcuguaggcuaaugcaaguguucugagcacauuuaaggucagcuaggccaagcuaugguauuugguagguucaguguauuaaaugcuuucucaacuuaagauauuuucaauuuuugaugguuuuauuaggauauaaguucaucagaaaucaaggaacaucuauacuuaaacugcuuguaaaacuacuguagaggccgggcgcaguggcucaugccuauaaucccugcacuuugggaggccgaggcaggcagaucaccugaggucaggaguuuaagaccagcuugaccaacauggagaaaccccaucucuacuaaaaauacaaaauuagccaggcaugguagugcaugucuguaaucccagcuacucgggaggcugaggcaggagaaucgcuugaaccugggagguggagguugcggugagcugagaucgagccauugcacuccagccugggcaacaagagcgaaacucagucucaaaaaaaaaaaaaaaaaaaaaccaaaaaaaacuacuguagaacugcuugaguuugggggcauuauuuucuuugguaaacccagcugcuuuuuguaguuguguggugcuuugauugacuaacaugcuaaaaaugcugccagucuccuuguuaaacauguuaaaugucauauucaucauagaguaagaauacaaaauuggagugaccuauuaaaauauugcuuuguauguguccuacuugaaaaaauacucugaauuuaucuacaaaugcgcuacaggcgggcuuuuuacaaaaugccuuuauguacaaacuuuugggaauauggcuuuaaauggaagauuauauggaaaacaucuucguaaaccauaaagcaauuaucuacaaguauagaggcuguauuaaaaaacaauguauuugacuucuacgagcaccuacuaguaaaucacuuuuuagguguuuaaccaucagaaaucuuaaaaucauggcacaugcaaacuuaaauuuacaaauuaaaaaacauuagugagaaguauaauuuuuagcaaaagaauucauaagcucauugaucucccccaagccagcuccagcugcugcacaggugaaacagcagugauuuaauuuuguuucaacacagaaaacuuacggccugcccauggucauaguggguuuuauacugaguaagaaggaaugcuaguaugccaaggauuugcuucccagaguaguaagacaguaguuguuguaaaggcuucaggguguaagaaaauuaaauuuuaggccagauguaguggcucaugcccauaaucccagcacuuugagaggccaaggcaggcggaucacuugaugucaggaguucaagaccggccuggccaacauggugaaaccccaucucuacuaaaaauacaaaaaaaauuagccaggcgugguggcacacgccuguagucccaacuacuugggaggcugagacaggagaaucacuggaaccugggaggcggagguugcagugagcugagauugcaccacuauacuccagccugggccacagaaugagacugucugaaaaaaaaaaaaaugaaaauuuagucucagucuucaggcauuuuguaucuuauauucuccaaaugucagcuugucuguguaauuuauaaguaacguaggcugaaagguaauagguugugauaggcuacaagcaagaaaacauugggacugggcacaguggcucacgccuguaaucccagcacuuuggggacaccaaggugggcagaucaccugaggucaggaguuugagaacagccuggccaacauggugaaaccccaucucuacuaaaaauacaaaaauuagcugggugugguggugugugccuguagucccaguuacuugggaggcagaggugagaaucucaugaaccucagaggcagaaguugcagugagccaagaucaugccauuguacuccagccugggcgacagagcaacacugucucaaaaaaaagaaaaaaaaaagaagaagaaaacauuggaauaugaucagaaaaggucugguugugucaagaucagaccuuuuuaauggagaaccauugauauuccacauagauaugcaguucuguguauuuugucacuugaaauauugaaaggauucugguugucugucacuuugucuggcuuguauaagcucaguuucccauucucuuuuguguucuuugcauucuuggcacaguucagcggaccaggagaggagaaauugaaacaugcugcugcuaccuuuugcaguaaccaaccuuucgcccuggaaaugaucaaaucucgucagaaaaaggauucucgauuucagacuuuugugcaagugaguugagugagucauguaagaaaaaaaauaaggcaaguuuuuaucaauuaucagauaaacugggggaauucugacuaagacuuuuacaaagauuacaucuguguuaacuuuuuuuuuuugagacagggucucgcuguguugcccaggcuggagugcaauggcacaaucucagcucacugcaaccucugccuccuggguucaagcgauucuccugccucagccuuccuaguaguuaggauuacagguacaugcuaccacgcccugcuaauuuuuucuauuuuuaguagagacgggguuucaccauguuggccaggcugggcucgaacaccugaccucaagugaucugcccaccucggccucccgaagggauuacaggugugagccacugcaccuggcccacguuaacauuuuuaaaagcaauacauuaucucuuaaauuccuggaagguacaaaaaugacuuuggaauggugaagaauaauaaaaaauauaugucaggauuaaaauacuuaauauagaaauccacauugccacgaggcuuuuaucaguaaacaaccguaugcucuauuaagagaauauugucaaagcaugagaauggguuuauccagggaaaaacguaacagcagccacacucauugggguauaugaauuaaggguugguaaacuauggccgacagaccauaucuagucuguuaccuguuuuuauaaaguuuuauguaaauacaaacauggccgcuugacagauuucucacaguuguugugguguguggguaugguuuagcagguuccucccuugagaguuugaccaggcugagaucacagcgucagcgggagcugcaguuuucaucugaugcucgagguucucuucuaagcucacugguuguuagcagaguucauuucuuuguaaauguauaacugagguccuaccuugcuagcuauuggcuaggaaccaguuucaacuccuagagaacagagagaucucugccauauggccccauuaggcaguuuagagguggauguuugcuuucuuccaggccaguaggaauguggcuuucugacacagauuuguuuuaaaggcuccucuaaugaaaucaggcccagccaggauaauuuccuuucuuaugaucucaaaaucaugugguggcaaccuaaucauaggugugauaucccauuguaaucacagauuccaaaaauguucauacucaagggcauaggauuacacagaguauuuacacaagaggaugggaaccuuggaggccauauuagaguucuuuacuacacagagccuuguucauucacuuaugccaaaacaguagagcugaauaguugugagagagacuauauggccugcaaagccuaaaauauuuacuaucuggcauuuuacuaaaaacuuugcagaccacugguauagaugagcuggcauacucgacugguuauccauugugcauacuuggaauggcagauaacaaauuagcuaaccaauuuugguaggaaugucaaucauaggagaauggaccuagauuuucugaauaggugaagauaaaacuguuucaacacaaggaagcgauacguagagcugcuuauggaugcuuucaguccuuccuuaaacagauaacaagccauucauuuaguaauagaggcucccuucccccauuaugugauuaaaggagaaagcagaaguauauuguggcaaugauauaucuuggcauuuuuuaaagaucuugauuuaauaaccagaacugugaugcauuaaacccucacggugaauacaugguacauguauaaguucaaauaagaauuacagauucacuuauuucacuuuaauuuuaggaugcugaaaguaauccacugugucgucgucuucaacugaaggauauuauucccacucaaaugcaaaggcuuacuaaguacccacuucuguuggauaauauugccaaauacacagguacagcauuuucacugaaauaaaaagcuuaagaacaacaacaacgaaacacccaauauccuguaaauaauaucuuacagcguccugaauggaguuggauuuccaaauaguaugacaagauuuucuuuuuuuuuuuuuuuuuuuccuuuuuugagacagggucucacucagucuugcaggcuggagugcaguggcacaaucauaguuuccugcaaccucaaacuccucggcucaggcauuccuuccaccucagcuucccgaacagcugggacuacagggguacaccaccacacuuggcuuuuuuuuuuuuuuuuuuuagcaagggucucacuauguugcucaggcuggucucaaacuccuggccucaagcaguccuccugccucccagagugcugugauuauaggcaugagucaccauacccagccaagauuuucuaacaagauaugaucuagucuucuucgggcuguuugauauaauguacuccauuaguagcuuuaguacgggguauaucaaacuaugaaucauagaccaagucaugcucacugucuguuuuuguaaauaaaguuuuauuggagcacagccgugcucgucuguuuauguacugucccugauugcuuuuacauuauaacagcagagucgaguaguuuuaucggugcccauuuggccuacaaaguguaaaauuaucugguucaaccauccuuguucuagccugcaucauuuuugcuuugaagaagguucauccuuggcugaagagauguuucauggauaucuaucaaugacuuuuauuaagccaaaucaaugcgguguaauuccaacucucccguuuugaaacaugaaaugaaucuguuucucagcugagcuuuagguucuuauacuuagcucucauuaauaauuuaaugcaacugaaaucuuguuucuugugccugagaauuugaaugcauaagcaggaaauuuuaaauuaugguaccugguaacaaaagugguuuacacucauacauauuaauuuuuacacuuuaauauaucugcucaguguaguuagacugugguuuggaggauuauaauuuugaauguucugauuuuggucuucuuuguauuauagacaugacauagccucaauacguuuugucuuguuuuguuuuguuuuguuuuguuuuuuugagacggagucucgcucugucgcccaggcuggagugaaguggcacaaucucugcucacugcaaccuccaccucccggguucaagcaauuccccugccucagccucccgaguagcugggauuacaggcgcacgccaccacaccuggcuaauuuuuuuguauuuuuaguagaaacaagguuucaccauauuggccagacuggucuugaacuccugaccucaggcaguccgccugccuuggccucccaaagugcuaggauuacaggcaugagccaccuugccuugccgccucaauacguuuugaugaauuucaucuucuuuuaauguaaucuauuuucuuucuuuaaauauaaucucaaauucaaagaaacuuguuuuggaauuauuuugaauuguguuauuaaaaaauuuuguuuaacaaguucacuggacauaauuauguaggcuaugcacugugaaauucugaggggagaagggauuuccauuuauauuauuuacaaaguaaaugagaccugcccuucuggaguguauaguauagugguccugguacuucacguaaagcaucucuucuuggauuucggguucuguacugugauuucuuuuuaaagauuagaauuuauguuuuaaaguccuguuauaagaaguuuuaccuguccaaagacugcuugaauugagacucugacagaggcuuuaagcugguacaaaaaucuucaaggucuuaauaugcucuuaaaaguauugaaaugaaaugaaaucucauuuacauauauuuuaugguuuuuugcucaguucuuuuacauuuuggauuucuuucccauauuuagaauggccaacagaaagggagaaggugaagaaagcugcagaucacugucgucagaucuuaaauuauguaaaucaggcugucaaggaggcagaaaacaagcagguaaaaaaggaaaacaagaagguacaggaugacauugggagaacauuaaauuaauauuaccuggaaucugugaaauaguuguuaaaacuaucauuaccuaauggacagggagaacauuuguuuacuguucgcauaguaggcaggucaagaucaaucugugauagaauaucggaguuguauuugacuuuuugaaacaccucaagcugcuuguuugcucuuucauuuaucucuucauucagcagauauuuauagaacaucuacuguaugcugggcauaggguacagaguaguugagaaaaugagugcaauaucugcccacacugagcuuguuugcuaggaggauagaaaggcauuuaacaggauuauagugcaaauauuuuguaucaguugugauagcuacuaucaaggauaauuucaagaugcuacgauauauaacuauggggccuagcuuaguuuggggauguuagguggugccuauuagagaaaauuuucuugaggaauugacacuugagccaagcucugaaggaugaguggaagugaaccaaaaugaugugaagggugcaacccuagagguagaggcaauauauaccaaaguccugacggaaaaagaaagcauggucuguuggaagaauugaaaauuuacaugaguguggaucaugccuaaaaagcaaagucagaguggcauaaaaugagguaaaguagaccaaggccaacucauaaaggcccuagagaucagguuaaagauuuugauuugucuucuuaagugcaguaggaauucagcauagacaaguaagaauauaguguucagauuuucauuaucugaacuaguacucuauggagaaugaguugaagaagggugguggaugaaagagcccauuuauuaaccucuugcagcaaucuaggauagaugauggcagcuuagagaaguuggagaaguauuuagaagguaaaauugacaggacuugaugacugauuugaagaaggauuugaaggaaaagugaugucaagaauaaacccccagguuucuggauugcauauuuggauggacaggaugaguggagaagccccacguuuguggggaagaugaugaggucacucugggauaucagguagacaugcacaguaagcaguuggcuguaugggcccaccucuaagaggaccauguugaagauaaaaauucaagauugugagcauacaggggcugauugaauccgugaacacggauguaguuucuuaggagcugaguaugauuacaacucucuuggugaggcuguagaaaaacuaguacuuucagcugugcuguucagaguguaaaaugauaaaaccccagaggguuauguagcaauauuuaucuaaauuaaaacucuguagguacccuuauaucuaccuuuugacuccgcaguucuguuccuagugauuugcucaagagaaaugaaccauauuagaguucuuuacuacacagagccuguucauuuauguauuaucuguggcuacuuuuguuccaaaacaguggagcugaacaacugggagagagauuauauggccugcaaagccuaacugacauuuuacuaaaaaccuugcagaccccugguauagaugagcuggcauacucaggcugguuauccauugugccugccgggaauggcacauaacaaauuaacuaacuaacuuuaguaggaacaccaaucauaagcaaauggaccuagauuuucugaauaauaaaauauaucuuuaucugaagauaaagauauacccacaaacagacuuagaccagaaugcuuauagcaacuuuauucauaauagcgaaaagcuagaaacagcccaagaauuuaucaacagaauggauaaaccaacugugguauaguuauaaaauagaaugcccugagugauaggaaaggaauguaccacuaaggcacacaacauggaugaaucucacaaacaugcugaguggaaaaaaaacagaugcaaaagaguacauaccuaugauuccauuuauaugaacuucuaagagagaccaaacuauucuaugguaggaaaaaccagaaaacugguucccauuggggaugaggagguagaaauuaacugggaagaaguaugaggaaacuuucuggggugaugguaaaauuuucuaucaugauagaaguuuagguuacacaaauguguaagcacuugucaaaauucauggaacauacacuugaaauguguguucuacuguaugcaaauuuuacuuuuuuaaaaagaacuguauggauguuuaaauguuuagagguaaaguguacuuaugucuguaauuuauuuugaaaugcauccaaaaaauaagauggacugauggauagagggaugaauaaauagauauaugauaaaacaaauagagcaaauguuaauuguagaauauagaugguaauauauagguguucacuaugcucacucagacuuuuccauguauuuggaaaugauauugugggggaauguacauacccuuugauccaacaguucuggaaauuuauccuacagauauccuacauggauguacaaagacauauauuuaaguccacuuuauuacaguauuguuuguuacagaagaguugaaguaacuuaaaugcccaucaguaaggcguaaugaaauaaauuauaguuuauucagagaguuuuacauccuguagucauuuauaaaaaaaugaaauaacucucuauaugugcuaauguggaacaguccccaagauauaagucauacaccacacacacacacacgugggggaauacguauaugaauguauucuaccauuucaaugaggaauacauauaggaauaccaaaggaaugcauauaugaauauauuaugcuaccauaucuuguuuuaaaaaaggacauauacacacaacaugcacaaagacaagcauacuuauauauacauauauaaauaaauacauaucuguuugcauagaauuuuucucaaaggcuacccaagaaauggauauuagugauugcuucuuuagggaaaauugagggggguggggcaauaggacaagguuagagggagacuuuuuauuuuuugccuuauauagccaucugaauuuuguacugugugcaugauuuacauauucagaaaauaaauauaagcuaauaagagaccaaugacuuugaaaagaagauugagaaagaaaagccaaagaggcaggaggaaaacuaggagaguauauuaucaccaaagccacgggaagagagugaguuuucaguccugucuagcauugcaaagagcucaguaaaauggagauuuuuuuuuuuugagauggagucuugcugugucgcccaggcuggagugcaguggcgugaucucggcucacugcaagcuccgccucccagguuugcaccauuccccugccucagccucccaaguagcugggaccacaggcgcccgccaccaugcccggcuaauuuuuuuuuauuuuuaguagagacgggguuucacuguguuagccaggauggucuugaucuccuaaccucgugauccaccugccucagccucccaaagugcugagauuacaggugugagccaccacgccuggccaaaauggagauuuuaaaugccaaguuugauucagaaauagagaggucauuaaugaccaaagcacuaaccuugguuccacccugccuaauuuucagcgccuagaagauuaucagcgucgccuugauaccuccagccugaaguugucagaguacccaaauguugaagagcucagggugagagauggucuaaucauaauuuaaaaaauaaaauaaaauuugcuaaagaccuggcagguaauuaacaucucagugggaauauacgucaccugaaggaguucuuguaucguagauuaucuguauuuaugauuuuuuuugcugccuuuuaaaugcuugaucuguaugaaauuaguuuuucauuagaggaauaucuugcauaaaacuguaauauuacaugacagcaauuggcaggagacuaagggacacuaauuauuauaaaauuuaauuuuauuguguucuguaguuuguuucagacagggucuugcucuguugcccaggcuggaaugcaguggugcagucuuggcucacugaagccuuggccuccuggacucaggcaguccacccaccucagccucccuagcagcuaggacuauagguauaugccaccauacccagcuaauucuguguuuuguaaagacaaggucucgcuguguugucagguugguccagauuuccugggcucaagugcuccuuucucagccucccacagugcagggauuacaggcaugagccacuaugcccagccuguguucuguaguuuaaauaaggguaggacuguuugguaacuuuccagaucauuuaauaacacaagauagcauacuauuuucucaugaggcucuucagaagcauaaaaguuggaaccauuacaggaacgauaguaaaauguuuacuaauugccacuucuaguaugugggcuuauguguuaacuuuuucggauuuuaaguguuuuuguaccauuucacuagguggugguuuuggcagauuuauuugguggcuguuaaaauagacuuuuaugucauauauuaauacuucgucaacaagcacguaaaugugcuuauuccccuuagcuuccaaagaaugagaguuuucuagagcugcuaauacuaaaagaugauucucuuacuaauaaguuguuaauauuuagaccaagucugaguaguaccuggacuuuucaugaguacuauuucuuagaacuuucuuugaaauuagagccuuggaacucagaagccacuuucuuauagacaagcauauguaccaugcucauccaguuauucauaggaaaauuaaaggauacguugagaaucuagugacugaauguuuguaacuugaucuucauaaucuguuaucaucuguuuagagugagguuugaagauaguacuccugaauguucuucugcaagauaccuuuuccuuuuuagaaaauuguaugcagauuacuuuaauauggcuuuugugccauuuucaagaacugacaaauagcaauaaugauaguugaauguaaaugguguauuuuauauuaagaauuucuuuaaaagagacuguauuauauagauaaucauguuacugagugcuuggaaauuauuugugcaugauuuucuuuauuuugccagaauuuggauuuaacaaaaaggaagaugauucaugaagggccauugguuuggaaggugaauagagauaaaacuauugguaggucugauauugucuuuuaguuuuggggagaguggcaaaagggaaggaauaggaaaguuuccuaugacaaagggaagaggagagaaccauucucucagcaguuugcagugcuaccucguguuauuuguacauuuguagaucugcuuguguuauuucauuauauguaagauguguuaaauauucauuuaggaauguaguggagaacugauuuaguccuauuuccaucauucuuauagucuagugagucuuuguaugcuuuguaagcuuucuuuagaccaguacaucuuaaacugucugugaugaggaaccguuuuuguuuuuucagaaacaaggucuuucuauguugcccaggcuggagcacaguggcuagucacagaugcagucauggugcacugcugccucgaacuccugggcuuaagggauccuccugccuuagccucccuaguagccgggacuauaggcgcacagcaccacacccagcuuguuguuuuuuauuuccuauuggucacagacugacacuucagugaaauaaaauaaaaaugaauuacugaaaaugaaauuuuaaaagauaauauacaagucaauuuuuaaaauuuuguagcuuuaacagaaauagaauuccucuguugaaucauuauaaaguuaaucaaacgcgucuccauuucuguacuuaccauuuuuuucugcacuuuuauuucuagauuuauacacguugcugcuggaagacauucuuguauuguuacaaaagcaggaugauagacugguuuuaaggugucauaguaagauucuggcaucuacagcugauagcaaacacacguuuagcccugucauuaaguugaguacaguguugguucgacaaguggcaacaggcaaguauguccacugaaggauacuaauuuccagauucauugugaaguugcauaagauacucggugcugucucaauaacacaaguggcauagagucuugcuauuuuuauauucuuaagcaaauuacaugaaauuuacugcuuagaaagagaccuaagaguuuauaccccaaaguuauuagggugucucgauucugugaacaguuuucugcauuugaaaauuuuuaugcuauuacuuugguucuuuauguucaaaucauugauagaucccaaugaaaagccuuucauuuagggugguauguuuuuugauuuggugagaaaaaaaucaaaaaccaaagagacggauguaguguugauuaaaaaucaaauuugacuggcaaguuauauuuuaacucuauuaacaacggggucccuuuuaaaacuuguuaguuucaugguggcaaaauaaauuugugaccucuuuucuccacuacucacugaauauuauuaacuaacaacuuagcaaaagugcaguucaaaauaaaugcaaaagaguaauagcauuuaaucugguaauuuggauuuauuuauuuuuuuucuuuugagacgagggucccacccugucacccaggcuggagugcagugguacaaccuuggcacacugcaaccuccacaucccaggcucaagcaauucuucaaccucagccuccugaguagcugggacuacaggcaugcaccaccaugaccuggcuaauuuuuuuguuuuauguagaggcaggguuucgccaugcugcccaggcuggucucgaacuccugagcuccaagcgguccaccugccucggccuccuaaaguacugggauuacaggugugagccaccgugcccggccaguaauuuggauuuuugacaugcuuuuagcaaaguuucuaguaaauuauuguggaauuagugcuaauucguauaaucuuuguuuuauugaaguacaauaaauauaguacaauaaauacguuaauaugguaaguugcacaaauuuuaaguguacaucuugaugaauuuuaaaguaaauauauguaaccuuuaucuaguuuaaggggcagacuauuucaagacccuaaaaacaucccucauggccuccccaggucauaguauuagaguaaucuuguauuguuuuuuccagauaacaaagcuuuauucgucauuuccaugucagacaauggcgcucagauuuaugaacugguggcacagacaguuucugaaaagacuguguauguaucagauauggcuaccuugcuauagcuaauauuuucauuaucccaagcguaauauuccauaaacuuaacuuuguuuuuauaauguauggaaaccaagcacuuccucuguacucuuuuagagacguucuacuaugaacuuguucuuuuuuagguugaugccuuuuauuuugauucuauucugaaaguuuauuuccuaaagaaaaaauugugcaaaaugucaagugaaguuuuuuuaauguguccauagauuucucuuaagguauaguuuuggacucucgccuuaauaguguguugccaaaauaaagauauucucuggcagaguggguuuuguuguuguuguuguuguuguuguuguuguuguuguugguugauuugguuuuuguuuaguuuugcuuucugaguauauuuaaaggauauuucuuuuuucuuuuuuguauuuuggauuucuuuccaacuuucugaagcuggcaggaccuaaucugucggauggcugcaucagugaaggagcaauccacaaagccaauuccauuaccacagucaacaccuggcgagugaguguuccuuugcauuguaguaggacuuauuuuauguuuuggguuggaaaagacuaggauaauuauuauguuuuguugcgaugauguuuagauaccucaggaagguaaaaguuuuuuuuuuuuuuuuuuucucuacagaggagauaaugaugaagaagauccuucaaaauuaaaagaggagcagcauggcauuucagucacugguuugcagaguccagguacacucuucugaagaguucaauggagaaugugcucuauuaucuguuaaaaugcuggccggaugugguggcucaugccuguaaucccagugcuuugggaggucgagauaggcguaucaccugaggccaggaguuagaggccaaccugaccaacaugacaaaacccugucucuacuaaaaaauacaaaaauuagccgggcauggugguaggugccuguaaucccagcuacuugggaggcugaggcagggagaauugcuugaacccaggaggcggagguuacggugagccgagaucgugccauugcacuccagccugggcaacaagaccgaaacaccaaaaaaaaaaaagaaaaaaagaaaaaaaagaaaauaaaauaaaaugcaaagaaacuuuaauacuguuugguuuaugcagguuccagcaucagagauucaguuuaacaaacuuugccuuugagccuucugugugucaguauaacacuguucuaagugauguguauuuuucuuaacagaugaucucuguaguuuauggauuguuuuuuuuuuuucugauucuucccugaaugcuucauguuaaaaguuaaaagcuuuguuuagauauagucuaccuuuucuauuccauuggacagacagagauuugggauuagaaucuaccuuaauaucgucaaaaccucagucucauucacugaguaccucugggaaaucagagguacgugaucuguuuguggcugagagacaguuugcaaaggaacaacauacagaugggacacuaaaggaaguuggagaagauuaucaaaucgcaaucccagauucacaccugccugucucagaagaacggugggcauuggaugcacuaagaaauuguaaguuuuauucauaacuuauuacagauacuuacuaaguaugacacucaugugccaucccuaaaguauguggauuuaucaaacuccacuuauucuucuaguucuauuguggagauuauaguauucucuacaguggcccaugccacaggcacacacacacaugccacucuguuagcuccccaccccccugccugguucagaaucacuguuaaaaugggaggauagcauaucucucaguuguauugaggugggaaaaaggcugagaacaauuucuuuggcuggggagaaccacuugaaauuuuuaaaccagcguaugacuaaagguaugaaaaaagauuaaucuggcugaaagcgguggaaggauuugaauggaaagagguauggaaugguguacuuacuaaauaagcuauuauaauagucuggccugagacuaaaagaguuuggacuagaauguuaucagaaggaauaagaagaaacugagaagucaucaaaugcuuaaaauaauugacuucuuugaaugugaggucaaaggaaagggaauauuuagagauaauuucauuaaucuagucagaaauaagagucagaaaaggacuaccacugcuucccccaccuccuuccauuguacuuucuuuuuucuuucuuuugauuugguagaauuauaggcucaguuuuaaagcaugucaagauuaagauaaugaaugacaaaacacuaaaaagugaguaacuagcaggaaguuagaguuuuaggagugaaacuuuagagagagguuaggaagagauagagaugugagcaucagagccaugagacuuccuggcaucucucaggaagugauuguagagcagaaggacagaggaugagagaccuaaguggaaccuguugccuaaagaaacaugacagacauuaagcuagugaugagagcagagaauugguuauuuaaaaccuacaauauuuuuuauaccuucuccugaauuaacagucuuaauaauuucugaugguuggaauaacauugucccaauaacucuaucauugucugggugaccucauagcauacacuuggcccauucaaaauuaaauugguucuuauuuucaguaaauguauguaucucauaaaauuagaggaaauaauaugcauauagugucuggaucuggaaaaagcagaacuuuuuuuuagcuuuuucugucuagcuuaacacagccuuucaacauucuuaagaaguaccuuuaggguauuauucuaguuauauagaagaaaaaauagaggcaugauauugguuauugaggaguucuaaauaguaguaucucccuauucagaaugcuuagaucuuuucaaguuuaguuuaacguuaaaucuucucuaaaagauggugcuuuauuucaucuucaaaacaaaauggaaaaugauuguaugaaguaagaugauuguaugaaauuaauaauuaacauuuuaauaugucauuaaaagauacuuuuuaaagauagaucauugguaagucagcuaauuuaauucuugcagccugagguuauaguugugaauauguuuuuuuucccccuccuuccuaaaucguuuaguggguuuguugaagcaguugcuggugcaacagcuagguuugacugagaagagcguucaggaagacuggcaacauuucccaagauacagaacagccucucaggggccgcagacagacagugucauccagaacucugaaaauauuaaggccuaucauucuggugaaggacauaugcccuuuagaacuggaacuggugacauugcaacuuguuacaguccacggacuucaacugaaucuuuugcuccacgggauucagugggacuggcaccccaggauagccaggcaaguaacauuuuaguaauggaccacaugauuaugaccccagagaugccuaccauggagccagaagggggucuugaugacaguggagagcacuuuuuugaugcccgugaagcacauagugaugagaauccaucagaaggugauggagcaguuaacaaggaagagaaggauguuaauuuacgcaucucaggcaaguaucuuucacacuuaaacuuugauuuugauuuugaucauuguuaacuguccuguauuuugaaauggauguuguauugguauccagguguguguguguguguguguucacacaugugcaauauuuauuccuucauuugauaaauacugaaucuacucuguaccagaccucaucauaggugcugggagauauagcagugaauaaaacacagaaaaaucccaucuucucaugaagcuaggggaaagaaggaugguaaauaaguaaacaaauaaauagacuucaggaaguauuaggaagaaacauaagucagacugaggggacggagaguaaugaaggcaaacagggugaucagggauuaggaccuccgaugagguagcauuugagcagagaccucaaugaaaugagggaauaaagccggguggguaccugggagcuuacuauuccagcagagagcagaguggggcagaggcuuugugucaaagagcaagcuuuuuguggugaucgaacacuggaugagggagacaauggcaggagauggggcaagagaggcguuuggcaggggaagugguagcaagaucauuuaggcacuguaguuuccagcuuuaaacuuuugaaaugaaauuuuuuggaaauuaccaugaaaguuugcagaguuuagcuuucaucugaagugaggaaauucugauguaccugaaacuaaacucaggaauuaauggcuuuucccucucuuaauaacuuuucaaguugaaguugucagcacacuaugcuauuucuguuuucuaauggcagcacuggucuuaucaaacuauucugucucuauccauaggaaacuauuugauccuugauggcuaugacccagugcaggagaguuccacagaugaggagguugcuuccucacuuacccugcagcccaugacaggcaucccugcuguggaauccacccaccagcagcaacauucuccucagaauacucacuccgauggggcaauuucaccauucacccccgaauuucugguccagcagcgcuggggagcuauggaguauuccuguuuugagauccagagucccuccucuugugcagauucacagagccagaucauggaguacauucauaagauagaggcugaccuugaacacuuaaagguaccucauacuuccacauccauaggacuugguuguaagaaacauuuagcagaggggaagaauagggugaugaaaaugcugaugucaauaaacuuguucagguucuagauuucuuugacuauuauccaugaauaggccuggguaaaaaguugagauuggcauuguuuaucuuuuucuuucuuucuuuuuuuuuuuuuuuuugagacggagucucgcucugucaaccaggcuagagugcaguggcgugaucucagcucacugcaagcucugccuuccagguucacaccauucuccugccucagccucccaagcagcugggacuacaggcacccgcccccacgcccagcuaauuuuuuguauuuuuaauagagacgggguuucaccauguuagccaggauggucucgaucuccugaccucgugauccgccugccucggccucccaaaguacugggauuacaggcgugagccaccgcgcccagucggcauuguuuaucuuuugacuaucacaagagcagaaaaaguugcagcucugugaacuguguguuuguaugggugucuaaguuuaagaaccugaaaugcuucggguaguuggcuggccucugucagacaugaacaagaagaugagauagguaggguuuauguaguuaugaaucuaggcugagaaaugcuaugacuuucuguagccuauuaucugugacucauuaggugacauuggcagcuucccaaauccuaugacagauagaaauuggcuucaguggcuccuguaaucuaaaaacauggucaugcaugggauuuuuguagauugguaauugaagaugucacuauugcaaaacugacuuguguggcaauuuccaagagaaagaccuaucuuaaaguuuuccaucagaggcagggcacgguggcucacgccuguaauuccagcacuuugggaggcaaggcaggcggaucacgaggucaggagaucgagaccauccuugcuaacacggugaaaccccgucucuacuaaaaauaaaaaaaaucagccaggugugguggugggcgccuguagucccagcuacucaggaggcugaggcaggagaauggcaugaaccugggaggcggagcuugcagggagcugagaucacgccacugcacuccaaccugggugacagagcgagacucugucucaaaaaaaaaaaaaaaaguuugccaucagaaaacacagcuuccagagcccaaacauuuuccucaugacaucauuuacaccagagacuugagggguagauuuaaguauccuuagccuuugaguuaaagacuggucucccuuaguuucucuuuuaccuucauauaauugauuuuucccucuucauguuacuuauuuuauguaguaucauucuguagcugaugagauaucgacaagcccauugaggacaggucgguucuuauauacagucauguguugcuuagcaauggggauauauucugagaaauucaucauuaggcauuuuuaucuuugugugaacuucacagaguguacuuacacaaaccuagauagaauauaucuuuauuuacauagauuuuuucauauggaaagccaaaucucucaacacuauuacugaauauuagucauuuccccuaccugaucagcaaugccauuauuaagugccacacaccagguuucuacaugugcuccauaauaaucuuuuuuuuuuuuuuuuuuuuuugagacagucuugcucugucacccaggcuggagugcaguggcgcuauuucggcucacugcaaccucugccucccagguucaagcgauucuccugccuuggccucccaaggagcugggacuacaggcaccaccaccaugcccagauaaauuuuuuuuuuuuuuuaaauggagucucggucugucacccaggcuggagugcaauggugcaaucucggcucaccgcaaccuccgccucccggguucaagcgauucuccugccucagcuuccugaguagcugggauuacaggugcccgccaccacacccagcuaauuuuuuucuaucuuuuaauuuauuuauguauuuauauuuuuugagacagagucuugcucugucgcccaggcuggagugcaguggcaugaucucuccucacugcaagcuccaccucccagguucacgccauucuccugccucagccuccccaguagcugggacuacaggcgccugccaccaugcccggcuaauuuuuuuuauuuuuaguagagacgggguuucaccauguuagccuggauggucucgaucuccugaccucgugauccgccugccucggccucccaaaguguugggauuacaggcgugagccaccgcgcccagucccagcuaauuuuuauaauuuuaguagagacaggauuucaccauguuggccaggcuggucuggaacuccugaccucaggugauccaccugccucggccucccaaagugcugggauuacaggcgugagccaccaugccccacccauaauaaucuuaagggaccaucaucauguaugcaggccgccaugucuuuaugugcugcaugacuauagcucaugcacaugaugacgggaccauguccagggugacuccugggggugggagaauugcaucuaugguuaccaccucuacuuucuuuuuacaugggaaaauacuaaguuauuccuucaguggagaaauugguaaaaggaaugaaauuuacuuuuuucuucccacuaaugaaauuuuuaaugaugaaguuaauauuuuugaaauuugggggcuuguaccuguaauguaaaaagggcuucuuuucuguuuucugaaguuuuuguuuuguuuuguuucauuacguuugaauaaaaaaccuauggguuuuauuucacagaagguggaggaaaguuacaccauucuuugccaaaggcuggcuggaucagcccucacagacaagcacucagguauguaaaaguuaugaguuccagacucuagacuaaucauccuacacugaaugaaaugacuuaucauacuuugaagugaaaaccuucugagauuccauuucucuucugucuuuaaagaacugccuguuucuaaacaucagauaucaagcggaagcucaugccugcugacucuacucuucucuaagaggaacugcaguugucaguucccauaccauccccucuucucucucuuuucaccuuuucaaagcagaaggcagagcagugggaagccugguaaaucacagauucggugugaggcuuacugguacugcugugacucccuaguguggaggauuuggccuuauuggauguuggugcacuugccucugcugacaguguggcuggugucuccccugacugcagauggauuuguguucccugcagcaguuuauacucaucugcuuacauacugauucagaaacaaagauugaaccacgcccacagaugucauggguauucuuugcaauguuaguauauucuuuuucuuaauaucauuuccauguaucuuuauucuucucagauaaaaguuagagccgcauguccuggaggugacugcagguuguuggauuuggaguaucggccgugucucaccacauccuggcuccaguguggaugcagagagagugugacagaggaucugccugugaaccaccugggauuagucaagucccaaggugcccagagugggacuaguucuucacaguguggcagcugcacuaaucuguuugugagggaauauccauucccucacucuacucuccucacuaucggaaauucauuuugauucagaauaaaaaccaaauguauagagcuuuggguguaggauaugaaauuguacuuagauuuaagaaaaagagaaaaucagauguauuuauuugacuucauuccguauuugaaagcacauuuuaauuuuuauuugccuuguuuuguuuuaauugaguagugagaguuuuagaccuuugucuuuaguacacccaaggaucaacugcuccugaagcaaagaggucaggauggaguaugcagaaguuggguagagagguuaagaagaggaggaagugagacggggaagggaggagcaccuugcuucacuauacaguauuccaagcucucugcuguccaguaggcugcuucucugagggucaccucaaagguaugcuaugccguguggcucuuaugugcccaggugguguggucagagaguggaugggcuuccucccgcccugaggcaagcaccucuucucuguagcugggaucaaccacaauuaauaggaauccucaacauacuaaauagcaggcacuugaaaauggguguguuuucuuccauugucgucuuuucuauugaggguugggauuugggugggagaggaaagcaaauuuuauuuucuugacuauaaauuuguuauucuugguaucauuucauuuuuauaauuauacauuagacauuggcacuuguguaaaacugucccugcagauugagcaggaaguaaaaacaaauggaaaugcuucggauaguggcagggguggggguugcuaaggaaagggugggaugggaguggguaaagaguuugggaagguuaucuaacugaaucacuacugaguugaaucauggcuaucauuagccacagguacugcugauuauaaggccaguaaaauuuuaguaccuggagguuugacucuaauuuuugcacugauggugccaaagggcccugagucaaaaggauagccaaggguggaguggaaaaagauauggugaaggcagaacugcucacaccagcuccagaagcacguccucugacuucacugccgcagcucuuuccacacggggccgugauugacccuaaaaauugcagaccagcacauacacuggacacugcaggcaagguguugguaacugccugcucuaggaugaauaguagcguuagcagcacccuacagaggguaaguuucagaauuguaauuugagaacuccuucaauuauauugacuuucuuugguuuuccuugugcauuagguauauauuuuuugaaguauuuuugccaacuaaaaugaagucuguaaauucuguuaauaaacaaggaguucauccguugcucacaucuuucauuggugcccucugaacucuguggguugcuaggauguaauuuuaaugcuucccugcaguccaaagaugauuuuuucaccacaaaugguaagggaugcccaccuacuuuuauaaacaccacugcaacuuaacaaguuuauuuaucuauguccagauuucuguuucuguccuaaauugaucuguguuuuuagguggaucaacuuggaucuuuagaccucaucuauaaauugaaauuauauuuuuagucauaagccaaguacaaucuaacucagaaugggauuaaaaauuuuagaagcagaagcuaauauauaaaugaaguuugggauuuggaacuuucuguaucucuuaggaggaacaaguaaaaaccaaaugguuacauugugcugcuagaaauaaugucauucucaauuaaaaggguuacaccuguagccacuugacacuaacaccaucgagggcaauuaaucaggagaaaaguaaauauaaaaacuuugcucuuaacgucacacacuacaggguaauuauguaauucucuagcacucaauuaagaagcuuguagguuagcaaaauuucaguuucucuaguucagccagugucuuguccuuaguaauuauuugcuuucccugcaguucaauuucuccuuggaacucuaacaggacuaacuggaaaaauacuuugaccauagcucuaguacuuccaaauaaauucauaucuagauuuucaaacaaagccccaagaugaagucuaauucugaaaauaucucacaauuuuugaauguucuuuuuaucuuaccgaccuaacuucucuuuucccucccaacuuggccucccacacguuccauuucauuuuggccauuauagucacauccguuugacuuugguugugacaucuuccuuucaggaugauggaauuagaugcagucugucuuugagugagacuggucaccaucagaggaguuuuuucuaagugacgugacuagaaguugaaaucuacuucccugcuaaagggcacaggggugguguacaaagaaagcuaccuucccagagcaagcaggcugcauuuuagcuauggaagugaccugcugugacacugugcucucuucugugggcuuaaugguuccuuugcuaugaaguggcaaauuacauguagagugucuccuuccuuuucagagaacaguuaaucaaggcaaaucagcaagcccccaaagugcuguaauuuaacaucaugauuaccaccuucgaagcuauauauuuugcauacuuuaaaaucaccuaacuuggacugcuugaauuacauuggcuuuuagaaccgaaauuguaacuauguauuguauuucaugggagguauauuuuaugagcuuuuuggcuuucuuuuuucccacagcaacugccaaugaaggaugaauccccuuuuuaaaaaguuguuguuguuguuguuuauuugauuuugaguuaggagggauaauagagaaguccauuuaaaaauuauuuuuagaagcuaaagaaaguaauuaugcuuccugugaauugucuuuuacuggcaucuuuguuuuccucuuugauguuaguaaauuugguguaauacguggggcuuccauauuucaaaguggaagcuuucuucucugaagucgauauaugguuuugaauuacuagagcuuuggucaguauuuccuucccuauaugucacagagggcaccacugagaacugcgugcauaggaccucaaaauacaaaauuagcagggccucacagucagcuuccucauggcuaguuuuucccccuuauauuacaauuuuuguuuuauaagucauuuuuuuccugauauuuccaccacuuuucagagucaucuacaaaauuuuucuuuccucaagaaaagaguuccuuuugccuuauuccuuaugccuuccccacugguauugaggguuuugauaauaaauugguaggaaaaaaaaguaccuccuagaaggaagccuuccccaccauuuccaggugccaacugcuaagcagauauauuccaaaaaugguaacugucaugugcacacuguugguuauuuuuaauaagccucuuccuacuagaacauuuuauuuuccuuguucaccauacaaucauguacucuuuaacagaaauugcuuuuaaaaaauaucuggaacuaucuuuaaaaaaacuuuauuaauaaucauguauuuuuacugaucacauuuugaaaugccuaaaagacuuuauuguucuaauuauccagauguaccuuuguaaaauagcucuuuuaugaauuagcugauaaggcuguauguuucuggaacaaaauauuggucaucuaaaaacuuucuguuuucuggggucugggaaaauagaaaauaagauuucaaauauuaaauaagcuuaaaggaaccaagcaugugacuuuuuauuuguauucugguugauuugucuuguccaaguuauauuagaaaaguugaggagucgaggagccuguaauuaauuuuccugucagugacugucagacaucuuccugcuuauuagagcaucccuagcaacaaggcuaaaccuucaugacagugcuggcaggugggcuugcccuagcauguggggcagguuuguuguuuuuuuaauagcuuuauugagauauucacauaucauauaauucauccauuuaaaguguauaaucagauggguuuugguauauuauugauuuuuaauuguggugaaauauauauauaacaaaauuugcuauuguaacuauuuuuaaguauaaaguucagugagguaggccagcuuuuaugacgcaccugaagauaacuuugguuuuaauccuacccuaaaugaagcauaugccucuauuuuuccuguccccagugcugggcuucuucacauaccaacauuucugugcuuuuaccaacagcauuuuagcucagaaggcucgcuuacuuugggcauuugcuguauuuugguuuugaaauacuuguaauuugacuuauucuugggauaauauuuuaguuuucagucauucaagggcacauuuggcugacggagcuaauaagcguaauaaaaugcuuaguaguuuauaccaucuuuuaguuaaacauuuuaaagauuaagacuauucaaauguacuuugcggaaauuaaccuguuuguaugccuggcuuuguuuacaaacauauaucuauaucuauauauauagauacagauacagauacauaucugguggaacaaagaaauaccuguaccauucccacuugcucuuugauagccaccuccuaggaauggagacaauaaaacucuguauuugcaugug

SEQ ID NO: 192044 - RNA, 13533 nt, Homo sapiens
uuggcugucagucggauccgagaacgacgauuggcuuuccuugaccgucccucaagcgccucuccggagauggucugaggugggagaagagcugaagagaccuggagccgacagacgguaagcugggguaugugcucugcaggggcugcaggaggccaagcucuucccgagccaccucggcgaguauucuugccgcuuggccacgcuggucugcccugguccgguccccucaccccgacuggaaccucccugcuuucuagucuaggggcuucgcugcggcugagacucggucgccgccacgccuuagcgugaaggauuccgggaagccugcgggacugcgaguggagagguuuugcccaacgggacggucuccuuccuucuguccaaauucuaccuguccuucgaggcguggugcgggccccacugcuuaggggagacuuccuuuucgccugaccgcggaggugucucucuguccuggucucccucaucggguacuuuguuucggucguugucuucacguaucagucuuaucuuuuuggccaaauuaugaguucuuaggcguuuaggacccuuuuuuucuugaauaccacaguucauucauugucuugcguuacaguauaugcccucuuaaguguuaagaggguagagugaagaucaugccccuaucuccucagaguagaaacaagagacacagaaagagaaauuaaagaagacaggaggacagucagagagcgucagggaguuuugccuagguuucagaucauucuguaucgccagcuagcuugccuccuuggacuuacccaccagucuaacagcagguguauguuuagaauauuugugcucggcacaguguagggacacgggcaggugugauaugguuucugcucagaagcuucuuauaguccaauuggguaaacgagacuagaacacauaaaacgaccauggcaacaugaaaauaggguugaaguuuuauggugucagcugugccagccauagaacuaaggagcaagaguagauucagggaugggguaguuuaggaaggcuucccggaaugugauuaucuccugauauuuauugaguaccuggggugugcaaagcucugugcugaaucugagaaugagaagugaauaagugauggccacuguccugagaaacuccuagucuaggggaaacaaguuucauugcauugauagcaaagauguguguggaugccgugggcaagagaugggauaugccagcuguaccuggaugaauugggaagggggucaucaaagagaagacuuugggguuugaaaggcgaauagaaguugcauagguaggccugucgcgguggcucacaccuguaaucccagcacuuugugaggccgaggcgggcggaucacuugaggucaggaguuugggaccagccugaccaacauggcaagaccucgucucuacuaauacuacaaaaauuagcugggcgugguggugcgugcuuauagucccagcuauaauacuucggaggcuaagucacgagaaucgcuugaaccugggaggcggagguugcagugagcccagaucacagcacugcacuccagccugggcgacagagcaagacuccaucuccaaaaaaaaaaaaaaaaaaaaaaagaacuugcguaggcagagaguuuuaggagaauguagaguauucagagacaaagaugauugaaucagaggaagagggaaugaaguaugggugaggaagccagagaacagcaucaugugggagaaagagcaugaucuuuggauuggaaugagggugcucuuacaucagaugaaguguagagaggacucaccacagggcugacacacuguagcuucucaauagauguucguuucccuaccuagaacuggagaaguaaaauugagaccacuuugagaagagccuugcauuucauacuguaauagucagaggaggugugggauuuuaugacuuuugaagcuuuuuucuacuuuucuuaccacaacauuauaaaagcagucaauauucaauauuucuuucuucuuuuuuuuuuuuuugacagggucugggucugccgcccaggauggaguacaauggugugaucuuggcucuuugcaaccucugccuccugggcucaagccuuccucccaccugaaccucccaaguagcgggacugcaggugcaugcuaccacaucggcuguuuuuuuuuuuuuuuuuuuuuuuuugagauugaaucuugcucugucacuaggcuggagugcaauggugcgaucucggcucacugcaaccucugucucccggguucaagugauuccccugccucagccuccauaguagcugggacuacaggcgugugccaccauaccuagcuaauuuuuuguauuuggccaggauggucucaaucuccugaccuugugauccccucgccucggccucccaaagugcugggauuacaggcauaagccacugcgcccggcugauuuuuguauuuuuaguagagacggaauuuugccauguugcccaggcuggucacaaacuccugagcucaagccauuugcucaccucagccucccaaagugcuaagaucgugagccacugcacucggcccagcagucaauauuuguaauagggauucacuaguagucugugagcagcucagcaacccuauaugcaccccagaguguuaaggaugacuggauucuucucugaggaggagaaaaggcuauguagguacaguagguauaguggguucagaaaagccuguauugggggcaugaaggaucuucuguuuuuucguauuuucuguuuuuuuuccuuuuaguauucaguaaaggccuuuuuucagaguucccaccugucucagguaggccagagagagcaacaugguggggucagcaagaauccgugagaauuccugaggagaaggugacacucaggagacagagccaaggccggcuaguguccucucucuagcagaaauuuugcuugcaacgucacccucuguucuguguuucguuuauucuuuaauuguuacucaaaguaugcuucuggaacugcuugcaucacaacuggggugcugaguuaaaagggcagauuucuaggcuuaacuccugccuuccugaauccgaacuucucacgcaggcgcuggauaacuacauucgugugcagaucuaaaauugagagcuaccugggcaugguggcucacaucuauaaucccagcacucugggaggcugaggcggguggaucaccugaggacaggaguucgagaccagccuggccaucauggugaaacucugucucuagcaaaaauacaaaaauuagccaggcguggugacacaccuguaaucccagcuacucaggaggcugaggcaggagaaucucuugaacccggcagguggagguugcagugagcugagauugcgccacugcauuccagccuggguaacagcgagacucugucucaaaaaauaaaaauaaaaugaaauaaaauugagaaccuuuaguuuuuuguuuguguguguguguguguuuuuuuuuuuuuuuuuuuuugagacagagucuuacucuguugcccaggcuggaguacaguggcacgaucucggcucauugcagcuucugccuuccaaguucaagcgauucuccugccucagccucccgaguagcugggauuacaggcuugugccaccacgccuggcuaauuuuuguauuuuuaguagagacaggguuucaccauguuggccaggcuggucuugaacuccugacuucagaugauccaccugucuuggccucccagagugcugggauuagaggugugcaccagugcgcacagccgagaaccuucaguuucauguuuaucuuucuucaauaaauauuuauuacagacugggugcaguggcucaugccuguaacuccaacacuuugggagucugaggcagauggguugcuugaguccaagaauucgagaccagccugggcaacauggcaaaacccugucacuacaaaaacaaaacaaaacaaaaauuagacagaugugguggcgcaugccuguggucccaguuacuugggaggcugagguaggaggaucuccugagccuggggaggucgaagcuucagugagcugugauugugccacuguacuccagccugggugacagggugagacucugucucaagaaaaaaaauauuuauuacaugccuaagcaugccuagcaguguauagacacccaaggugcaguauaaacuacacagauacggcuuuuuauguucaaauggaaucuacauuuuaacagaagguauuagcagagugguggaguaaaccguuggauagguuagguaaaggcagauuguauggcacugugaaagucuggcaggggacuuaugauucaauaagaaauaaggagcuucuaggcucaucuguaggcucuauggaguagaaccguauauggacuagagucagcccaacaugacccuaccauuaccacuaguguguggccgugagcaagucaguugaccucuggaacuucagguguuuaucuauaaaugagguuaaaaauagcaccuaccagcugggcgugguggcucacaccuaugaucccagcacuuugggaagccaagguggguggaucaccugagggcaggaguuugagaccagccugaccaacauggggaagaaacccugucucuacgaaaaauauaaaaauuagccaggcgugguggcgggcgccuguaaucccagcuacucaagaggcugaggcaggagaaucgcuugaacccgggaggcggagguugcagugagccaaaaucgagccauugcacuccagccugggagaugagcgaaacucaaucucaaaaaaaaaaaaaaaaaaagcaccuacggcaaagggugguguugguaauuaaaugacauaaugcaaauaaaaugcuuacuguggugcuugacauauaguaagugugaaauuaaaaacaaaaagauuuauuaucuucauuuugcagaugagaguauucagaaguuaaguucuugacaaaggucauacagcuaguagaugguagacaguggagccaggauuugaacccugauccuucucaaaagccaucuguuugaaccugagcauuguucugccucacagaggaauaauuccuucuugguggguugcucugaagcuucaugagaaaaugucuguuaaagcguuuagcucagugccuggcacacacucaauaguguuaguuuuuguuuucccuuuccacaaacaccagacaucuuccagggauuuaaggaauuacuccauccuuacuguaaaagggcaggguuucucaugggucacuggaacaacacgugcugauucuaggcaggcugccugcccagcuuuuugcccucagcagcaccuggguggaauucuugcagcuguggauuucuuccucuuccucuagggugaaggccaugccgccuccugggaaaguuccccgaaaggagaaucuguggcuacagugugaguggggguccugcuccuuugugugcucaaccauggaaaaguucuuugagcaugucacucagcaccugcagcagcaccugcauggcucuggggaggaggaggaagaggaagaggaggaugacccacuugguaagagagcaggacacaggaaggggaggagcucaaggaaagguggaaaaucugacuuucuuuuccuuagagggagaaggcggccuaagagaauggugguuuauuuuccuaauuguguuuuuguuguauauaaaaacauuguaaacucauuuauagaaaacucagucaacaaggauauaaggaauaaaucugccauccugccaucaagaaguaauugcugacaguacuuuagugaacauuguuuuugacaucucucugccuguguuuacauauauuuaaauacagaugaaugugcuuuuuuuuaaucauucuguacaaguuguuggcaaccuguguuuuguuguuguguuuuuuuuuuuuuuuuuuuuacucuucuaguauucccaauuuuuuuuuucuuuuacugcaaccagucagaaauacaucuuacuuuuuagagacagggcuucaucuugucacccagguuggaguccagugucaugaucauagcucacugcagccuucaacacucaagggauccuccugccucaaccucccgaguaguuaggacugcaggcauguaccaccaccacacgccaauuuuuaaaaaaauuuuuuuuagagacaggaucuugcuuauguugcccacugaucucaaacuccuggccucgagcaauccuccuaccuuagccuccuaaguagcugggacuauuggcuugugccaccaaguccaaccccacucccaccuuccaauuuuuuuuuuuuuuuuugagacggagucuugcucuguugccagguuggagugcaaugguucgaucucggcucacugcagccuuugccucccagguucaagcaauucuccugccucagccucuuguagcugggacuacaggcgcgcgccaccacgcccaacuaauuuuuguacuuuuaguagagaugggguuucaccauguuggccaggauggucucaaucucuugaucucaugauccgcccaccucggccucccaaagugcugggauuacaggcgugagccaccgcaccuggccccaucucucacuuuuuaaccuuugucugacuuauguuuuagguaugccuuuuaucaauagcaaauaacugggauuuuaauaaaauccaaucugaaaacaauaacaauagugaacuguauucuauaguaccuacuguguguuaaguauugcuggguacuuuauuuuuuuuuugagauggagucucauucuuguugcccaggcuguagugcaguggugcaaucucggcucacugcaaccucugccuccucgguucaagcgauucuucugccucagccucccgaguagcugggauuacaggugcgugccacuacgcccgucuaauuuuuuuuuguauuuuuaguagagacaggcuuucaccauguuagccaggaugccccuguuggccagccuggucuugaacuccugaccucaggugauccgcccgccucagccucccaaagugcugggauuauagacgugagccaccaugcccggccaguacuuuuuuaaaccuacauuaaagcacuauuucccaaagagccuaugagauaggcacuauuauuauuauuauuuauuauuauuauuuuuagauggagucuugcucugucgccaggcuggagugugguggugcgaucucagcucacugcaaccuccaccucccagguucaagcaauucuacugccucagccucccgaguagcugggauuacaggcacaugccacuaugcccagcuaauuuuuuuuuguauuuuuaguagagacgggguuucacuguguuagccaggaugggauaggcacuauuauuauacccauuuuacaaauaaggaaacggaggcacagaggaauaaaauaacuugcccaaagucacgguacuaauaaguguggcaggauuuaaaagaaaaaggaaaaaaaaaacuuuuuuucagaguaagauggagucuuacucuguugcucaggcuagagugcaauggcaugaucucggcuaauugcaaccuccgccucccggguucaagugauucuccugcuucagccucccaaguagcugagauuacaggugcccgccaccacgcccggguaauuuuuguauuuuuaguagagacaggauuucaccauauuggccaggcuggucccaaacuccugaccuugugaucugccugccucggccucccaaaguguugggauuacaggcgugagccacugcgcccgaccaaagccacuuuuuuuuuagagacagagucuugcuauguuaccagguugaucuuaaacucuuggccucaagugauccuccugccucagcaugcugagcagcugggacuauaagcauaagccacugcaucuggcaggaauacauuuuucuuuucuuuuuuuuuuuuuuugugggagugcaguggcucgaucuccgcucacugcaagguccgccucccggguucaugccacucuccugccucagccucccaaauagcugggacuacaggcgcccaccaccaagcccagcuaauuuuuuuuuguauuuuuuaguagagacgggguuugacuguguuagccaggauggucucgaucuccugaccucgugaucugucugccucggccucccaaagugcugggauuacaggcgugagccaccgcacccggcccaaaaugugguugauaguucacugaacugauuuccuaacccacuagugggucacaacacagucugaaaaacucuauucuacaggaaauauggaggcagcucuccuucucccaccccaaauucuguuuuaagucugaugacuaugaaccauaauugauaguuucaaaauucaagucauauuuauacaaaggcaaaauuggggaaugauuauauuuucuaaaguaucuguguuucaaaacaaguuaacuuauauaaagcgcugaaaauacagugcuuagggaugcuagagagauaggaaauggauuggaagaguugauggggccuucuuggagaaggcagaucuugagcaaaacaugaggggaaggaggaguggugguuuuacaaggagaagugggaggugucagaucgagaggcagcaucuucaucaggaacugcagaaacucaagucagaggacuugcgugccggccauuucugcugucuguuucuggcauaggccuugcacacacucucaccucugccuagaccacacuucuucaccuauuuacagauacucauccaucguacuucagaguucaacauggggacguuucucagaacaccaugucaaaugaccucuguuuaaugcuuuuauagcaccauguauauccccgcuuuguaacacucaucacugguugcaguuuuauauuuauagaucugauuauuugaugaauaugcuuucucccugacugaaagcuaugugagggcaaggagugggacacuuuuuacuuguuauagucccucuaacuggcacacaauuuauggucauuaaauacugguauuugcuaaaugaacccugguaauuugguuagaguccagccuccucacgaguccagccuccucacucucuguuuagugcugcagguggaaggugaccugagccuuggaaagugucagacucuuccuuuuaaaccccuuucuacagaggaagaauucuccugcuuguggcaggaauguggcuuuuguucucuggacaguucugcugaccucauccgccaugucuacuuccacugcuaccacaccaagcugaaacagugggggcugcaggccuugcaaagccaggcugaccuuggccccugcauccuggacuuccagagccggaacgucaucccugauaucccugaccacuuccugugucugugggagcacugugaggucagcaggcagugccaguaauugggguggaaggaagcugggggucuuaacucugaugccuugucccuuucagggaugccuuauauuuccaagauuccugcuaguaucucucuuccauuucuuuugcucuuuuaaaauuuguuuauuuuuuacacacaggcucuugaucugaagcccaggcuagagugcagugguacaaucauagcucacuguaaccuugaacuccugggcucaagcaauccucccaccucagccucccaaguagcuaggacuacaggcauguaccaccaugcccugcuaacuucuaaauuuuuuguagagacaaggucuggguguguugcccaggccggucucgaacucuuggccucaagugauucuccugccucagccucucaaagugcugggauuacaggguuuagcaaccgcacccggccacuccuccauuucugugcagugccuuuccucaaaauuucccauccccaucaaguuaauuugggagagagccaagaauucuucgggcacauaggggugagucccucuacccacccucaguccucaccccaaguugccccuggcacagaauuccuucgacaauccugagugguuuuaucggcauguggaagcacacagucugugcugugaauacgaagcagucggcaaggacaacccgguggugcuguguggcuggaaagguagggcugcuucuuaacuuguggcuucuggaggaaacgcugggguuccugaagagcugggacagaaagggauagggguccuacaggggcaagguugacugccggcuggagagacucagggguaccagauccuaggcaaaacugggguuuuguggcaggagacugauagggcuuccuucccaggcuguaccugcaccuucaaggaccgcaguaaacuucgagagcaccuccgcagccauacccaggagaaagugguagccugccccaccugugggggcauguuugccaacaauaccaaguucuuagaucacauccgucgccagaccucauuggaucguaaguagucagaggaagugggguggaugcaggcuguccugcuuggaauggguuaggggcauguuucuaguggggguggccacugaagagaccugccuuuuggcugccucuucuuuuugggcucaggcaccucccauagucucuuugcugauucagauucguaggcauuguuauucaguacuuacuguaccucguaucaguuacuuagggaauccucacaacagccccaugagguaggcuucuuaucccccuuuuugcagaugaggaaacugaggcucagagagguuaaaucacuuaccugagaucacacagcuaguaaguggugaagcuggaauucuaacucagguucucuaagucccaugcucuuuccaugauacuguguccauucauagcucccuaagcucuccuuuucuccuugggugguucccuucugccugggaugguuccccucuccuuucugugccucuccacuaucaccuacagcccuccuuucuucugccugccccaccccagagcagcacuuccaguguucucacuguuccaagagauuugccacagagcggcuauugcgggaccacaugcgcaaccauggugaguggccugcggcccacagccucccuccugcccuccaagguuccacaaguucucacaucacagccuccucucugcuucucucagugaaucacuauaagugcccucugugugacaugaccugcccgcugccuuccucccuccgcaaccacaugcgcuuucgucacagugaggaccggcccuuuaaaugugacuguugugacuacagguaagggggaccagggaccagaaaacagcucauguuccaguguuccccauguccuccaaucccuccugauuucucauggcagcugcaagaaucuuauugaccuccagaagcaccuggauacccacagcgaggagccagccuacaggugugauuuugagaacugcaccuucagugcccgaucccucugcucuaucaagucccauuaccgcaaaguacaugaagugaguggggcugguguugggaaggacuaguggaaguaugggggacccuggggugaagagcuggucucauuucucccuuccuuccccaucagggagacucugagccaagguacaaaugucaugugugugacaaaugcuucacacggggcaacaaccucaccgugcaccuucgcaagaagcaccaguucaaguggcccucagggcauccccguuuucgguaugucucucaacccuccuucccagauuaacacacuuguuuuuauaccuuuucaaccaguuuuaaaaaccuuaauuugggucgggcgcgguggcucacgccuguaaucccagcacuuugggaggccaaggugggcggaucaugaggucaggaguucgagaccagccuggccaacauggugaaaccccgucucuacuaaaaauacaaaaaguagcugagcaugguggcacaugccuguagucccagcuacuugggaggcugaggugggagaaucacuugaacccagaaggcggagguuguagugagcugagaucaugccacugcacuccaaccugggugacagagcgagacuccaucucaaaaauaaauaaauaaauaaauaaaaccuuaauuugauggugguuuuaugucugccauuuccauuuagauucaaagaauccuaagaauaaugguggagcaaagcuuauuuuucuguuuuuugaaucuuguaaggcauggugccaaacccaauaaauggugccaaaaaguccugcagcuggaacuagagcuagagucuaaggguucugauccuuagcuccaaggccuucucauaaauccuuugacacuuucacccuccaacacagucagucagucucuguuuuucugguuggguuucuauauaaaacuuuccauuuugaguaaugaucuuucccucuugccuuuucuucuacauauuccaauaaagaccuuuuuugucuucaacuccugucacuuggauuccaggacuucuuccaucccucauguuuguuccuuacuuugccagccucggccauuucuguaucccccugccuggguuugcugcccuuuaugcuccuaccucaccagguacaaggaacaugaagauggcuauaugcggcugcagcugguucgcuacgagaguguagagcugacacagcaacugcugcggcaaccacaagagggaucgggccugggaacgucgcugaacgagagcagccugcagggcauuauucuagaaacagugccaggggagccaggacguaaggaagaggaagaggagggcaaggguagcgaagggacagcccucucagccucucaggacaaccccaguucugucauccacguggugaaucagaccaaugcccaaggccagcaagagaucgucuacuaugugcugucugaagccccaggggagccucccccagccccugagccaccuucagggggcaucauggaaaagcuucaaggaauagcugaggagccagagauccagaugguuugaaggccgcagagccagaccauuucuuccccagguccugaaguuugagccaggcaaguggcagugccccuagugggcagccguugccaauggaugccuuuaggaguggugccgagagcagugugguccacucuggccuggguuugcaucauucugcagacucuaaagacuucccuuuucugccagacuacauuuuguggggagccugaggacucuggauucuuugaggggauccuggauguguguguucuuguuaaagaggcuguuaucaggcuuaaccauaacccucaagaucugcuugacagugauuaaauccuuagcucacauccauucccaucuuucgggcuccuuaggcccaaggauggcaugugacuggucccugcaaggguccuuucuuugucaccagccaaggcauugauaaccaaguagccauuuuccucuuaagguuuccucuacaaccccaaggacuuucaugauuauccucagggacaggauuggaggcauugagcguguuuauuaacaaauuguuuuugguaauaaaauaaaugcuuggacucuua

SEQ ID NO: 192045 - RNA, 14196 nt, Homo sapiens
cucacgugacaaagcucccggaggugggagcccugggccaaaauggcggccuaccugcaguggcggcgcuucguuuucuucgacaaggagcuggugaaggagccgcugagcaaugauggggccgcucccggggccacaccugcuucuggauccgcugcuuccaaguuccuuugccucccuccuggcaucacugucugcgacucaggccgagggagccuggucuuuggagauauccuucguuuggagcugucuuuucccucccgggaucccgaagagaucgaguuaggaugaaaucuguuugucggagggguccgugccgcgcgccucuuugguuuagcuggucauccagaguuguucuguggucuacgggaagaaagaaggaaguccaucuccuaacuuguuaucaacugagcaauccugggcaagucauuuaaccucucuggguuuuaauuuccuuaucuguaggagaugugugcaugccaauuugacgagguuaauuugagaucaauaagaaaaagaaugcaaguuggcuuuaaaagaugaauauguaaagugacaugauuuccccugcccuaauauuaucguuggcgaggagguaaaugagccuagcgguuuguugcuuucaucuucauguugcugcuacuaaauucuggccuuuuuaccuuuuuuuuuuuuuuuuuuuuuuugauacggagucuuacucuguugcccaggcuggagugcaguggcgggaucugggcucacuguaaccgucucuugaguucaagcgauucuccugccacagccucccgaguagcugggacuacaggcgcuugccaccacacccggcuaauuuuuuacauuuucaguagagacgggguuucaccauauuggccaggcuggucucgaacuccugaccucgugauccacccgccucggccucccaaagugcugggauuacaggagugagccaucgcgcccggcgcacuaaauuuuuuucuuuuuuuugagacggacuuucacucuuguugcacaggcuggagugcaauggcaugaucugggcacacugcaaccuccgccucccggguucaagcaauucuccugccucaaccuccugaguagcugaaauuacaggcacgcaccauuauaccuggcuaauuuuuguauuuuuaguagagacagguuucaccauguuggccaggcuggucucgaaccccugaccucaggugauccgcacccccccccccccccggccucccaaagugcugggauuacaggugugagucaccgcgccuggccucauucuuuuuaagauaaggaguaugugggaaaauccuugaaaauuuuagaguuauauacauguaauuguuaucugaguucuggucugaauguaaguaucucuccuuggaaaggaggcuccuugacuacccugcacauauggaaggccagaucugguucuugccacguuccuacagcuuacaggcuuccaagccuacaaacuacgggugacacaccuguaccaacugaagcagcacaauauucuggcaucuguuggagaagaugaagagggcaucaaccccuuggugagucccagcagggaaaugggaaagauccagaagccuaggaaugauuuuuuguuggaggaugacuagcauuuacacuucugaggucuguccacagguuaagaucuggaaccuggagaagagagaugguggcaauccacucugcacucgaaucuucccugcuauuccaggaacagagccaacuguuguaucuuguuugacuguccaugaaaaucucaacuuuauggccauugguaaacagaaggcaaaacuaacccuccuagauuuguuauagauuuucuucagaguugcuucugccucucaucuuuacuguuuucaggagaccacuuuguacugaacugaggccuuugcgauauuaaauuuuggaaugggggccaggcgcgguggcucaugccuguaaucccagcaccuugggaggcugaggugggcggaucaccugagauugggaguuugagaucagccugaccaacauggagaaaccccaucucuacuaaaaauacaaaauuaguuggguguaguggcacaugccuguaaucccagcuacuagggaggcugcggcaggaaaaucacuugaaccugggaggcggaguuugcagugagccaagaucgcgccauugcacuguagccugggcaacaagagcaaaacucugucucaaaauaaauaaauaaauaaauaaauaaauaaaauaaauaaaguuuggaaugggaaggcauuuaauuuuguucuuugaaaaugugucagugaguaccaauauucagguuaaccauuagagagguuggguauauggagaaagcuugucacuucugagugccucaaguggucuuuuuuccccucuccacuuccugaucuuuucagccuuacugaaguaauuuucuuguuuucuuacagguuucacagauggcaguguuacauugaacaaaggagacaucacccgggaccggcauagcaagacccagauuuugcacaagggcaacuauccuguaacuggauuggccuuucgccaagcaggaaagaccacucacuuguuuguugugacaacagagaacguccagguaugaccaaggccuccacucuuaggagcaggcagggagggcuucuccauuguucagggggauaggguaaugaagugacaggaaaggugggaguguuaaaguuuuaaucauauaauucgaaucauuugccuagcuuuguauuuuauuuuuuugccuaggaagcuggaaagaguuagacucugggcuuguaguaaaaagaugugaauuuucuuucuuuuuuuuuuuugagaccgagucucacuguguugcucaggcuggagugcaguggcgagaucuugacucacuguaaccucagucucccagguucaagcaauucuccugccucagccuccugaguagcugggauuacaggcacacaccagcauguccagcuaauuuuuguauuuuuaguagagacaggguuucaccauguuggccagucuggucuccaacuccugaccucaggugauccacccaccuuggccuuccaaagugcugagauuacaggcgugagccaccgcacucggccuugaauuuuauuucuaacuagcuuuuuuuuuuuuuuucuuugagacaggaucuugcuguguaacccaggcuagagugcaauggugcugucucagcucacugcaaccucugccuccugggcucaagugauccucccaccucagccuccugaguacgugggauuacaggcaugugucaccaugccuggcuaauuuuuguauuuuuucuagauauggggguuucaccauguugcccaggcugaucucgaacuccugggcccaagcaauccaccugccucaaccacccaaagugcuggaauuacaggcaugagccacugcaccggccuauuuucuaacuaacuuuuuaaaugacguuggacaaguaucuuuaccuuucuuguuccuggugccccagauuuacaacagucuacucucucaggaauacucuugauaaaguaguagauuauuacauuuuucuuacuugcagaauuucuguacuagauagugauaauauauacagagaaagaaauugugaucucugguuauauauuuaauagauggguaaugguuaaugaagaaggccagcagccaagagaaagacuuuagaaugccaagagggaaaaaagagccaguauggagaugggaauaccuuugugaaggcuuagaguuaccuccucaaaggagccuguuaaccccuuuguugcuucuggcaguccuauauaguuucuggaaaagacuacccucgcguggaguuggacacccaugguuguggccugcgcugcucagcccuaagugacccuucucaggaccugcaguucauuguggccggggaugagugugucuacuuguaccagccugaugaacgugggcccugcuucgccuuugagggccauaagcucauugcccacugguuuagaggcuaccuuaucauugucucccgugaccggaagguuucucccaaguaaggacucagugagaagggacagggagagggcuggacuuguuccccagaauccgccugauuuuaaaauccuaaugccuggauacugccaaucuccuacuccuacuccgguguuauguagguaacauuucuguuuuuuuuuuuugagauggagucucgcucugucacccaggagugcaguggcgugaucucggcucacugcagccucgccuccuggguuccagugauacuccugccucagccuccugaauagcugggauuacaggcaugugccaccacgccuggcuacuuuuuguauuuucaguagagacgagguuucaccauguuggccaggcuggugucagacuccugaccucaagugaucuacccgccucggccucccaaaguacugggauuacaggugugagccacugcacccagccagugacacuuauagcuagaguugguuacaaugcuuuuuuuaacugaaaaauggauguuuuuacugcagguauuugcuacauagcccuagcauacuagaaugcuccagggaauuuggaccugcuuuuuuuguucuguuuuguuugagauggagucucgcucuauugcccaggcuggagugcaguggcgcgaucucggcucacugcaagcuccgccucccggguucacgccauucuccugccucagccucccgagcaacugggacuacaggugcccgcccccaugcccggcuaauuuuuuguauuuuuauuagagacgggguuucaccguguuagccaggauggucucgaucuccugaccucgugaucugccugccucguccucccaaagugcugggauuacaggcgugagccacugcgcccggccuuguuuuguuuuuuaacucuuuugucaaaauaaauugggcagaggaacaagggauucagcaguggagaaauuagaaagugcugggaaacguaggaugcaaguuuucuguuuuguuuugguuuuauuuuuuuaagggguaaguggggucuucugcaugaugaaaguacucccuguuagaugcugguuuguuuugcuuucauucaguuccaggcacaguguuuuacauauaccauguauuggauuauuauuuucuaaaugaauggauauguuaguguacuuaauuuucuaaucuguuacuuggguuaauuguaggauccuaaaggguaagaucagguuuauguguucucuauguacaacuaccggcacagcgcugcauguuaugggaugagagggaccagagaggugauuugugcugggugaaaugugcaccaaaguuaucaugggaaaggaaauaggggagauaagacagagauguccaaacaucuggugcuuuuucuuuccuaugcaggucagaguuuaccagcagggauucacagagcuccgacaagcagauucuaaacaucuaugaccugugcaacaaguucauagccuauagcaccgucuuugaggauguaguggaugugcuugcugaguggggcucccuguacgugcugacgcgggaugggcggguccacgcacugcaggagaaggacacacagaccaaacuggaggcaaggccaccaggcucgcagagcuggccacaggcaccuagaagcagcugcaggagcagguuccccaagucauauuggccaggguguuucccuccuugugggucacagccuuacucagcuuccuuaggguaggauuauaagguaaauggccugggauggggcuuuagagggaaguaguggcugggagccugagcccacucuaaggguucacuuuguuuccagagaaccuuaugaaauaagaugauacugaucuuggggauaucugguagcucuugguuugucuaggaucuaggcagaucagaaauccaggacuuucuguuuuguguguugugcgcacauuuugggaaagugucuucccaggaccacuucuaccaauuuucuaaucucucuucccuucuagaugcuguuuaagaagaaccuauuugagauggcgauuaaccuugccaagagccagcaucuggacagugaugggcuggcccagauuuucaugcaguauggagaccaucucuacagcaagggcaaccacgauggggcuguccagcaauauauccggucagucuggaggcacuuugggauauagcugugaaugcagggacaggcagcuagauagcuaaagcccauccaugcuccagguaggggcuagaauucuaccaggaacuguuuuuguuuuugguuuuuuguuuguuuuuguuaguuuuuuuuugagauggaguuucgcucuuguuguccaagcuggagugcaauggcgcgaucucgacuuacugcaaccuucccuccuggguucacaugauucuccugcuucagucucccgaguagcugggauuacaggcgcgugccaccacaccuggcuaauuuuuuguauuuuuaguagaaacgggguuucaccauguuagccaggcuggucaugaacuccugaccucaggugaucugcccgcuucagccucccaaagugcugggauuacaggcaugagccacugcgcccgguguuuuuuucuuugcuuuuuuuguuuguuuguuuguuuuugagacagauucucgcucuuucacccaggcuggagugcaauggugugaucucggcucacugcaaccucugccucggguucaagcaauucuccugucucagccucccaaguagcugggauuacaggaucaugcugccaugccuggcuaauuuuuuguauuuuuaguagagacgggguuucaccacguucucuaggcuggucucgaacuccugagcucaggcaaucugccugccucggccucccaaaguguuaggauuacaggugugagccacagugccuggccuuuuuaauuuucuuuauaagaacuaugaugccuuaaaugagagaacaagauuccuuguugaaaagggaauuuuagggucaaauauuauaugaccaguaugcaguugagccgaugauuaccucucauuuuaaccuuuagcuuggccuuuguaaauauucacuuugaccugguucuuuaagggggaaaagguauucaucucuugcuuccauaauuccuuccaucaguacuaauucuuggaauuuucugccuuaagaagggguuuuagaaaucugucuaagguggccgggcgcgguagcucacgcauguaaucccagcacuuugggaggcugaggcggguggaucacgaggucaggagaucgagaccauccuggcuaacacggugaaaccccgucucuacuaaaaaauacaaaaaauuagcugggugucguggcgggcgccuguagucccagcuacuugggaggcugaggcaggagaauggccugaaccccagaggcggagcuugcagugagccgagaucgcaccacugcacuccagccuggguaucagagcaggacugucucaaaaaaaaaaaguuugucuaaggcuggggugcaguggcaugugccugugauccuaucccuuugggagaccgaggugggaggaaugcaugagcccagucugagcaacauagcaagaccccauuucuaacaauaaauaaauaaauaaaauuuaaaaauauggcugggcgccguggcucauuccuguaaucccagcacuuugggaggccaaggcggguggaucacuugagguuaggaguuugagaccagccuggccaacauggugaaacccugucuccacuaaaaaaaaaaaaaaaaaaaaaauacaaggccaggcgugguggcucacgccuguaaucucagcacuuugggaggcugaggcagguggaucaccugaggucaagaguucaagaccagccuggccaacauggcgaaaccccaucucuacuaaaaauacaaaaauuagcugggcaugguggcgggcgccuguaaucccaucuuaaaaaaaaaaauuagcugggugugguggcauaugccuguaaucccagccacucgcaaagcugaggcaggagauucacuugaaccugggaagcagaggcuauagugagccaagaucgugccacugcacuccagccugggcaacagagcaagacucuaucaaaaaaauaauaguagauaauaauaauaauaauaaauaaauaaauugccagggggcagugacucacgccuguaauccaaacacuuugggaggcugaggugggcggaucacgaggucaagagauugagaccauccuggccaacauggugaaaccccguuucuacuaaaaauacaaaaauuagcugggugugguggcaugcaccuguagucccagcuacucgggaggcugaggcaggagaauagcuugaacccaggaggcggagguugcagugagccaagaucgugcccugcacuccagccuggcgaaauagcgaaacuucgucucaaaaaaauaauaauaaaaaaaggccgggugugguggcucacaccuguaaucccagcacuuugggaggcugaggugaguggaucaccugaggucgggaguucgaaacuagccugaccaacauggagaaacccugccucuacuaaaaauacaaaacuagcugggcaugguggcacaugccuguaaucccagcuacucaggaggcugaggcagaagaaucgcuugauccugggaggcagagguugcggugggcugagaucgugccacugcacuccagccugggcaacaggagcgaaccucccucucaaaaaaaaaaaaauuaauuaaauuuuaaaauaauguaaaagaaagagaacaaaaauacaacaauaaaacaacaacaaaauaguaauaauauaaaaagaaaccuguuuggccucuuccccguucucuuuagaauuccuauuuuuagccaaauuuaagaagcagugcucuggagccuuguuacccagugugguccacagucuaguagcaccgauauuaccugggacuuuguuagaaauguagaaucucaggccccacuccagauccacugaaauagaauuugcauuuugagaagaucugcaagugauuccuguguacaugagcuggagaaguacacugauucagaugcuaucgggugcacaugucucccuagaaccauuggaaaguuggagccauccuacgugauccgcaaguuucuggaugcccagcgcauucacaaccugacugccuaccugcagacccugcaccgacaaucccuggccaaugccgaccauaccacccugcuccucaacugcuauaccaagcucaaggacagcucgaagcuggaggaguucaucaaggugcaggauguuguugguggggaagucuuggaggccccacugagcaugagguggcuccaccgggacuuguucguuucagcaagacauagggagaggaaagggcugaccuuauuuagaggaguggcuguuccuguuaguucggugccaucuccccucuuguuuuaugauucuagaaauucccaugguaucuaagcccagggugguggcacuggggaaguccugucccuagcggugucccucuaaugguaggggcagaggaaaacuuuagucagaaacucccacaggcugaguagcauaauauuuucaaagugugaacguuaugauaucaccuuaggaaucugaaagucaggugccuguuuccucucccuucucuaucucccucuguguaaaugauuuugucucaugucucccuggcagaaaaagagugagagugaaguccacuuugauguggagacagccaucaagguccuccggcaggcuggcuacuacucccaugcccuguaucuggcggagaaccaugcacaucaugagugguaccugaagauccagcuagaagacauuaagguaggugagacugucuuuuuuccccaagagacagggucucacuauguugcccaggcuggaguugaauuccugggcucaggugauccucccaccccauccuccugaguggaggugagacucucaacuugggcagagcccugucguuuuugaagacaucuccagaauggugaaagugcuuccugguggcugaggcaggaguauacacuauucugcccuuuacuuuuccacagaauuaucaggaagcccuucgauacaucggcaagcugccuuuugagcaggcagagagcaacaugaagcgcuacggcaagauccucaugcaccacauaccagagcagacaacucaguugcugaagggacuuuguacugauuaucggcccagccucgaaggccgcagcgauagggaggccccaggcugcagggugaggcugcagggaaaagagcuucagacuguggggaucaccuuaagggcuuccuguauaucacgcccacucauucagccuccuuuuuccucucuugccauccuaggccaacucugaggaguucauccccaucuuugccaauaacccgcgagagcugaaagccuuccuagagcacaugagugaagugcagccagacucaccccaggggaucuacgacacacuccuugagcugcgacugcagaacugggcccacgagaaggauccacaggugaggccuggccagggcuucaggagaaaagacaguucgugccgucuccauucuuccgucuugguggcugccuuucacugcauuccuuagaccaguaacaccuuaccucggggcucaaugguccucugugaagagggaauggacugagggaaagaguugacuggcuuugucccaagagaccuugugauuuuccccuuuuguccagcagcucugcccuccuuccucuccaggucaaagagaagcuucacgcagaggccauuucccugcugaagaguggucgcuucugcgacgucuuugacaaggcccugguccugugccagaugcacgacuuccaggaugguguccuuuaccuuuaugagcaggggaagcuguaagaguuuggggaauuucagggaaaggggaagaauccaagucauuuuccagagacagccacugaggugugcccuugccccggccgcagguuccagcagaucaugcacuaccacaugcagcacgagcaguaccggcaggucaucagcgugugugagcgccauggggagcaggaccccuccuugugggagcaggcccucagcuacuucgcucgcaaggaggaggacugcaaggaguauguggcagcuguccucaagcauaucgagaacaagaaccucaugccaccucuucuagguacuugggaagacagaugggugggugacaagcugcugacagcugggcucuguggcaggggcccuucaccuuuauccagagagugccacacgugguugauugucuuguuuccucuuggaccccaaucucaguggugcagacccuggcccacaacuccacagccacacucuccgucaucagggacuaccugguccaaaaacuacagaaacagagccagcagauugcacaggaugagcugcgggugcggcgguaccgagaggagaccacccguauccgccaggagauccaagagcucaaggccagguacccggggcauggauauguggaggaguccaggggauaacuugcccuucacaggguauucauuacuaaguacuuuccguagaggauacuauggagugcuuuugagcauuuugauucuucaaguuguguuuuaauugaggaauuccaaaaaaugguuuauuacauagaucauuauuuauugggcuuuggaugauauuauuuuguagcagguacuuuuuguucuuuauaugccuguauucuaccacuucuaaacacauccguauugugguuggaagccguucugguguuuuucuuuuuugagacaggaucuugucacugaggcuggaguggaggggugugaucacggcucacugcagcuuugaucuccugggcucaagugauucucccgccucagccucccaaguagcugggauuacaggcgugugccaccaagcccagcuaauuuuuggauuuuuaguagagaugggguuuauaauguuggccaggcuggucucgaacuccuggccucaagugauccuccggccuugaccucccaaagugcugggaugagccacggugcccggccauaaucccaacucugaaaucuuaccugcccuuaacauucuguaaaauauuuauuagagaacaacaguuucuucauucuacaaauauugagccucuguggugucccagacacuauucugaacagcacaggcaaaaagccuucauggagcuuuauguuguagaagagacagacagcaaacauguuaaauaggcaaacuuuuuuuuuuucuuuugagauagagucucacucugucacccaggcuagagugcaguggcgcgaucucagcucacagcaaccuuuaccuccuggguucaagcgauucuccugccucagccuccugaguagauggaauuacaggcgccugccaccaugccuggcuaauuuuuguauuuuuguagagacaggguuucacuauguuggccaggcuggucuugaacuccugacuucaggggaucugccugccuuggccucccaaagugcugggauuacaugcgugagccacugcacccggccaaauaggcaaauuuuuuuuuucuuuuuugagacgaagucucgcucuugucccccacgcuggagugugauggcgcaaucucggcucacugcaaccucugccuccuggguucaagcgauucuccugccuuggcccccugaguaccugggauuacaggugccugccaucaugccuggcuaaucuuuauauuuuuaguagagacuggguuucaccauauuggccaggcuggucuagaacuccugacgucaggugauccaccugccucggccucccaaagugcugggauuacaggugugagccacugugcccagccaaauagacaaaguuuuguaguauguuagguggugauaaguucugaguggcaaaugaauugagcaaggggagugggagaaguguguuaacaaguuuagagaagguggcccaggaaaggccucagugaaagggucacaucugaguacagaccugaaaguuaauuuaguggcaguugugaaaauggagacagaggaaacaauccccaggcugaguuggccuuguugggagcaugcugagacucacugcagguccagggcuguuguauucauuugacucccuuaaggcgauaagaagagcagggcagggccuucaggggccuuaccagggaccuugcccugugcacuucagcugccuucuuucucauccuugacuccuggccuugcccucacuuuugccacucacuucuggucuuucuucccuguaguccuaagauuuuccaaaagaccaagugcagcaucuguaacagugccuuggaguugcccucaguccacuuccuguguggccacuccuuccaccaacacugcuuugagaguuacucggaaagugaugcugacugccccaccugccucccugaaaaccggaaggucauggauaugauccgggcccaggaacagaaacgagaucuccaugaucaauuccagcaucagguggggaugagugggcuagaugggccaggggauucccacuagugucacagagucacuggagggcuuguuuccuuaucaccuccucauuuaagaaacaagcacuuugauucugauucguauuccuucccuccucuucuccugcagcucaagugcuccaaugacagcuuuucugugauugcugacuacuuuggcagagguguuuucaacaaauugacucugcugaccgacccucccacagccagacugaccuccagccuggaggcugggcugcaacgcgaccuacucaugcacuccaggaggggcacuuaagcagccuggaggaagaugugggcaacaguggaggaccaagagaacagacacaaugggaccugggcgggcguuacacagaaggcuggcugacaugcccagggcuccacucucaucuaaugucacagcccucagaacuaaagcggacuuucuuucccugccuucuuauuuagucagcuugccaucccuccucuucacuagcaguguagaucauuccagaucagugggggagggcaccucagcaaccucugaguguggacaauagcugcuuucuucucuauccaagagcaccaggcugugcuuggguccuugcucucagagucuauaaauaaaagaauauaaugauuugggagcuuaa

SEQ ID NO: 192046 - RNA, 43500 nt, Homo sapiens
aucuugaguggaggaggagccgcggucgccgccaugcggagaggcagggaaagagggaggaggcggcgggcgggcgaacgggcgagcgagggagggggcagaggagccgaguuagcucagccaggcggcgacuucggcggcgccacgagagcgggcagcggaggagguagggcuggacagccgggggagccggcggcucgggcggcuggccugcgcgccccucggagcggggcgggggcgggggcgagaggaggccguagcgagagggcugggugggggcgggcggagguuuccgaggaggaaggagcguccgccauuuugggagcuucgagucaacaauaaaggaccgagggugccgagcgggaguggccucguugguaggacacgggcccgagucgcgaggcuuggggugaggugguggggucgaggucagcggugcuuugggggcuguggggagccccccgggccggcucugggggacucucgggcggaggccuaaggccuggccgggccuggggaggaaggcggucggcagcuguguggggugggagcgccugagaggaggcgaauauaggaauguggugcgcagcagggucggcaggaggaacaggcuaaguacucggaguagcuuuaucgaagaugagggaauaugaggccgaagggggcggcaaggacuuagggggaugaugguggagguuauaggguacgaggcggcccuauagggggcggcagggacaugcuguauuggagggcucgguuuagaagcaaaccggccgcugcuugauugcaguaggccuugcgggucaauaacaagaggguauuuauggagcccccgacucuuggaggaaaggagggggauuucugguuuaggggguccauuuggggccuccuugggggagucccuauuguuugcuacuaauggagcgguugcuggcucauauugcgcagauaagauugcagagccccaaccuuuuguguuuauggucagaaguguguguguuuggggcguggggcggggugcggggggacaagaaauuuccuuucaguuacgggguuccagucauuagucaaugacucuuucccguaucucucuccuuucucuuccucagcccccauuucccuucagaauaaaacccagucacuccaacuugcaggcaaagcuagaaaaacugcgcugcauuugcaaacaaaagcucuuguuggcgaugacgauacuguuuugggugugaaacugucaauugcuaacuacgaucugugaagugcuguaauuaacuccgcuaggggcuccucccaacuagucuacguuucuuguuguuuguuuuuuguuuuuuuguuuuuuguuuuugaaaauguagaaaacuugcaaaucuaaauugggaagggguaggaggaauauuuccuucucugagaaaaagcugcagugcagguuucaguuuaagaagggagcaguuaucacauagucucauuuuggauuuaaggauauaggaggucuuacugugcaugauggacaguaaugaugauaucguucggucuuuagagguugcccuuuucauccucuuagugcucugcaaacagcuaagucucugugaacugcgugauaucgcugaucauaauauaaaaccgucaauacaggaaaguagcuguuaaccauaucugcuuaagaggucagagucugaaguaaacagcuuuguguaugugauaaucaggauuugcuugugagcaacuuguucauuuuuuuuuuaaggaaggcauaaucaaggagcauuuucuucauaaauguugagaucuguugacuuuaaaauuuugaguuucacaugccuugguguauggcagaaagaaucagcacucguaagcuaguguauuuuauauaagaaauguaacgggguugcugggagcgguggcucacaccuguaaucccagcacuuugggaggccaagacaggcggaucagcugaggucaggaguucgauacuagccuggccaacauggcaaaaccccgucucuacuaaaaauagaaaaaauuuagcugcgcgugguggcaggcgccuguaaucccagcuacucgggaggcugagacaggggaaucgcuugaacccaggaggcggcgguugcagugagccaagauugugccacugcacuccaaccugggcggcagagcgagacuccgccucaaaaaaaaaaaaaaaaaaaaaguguaacgggguuaaaucaaaagccaacagaguagggcuuuguuuucgugucuuuguauguuuuuauuaacuccaauuaaaaguaagauuucagccgggcacgguggcucucgccuguaauccuagcacuuuaggaggcuaaggcgggcagaucauuugagguuaggaguccaagaccagccuggccaacuugauaacaccccgugucuacugaaaaauacagaaauuagccagaccuguaaucccaccaagcuacuugggaggcuaaggcaugaggaucgcuugaaccugcgugguggagguugcagugagcugagaucgggcuacugcacuccacucugggcaacagagugagacucugucucaaaaauaauaggccgggcgugguggcuuacgucuguaaucccagcacuuugggaggccgaggcgggcggaucaccugagcucaguuguucaagaccagccuggccaacaugucgaaaccccgucuuuacuaaaaauacaaaaauuagcugggcaugguggcgcaugcccguaaucccagcuacucaggaggcugaggcaggagaauggcgugaacccaggaggcggagcuugcagugagcugagagcgcgccauugcacuccagccugggugacagugcaagauucugucucaaaaaauacaauaaaaaauaaaaguaaguaagauuuccauuuacgggauaauuuuaaacugagguugacuaguuuuguggguuuuguuuguuuguuugcuuuguuuguuuuuaagucagaguauugcucuuguugcccaggcuggaguacaauggcaugaucuggacucacugcagccuccaccuccuggguucaagugauucugcugccucagccuccuaaguagcugagauuacagggccaccacgcccaguuaauuuuuguauuuuaguggaacggaguuucaccguguuggucagguggucuugaacuccugaccucaggugauccaccagucuuggccucccaaaguguugggauuacaggcgugagcuaccgugccccuccuaccaguucuuuuuuuuuuuuuuaaacuauuaauuagcuuuacuacucuggauuucuuggaaaguuuucuuaaaauuacuaguguguuuagucuuccgcggauuuuuuuuuaaacaggaauuuuccuguuuuuuuaaauuuaaaauuagaauaguuauuagcuaaguuuguuauaaaugaauaaaauuauuagagucaucuugguuuugucaauuucaaaauaaaaauucauuuauacaaaauuuguguauaucauccguccuugggaucauuacuugcuggaugcauuauggcagaaauacacuauucucuugacugcuucauuuauuguuuuaaaggacaaaaaggaaaaaagaaaauacauuuuucuucuuaaaguuuuuuguuguuuuuugagacaaggucucugucaccuggcucacugcagccuccgucugccagguucaagcgauucucgugcuucagccucccaaguagcugggacuccauuacaggugugcaccaccaugcccggcuaaauuuuguuuuuuguuuuuuuuuucuuguuuguuuuuguuuuugagacggagucuggcucugucgcugaggcuggagugcaguggcacaaucuuggcucacugcaaccuccgccuccuggguucaagcaguucucugccucagccucccaaguagcuggaauuacaggcgcucgccaccacgccuggcuaauuuuuguauuuuuaguagagacaggguuucaccaucuuggccaggcugauccugaacuccugaccucaugauccaccuuccucggccuccuaaagugcugggauuacaggcaugagccacugcacccggccuaaauuuuguauuuuuaguagagaugggguuucgcuauguuguccaggcuggucucuaacuccugaccucaagagaucgcccgcauuggccucucaaagugcugcgauuacaggccugagccaccagcacccagcccauaaaguuuaauaguugaaauuuguaagggcacaaagguguuuuuuucuggaagugugaaguucaagucaaaagcucacuuaaaucuauaaggacucucgguugcuauuacaaguagaagaaaauuaaugaauugucuuguuuaaauugugugauacuucagugaguuguaaugcaauuaaguauaaugaaucacugacuuuuagagaugucagagacuuagagaauucauggggaggaaacugaagagaagagauuaucauugacgaguagugcuaauuuacuagucucuuucuacuuaaucucuggauugcuuugaauuaacaauuuuaaauguuugauauuggccucauuguguuuuugagauaguucaaaguugugucuauccuagcuuggcucgugauuuggucuaaguguagcuguauuauuaauucuuuaauauaaaagaugagaauucuuuuaaagggguucuuuuaaaagggaaacaaaguuuuucuguuguguuugcuaauuuaauuuuguuuguuuguuucagauugacgugagugaauucagauauaacucaagcuuguuagagggcuuuuuaaaaauaaaaaguugauuccgugcaagagagcaaguuacugcugcuuaccguucagagacuuacaggugcuugccugcauugcaauaaaggacucauuuauugagcaagacuuauauuuaucucuucauuuuggagagccuaauaaacuguuauuacaguuucucuacugacuuucaaaaguuuugaaguuugaaagaccuuugcaauuaaaacagcaugagcacggccagaacagagaacccuguuauaaugggucuguccagucaaaauggucagcugagaggcccugugaaacccacugguggcccuggaggagggggcacacagacacagcaacagaugaaccagcugaaaaacaccaacacaaucaauaauggcacucagcagcaagcacagaguaugaccaccacuauuaaguaaguguuagaguaaauuauuaauaaacacuuguggggaaccaagauuuguguuacuuugguguugacuauuaauacuuaugccuuaauuuaaccauuuugauuccaaauagaggacagaugacuuuguuuuauggccaguagguauuugcaauagaauaauauauuucugccauaauuuguucagcaaguagucauccugaggucagaugauacacacaaauuuuguauaaaugguuuuuggaaacauuucuggcuuucauaauuaguguaaaaguuauuagcuuaguuuguuguaaaugaauaaaauuauuagucaucucguuuuugucaguauaguuuuuuuacgacugcaccuuacccuaguuaaacagcagauaaagccaacuuuauguauuaaauuuaaagacucagucugagucuuuagagucuuuaaagacuugcccagccuucugaacuccaagcauuauucacucagaaaauuuucucguaacuuuuuuuagcuuauggaacuuagcuuuuuuacuuuaaaaaaaaaaaaaaguuggcugguugaggugacucaugccuguaaucccuguacuuuggggaggccaaugugggaggaucacuugaguccaggaguuugagaccagccuaggcaacauaaugagacucugucucuacccaaaaaaaaaauuuuuaauuuuuuuccuccuuuuacauauaaaaagggaacuaagaauuuugaacucacagaacacaguucugaacagucucagaaaccuuuuguuaaccuuaaaauugaagagccuccucuuacuagaggauauuuuuucuuuuaaagcugaaaguauguaggcuauuuguuacuuuuaagugcauaguuuaaauuacaauauuugaaugguaaccaucacuuuaaagauucaguuauaggaaauuaacauuuaagauucuugacuccaguugauguuuggcuuuuguuaagaacuugccauauagguccgggugcaguggcacacgccuguaguccaagcacauugggaggccaaggugggcggaucaccugaggucgggaguucgagaccagccugacaaacauggagaaaccuugucucuacuaaaaauaaaccccgucucuacuaaaaguacaaaauuagcugggcgugguggcacaugcccauaaugcuacuugggaggcugaggcaggagaaucacuuaaacccgggaggcggaguugcagugagccgagauugcaccauugcacuccagcuugggcaacaagagcgaaacuccaucucaaaaaaaaaaaaggccaggugcgguagcucacgccuuuaaucccagcacuuugggaggcugaggcagguagaucacgaggucaaaaguuugaggccagccugaccaacauggugaaacccugucuuuacuaaaaauacaaaaaucagcugggugugauggcaugcgccuguaaucccagcuacucaggaggcugaggcgggagaaucacuugaacccgagagguggagguugcagagagccaagaucgugucacugcacuccagccugggcaacagagaaauacuccaucucaaaaaaaaaaaaaaacuugccauauaaaauaauuuaacccugggaaucuuuauaagauguugacacuggguuacugaacugagguauauguuuuauuacaaccuagaucuuuucacuuccuacagaaaaauagcuuauacaagcuaccagacugucauauaguuaccguaugugguucacuaggaccucuaagaacuaauuuucagcagaauugguuaggucauugggagaauugguauuaguguauauucuguuauuuuuaaggugaaugcuuuaauugguauagaaaugaauacuacuucaguuguaguuugucuuggcagaauguaaguagguuagcaaaauuuagacuauuuuuaauuuuuuuuauaacuuuuuuuuuuuuuuuugagacagggucucacuuuguugccuaggcuggaguaugguggcacgaucauggcucacugcagccucaacuucccaggcucaagugauccuccugccucagcccuacaaauaguggggacuacuggcaugcaccaguagcgacggcguuuugucauguugcccaggcuggucuggaacuccugagcucaagugaucugcccaccucgaccucucacagugcugggauuacacaugugagccacugcgcccagccuauuuuuaauuuuuuuuuuuuuugagauggacucucacucacucuguugcccaggcuagagugcaauggugugaucucgacucacugcaaccugcaccuccuggguucaguucaagccauucuccugccucugccucccaaguagcugggauuacagguguccaccaucacgucuggcuaauuuuuguauuuuuaguagagaugagauuucaucauguuugcaggcuaggcuugaauuccugaccucaggugaucugccugccucggccucccagagugcugggauuacaggcgugagccacugcaccuggccuaugagaauauuuucuauuuaaaaaauucuggggcuggauaugauggcucaugccguucaucccaucacuuugggaggcugaggugggaagaucacuugaggccaggaguuugagacuaaccugggcaacauagcaagacccugucucuacaaauaauaaaggcugcagugagcuaugaucgcaccacugcacucaagccugggugacaggguaagaccccaucucaaagaaauaaaaaauaaauucugauuuggggacaacaguggauuuugauuuuucuuuucugguuuuccuacgauuaaugguuucuuuucaguucugcgguucuucaaaucucauuuucucugcccucucuuccaugaaguccucuagaucccaucaagugucucagaacacuucuaauacuuaaccuccgucacuuacuuucucauuuuaaauaguuuuuucaucucauaagauuauaaauuucuuguggucagguuuugcauuguaucuuacgcauuauuauucacuauuuuguugaauucaacgguaugucaaacugacaucagaaacuucgaugauacaggcuuagaugaaaggcuuuaguaggccgggugagguggcucacgccuguaaucccagcacuuugggaggccaaggcaggaggaucacgaggucaggaguuugagaccagcugaauccccgucucuacuaaaaauacaaaaacuagccagguguaguggcaagcuccuguaaucccagcugcucuggaggcugaggcaggagaauugcuugaaccccgggagguggagguugcaguaagccgagaucaugccacugcacucuagccugggugacauagcaagacuccaucucagaaaaaaaaaaaaaaggcuuuaguacaguaguagucuuggaauugguagcaaaaaguuaccaauguuagaguaugcauuauguaggaccuaguuuuaaguaaaauaaguggucuuuuugucugugaauggagcauuugagauguuuuggggacucugguuauguaagaacagcugcagugaaaacuuuuucgaagaugucacaguuaaauacuuugucugcagauguucccugaucuuuuuuuuuuuuuuaaagaugcuuugaguauuuauuacuugagguuuuuaccuggccaaaaagagaguuuauuuauauucuccuuguuuuuauucucuuucaugauuucuagcauuuccaauaaaaaagaaagauuaagagaugcucauuggcuaauacugugcuauuauuuugccaggcacugugcugagugcauuauaucaauuguuugauguaacuguuaaccuauuuuguuuuauuuauuuauuuggaacggagccuugcucuggcgcaggaucuuggcucccggguucaagcaauucuccugccucagccucuugaguagcugggauuacaggcacaugccaccauggcuggcuaauuuuuguauuuuugguagagaguggguuucaccguauuggccaggcuacucucgaacuccugaccucaggugauccgcuugccuuggccucccaaaguguugggauuacaggugugcgcccaccuuauuuauuuuugagacagagucucccucugucacucaggcuggagugcagugucgugagcuuggcucacugcaguguccgccucccagguucaagugauuccccugccucagccucccgaguagcugggacuacaguugugucccaccaugccuggcuaauuuuuguauuuucaguagaggugggguuucaccauauuggccaggcuggucucgaacuccugaccucaagugauccgcccaccuuggccucccaaagugcugggauuacugaugggagccaccacgccuggccuguuaaccuauuuuaaaaaugagaauagccggccaugguggcucacaccuauaauccuaucacuuugggaggccgaggcagguggauuucuugagcccaggaguuauauaagauauauaaaaucuuacaguuuuuaaauguugagaacuaauuuaaacucauuuaaauuaaaacacaugcuguguaggucaaacaaaacaccuuuugacaacaguuacacuguauacaauauugcuuaagaggauggaugccuuaaucccuucuguucuugauuuuuuuauccuccugagauucucuauaagaacacuuuuucuaaaguuguuuaauuaucuuguuagauauauuaaauggaauauauuaaacuuacugugcuuuuuuaacacuuaauuauaauugagaugaaucaucuuuguuaggaugcuaugaauuuugauacuucaaguuuacuguauucucucuagaccuggugaugacuggaaaaagacuuuaaaacucccuccaaaggaucuaagaaucaaaacuucgguaaguugguuguaaaauacaaguagaauaaugguggggaacuagaagugagguauagcugucccucgguaucuggagggaauugguuucaggaccauaacaccacugccacccuccuccuccaacccaguaagauagauauucaggcuauauauucccauuuuguggaugagaaaacaaaugcucagcaguuaguucucuuagccuauuguuuucaaccgggagaauuuuugucucccgggggcauuuagcaauuuguagaaacauuuuugcuuaucaucaauaggggggaagcuaaaggacagcccuuuacaacaaagaauuuuguggcccaaagugucaguagugcugagcuugagaaauuugacuuagccaaagauauuuguagcucaugagugguagaggugggauuuaacuucauaucuugugauuugcaauucauggcaugauauuuguguaaaaaaauaacacuauuccaccaguccuuaggagacugugaccaagggccgggcacaguggcucuugccuguauucccagcacuuugggaggccgaggcaggcggaucaccugaggucaggaguucaagaccagccuggccaacauguugaaacccugucucuacuaaaaauacaaaaauuagucgggugugguggcgugcgccuguaauccagcugcucaggaggcugagacaggagaauuacuugaacuugggaggcagagguugcagugagccgagaucacgccacugcacugcagccugggugacagagcgagacuccaucucucgaagaaaaaaagaaggcuaugaccaagugcucuuuccccaaaacauaguuuuuuaaaaagcuugugugucaaagcagggacagugguuuuucuucaggaaaaguugaaauacagauuaaaacaaguaaucugcauauauuuauauuuaagauugggcagguaaaguacuaaagucagagaaguuuucuuuccuuuuuuuuuuuuuuuuuuuuuuuuuuugagauagagucuggcucuguccccccaggcugugcagugagugcgaucucaccucacugcaaccuccgucuccuggguucaagcgauucuccugccucagccucccaaguagcugcgacuacaggcgugcaccaccacccuggcuaauuuuuuguauuuuucguggaguuggaguuucaccauguuggcuaggcuggucuugaacuucugaccucaggugaucugcccgccuuggccucccaaagugcugggauuacaggcaugagccaccaugccuggcccagauaaauuuucuuaaacacagauaaauuuaccaaaggacaccaaauuuaccaacaguguuauuuauucuuuuauuguuccuuuuuguuugacuaggaugugaccuccacaaaaggaaaugaguuugaagauuacuguuugaaacgggaguuacugaugggaauuuuugaaaugggcugggaaaagccaucuccuauucagguauguuaacccuuuuuaucacauauguaagguuaugugucaaccauuaaacaguuuucuuuuugcucugcagaagugauacagugaacuaacauuucucucucacguauacacacuuuuucugaaauuuuuaaggguaaauuagaaaaucauggcuuuuacaacucuaaauauuucgguguguauuucuuuaggauauucucuuacguaaccacaguacaguuaccuucaguuaacauugauaaaauacuucuaucucaucugucauucuaauuauuaauggacccaaacauguccuuuauagcaguuuuuuucuucuauacaggauccagucuagggucagguauuauuuguaauuaugucuuuuuuagucauuagcguuucccuaguguuuguucuucuuuuuaugacaucagcauauuaaaaauacagccuacaaccccuucccccaucccucuuuuuuuuuuuuuuuuuuggcaacugggucuugcccugucacccaggcuggaguucaguggccugaucucggcucacugcagccuugaccucaugggcucaagugauccuccugcgucagccuccuaguagcugggacuacaggcaugugccacaacacccggcuaauuuuucuauuuuuuuguagggauaggauuuugcuauguuauccaggcugauuaaaacuccuggguucgccauagugcuaggauuacagacauuagccaccaugccuggcccccuuuuuuuauuaauaguacauuucccguuuugggauuuugugauauucccaaguaauuagauucaagguaggcuuucucagcccgaauaaugcagaaaucacauuauggccuucucaggguaucauguuugaaggugugccuaguguccauuuauuccucuuuggugauguuaauuuugauuacccugucaagauguugugugguuuuucccuucuauaauuacugcucuuuccccucucccuugagacgaauaagcaaucuggggugcauuuuaagaccauacaaauacaauaauacuauggccacccuccuccuccaacccaguaagauagauguucaggcuagguauuauccccguuuuguggaugagaaaacaaaaguucagagcaguucucuuagcguauuguuuucaaccagggaggauuuuugucccccaggggacauuuagcaauuuguagaaacauuuuuuauuaucaucaauggggggaugcuaaaggacagccccuuacaacaaagaauuuuguggcccaaaaugucaguagugcugagcuugagaaacuugacuuagccaaagauacuuguagcucaugagugguagaggugggauuuaacuucguaucuugugauuugcaauucauggcaugauacuuuuuuaaaaaaauaacaaaauuuccccccuaguuuuagcacccauuggugauucuugcuugaucucaucucugcucugauggguuaugaugacuuuccaauucuagcacucccucuguauuugccccuauaaagaagaaacuucccuuccccucauccauauauaucuguuaucaguauggacuuauacucaccauuuuuuucaauuuuuuucaauuuuuuuuuuauuauuauucuaaaaauagccuagaucuggccaauguaagcucuuucagccugguuccuauguuuuuaugauguguccccuucauuuuucuugaguacuuucuugguuuuuuuuuuuuuuuuucucuuuuuugagauggagucuagcucugucagagaggcuggagugcaguggcaugaucuuggcucaccgcagccuucccauccuggguucaagcaguucuugugucucagccuccccaguagcuggaauuacagaugugugcuaccacaccuaacuaauuuuugcauuuuuaguagagacaggguuucacccuguagaccaggcuggucuugaacuccugaccucaaaugaucgcccacuuuggcuucccaaagugcugggauuauagaugugagccaucguacccggccccuuucuugcuuuuugacauaucaugaugcaggcuuaucuuauaccuauccuggcccagcauuggcauccaaggauccuugauucuuuuuaguguggaguaguauuagggaccaagacccaggcauuagguacccuguuugcuacuugguccuuucaguggaaagagcaaggaaauaaaugcauguauauacauauccacacacacauacacauaaauauacacguacauauaaacaugcauuauacauaggccaguuugauaaaugaugacaacagacauacuuaaauugaugaaaugauugaauucaggcugugcuaaggacaaacccugugacaucacugaguacuuuuucauugagccaacauguguggagugaccuagaaaguguuugaccuugggaauucuauaaugaauaagacagauauaugguugcugucuuacagucuggaaaggacagcuaauuguacagguaauucacuguaauaugaugaguaccuuucuaguuggaauugcguauguauguagucauuagaggaagaugggacaaccuggaagaauugagcuguguuccaagcagagaacgcuggguaaugauugcccagaguugagagugugcuuuuggcuggauaaaguaucaaaacaaggauaugcaucaucagagggguaauuuggguguagguauuagaaauaccuaggaaucuacuaugauguaguucauguuaagccauuuuaucuacacugaagucuuuuuuuuucuuucuuuuuuuuuuuuuugagacagagccuuacucuguugccaggcuggagugcaguggcgcgauguccacucacugcaaucuccgacuccuggguucacgcgauuccccugccucagccucccgaauagcggggacuacaggcgugcaccacagcacccggcuaauuuuuuguguuuuaguagagaugggguuucaccauguuagccaggauggucucgaucuccugaccuugugaucugccugcuucagucucccaaaguguugggauuacagacgugagccaacacaccuggcccacugaggucuuaugagaguuccuuuacaguaggaacugcaucauucaacuuuuaucucuaguacuuagcauagugccugugcuuauuuagcgugcuuugaugaaacuuagguaacucaugucugcaggugaacuugguguagggaacugcccagauuaaaucccagcucuacuccuucauaaauugguuauuugggaucuauaagucuuagacuccugaccuauauaauugagguaauaguauaauaccauaggguuguuguaaagauuaagugagauaauucacaugcuuaguacaaugccuaguacgugauaaaugcucaaaaauguuauggguuauuuuauauaauaguuucaaaaaaggaaauuaguuaauuuaggagacguaauuguuuuaaauuuguuuuaaagagacugagucuugcuaaguugccugggcuggaugcagugucagaaucuuagcucacugcagccucaaacuccugggcucacgugauacuccugccccagccuccugaguaaggaugauaguguaguaccagcacaccugguuguuuuuuguuuuuguuuuuguuuuuguuuuugguagagucaagguuuugccauguugaccaggcuggucuugaccuccugggcucaagcaguccuccugccuuggcuucccaaugugcuagaauuauagaugugaaccacugcacuuagcccaguccucauucuuaguggauauuugcugacuccuauuucuuaccuuguauuaaaauuuaaaauuaacuuuguuacuuguacucugaguguuguuauagcauauaggcaauuaacucuucagccacuuaaccaaucugacauccagcuuuuucuguaaaguagaaauaaguacucucccucacaggauuuuuauuguuaagaucaaauguaguguacaaccaaaguauuuugaaauagcaagguauuguaugaguauauuguuuuagauacucaaggucaccacuuguauugccuuuuucuuuuuuuuuauugccuuuuucuuuccuauuguuuuguccuggggauccauggaaagcacaagauuauguguuucuuagaaucaaucagaguuacaagucacaaauauuaggauuuuagaaccgaaacaaaauuuacagauccccuaguaaaaaaauuuuuuaaauuuuuauuuucauagguuuuuugggggaacaggugguguuugguuacaugaguaaauucuuuuguuuuugagacaggguuuugcucugucgcucaggcuggagugcaauggugugcucucggcuuacugcaaccucugccucccggguucaagcgauucucgugccucggccucccaagugacuugggauuacaggcgggcaccagcauacccggcugauuuuuguauuucugguggagacgggguuucaccauguuguccagguuggucuugaacuccugaccucaggcgauccacucuccucggccucccaaaguacuggaauuacaggcgugagccaccacgccuggccaaguaaauuauuuaguugcuauuucugagauuugggugcacccaucaccccccugguaaaauauaaccucauggcaggcugucuucuaguauucuuuccauucuuaucuaccuucucguuuuauuuuugucaucccucccccauuccuaaaaguaucucuucuaucaugcuugguuuuacaguuuuauccaggcauuuuuuuuccccuaaauauuaaaacugccuugauuagaugggugagucuucugcauuugaauauuuguuugagauggaauuuaguugcaguuuggcugugagauuuggagaauuggcugggugcaguggcucaugccuauaaucccagcacuuugggaagccaagguggguggauugcuugaguccagggguucaaaaccagccuaaacaacaugacaaaacccugacuguacaaaaauuagcugggcaugggggacauguagucuuagauguucaggagguugaggcuguaagugagccaggauugugucacugcacuccauccugggcaacagagcaagacccugucucacaaaaaaaaaaaaaaaaaaaagacuguuagagaauuaggcacuuaaaauuauaugcucucaaaagagcuuuuacauugacaggcuggaaccagauauacuacagauugcucccacaacguauuucuagagccaucugugaccaguucuaggucuggaugcuguggccaguagaauaauugccauucuaaagguauagcuuuauaggaaccuagacuucuuuggaaggcuuaagaauauacuguuuuugucugcuuagcauuauuugaaacuuuauauuaacuuugggguuaugauugagaaagauggccucucucguugcuucuaaacccugggaacaccucuugaagacuuuuucgaaacucuaagaaggugaagaaaugagaaguaguugauuauugagggaaacauggaagcuccguacuguuggcaacaaaauuuugugccaggucagcuaaggucuaaugaggauuaauaguuuacuauuuauaguuaggaauuauagcauucugaauccuguaaauaagucauucuuccugcuaacaaucgguuuaucaugauugaaaaaaauauuuccuaaaaacucaaagguuuuuuuuguuuguuuguuuuguuuuuuuuuuugguguguguuuuguuuuguuuucuuuuuggguggggucggggagacagagucucaguuugucacacuggcuggucuugaacuccuggccucaagcaguucuccugccucagccuugcagaggguugagauuacaggugugagccaccauccccagccuaaauuagagauauaauuagaaauuaccaucucccuuuuuuuuuuuccuguuaagcaggggacauuuguaacaaucauugcuaccucgucuggaguaaccauagguuguuuuuuuguuuuguuuuauuuuguuuugagacagagucucgcucugucgcccaggcuggagugcaguggugcaaucuuggcucacugcaaguucugccuccuggguucacgccauuccccuaccucagccucccaaguggcugggacugcaggcgccugccaccacgcccggcuaauuuuuuuguauuuuuuuaguagagacgggguuucaccauguuagccaggauggucuccaucuccugaccucauggucugcccaccucggccucccaaaguguugggauuacaggcgugagccaccgcgcccggccuuuaaccauagguuuuuuuucccucuuggaaauuaagguuuggaaaauaagaggaagcagucaguguaaaugcagcuaguugggugauguugagcuuuuguugguaccacacuuuuguaaaaugccucucaaugcuaggagauuggaaaauaaaccauucuuuaauuauaggcaucagaaaccaacucgaucuaacuuaagcaaaaggaaauuuauuggaaaaauaacgggaauucacaagauugagaaggcuagagaaacauacuuggaaaugacuaagaauugagauagcucugaaggacuuaggaagcuguaauggaugcacuauaacaauuuagauucuuaggaggcaacauuccgcuggcccagugugggcuaugugucuaccacuuggcuuagaaaauuggugaggcuuggucuguugggacaggggagaccagggcauauguaauuccuuagaaggaaauugggguguuacuuaguaaagggauacuagaguaaccaaaacacaacaaauacucuucagucauuaucuaaacguuacagugaaugugaauuuggagaccuaagguggcagaugucagcccuaagcuugugggguugguuuuuugggguuuuguuuuuuggggguaauagcuuuauugagauauaaaugacaucacacaucaaaaguauacaauuuaaugcuuuuuagugcauuuagaguucugcaaccauuaccacaauaaauuuuagaacauuuugaucagucccacaaaagaaacccuuuuagcagucacaccucauuuucccacaccccuaaacaaccacugguauacuuucugucauucuagcuuugccuagucuggacaugucauauaaauagaauccuauaguauguguuuuuuuugugacuggcuucuuugacuuagcguaauguuuuccgaguucaucuguguuguagcuuguaucaauauuccauuccuuuuuccugaauaauauuuuauuguauggcucuauuacuucugauuuauccagucaucaguugguagacauuugggguuguuuuccaaggacugaggauuuaaugugcuauuuugugaaaaucugagaaguaggaaggggauuuaaugaucucaacugucauccgucugaaaaaccuaacuugugauuuuaaauaaaauagcaggcugccuuccccuguucccuuuuuaaaauaggaacugacccugcuuuaaccuuaugaaguuuuauuuaugaauaaaguuuguacuauuauaaaaaaaaacauagaaggaacuggcuauuaaggauaaugcugcuaugaaaauucaggugcagguuuuuguguggagauguuuuuauuucucuucgcuguauaccuagaauugcuaguucauaugguaacucuuuuuaaccuuuugaggaacugcaaggcugguuuccagcguagcuguacauucccacuagcaguguaugagaguuccauuuucuccaacuucuugccuacauguuaugugcagaucuaaguucaaauacuggcuaaagcauuucuugcuuugugaccuugggcaaacuaauccuguuuaggauccauuuugucaguuguaaaacaaaguaccuaacuugaaaguugugcugagcacauaguaaguuuuaaaaaaaguuuucguuuccuuccuccuuugccuucucccuggcaguuccucauaauuuccucuuguauuucacagcuuuuugaacuugacuugaauucucuugcuuuucauuauuuccugagaaacacugguaagaggcaguguggaugugcugaauucacugacuguuaaucauaauggccaucauauaaggcaaaauaucagggugucuuaacuuacagucuaucacauguacuuuguuaaagcuuuauccuugaacaguuuuuguaggguauaaucccugucaaagagggcaaaggaauagaagucaauggccuuaaucaagucagucaaaagaugaacugaaaagggggauuaggauaccucuagucuaauucuguucugccucacuugauugaaaaaaagguuuacacuuuaaagaaccugacccagcaagucguuaugagaccaucagagaccaccuaucuuacuuuuucaauacuguaaaacugaguagugugcaggcagccuguuaaaaacuacagacuacuggcaccacagaaccacaaaagagaaaaccugaggugacaggguaaugggagccucuggaacaacuggaaauaaugguucacuuaucugugaugagggaagaaauuuaagaccaaaggguuaaagccaagguuuucuucuuuguuugcuuuaccuuaauaagcagagucuuuaaugcuggcuguaagaacaagacaacaguauuuucuuuucuuuucucucucuuuuuuuuuuuuuuugugagacugagucuugcuccauugcccaggcuggagugcaguggcgcaaucuuggcccacugcaaccuccuccuccugggcucaagcaguucuccuaccucaggcucccaaguagcugggacuacaggugcgcaccaugaccauuuuuguauuuuuaacagagaugggguuucaccauguuggccaggcuggucucgaacuccugaccucaggugaucugccuaccucagccucccaaagugcugggauuacagacaugagccaucguucccagccaacaacaauauuuucacaguuguucuggcagcuguguuguucugaccauauggaacccauuuauauccugugauuggagcucuagguagaaagaguguugucgugggagauggaagucauccugcuuauuuagucauuucuaccaauagcagcuuuaaagggcuaaagcuguuuuuuguuuguuuguuuguuuuugucguuagcccaggcauagaagggacaaaugucagugacugugaauuugguuccuaguaucuuaguuuuagaaauuaaaaauucaggccagacacaguggcucaugccuguaaucccaacacuuugggaggccgaggucgguggaucaucugaggucaugaguucaagaccagccuggccaacauggugaaacaccccgucucuacuaaaaauacaagaauuagcugggugugguggcacacgccguuaaucuaagcugcucgggaggcugaggcaggagaaucgccugaaccaggaggcgaaaguugcagugagccaagaucgcaccauuguacuccagccugagugacaagagcgaaacucugucucaaaaaaaaaagaaaaaaaauuaaaauuccacaucauggcccggcgcgcuggcucacgccuguaaucccagcacuuugggaggccaaagcggguggaucacgaggucaggagaucaacaccauccuggcuaacacggugaaaccccgucucuacuaaaaauacaaaaaaaaaauuagccgggugugguggcgggcaccuguagucccagcuacucaggaagcugaggcaggagaauggcgugaacccgggagccagagcuugcagugagccgagauugugccacugcacuccagccugggcgacagagcgagacucugucucaaaaaaaaaaauuccacauaauuuccuuuuaacaauuuuucaacgaucaagcuuuuucaacgaucuauuguauuuuauaguuuguuguuguuguuuguuuuguuuuugcaaagagugggggugcuugccauguugcccaggcuguucuugaacuccugaccucucuuuguauaugucuauuuauuuuuaaguaacuuuugggaauccuuugcuguugucugggaaauuuaaguuaguaugaacuacuguuauuauuugcaaaauagauaacaaaguaagccaaauauuaaaaugagaggucaccuuuagugaugugaccguauuugagguagcugcaauagaauugaaccuucaauagagagcacauuacagaacagagaaguaggcugugggacagacauuggagauuuacuuauuauauaaauaaaugacaaauaggaccugagguuaaacuuucccagccuauucguguuuuguugcagggaugagguguccaagcuacaauuuuucacuguggucaaauuggugugcuagucucaaaauauauauagucuuaccuuggaauuguuuuuguuuuuuccuuuaaaaauuuuuguagagauggggucucaccauuuugccuaagcuguucucaaacuccugggcucaagugaucguuuugcuuuggccucccauaauggugggauuacagaugugagccacuguaucuagccuuuuuuuuuuuuuuuuuuuuuugagaugagacgaggucucuuucaugcuggaguacaguggugcaaucauggcucacuucacccuugaccuccuggcucagccucucaagguuuauggacacccaccaccacacccagcuacuuucuguaauuuuuguagaguugggguuuuuccauguugccuaguugcccgggcugguguugaacuccugggcucaagugaucccccacuucugccucccagugugcugggacuacaggcaugagcugcugugccuggccauuuuuccaauuuuuauuugaaggaggcuuugcuuuuguuuugucuguauuuucaagugcuauuuaugggucagccugaguuccuccauuuucuuuguuguucucuucagauacacacauaucacaguucuuaugacauuggguuacaauuuaaaauucugugagcaguucugguaaauacugguuuauaaugauguugauguugacuggucgugcugauuuacuuggaucucugcuauucaugugagaauucaaauguaggauacuuaggacacuuaaagcaauaccgaaagagguauccuucaguguauuucagagaggaauuugcuuguguacuacauucagaaguaauuuuguauugucuuaucucuuuuaggaggagagcauucccauugcuuuaucugguagggauaucuuagcuagagcaaaaaauggaacaggcaagagcggugccuaccucauucccuuacuugaacggcuagaccugaagaaggacaauauacaagguuaguugaauaaaaguuuguuuuuaaacuaaaaaugggaguuucagccuuggagccauguguagaagauacucuuuuuuuagucagaauuuacauuaucuaaaauuuguauucuuucuuuucagguuuuuucuuuuuuuagccugaugauggucuuuuuauuaaaaaugauucccagcuuuuuagagauuucuaguuuuaagaguauucuuauaugauacacacuugugacagcauuccagugagacaggaaaaauaaguauuagugcccuauagguaggaaagcugaggcugggcacggugccucacagccuguaaucccagcacuuugggaggucaaaguggguggaucaccugaggccagauauuuaagaccagccuggccaacauugcgaaacccugucucuacuaaaaaugcaaaaauuagcugggcaugguggcgcacaacuguaaucccagcuacucagaagucugaggcacgagagucacuggaacccaggagguggagguugcagugagccaagauugugccacugcacuccagccugggugacagagugagacucucaacucaaaaaaaaaaaaaaaaaaaaaaaggcggcugaggucaugagaaguuaaauuaguugacauugcuacuuauaaacuauggaacuauuucuuguggcagaugaguguuaacagaauuccuuguagaaacaugaacuucuguuuaaaggcuguggauuuugggauuuuaagagccuaggcaguggggaauaaaaaauuuucauaguuauauucaauguaaguuaauggaauuaagauuucaucucugaaacuuuacauuuuuagcuuucgugaucuguaauuaucuuuucuucccacuuucauaugauguaaauagagccuagguagcaggaguuuccuaccuagguauuuuacacagugaaucugacucaaauguaguuggggcuuuuagaaauauuguuaauaaacuuugagcuaauaguugcgaacucaacaugcugaaaguuuguaauuaagaacaguauuggcugggugugguggcucacgccuguaaucccagcacuucgggaggccgaggcaaggcagaucaccugaggucaggaguucaagaccagccucgcuaacaugguaaaacccugucucuacuaaaaauacaaaaauuagcuggguguggugacaugugccuguagucccagcuacucaaggaggcugaggcaggagaauugcuugaaccugggagguggagguugcagucagccaagaucaugucacugcacuccagccuggguaacagagcgagaucugucucaaaacgaagaagcagcagcagcagaaggccaggugcagugacucacaccuguaaucccagcacuuugggaggccaaggcaggaggauugcuugaggucagggguuugagaccagcugggccaacaugaugaauccccgucucuacuaaaaauacaaaaaauuagcugggugugguggcgguuacucaguaggcugaggcaggagaauugcuugaaccugggaggcagagguugcagugggccgagauggcagccacugcacuucagccuggacaacagagcaagacuccaucucaaaaaaaagaagaggaagaguuuaauauuuauauaauaguauugcugagggagagucuaaaucugggacacuauaauagguucucuuuucauaaagagauuuguacauuugaguuuucauaauguccuguguaaugauucaacuuuuuauuuuuauuucuuaauuuuuuuggcgggggagacagagucuugcugugucacccauucuggaguguggugucaugaucauagcuuaaugcagucuuaaucucccaggcugaugugauccuccugccucagccuccccagaagcugagacuauaggcacaugccaccauucccagcuaauuuuuuucauuuuuuuuuuuaguagagauggggucuugcuauguugcccaggcuggucuuaaacuccugagcucaaacgauccuccugccucagccuccaaaagugcugggauucuaggcaugaguuacucacugugcugcccagcccaauuuuuuaauacaucucgguaucuagauuauaaggggcaguguuucuuuucuuuuuuuuuauuugagacggaguuucgcucuuguugccuggacuggagugcaguggcacaaucucggcucaccacaaucucugccucucggguucaagcgauucuucugccucagccucccaaguagcugggauuacaggcaugugccacccacgcccagcuaauuuuguauuuuuaguagagauagggucaggcuggucucaaacucccggccucaggugauccacccaccuuggccucccaaagugcugggcuuauagguaggugugagccaccgugccuaggcuauuuuuuuuuucuuucuuucuuuugagacugagucucacucugucgcccaggcuggagugcaguggcgcgaucuugccucacugcagccucugccuccggguucaagugauucuccugccucagccuccugaguaggugggacuacaggugcgugccaccacgccuggauaauuuuuguauuuuuaguacagaugggguuucaccauguuggucaggcugcucucgaacuccugaccucaggugaucugcccaccuuggccucccagagugcugggauuacaggcgugagccacugcaucauaaggugcaguuacaggugugagccacugcaucauaaggcgcaguauuucuauagcuucuuaaauuuuguaaauaaugauguauagcauguucucccaccucaccccauauuuucuuauauauuccuugauacuguuucagcaauggugauuguucccacuagagaacuugcucuacaggucagucaaauuugcauccaggucagcaaacacaugggaggggccaaagugauggcaaccacaggaggaaccaauuuacgagaugacauaaugaggcuugaugauacagguaagaaaugauuacuaaaagguaguguagcucucuguuauuuuagucacaaguauuucaguaaauuauuaaaaauuguuuuuaagaauuaaggaacagaaauacugcaguaagaaaaggaaaugaccacugcauucaagcgaaaaagacaaauuaccauaauugaaaacgauauuugacuuuauuaguaauuguaaaacagcaaguuuauaauaauuuuaccuguuuaauugguaaagcuaaaaguauuaguagacgauaaugugaguuuguggacaaauaggcuacauuguaaauguggggguguaaacuuacaucucuaucaugggcaauuugggaguauauuuuaaaauuauaaauguauauauaauguguguguguguguguauauuuuuuuuuuuuuuggagauggagucuugcucuguugcccaggcuggagugcagaggcgcaaucuugacucacugcaaucuccgccucccagguucaggccauucuccugucucagucuccugaauagcugggauuacaggcucccgcuaccacgccaggcuaaauuuuuguguuuuuaguagagacgggguuucaccguauuagccaggauggucucgaucuccugaccucgugauccaccugccucagccucccaaagugcugggauuacaggcgugagccaccgugcccggccauaaauguauauuuuuaagaaucuuuccugaagaaaaaaguuggguaaaugcagggcuguagguacaaaguuguuugcuauggggugguauugucgugccgaaaaauuggccaacuuagaaggagauuggcuaacuaaauacguuaagguauaaucugaauaggauucuacauagucauuaaagaguaaaguugaccuguauucauuuucaugaagaggauucaugauacauugccgaguggaaaaagguaacaaaacagcaagaugagaucacucauauaaaauuauaucuugauuuuaguuagaauauuauauaugauaauuaugugauacauucuuuguauugcauagguuuuuaaaaaauuaucuuguuugauccuuuuaacaauacucggcucacugcucuagauuagaggcauugcucuuaugucagaagucuggugugccuucugcuauuaauugagaauuauccuaagacaagaaaguaugccuacuguugaaagcagcaggugauuuaggaagcuguaccccacccaauguagaggugaaacaaauauuuuuuaagcauccuguggugaaauggaagucuuuauccuaaaacacaucuuugugccuuuuuguguuauuuccaccucuauaacacaauguguuucuucucuuucuuucuuuuuuuuuuuuuuuuuaauuugagacacagucuuacucuguugcucuggcuagagugcaguggugugaucucggcucacugcaacgucugccuccuggguucaagcgauucuccuaccucagccuccugaguagcugggauuacaggcucccaccaccacacccagcuaauuuuuguauuuuuaguagagacaggguuucaccguguuggccaggcuggucucgaacuccugaccucaugugauccacccaccucggccucccaaaguacugggauuacagggaugagcuacugcacccggccuaguuguuucuaauaaaagauagucaugugcugcauacaauguuguggucagugacggcugcacguaugucgguguucccauaagauuauaauggagcuauacaauggaguaggcuauaccaucacauagcaaugcauuucucagaauuaucauuaagcagcucaggacuguaauauuauaaaccuuuauccucuuugcucaaauuaaaauuaaugagaauguauguuuucuaaaucuugcauagugcacguggugauugcuaccccugggagaauccuggaucuuauuaagaaaggaguagcaaagguugaucauguccagaugauaguauuggaugagguaaugucucuucauuuggcauuauacuguucuguacuuuucugugcuuugcuuauaacugccagugaaugaagcaaaagcugcuuguguuuaugaucuaauaaacacauaaacaaucaguuuaaauuaauuugcuuauaaaauguguuuuacccgucagagggaguagauuauaggcauucauuggaauucagcauuuugucuuuuucuuagagauagcagacauuagguuuuaauuuuuuaguagaggagugaauaaccucaaugccaaauuuauucuaagucucuuucugcucugugauuaauuuuuaaaagcauauaauauauauugucucuucucauuuugugcauacuacuuuguacuguuugguuuuuaaucucuguuacauguauuaucucaccauguuauaaaugccuuuuaaaaacuuauuaaaaucuguaguccugggaucuagccauguuuuguacauguacagauggucccugacuuaagaugguucacuuuacaguuuuucaguggaagugauaagcuuucauuagaaacuguacuuugaauuuuuaagauugauauuuuuccugguuaguaauaugcuauaugauacucccaugaugcugggcaucagcagcaaacugcagcucccagucagccacaugaugauugagggcagacagccgauacucuacaguauacggcguugcaggugauuuugcccaacuguaagcuaagguaaguggagcauguuuaaaggaggcuaggcugagcgaugauguucaguagguuuggguaauauuuucaacuuaggaugaauuuaucagaacauaaucccauuguaagucaaggaggaucuauagugaucagcguuguuaauguuuugacaugagguuauuuucacauuuggguugagguuuauuauuauuauuauuauuuuuuuuuuuuugagacagacucacucugucacccagacuggagugcaguggcgugaucucggcucacuacaaccucugccuccccgcuucaagugauucuuaugccucagccuucugaguagcugagauuacaauuauguaccacccacgcucagcuaauucuuguauuuuuaguagaggcgcgguuuugcaauguuggccaggcuagucucgaacuccugaccucaggugauccuacugccucagccucccaaauugcugggauuacaggcaugagccaccacgcccggccugguuuguguuuuagguaacaugauuuaauucaaaucagacuuuuaucuuuaaguaaugagagagaacauuuauuaaucacuggguaccagcacuaagugcuuuacaugguuuguuuuuuuuuuuuuuuuuccauuuaauuuuuacaagaaaccuauaagguagguauccugucaaguaguuacuauaguauguagacauccaacuucuaauuugcuuauaaaauacguuuuauacuucagaugcaauagauaggcauucauaggaauucagcuuuuugucuuauagaugccagaguuuagguuuaauuuuuaagaagaggaguggcuggauaacuugaaagucaaguuuuuucuuuuuuguuuuguuuuguuuuguuuuugagacagagucucguugccccgcuuggagugcaguggugcgaucucagcucaccgcaaccuccaccucccaaguucaagcgauucuccugccucagcccucccgaguagcugggauuacaggcaugugccaccaugccgggcuaauuuuguacuuuuagcagagacaggguuucuccauguuggucaggcuggucucaaacucccgaccucaagugaucugcccaccuaagccucccagagugcugggauuacaggcgugagccaccacaccuggccuuagccaaguuuuuucuaaaucccgguaaaguaguuacuacauuauguaaacauccaaauuuuaauaguuuuacaauuuuagaguuguggaaacugaaguacagaguaguucuguaacauucccacacagcugagaaaugaaggaggcaagauuucaaccuggcaguuuagcuccagaaccuguacuuuuuuuugagacagagucuugcucuguugcccaggcuggagugcaguggugcgaucucagcucaacugcaaccuccaucucccagguucaagcaguucuucugccucagccuccugaguaguuggaauuacaggcgcuugccacugugcacagcuaauuuuuguauuuuuaguagagacaggguuucaccauaucaaccagucuugucuugaacuccugaccucaggugauccgcccgccugguccucccaaagugcugggauuacaggcgugagccacugcacccggccucagaacccuuacuuuuuuuuuuuuuuuuuuuuugagacggaguagucucgcccugucgccuaggcuggagugcaguggugugaucuuggcucacugcagcguccgccucccaaguucaagcgauucuccugccccagccucccgaguaccugggauuauaggugcguaccaccacguccagcuaauuuuuguauuuuuaguagagaugggguuucaccauguuggucaggcuggucucaaacucuugaccucgugauucucccgccucggccucccaaagugcugggauuacaggcgugagccaccgcgcccggccagaacccguacuuuuaaacacuacaccauacuaccucuuuaaugagaaucaucacauuaaaauucuguuguggagcugggcauggagguaugugccuguaguccuagcuacucaguaggcucaggcaagaggaucacuugagcccaggaaguucaggcugcagugagauacgauuaugccacugcacuccagcugggugacagagugaaaugcugucucuaaaaauaaauaaauuaauuaaauucuguuacagaaagcgggggagguugucuguguaguguagaauuuuuuuuuuccccuagaagauggggauuauagauuuugcccccuucugcauauuugacucucugcaguguuggagagaauuuauuguuuuccaccaggaacauuucauggaugcuuuuguuggaugaugccuuauucuuugaccauguauuaaccaagaccuuagacauuauuuuauuguuuuuaaaauugucuuuucuuucuacugcaggcagauaaguugcugucacaggauuuugugcagauaauggaggauauuauucucacgcuaccuaaaaacaggcagauuuuacuauauuccgcuacuuucccucuuaguguacagaaguucauggugaguauaaaucuguacuuggaaucagugccauccugugaccuuugaguaugcuuuuauuuguaauuacaucuucauaucugugaauauacuuuaugcuaauuauuucaagccuuuggcucuuucuucaguugaucaauuaaagauuuguuuuacguaaauuaacugacuuuuuaagaagguuguaauaguaacuuaauuaaauuccucaucuuucacuuaguuuuuggugucaugaugacauagccauuggugcuagcugaauugauuccgguauuauucuauauacaaaacagagcuugaguauccuaaacugaaauccaaaauacugcagaauuugaaaccuuuugagccacgaacaugaugcuaaaaggaaauguucuuuggauuuugaauuuucaaauuaaggaugcucagucacuaaguguaaugcacauauuccaaaauuagaaaaaauuuaaaaccugaaacacuucuguuccuaagcauuuuggguaaggaauacucaaccuguaguaacuuagcugcauuuuugagaucuuauaucuuaauuuauuucuaucgggucgggcaugguggcucaugccuguaaucccagcacuuuggggggccgaggcgggcagaucacaaggucaggaguucgagaccagccugggcaacauggugaaaccccgucucuacuaaaaauacaaaaauuagucuguuauggcagugcaugccugcauucccagcuacucgggaggccgaggcaggagaaucacuugaacccgggagguggagguugcagggagcagagaucgugccacuacacuccagccugggugacagagcaagauuuugucucaggguggcaggggggaaauucuguaaugacagaucauauauuuuguuuugaagagaguugcgucccuuacagcaagaguuuaucggacagaaacguauaggguauauuuugaauuugagaugaacucugcuuucauuuaagacgacgacucaucuuuuucccgcuccccccccagaauucccauuugcagaaacccuaugagauuaaccugauggaggaacuaacucugaagggaguaacccaguacuacgcauauguaacugagcgccaaaaaguacacugccucaacacacuuuucuccaggguaagaaguaggcuucugcuguugaauauuaucucucgagucccaguaaaacagaugauuucaucaauuuucccaccgucuucacuguauaaaaguucguaguguuucuggcuuggcacgguggcucaugccucccagcacuuuggaggcugaggcaggcagaucacgaggucaggaguuugagaccagccuggccaacauggugaaaccccaucucuacuacaaaauacaaaaaaauugggcaugguggcgugugcccauaaucccagcuacuugggaggccgaggcaggagaauugcuugaacccaggaggcggaggcugcagugagcugagauugcaccauugcacuccagcucugggcgacagagcaagacuccgucuugggaagaaaaaaaaaaagauuaaaaaauaauucauaguguuuccuaaaaggcagguuuaguuguugaccuaaaguugauacuaaaugauuaaccaagucacagauacacuuuugaauaguuucugaaauacuuugaccuuaacuaggguuaauccucauuauucacauauucuguauuugugaauuugcuuagucacuagaauuuauuuguaacuccggaauuaauacucaagguaguucagcagucauuuguggacguguacaguguggcaaagaguuuaagucaccugacaugcacauucccagcugaggucgaagaaagcaaucucuguccucuuguuuagcucucauacugugaacaaggguccuuuucacagucugccauguuuuucaaguuuuuguugcugauuucacaguuuuaauuggccccuacacauggugcugaagugcugcccaaugcugguggcauugguugugaguauauuaaagaagguauucuuggcugggcacaguagcucauaccuguaaucccagcacuuugggaagccgaagugggcagaucaccugaggucaagaguucaagaccagccugaccaacaggcugaaacccugucucuacuaaaaauacaaaaguuagccaggcauuguggugggugccuguaaucccagcuacucaagaggcugaggcuggagaauuguuugaacccaggaggcagcuguugcagugagcugagauugcaccauugcacuccagccuggacaacaagagugaaacuccauuucacaaaaaaaaaauaaaauaaaauauuuuuaaauggaaacacauaaaacauaacuacuuugaaucagauaaucaauuguauuacucuuguugacaguuauguggcccuuaagaaauauacucuaauacgguaaaucuuagauauuauuaucuuccaucuauuauuuacaauuuuuacaauuuaccaucucucucauaucaugagauucuaaguuuuagaccauguuaauguuucuuuuuugcugguucguguuuucaagauuuggcaaaccaaaugaagguuuuuuuuauuuuucucauacuuauuuuuuucugugcucagcuucagauaaaccagucgaucauuuucuguaacuccucucagcgaguugaauugcuagccaagaagauuucucaacuggguuauucuugcuucuauauucaugcuaaaaugaggcaggugaguauaaaacuagaacuugcacaaauuuaauaagaaaucucuuucuuuauuuuguuuuaauguucuuuuaaauguccugaguuuaagaauaaacuguuccuuaguagccaaaggaccuuucauuuugaccucccucagguucaauuuucuagcaauaaaauagggauaauaguacauauucauaacuuacaagguuguuaggaaaauuaagauaaauguuuaaaugaguacuuuggaagcugucaggcaugauacaaauguaaaauuuuauucuucccuuccuuuccauguuuaauucucuguuuaauacaguaaauagccacauguggcaauuuaaaucaguuaaaauuaaaauaaaaagucaguuucucaaucacagccacauuucaagugcucaguuaggcaccuguugcuacuggauaguguauuggaauuggaaguacagacacaaauauuuccuuuauuauagaaguuuuacuggacagcacugcucuggauuuuuaaauauggccccucagcuggcugauuuuucuuuuuuucuuuacuguuugccuuuagaaaaagauacaauaucuaaauuucagaauuugauuuagcaaaaaauaauuuaaaacuguaacaaaaaugacuuuuuuguuaacuacauuaugaaauuucguaaguaaacaguuucuguagacgaagauaucaagaacuuaacucauuugguuuugaaagcagcuuaauaucauggaucacuuauaaacagauuuuggguagaacugaucgucugggagaaauaauuaugggaaauuuggggcuguauaugaguguuaaucaaauggaauacauugcuuucuccuaggaacaucgaaaucguguauuucaugauuuccgaaauggcuuaugccgcaaucuuguuugcacugguaaguauuuuuguauuuccuuuacccaguguuuuucucccaaguuguuuuuugcuuucucuguucauauuacauagugcaaccugugacauaguccgacacacccuaccacuacuucuaggauuucugaaguugaaaaugaacucuugucagcuccugauacuggguuccauaucugaaacuuuagaagacuuacucuggcacucauaccucaucucugucuuuuuuuugggggggggggggagggggauggaaucuuugucacccaggcuggagugcaguggugcgaucuuggcucucugaaaccuccaccuccuggguucaagugauucuccugccucagccucccaaguagcugggauugugggcgccugcuaccgcuuagcccggcuaauuuuuguauuuuugguagagacagggauuucaccauguuggccaggcuggucucgaacuccugaccucaggugaucuuccugcuuuggucucccaaagugcugggauuacaggcuugagugcacccagccucuuuuagacacauuuuuuaaaacuugcuuacaauuacuggaaaaaaguaacuugggagcagaaaguuauuuaugauaaugugauuaugaaagguaaugccaguaaugugcaaaugcauuugaauaacugaauuaaauuaauaaacuuagguuaugcuagaaauauguguuaguauuguacugagagacauuucuaaauugaaaaaaugaaaauuaucuuuuuuuuuuuaagaucuguuuacccgagguauugauauacaagcugugaaugugguaauaaacuuugauuucccaaagcuggcagagaccuaucuccaucguauuggaagaucaggugaggaaaaaagaggugauauucuugguagaaguucuuuuuugaggcguguaaugacuaaauuuuguucuuuugugaaauagaguacaguagcuaugagaacagugaauuaacaguaauucaguuguuugguauuuaagacuaauuucuaauucuucuguagcauuuauuaagaaaaguuaaaauaacugcuuaauuugagaugaaauuaacacaugagaacuucacucauuaggugguauguucugugacuguuguuuaauguguauuuuauggcaguuuugacugccauuuugucauuugagaaaggugaaaugaaguacuauuuugggcugcgaaaccugaaguuguagggaaaccuguguuugaagaccauuaagaaguuguuuugcauacuaagaauggcacugaacaucauuaucaauccugugugguuuugccacugcuugacuugcacaauucacauugauuuucauauuuuauucauuaaaauuuuuaaacgcauguuuuuuaggucgcuuuggucaucuuggcuuagccaucaacuugaucacauaugaugaucgcuucaaccugaaaaguauugaggagcagcugggaacagaaauuaaaccuauuccgagcaacauugauaagagccuguauguggcagaauaccacagcgagccuguagaagaugagaaaccuuaacaagcauguacgucccugacagaacagcuaagaggaaccuuuaaaugagggaaaucaaaaucuucuuuccugggggaaauuugaugucacaccauauauaauagcaauaaaggguaaaauacccacuagcauaaaugacaguaaauaauaucucuugugggagguuguagucucauucgagaaucuguaaauguuguucuugaaugcagcuucccggguaaugugguagauuagcaguacuuaaauucagaguccuaaaauaaugaaagcaaaaaagaauguuuuucagcaauuuguuuuucuuuuugagacaaggucucacugucauccaggcuggagugcaguggugcaaucauagcucacugcagccugguucuccugggcuccugaguagcuggaacuguaggcacaugccaccacgccugccuaauguuuuaaauuuuugguagaaacaaggucuugcuuuguugccuaggcugguccagaacuccugaacuccagcaguccuccugccuuggcuucccaaaguguuaggauuauaggcgcaagccacugugccacugugccuggccuuuuuugacaguuuuguaggggggauuuuuguuguuuuuguuuuuugagagucuugcucuguugcccaggcuggaguacaguggcacaaucacggcccacugcaaccucugccucccagguucaagcgauucuggugcaccucagccucccaaguagcuggaauuacaggcaugcuccaccaugcccagcuaauuuuuguauuuuuuaguagaguuggaguuucaccauguuggccagguuggucuugaacuccugaccucaagugaucuacccgccucagccuccuaaagggaggcugggauuacaggugugagccaccacacugccagcaguuuugaauaugaaaguauuuacauuucugaaaauguaaaauguuuuuagcauuuacucuuaauuucuaguaaguacauuaaucacucugauaaaacuauccauaauaccuuauuagcaaauguuuaaucagauuaugaggauggccaucuuuuuaaaauacccacucugggccgggugcgguggcucacaccuguaaucccaguacuuugggaggccgaggugggcggaucacgaggucaagagaucgagaccauccuggccaacauggugaaacccugucucuacuaaaaauacaaaaauuagccgggcauggugacacgcaccuguagucccagcuacucgggaggcugaggcaggcgaaucacuugaaccugggagguggagguuacagugagcugagaccgcaccacugcacuccagccugggugacaaagcuagacuccaucucaaaaaaaaaaaaaaaaaaaaagccacuugggcuggcucaguggcucacaccuguaaucccagcacuuugggaggccgagguggguggauuaccugaggucaggacuucaagaccagccuggccaaccuggugagaccccguguccacuaaagauacagaaaauuagccaggcaugguggcgggcgccuguaaucccagcuagucaggaggcugaggcaggagaaucucuugaaccugggaggcagagguugcagugagccgaggucaugccauugcacucgagccugggcgauaagagugaaacucugccucauauauaaauaacccacucugauuuccuagguaauaagagugaaacuccgucaaauacauaaauaaaauacccacucugauuuccuggacaaccugucuucccaucuuuuuuuuauuuuuauuaagaugggaucucacuauguugccccggcugguuucaaacuccuggguucaaaugauccucccacuuuggcuucccagagugcugggauuauaggugugagccaccacgcccugccucuaucaucuuuuggugacuauugggcucuaguuagaaaugcaugaaacaaggcucagcuuuaagcaagguagguuguuucaguauuuccuaaagaaaaucugauuugacaaaggauaguuuccaaguuauaggugaacaucuuaccuauuuaaguaaccuaauguuacuuaaauuuuuuuucucuuucuuuuuuaaauagagacgaggauuuaccauguuggccaggcuggucucaaacuccugaccucaggugauccgcccaccucagccucccagagugcugagauuacuggcaggagccaccucacccaaccaauuguuacuuaaauaauuuuuaaauuacucuguacucuuuuuuuccuuaaguuaaacaucaaacacaaacucuuggacaagcaugaaacuagccaauguuugcuaguacuuuggcagaguauucaguuuguguaagguuaauuuuuuucccccggauuuguuacgagugagggcugccugcuaucagaacauucacauucauucaggcccccaaucuaucucaggguugccuaccagaaauuauuuaauccuauaaccaguagauucuauaguaggcacaggguuaguagaaacuacuagaaaagagcauuugggaugaggauugugaaaaccuauguauccuaguuuguguugcuuucagaauguuaauuuuguauucucuucuucuguaggcuuugacaaauuacaaaaggcucguuuggaucugugacacaucguuuuggggggaaugcuccucucuuuguggguuuuucaucuuuuauuuuggaacuaugaagacuuaaaagagcucagacauuuucuuuuuuuaacuggugaagagaaaaaggcugaaaagaaggaauauaccuuuuuuguuccacuuguuugcacugugugcugacugaacauuaguugcacuaacugcugguuuuuaaaaaauguuuucuggggaaaggggacaaggaaggaaaagaaagaagagaaggggagaaacccuaaaaagagaagaaucuuaaugaacacacaagcuugucaaugauuucaaaauucuccaacagcugacucucgugcauuucaacuucucccugauuccucauccguuuuuuaagccugaagagcuuauuacuuauuugugcgaagugccuuaugcuaugagaccauucagaauaucaucuuuuagacacagcccgaggaaucaacaauaguaacucuuucuuuccguuuuuuuuucuuuuucuuuuaaaaaaugucuucuuauuuugguuucagguugaagucucuucccuuucuacccaguacucgagcccagggcuagaaguugaaacucacuaguaauguuaaacaccauuuuuuuuuucuuuuuggggaggaguugauaugcaacugcaguucauccgcacuguaaauacauguauuuaaaaaaacaaucccaaguaaaaauuucuucugggcugaguagauaaaaaacaucaucgcucccaaaggaaagagcagucuaucauugcaggagccauaugacaagccuuugugcucuauagcagacacuaaagacuggguuacauaugccuccaguaguaguauggcacuugauguguagacaugucagagcuuggcccucuuuccucuguggcaaagcgugucccauagaaaauuggguguguauacuuguauaacuuuguaaauaaguuuuuuuucuggguucauauauauauauauauauacauauauauauauuuuuuuuuggaugaagguugcugggauuaaggggauuagagugauuaugggagcagcuaaagaugagaggggcucaguuuuacgcaacacuaaauucuagaaaguacuuuggccucgugcuguagagagcagauuucuaugguacccuguguuaguaaaggggcccagaaaucugggauguacuguuugcugccacacugucucaucuaguaccuuuggaguagguuuaccagagagagcaaggaagcuucaaaacauugauaauucaacauuuauuuugagaagcucugauuuugcuucuucccccuuucuaaaaguuugaggaauauuucaagcucugcaacagggggcaaagauuaaucuaccuugcaguguaggaauucuauugaguggcagugucauugagcaguauauauauaaagcacagauuugcauuucagaauauuagccaguaccagcuuugguaauguuagcaguucuggagcuuaauuuucuguggaucauuuccuguaguguguaaauguguugcccucugcccgcuuugauacauaaacuuuugcaggaaugggcaaccugagagcuguuaacuuucaugcuacagaaagcugcuugccauucucuugcauugugacaagaauuguuaccugucauuuugcacuguaaauugcuggcagaugcuuuacagucaauaguguugcuuuaaauugugccccucccaacaugcuugauguuuggccugaucuccaggcaaaaggagugagaugaaucaaaaccagugaacuuuuuuuuuuaauguuuuuaauucccuuuuaacccaguguacuaggucaaucaggaggcaucuggaaagggggggaaaaaagcaaaaaacaaaauuaaaaaaaauugauuuccauauuuuauuuuucaaaacccuaaaauauuacaaaauaagucccgcauauacuuuaauguuuuaacucuuuuggacaaaggaaucaauuacuugaaguugcuuuuuugacucugccuacuucugagcaaacuauuugcgacucacccacaauugccuuggagaucaaaauccuacagaugccuccugaugggacauagcccuaacuccuuaacaacuguagcaagaacugcacgguacaaacccaaaaaagaacaagcucaucuauuuggaacccaagccucauauuuucuguccagucaauguugguuacuaaauagaaaaccuaauuaaggaaguaacuuuuuuccagggaggggugggagagggaauuuaaaaggugucaacuuuugaccaaaaaaauugugcccuuguaccgaugcagcucucuuucucccccaccucuugcgagauaagagggaucauucauguagaagaaaagaguauaaaugcaauucuguaucucgcuagagaacgugugggugacuaaacaaaaagugcagucuccuucaccaacuuuagacugcguggugccacaugccugugggucccucuuaaagcacagacuuaaaauggaaaguauuacugaaguauagccucuaaugaggaguggcacuuaaacuaucugggacaccacuacuggacacggucuuguagaggcagcuguccaguuuuggugcuugacucuugaauaggaauuguuaaauggaaagaugcucugaggacuaggucaaagccuggucuuuuuuuuuuuuuuuuuuuuuuucuuucuuuuuugggcccucauaauaagcauuguuacuauuggaaguuguuuucacauucuuuccaauauuaaauauguauuuuuuuaaguaaugauaauauuuuccaguggcucauuuggaugagaacuacccucuauuuuuaauauuaaaacuacauccaacucaucauuuagccuuugguuguacaguuguguaaugggcuauggacuguuacacaccuuaccaccucuaggccuauguuuuuucuuuccccauauauucugauggggauaaauacuguuuugccucucccauaggaauggaauacauuuauucuaaaaugaucuuucacagaaguaagagagagggaaaccuaaauauaccucuaaauuguuugaaguuggucccagcagcauaaaauggguuggccccaaaggguuggagggugggcuugguuaucaguauuuguuuucagaaugagaugggagcaucuuuccuuugccacgugcuuugugcuugauaacaucaugcuugguucaaacgacaacucagcacaaagccuugaguauaaauuguuggaaucaaaacaucucauucugaugacgugguuuaauuuuuuaauuuuuuuuuuuaauaggggugggagggaggguacuuugccccagaagggagggugucugcacuaaggauuuagaaacacuuuggaagcucauaaccucaucagaaacugccuuuagccacacuccugaccuucuagaugaguaacaaaaaaaugaaauaaguucuuggaaauuaagccauuuauuuuaauuugcuauuuuuuucaauguucuagguaucuuuaaauuuguuauuguggaaucauuuuccugccagauaccuuuaucaaaauuauuggccucaugagagcugaaguaagucagcuuuuuggugaacuuuaguggacuucugugagauuguaguuguacuuuguaucucuaaaucuaaagauaguuuuuuaaaacucccaaagaaaaucugcucuccuuucugaucuaaaaacucaucuuugggguaaagaguuaaguguccaaagguugucacaguucaugaggucagagggagcuagccuggcaccuggacucugcccauccacagcugacagauuccaacagaaguguauuuaaauucuccaguagacaaugcuggguaagggaggggguagggcuggguuauuaagauacaggcugcuguauuuuacauugguugugugggaaggggagccuggagaaaacaaagucacuauucccuuuuuugaaacaggaaaaaaaauuauuuuuuguucaguaaaaaugguagagaauuccaaugucccuagccacaagggaccaguuccacugagaagugaacagugggaacucaaaauuucagaaacauugggggaagggaaaauuggcuuucucuuaauuggcagauguuccaguggggggggggggggcucuguuuuuguugggauguguuauguuguauguacgcauauauggaccggagucugcugaguuuauaagguuccaaaaauaugguaaaaucuugguuuuuguuaauuuaucucaauaaaagcccacuggaacuccaa

SEQ ID NO: 192047 - RNA, 21549 nt, Homo sapiens
uagacaaacaggcgacuuggccgcccagagaggcuuuauccgugacuccuugaucuucuuccugcguggagagccuucgcgggugaggcuuaacgcgcaggaggucucacgagaguggaagcaacucucgcgaauuuuaaaauuuaucuuuuugccuagcgacugacaacaggcugguugcuuggcguggaauccuaaaguggccuggcuuugagacuggagugagaccccagcccuaggcugggguucuuuccauuauagaggagacggauucagaagggcuacagguaauuaguacucaucccagcaaaaagggaacugucuuucuagagaggcuuaagaggacuccccuuuaccccauucccgguuaccucuuccaaucuccgugguaacuguuccuucgucaccucaccaccaaccguccugcuuccuuuauucccccaagaaacuuaggugggauccuaucugcaagauaagggugaaaguggaggugaugauuuugggauuaucggaugggacugagagacuggaguuuccccucucuucggggacccucccacccuaccccgccucagcccaccccaccccaccccaccccaccccaccccaccccaccccagaggugacuccagagacagaacucuuucuagaaccucuacagccuucccugagaaaccucaacagccuuggccaucuacauacaaauaguguucugcccuugcgcguggucguacagcuuugggaagcugcagaaguuggcucucuuucccuccacgauucccugguuccucagccagccugccagcaguuccuaaauaagggcugcaacagaaugacuuaacugcuugaccgagggccaggaagccugaaggaaaguuuggauggggugaugguuuugugaaaaacugguuucuugaguaaggaagaggagccaaugcugguuuggaauauaccuccuggcagagugcuuuaugucucaugauaggagcuaugaauuaugucucccuuugcuuagaccaagguuguugaaaaccagacauaugaugagcgucuagagauuaacgacuccgaagagguugcaaguauuuauacuccaaccccaagacaccaagguaagagaggaaagaagagaaaugcuacugaaagagcaggauggauucacgguugucuucaagaaguucuuauuuuauaauagcaaauguugacuuucagcgucaauuuacuucacuugccauuguuuguuuucugacuaguuaagggggagaaaucauagccuuccaaauuacaggaucuucccccaauccaacccugucaccauuuacuucauguuacugcuuugcucacugucugccaggaauucacuguucuuuuucuuuuucuuuucuuuuuuuuuaacuuauguuuuuccuagcuuugaagaugcuucauaaccuccccuuagccugcaaccccaaccaaaaucacaguggaauguuuuuaaaggacugaacacuauuuauuuauucaacaaacuuuuuuuucuuaauuuuauagagacgaggccucgcuauguuaccaaggcugaucuugaacuccuagccucaagcaguccuuccgcuuuggccucccaaagugcugggauuauaggugugagccaucgugucuggccaacaagcauuuuaaaaugccuacugugugccagccuuaugccuggcacuuggguaaauaguguuaaaugacacaaugucccugccaucccgaugcugguaaucaugggaggcagaugacaaaugaguaaacacaugccaaaugugguaagugcacacugauggaggcagauuguuugcuguuaaggagaauaacagugaggaaggagacccacuuuuuuuuuuuuuuuuuuuuuuuuuuugagacagagucucacucuaucacacaggcuggagugcaguggugcgaucuuggcucacugcaaucuccgccuccuggguucaagugauucuccuuccucagccucccgaguagcugggauuaccacacccagcuaauuuuaguauuuuuaguagagacgggguuucaccauguuggccaggcuggucucgaacuccugaccccaacugauccaccugccucggccucccaaagugcugggauuacagguaugagccaccguaccuggccagaaacccacuuuugauaggguggucagggaagaccuaaaggggugacauguaagacugauagauggcagggauccagacacugaggaaaaguagaccaggaagaggaaacaguaugugagaugugaaaaaccuugaagccugaaagaacuuggcuuaguuugaggaccugaaagagaccagcuuaugguagaggggacacuaccguaugauauggucagaucagagagguagggcaggaagcacaauaagcagagcuuuggaggcuguguugcugucguguguggaauggacuguugugauggcugaguugagaugauaguggcuuggccucuggugaggaagcugagaauaaagaaaagaggcaaauacgguauaagacauugucgcagaaucacuaagacuuggugauggauuggauuugacucgaguuaggaaucaaggaugacauccaggguuucuguuuguuuauugugguaaaauauacauaacauaaaauuugccauuuuaacaauuuuuaagugugcaauuaaauaacauuaaguacauucacaauguuguuuaaccaucgccacuauuuccagaucauccugaacagaaaauccauacccuucaaaacaauaguucccuauugcuugcuuccacuccucccugguaaccacuauucuacugucuguaugaguuugcuuauucugggaaccacauaagugaaaucauacuguauuuauccuuuuguggcugacuuacuucacuuauugugauguucuuaagguucaucuguguuguugaauguagacuuucuuuuuaaggcugaguaauauuccauugcauguauauugcacuuuuuuuuuuuuuugagacugaauuucgcucugucacccaggcuggagugcaguggcacgaucuuggcucacugcaaccuacgccucccggguucaagcgacucuccugccucagccuccugaguaguugggacuacaggugcacaccaccacacccagcuaauuuuuuguauucuuaguagagacgggguuucaccauguuggcccggauggccucgaucuccugaccuugugauccacccaccucggccucccaaaguguugggauuacaggcgugagccaccgcaccaagccuaugccacguuuuuuaauucauucauuuguuaauggacacucggguuguuuucauauuuuggcuauugugaauaacacugcuaugaacagagguguacaaguguccauuugagucccuguuuucaauucuuugggaccuagccaccuagguuuuugacuugagcguguuuaugcucuugacagcuguggauauuauaauuuguuuuuaauuugggcuaauuuaguaaauaaaaaaaggguuuaauuugcauuuauuugauauagaaaucauuuaucauguuuucauuccaguuaaugccuuacaucuaauuauacuuuuauuuuaauuuaauuuuuuauuuauagagacagaguuuugcucugucacccaggcuggagugcgguagcaugaucacgguucacugcagccucgaccuccugggcucaugcaguccuccugcuucagaacccccgguagcugggacuaccagcccaugcccccauguccagcuaauuuuuuuuuuuuuugagauggagucuugcucugucgcccaggcuggagugcaauggcgugaucucggcccacugcaaccucaaccucccagguucaagcgauucuccugccucagccuccugaguagcugggauuauaggagugugccaccacaccuggcuaauuuuuuuguauuuuuaguagagacgggguuucaccauguuggccaggcuggucucgaacuccugaccucaggugauccacccgccucagccucccaaagugcugggauuacaggcaggagccacugugcccggccuaauuuuuguauuuuuuguagagacaggguuucaccguguugcccaggcuggucuugaacuccuaggcucaagcaaucugccugccuccgccucuuagagugcugggauuacaggugugagccacugcgccugucauuaauuauccuuuuaauuguucagaauauuuaaaaauugcucuuaucuuugcauacugauucggauucaaacuugugacuauuauuugccaggcccugggucaguuccuugcacauaaauuuuuucacuugauccuuauaagaggccuggguuagaaauauuagugaccccauuuagaggugggaauacugagacucaaagagguuaaaucuuuuuuuuuucuguccauauguuuaucgucuuuaucugaaaaaucuuuauagaaaauuguuugguuuagcucucagcagccugcuccugagcucugagggagcuugccuucuuuuaagcuaccugauguuucuucugagcaagggacauuuugggacaguuccaccuauucuuuuuaacuucuuucuugggccucuuuucauagacuggauucucucauauagcagcaugagcuuucuuauacaucucuuccaucaugucuggaguuacgcucuucuuuaugcauugagagaacugguucuuguaagcaucuucaucuucuucuguuaaguagugcauguaaucugcaacauucuggcccaugaugugcuucugguguacuucugcauuaaauuccuugcuuucagaaucauaacuagggaaucguuugguacugugagggacagacaagccuccauccacagcucccuucagggugccaaaaacuuuauugccagugguaguucuggcaagaccuguauccaaauagcagguaaaggcaccuggcugaccaucaaugcuuuccacauuguauucauugccagucuccuccacuuggccuucauagaucuuguccaugccaaaccuauugggaagccugcgggccagcagcaggccaguacaauaaguugcagcauaauuugucaggccaaccuucacaccacauuuuggcaguuugugugcauaugcugcgcagacuauaucccccucuauacgggcauaagcagucugacaaaugauaucucuguuuguuacacgaacuaucaucuuauauuuggguguguuguauuuauuuuuauccuguaucaccaagcauuucugaggauaguaaccaguuuuacccucucgucgucuucuaaauuucacuugguaucucuuaaaguaggcuuuauucuuaacaacuuuaauaaaccccauucugcggaacagagacccgcguuugcggcucgacagagaccugccggcccagcagugcuagggggugaaaaggcaaaaucauuuuaaguaauuuuucuucaaacccacucuuaguaugaauucagcacucuguacuuuacuaguuauuaaccuaauuugacuaauguguaaacuaagggcagaguguauauuuuucucuuucuuuucuuuucccccuccccuccccuccccuccccuccccucccuuccccucccauuccguuucugacaggcucucacucuguugcccgggcuggagugcagcagcaugaacacuggacacugcucacugcagccucgaacuccuggguuuaagcagaccuccugcgucagccucccgaguagcugggaccacaggcgcauggcaucacacccagcuaauuuuuuuucuuuuuuuuuuuuuguagaugggaucuugccauauuguccagucuaggcucaaacuccugggcucaagugauccuccugccuccccuucccaaaguguugggauuauaggcaugagccacugccccuggccagaguuuauauuauuuauguaauggcagauaauuugaauaguauaaugucuaacccaaugccuuaagcacaguaauguuuaguaaauauaucuugaauugaacuggcagagccaugacuagaauucagucuccugucucuuuagccagauguuccaauaaaccuuguuuuauaaaaugguuagagcauaaaauauuaaaaacuaaaaaauacuuguuuuuaaaaaucauuuuaacaauaaucuaaaggaaaaacuuuuuuucuaaggacuuccucguucugcccaucuuccuaacaaggcuauggcugauaacagcagugaugagugugaagaggaaaauaacaagguacaguaaaacucacagcuucuuguagaauuucugcuuuggguuuuuaguaguuagagaugacaccaguucaacgguaaacauuucuugaacacucaccuccagggguuagggaccuuugagcucauggaggaaaaucaguuacaaagagccuugagauuuugacccuucuucaggaauaaagccuacuacuacaauugacuuuggugaggaauuucacauaauguaggccaguguuucacaaacuuuccugaucauaauacucaacugagguacuuauuuuuaaauauacggauucccagucccagcccagaaucucaaaaguaaaagccugggaauuuauauuuuuuaggaagcaguccagguaauuuuaugcuaaagcgaguuugaaauuaucagucuaggcauuuuuucauugucaauacuugugauacugccaguauuuugugaaggagauuuuaauuuugaggucuuaagacccagauguuggcugcuguuauucuguguaccuagagaaucacccugcuucugaaagaaacauggcaagaggcccaccucucuagaaacauauaggaccuuagaguugcacauaugauuucuuaaaaaccguuuauguuggccgggugugguggcgcacuccuguaaucccagcacuuugggaggccgaggcgggcggaucaccugaggucaggaguuugagaccagacuguccaacauggcgaaaccccaucucuaauaaaaauacaaaaaauuagcugggcgugguggcgggugccuguaaucccagcuacuugggaggccucccaaggugcugggauuacaggcacaagccacugugcccagccuguuuuuuuuguuuguuuuuuuuuuuugagacagagucuugcucuuucacccaggcuggagugcagugaucuugacucacugcaaccucugccucuuggguucaagcaauucucaugccucagccucccgaguagcugggggaucacaggccugcaccaacucgccuggcuaauuuuuguauuuuuaguagagaugggguuuugccauguuggccacacuggucuugaacuccugaccucaggugauccuccugccuuggccuuccaaagugcugggauuacaggugugagccacuguacccagccugauggcugcauuuuaaugguuuuuguuuuuguuuugagacagagucaucucgcucuguugccuaagcuggaguguaguggcaugaccucagcucgcugcaaccuccgccuccaggguucaagcaauucuccugccucagccuccugaguagcugggauuacaggcgugcgccaccacgccuggcuaauuuuuguauuuuugguagagaugggguuucaccauguuggucaggcuggucucgaacuccugaccacaugauccgccugcuucggucucccaaagugcugggauuacaggcaugagccaccaccccgggcugacaauauucuuaaaaguucccucugccaaaacugcuuccuaugugacuaaggauaauuuuggcaaaucuugaauugagaaagaaugcucuagaaaguucuuaucagucauauacuaauaaggcauagucacugaauaaauucugcaacuguguuucauuaucugccaugcauauuacagcuuaguuagaauauacuuuauguauaauaaauuuguuauucuuagagcaaaaugugacuaaaagcaguuuuugguguccuguaacgugucacaauuuugugugccaauagcugcuuuaccauaaaaacaaauuaauuuuaaacaacuggaaucaaacguguuaaccucaguauaagccauacgguauauagaaaccaaguuuugaaaaccuacuuuuaaagggggccaauuggucauccuucagguccuaagggagggcaugccacaggcuccaggccacagaggcaaagacauggacccuguuccaccugccccugcaagucucaagugccaccagaccccuucucauguacuugagagggugggaugguacagagagagccagaagcacagaaagguagguuauaaugucaagaacaaaagagcuguuuaucuugagagagaauguguagucauuuuauguaauuuaugggguaagggaagggaaauacagauaggucagauacuccaugaagagaaauaucacugaacaaaaauggaaaguccauagucccugggacugcugguuugaugggcacaagguugauuuugaacuuucuucuuuugauaguuucaagcagcuuaugcugggcagucuugcaaauuaaguauuagauuuccucucuauggucuuugugaguauuaagaccccuaaaauuucuauucccacuucauauucccugauuuucuuccaaaauaacuagaguugccauccucuucuuugaaaguccauagcuuuucgggccgaagcugucuaaaguguacacagggcccugaagaucuaaguaauauguacaauagauaaaauuagaauuuauaccccagccucaaguagagaaauggaauaggguucuagaaaguggaguccccauuuguagcugagcaggggcagaagaaggcucucaagccccuucugggaagugcccccuucucuuucuggugacgaggugccaggugguugguguauugguuagagcaauagagaacugggcauagguacauuugauuuuuuuacuugaagcuuucuaugccugcccugcccuaucacaggagaagaagaagaccucacaguugacaccucaacggggcuuuagugaaaaugaggaugacgaugaugaugaugaugauucaucugaaacugauucugauucugaugaugaugaugaagagcauggagccccucuggaagggugaggaaagaacacccaagccaagggugcucuucagaauaccuccuucaaaacacuggagugggaggacgucaguuagaagugaaauuccagcaucucuuuugaucuccuguauuuaggauuuucagaugucucagaaacccaacauaauaaugaguuuuccucccuuucugacuccacuaccuuauccaguccuauaguaucacuuuacuaucugaaacguuugugggcuuggggguuacaugagauuuugcugaguaaaucaaaaaggugguggccaggcaugguggcucaagccuguaauccuagcauuuugggaggcugagguaggaggauugcuuaaggcugggcguucaagaccaaccugggcaacauagcaagaccucgucucuacaaaauuuuauuuuuuuuuugagacagagucuugcucuaucgcccaggcuggagugcaguggcgugaucucggcucacugcaagcuccgccuccuggguucacgccauucuccugccucagccuccugaguagcugggacuacaggugcccgccaccacgcccagcuaauuuuuuuuguauuuuuaauagagacgagguuucaccguguuagccaggauggucucgaucuccugaccucgugauccgcucgccucggccucccaaagugcugggauuacaggcgugagccacugcacccggccgcccaaaaauuuuuuaaaaauuagcugagcaugcuggugugugcccauagucccggcugcucgggaggcugaggcaggagaaucacuugagcucaggaguuugagacugcaaugagcuaugaucgggucacugcacuccaaccuggucaacagagugagacccugucucaaaaauaaauuaauuaaauuuaaaaaauaauaauaacacugcuaaaaacacuucuauaauuuuuuuuuucuggugcaaacuauuuucaugucagauauuuaaaucucuuuuuuuuuuugagacagagucuugcuuugucacccaggcuggagugcaguggugcgaucuuggcucacugcaaccucugccuuccagguucaagugauucuucugccucagccuccugaguagcugcgacuacaggugugcaccaccacaccuggcuaauuuuuguauuuucaguagagauaggguuucaaccauguuggccaggcuggucuugaacuccugaccucaggugauccgccugccucggccuccaaaagugcugggauuacaggugugagccaccacgcccagcccuaaaaucucuuguucuaccuuuucuugucauccuuucauuaaaaaaaaggaaaaccauuuaugcuacauuuuaacaucaaaaaaauauuauguuuuggauuuucugcaccucuguccuucagagucagagauaauugagaguuaaguacaaucaaccuuaaaguugccuugcaagccaccaggaaaggcagauauuggagaggcagaagcuagcuucaggaucaugucccuauagucaguaacacaccagcaccuaggacccugccaccucugcucuucucuggccaccucgaacaaacuguuuuccuuuucccagggccuaugacccugcagacuaugagcauuugccaguuucugcugaaauuaaggaacucuuccaguacaucaguaggugaguacuaggaccucccaccauaccccacuaucccuaccuugccccaaaccuuuccuaucucuagucugaaacagggccauuccccuuagauuuuuuuuuagccugaauaguaaaguaacuuuuucugacugucuccaccuucccuuggcaauaucuccuagguacacaccucaguugauugaccuggaccacaaacugaagccuuucauuccugauuuuaucccagcugucggggauauugaugcauucuuaaagguauagucaguacauccugaaaaugacuccuuaaguguuucuucugaugccccuguuacucuuaacaguuucccuaauuucuuugacuagcauuggcuagucauguucauuucauuggaguucuuaaccuugcucucaacuccaaauuacacucauugcucuuaaguaauacuuaauaucucauuacacauuaacaguuugucauguauuugcuuccuaauuaucuaugacaacagguucauauuuaagcugcuauggauaauauuuuuuuucuggauaguauugcguacagcaugauaagcaugcuuuuaauacuaguaauaaugaugaaccagaaguguucuuccucuuaacuuauuggaaacauuuuccuuucugcuuucuuaccuuuuucuuaaccaggucccacguccugauggaaagccugacaaccuuggccuauugguauuggaugaaccuucuacaaagcagucagacccuacggugcucucacucugguuaacagagaauucuaagcagcacaacaucacaguaagauacuagcuuaguauaggccccagcuggagagggccaagaguggaggaggccuugcuggcacucauacaguugacuuacugccugucaaaagagaugggccugggugcgguggcucacgccuguaaucccagcacuuugggaggccgaggcggguggaucaugaggucaggagaucgagaccauccuggcuuaacauggugaaaccccgucucuacuaaaaauacaaaaaaaaaaauuagcaggguguaguggcgggcgccuguagucccagcuacucaggaggcugagacaggagaauggugugaacccgggaggcggagcuugcagugagucgagaucaugccacugcacuccagccugggcaacagagcuagacuccaucucaaaaaaaaaaaaaaaagagaugguuauugcuuugggccagcucuauuuuuaaaugacagcuuuauuuauauauaacuuaaauaccagcaaguuuagccuuuuaaauuguacaacuuauuaguuuuaauauaaucacaguuuuguagccaucaccacuaccuaauuuagaauauuucaucaccucaaaaagaaacuucauacccauuacuauucacuccucauucucccacuuccuccuagacccugguaauuauuucauuccuuuguuauggcugaauaauauccacuguauggauuuaccagauuugcuuuauucauucucuaguucuguccacucuuauuaauaauggugcuuugaauauuuguauacaaguuuuuguguagguauauauuguuauucuguuggguauauacauaggaguagaauugcugggccauauggaaacucuauguuuagccauuugaagaacuaccaaacuguuuuccaaaguggcuguaccauuuuacauucccaccagcaaugaaugagaguuccaguuucucuacauccucaucaauacuuuuuguuuguauuuuucauucuaaccauccuaguaggugugaaaugguauuucuuuuuuuuuuuuuuugagacaguuuuacucuuguugcccaggcuggagugcaauggcgugaucuuggcucaccacaaccuccaccucccggguucaagcgauuuuccugccucagccucccgaguagcugggauuacaggcaugcaccaccacgcccagcugauuuuguauuuuuaguagagucaggguuucuccauguuggucaggcuggucucgaacuccugaccucaggugauccacccaccucggccucccaaagugcugggauuauaggugugagccaccaagcccagccuaaaugguauuucauuauggucaguccugccauuuugaccugcugccuuuccauggcuucagcaaauuauuuuuuuuugagacagggucucgcucuguuacccaggcuggagugcaguggugugauuggggcucacuguagccucgaucugcaagcaauccugcuaccucagccucccaaguagccgggacagaccacaggugugugccaucaugccuggcuagguuuuuuuuuuuuuuaauuuuuauuuuauagagguagggucucccuauguugucuaggcugaccucaagugauccuccugccucagccucccaaagugcuaggacugcaggugugagccacugcacuuggcuuuuuuuuuuuuuaaagacaggaucucgcucuugccuaggcuggagugcaguggcacagucguagcucacugcaaccucaaacgccugggcucaagugauccucuugccucagccucucaaguagcugagaccacaggcacacaccaccaugccuggcuaauuuuuaaauuuuuaguacagacaaggucucacuauguugcccaggcuggucuugaacuccuagccucaacugauccucccaccucagacugccaaagugcuaggauuacaagugugaccgccaugccuggccuggcugcagcagauuuuaucaggguuuucuauccccuucauuuggcuacuguuucacguggcagcagcugucaucagcaagcucgaauaugaaacagcagcagauauaaugagacacuguaaaaacaagagagcuacuucagugccaucagcuaggcuuucuccuuacuuuccuagcaacauaugaaaguaaaaagccuagaagaugcagaaaagaaucccaaagccauugacacguggauugagagcaucucugaauuacaccguucuaagcccccugcgacugugcacuacaccagguaagaaauaccacauucuuugcaacaguaacacauaguaaccuucacuaccugugaacuguugcuccugagaagaggcccagaggcugggaacauauuugaucaaccugagguccuguggauccuggcaacuacuggcugagauuguagacauaaagauuguaauuucucuaguauuacuuagcuaccuccuccaaaccccaggcccuggguaacuuugguaugcccagucuagguucuccugaagccuuccugaugugccagauugaagaccucuccuucauccuagaauaugcugauccagagguugcugauguuaucaguucacguuucuuguucauauuuaccuuuauacuuuuaggcccaugcccgacauugacacgcugaugcaggaaugguccccggaguuugaagagcuuuugggcaaggugaguggaagguagcaggagguaggguaagaaaguacaguauucgcuccagggcccaguguuuuuucucuuccuccauuauuauuauugguaacuuuuuuuuuuuuuuuuuuuugagacagggucuugcucuucccaggcugcagugcaguggcaugaucauggcucacugcagccucuaccucccgggcucaagugacccucccaccucagccuuaccaguagcugggaccacaggcaugcaccaccacacucagccauuuuuuuaauuuuugguagagacgaggucuugcuuuguugcccaggcuguucucaaacuccugggcucaagcaguccuccuuccucagccucccaaagugcugggauuacaggcaugagccacuccacccagcgaucauuaauuuuuuuuguugagauggagucucucucugucgcccaggcuggagugcaguggcaugaucucagcucacggcaaccuccaccucccaauucaagugauucuccugccucagccucucgaguagcugggauuacaggugccugccaccaugccaccaugcuaauuuuuguauuuuaguagagaaaggguuucaccauguuggccaggcuggucucgaauuccugaccucaagugauccgucugccuuggccucccaaagugcuaggauuucauuaacuuuuuaaugguaacacaggaaacccauguauaugugguaauuugauauauaagaaagauaguuuuuuuuuuuuuuuuuugaggcagucucacucuguugcccaagcuggagugcaguggcaugaucuuggcucacugcaaccuccguaccccccgcagguucaagcaauucuccugccucagccucccaaguagcugggauuacaggcaucugccacugugccuggcuaauuuuuguauuuuuaguagagacgggguuucaccaucuuggccaggcuggucuugaacuccugaccucgugauccacccgccucugccucccaaagugcugggauuauaggcgugagccaccgcgccuggccaagaaagauaguuuuuuaaaugauuggugauagaauuaggguauaaugagacaauuauuugaaaaaaauuaaaguagguuucugccucaacuguauacauaugugaauuucagaugaauuaaagaguuaaugugggccgggcacaguggcucaugccuguaguccuauaauuuugggaggcugaggcgugaagauugcuugagcucaggaccagcgugggcagcauaaggaaacucuguuuccaaaaauaaacaaauaaauaaaagaagggaaaaaaagaguuauuguaaaaauaaagccauguaaguaauauaauaaaauauaggagauacagaaggagcaugacugaaaaaauaaaugaaauaaaauauaggagaaauuuaauuaucucuuuuuaaaaaauucaagugucuuauaacuuagggaaauuuaauucuauuaggauaguuagguguuucucaguguaauaagaaacuuaaaagucauauugaggccgggugcaguggcuuaggccaggcgcgguggcucacaccuguaaucccagcacuuugggaggccgaggcagguagaucaccugaggucaagaguuugagaccagccuggccaacauggcgaaaccccaucucuacuaaaaaaauacaaaaauuagcugggugugguggugugugccuguaaucccagcuacuugggaggcugaggcaggagaaucacuugaacccaggggcagaggagggcacggagguugcagugagcaaagauugagcaacuacacuccagccuggguaauagagcgagacuccaucucaaaaaaaaaaaaaaaagucauaauggagugggaggcugagaugggaggauugcuugagcccaggaguuugagaccagccugggcaacauagacccaucucuguuaaaaccaaaagaaaaggccagccacaguggcucacgccuguaaucccagcacuuugggaggccgaggcgggcugaucaugaggucaagagaucgagaccauccuagccaacauggugaaaccccaucucuacuagaaauacaauaauuagccaggcgugguggugcacaccuguagucucagcuacucgggaggcugagccaggagaaucgcuugaaccugggaggcagagauugcagugagccgagaucgugccacugcacuccagccuggugacagagcgagacucugucucaaaaaaaaaaaaaaaaagucauaauggagaaaaugugacaguuuaaacucauagaaaugaaagguucuacauaccaauagauaccauaaacaaaguuaaaagacaguagcagucugagaaaaaauauuuuauauauguauguaauagaaaaaauuacuguccaagcaaagagcucuuauauaucaauaaggaaaggaaacugggccaggcacgguagcucauaccuguaaaucccagcacuuugggaggcugaggugggacgaucacuugaggccaggaguucaggaccggucugggcaacaauaggagacucuucucuacaaaaaaaaaagaaaagaaaaaaggagcuggacaugguggcucauaccuauaaucccagcacuuugggaggcugaggugggcgcaucaccugaggccaggaguucaagaccagccuggccaacauggcaaaaccccguuucuacuaaaaaaauuaaaaaaauagcuggguguuguggcaggcaccuguaaucccagcuacucaggaggcugaggcaggagaaucucuugaacccaggaggggugcagauguugcagugagccaagauugcaucacugcacuccagccuggguaauagagcaagacuccaucuccaaaaaaaaaaaaaaaagucauaauggagugggaggccaaaaugggaggauugcuugagcccaggaguuugagaccagucugggcaacauagacccaucucuauuaaaagaaaaaaaaaaggccaggugcaguggcucacaccuguaaucccagcacuuugggagggcgaggcaagaggucaagagaucaagaccauccagccaacauggugaaaccccaucucuacuaaaaauagaaaaauuagcugggcaugguggcgcacaccuguaauguaaucccagcacuuugggaggccgaggcgggcggaucgugaggucaagagaucaagaccauccuggccaacguggugaaaccccaucucuacuaaaaauacaaaaauuagccaggcauggugaugcacgccuguagucccagcuacucggaagacugagccaggagaaucgcuugaacccgggaggcggagguugcagugagccaagaucgcgccacuguauuccagccucaugacagagugagacucuguccaaaaaaaaaaaaaaaaagucguaauggagaaaaugugacaguuuaaacucauagaaaugaaagguucuacauaccaauagacaccauaaacaaaguuaaaagacaguggcagucugagaaaaaauauuuuauauauguauguaauagaaaaaauuaccguccaagcaaagagcucuuauauauuaauaagaaaaggaaacugggccaggcacgguagcucacaccuguaaucccagcacuuugggaggcugaggugggaugaucauuugaggccaggaguucaggaccagccugggcaacaauaagagacucuucucuauuaaaaaaaaaaaaaaaaaaggcugggcgugguggcucacgccuguaaucccagcacuuugggaggccgaggcgggcggaucacgaagucaggagaucgagaccauccuggcuaacauggugaaaccccgucucuacuaaaaauacaaaaaauuagccgggcgcuguggcgggcgccuauagucccagcuacuugggaggcugaggcaggagaauggcgugaacccgggagacggagauuguagugagccaagauagcgccacuacacuccagccugggcgaaagagugagacucugucucaaaaaaaaaaaaaaaaaaaagaaaagaaaagaaaaguaaaaggagcuggacacgguggcucaugccuguaaucccagcacuuugggaggcugaggcagguggaucaccugaggucuggaguuugagaccagccuggccaacauggugagaccccugucucuauugaaaacacaaaaaaauuagccgggccugguggcgcacaucuguaaucccagcuacucaggaggcugagacaggagaauugcuugaauccaggaaguggagguugcagagagccaagaucaugccacugcacuccagucugggcaacagagcaagacuccgucucaaaaaagaauuuuuuuaaaguaucaaaacagaaaaggaaacugaacaaagaugaccaacagguccuuccuagccaucauguuuaaacugcugcaccagcuccccagcauuccccgcccucugucccugcuuuuucuugauaacacuuaucuucuaacauaccauagacuuuauuuacuuauuuuguucuucccuacuaaaauguaagcucuacaaagacagauuuuuuuuguauaugaagaauugauuguaaacacacagaauuuggaaacagucucuuuccucagagcauuuugaagcuguaguugaggggaaggugucugauuaggggauugaauagcuagguugcaguacauccauucagugaaauacuaugcaauggaauauuauuuggccuuauuuugcucuaauaugaagaaauaucagugauauguuguuaaaugaaaaaagcaaauugcagcaaguugcagaacuauauguacucuguuuuuuguaaaaagagaaaaguuuuaagaaaccaguaguuuaaaaacuucacacugugacuuguuuagauccagagccuguuaccugaguuagaugucaugcccauuuucucuguucauaugguguccuggaaucauuaggcauuauaacaccaaguaaugcauauauaacuguuaauacuugcccauaacuugguaucaguuucuuuuucacagauucccacaggaaaagaguauggcaguguauuuuaccuauaaaacauaugaccaauuccauacugaucgggggaaaaaauagcauguuguauuauuuugcuaggcugccauaacaaaguaccauagacugaguggcuuagacaucagaaauguauuauuucauaguucuggaggcuaguaguccaguaguaguccaagaucaauuuguuggcaugguugauucccucccucccuuccuuccuuuuuuuuuacaggguauuacucuaugcccaggcuggagugcaguagcucaaucucagcucacugcagccucaaccugcuggacucaagcaguccucccaccccagccucccaaguagcugggacuacagauacucaacaccacacccggcuaauuuuuuuguagagauggaauuucaccauguugcccaggcuggucucgaacuccuaggcucaggcgaucugcccaccucaaccucccacagugcugguauuacaggcgugaagccaccacgccccaccaagauugauuucuucugaggggucucuucuuggccaucuucugugucuucccauggucuucccucuguuaugcgucuuuguccugauuucuucuuccuauaaggacaccagucauacuggauuaaggcccacccuaaugaccuuguuuuaauuuaauuaucucuuuaaagauguuaucuccaaauauagucacauucugaaguacagggaguuaggaacucaauaucugaauuuuaggggaacacauuucagcccauaaccugugucuuaugcuagaagcucuuuugcuucagagagagagagugguucugggaccacugacaccauccuuuugacuuugguccuuccaugccccuuccagguaagccugcccacggcagagauugauugcagccuggcagaguacauugacaugaucuguggugaguuccucuuuccuuuccucguccccaucucuggauagagacacucuaggcuuuuggacaggcuuguuuacucugggaagauaguaucuugaguuucagccuucacuuuaagcccguugugcucuuuggcagcacucaaaggugguguuuggcuuaugugacuaccugcuggguauuuaacccccaaagucauagcgacaccccaucugccagggcuuugccugugcuagacagaagggccucuaauucccggaguuuguuugcuucuguuccuggaaguucuucuucguuucagccauucuagacaucccugucuacaagagucggauccagucccuccaucugcucuuuucccucuacucagaauucaagaacucacaggugagccaagcaucagggguugacuuaagcuguagagaggaucacuauaguuucuacuguucugagccugcugugauugcauccuauagcgauguaggaugucucugcccaguuaccuucgcccuuucccauaauuaggagagcaaaggaggcagggauggaguuuucaaggggaaaguggaggaaaaaaaaggguggguggaaguaggaguugugggccuuagaugaaaucaggugaggaucuacagaggacacucguucuuucagaaccaaguucccucaugaauggaagcaggaaggaaauaaaggggguucauuuuaaagaaauuaauucuuguuaaaauauagcaauuagcauaucccuaauacucaauauucccucuccucuuccuugcagcauuuuaaagcucucgcugaaggcaagaaagcauucacuccuucauccaauuccaccucccaagcuggagacauggagacauuaaccuucagcugagacacuucccaagcugcuguuucaaggcugagcuggccccucugccccagcugagauggacagaucguugucagcuacuugauguccuugcccaugccacagcuuggcucaggggcagugcauguccugcugcccucucugccagagggcacagaacauguuuguuuaaugaaccugccugccucagauugcuguccccggggaguuaaugcaucuacaccacuguggggauuugaguuauaagaauuggaauuucugagaucccauggagguuagauugggaggaaagcuuaaaagauguccuuuuugugagagggauggaauuguuuucuuucauucguaaaguuagugaguaaagauuuuauaaaucaaaugcucuauuauauug

SEQ ID NO: 192048 - RNA, 254876 nt, Homo sapiens
cagccgcgucccccagccccggccucccgcggacccaugcccgcccguaucggcuacuacgagaucgaccgcaccaucggcaagggcaacuucgcgguggucaagcgggccacgcaccucgucaccaaggccaagguaccggcgcaggggccaggcggcagucggagcguggcggggccgggagagguccgcgccccccagccggggggucggggcggcgagcgcggcgcguggugggagcguugggggccgggaggcgggagggagccagccgcggcggggcgggcgcggagcuagggacaccugggacucgagacggcggaacuccaagcagggggccgagggcacagagcaccggcgcccaggagccgggcgcggggagggguccucggggcugagggcaggcggguaaaggggaugauuggaaagaaggggucggaacuccccgagggccgggagacuguaagcccagaagacucuggaaccagcagcuagggaaucauaagggaaugagggcaggggcauaugaaauguggacccggaggauggggaaaaacaagggugaaguggcagacccgggcuuguaaggggacccaggacggcuggggcacggacugggaaugugcacgucugcagggcgcugggaggucccaggauccuggugccuuaagacagagacaggaauccgcauuugaucaucuaagacugauagauggugcgaaggggaucccgaggagacacgauuaguggaggaggcaaugaggaaaauggggaaauaagggggaaauugcuuugcuuguccacaggaaggggcccagggaaugggggagugaggugggggugggggcugucccagguuuaugauggcacuagguagucagggguuaaacaauuugggagagcugauugcugguuauuuuuaguuguuggagggucgggaauugugggcuuuguagaacccagggugggcuuuuacugguuggggggaagcuugugauugaagaacccagacaccgggagauuacacucaucgagcccuuaguucucaaagggauuugaggcgcuauaggagugaaauuggccaaggucaauuaggaagcuauauauguaugcauguaaaauucuuugaggaaauaugguagcacuuucauguagccuucguugggaggacuggaaucuaagacaucaggaggaaucuuuugguuuugguggaacccgcaaagcccauuuuuacucuaaaauuuucuuugcucaauaucuuacuugaaugaauacuuuuaauguagucauucauuauguuuagaacugcagcuuguguuuucccucagccugaggaaugaagaacccuuacagcugcugccgccuccuaccaaagccacaucaauuccccucaccuccucagccuagccucugguugucaugaccuaccuuguuuuugcuuuuuuggcaguggcuuguuuucugaagccagugacuuaucuaggccuucucuccugaucacuugcaaccugaaguuccuuccccaccaucuuucugccugaggcuacaaggggcccuucuuaccagggugucaggguggguggcuguggcgaauugauuggucaguuucacuuccucuggagggcccucuucagccuuuuuguccguuuuuaucacagggccuccagucugcaggucagagcugaaugagauaccaaaguccagggcucccucagacccugaggggaagucaggggaagucgauugagccaagacuuuggugugcuccucacuugccaccccagccccucaccguguuuccagucuaguugacuauuagccaaggcaaacuuacauuuacaaacaauaugccuuguuccuuguuuugcuauuucuuuccuuuuuuucugccuauuuucuguguaaucacuuugugcuccugugguuauuuugcucugaccucugggggauagucuccaugaacuuaauugguugccugguuuaugguuucaugauuuaaagaauuuugaaucuuccagcccuuggauacaccaaaauauugauaaaaucuguuacagacaggguugaauguuuucguaaauguaauugcaaacaguugauucuuggcuuuaauauaaaagagacauuucuaucuucaguagucagcaaagccagugccuaauuauggcuggucugcccgcuuucuaauuuucauguguguguauaugugcgugcguguguuuuucauaguuuuucucugagaccuugguauccuuuaggacugcagcauuuuaaacacuggcuuguuuacaaacgggugucacuguuuauguugguuuuuaucuuugaucauuugugguaugcaguugugcaauuccuauguauggaaauauucaaagucuugaaugagacugaaauggcuuggacaaugaguugcaugugugaaggagccacaccagcauucauuuguguuucuguagcagugugcaauuuccuaguuacaguuacaagugcuauaucuuuugcugcuuaaauuacucugacuacaugagugaagcuuaauucacaaggaguugucacgugcucugggugaacuaggagcauauuuuggccugcuccaugcuucucugaauccacuuuggaagggguucucaaaugcggacagcuuagaugugccuaacagcugucgacauacaguacgauggccuauuaagguuaugguuugguuauauaacaauggugaaggugcauagguacuagaaguugccgaagcugcugcuucaguuaacucagguugauuuuuuuucuccccaugcacugcagccuuuaucuuacuucugcagaggggucauuuggaaacagagaguuauuuuuuucccccaucugucuccagaaugugucauuuguuguuuugucuuuuagaggugugugauuuuuuuuuccccuuguaggaaauggucuggguuuucuuauaaccauauauaacagucagacagagguaauucagaugauacuuguguuggcugaaggagguuagguaauagguauuuucugaacauuagaaauaauuaugaucccccuccuuuuuuuuuuuuuuuuuuuuuuuaaacacacaugacccauuccaagaacuaagagacuaaaguaaaccucauuuauugaguaggauacugcacuccauccaauacugcgugguuaagcuggcccuuucccaaauucuguuaacucucaaaccgucuagagugggauccugggaugaauaaaaucaguagagaaaagugaagcuuuuccuauuugguuguugguuacuuuugcagcacggcauucaugagcucagacuucauauuggcagcacugcagugcuuagagcggcacugcagaacaguuaccaggagagaauguucagcugugacauacuuugguuaguagcucacccuggcugucuuuguccuaccugcuuugauuuccuuuucuuuggaagagccuuacuuagccugagguucucuggcucuguuuuuuuuuuugguaggaaacuauaaaguauuacagauauuuuuaaaaaagaauguuuucugcucucaaauugcagguagucuguugccugugccuaauuauaccuucacuaguuggaugauugggaacaaagaguagauagauuuuguaugcauuuuuuuuccuuuuuuaaaauauuggggcagggucuuacucugucacccaggcuagagugcagugacacugccagaguucacuguaaccuccaacucccaggcucaagagauccuccugccucagcuuccuaaguagcugggacuacaggcuuauaccaccacaccagguuaauuuuuaaauuuuuuuuguagagaugggggucucauuauguugcccaggcuggucuugaacuucuggacucaagugauccuccugcuucagccucccaaagugcugggauuacaggcaugagucuguaacccaaaugcuuggcccauaugcauuuuuuaaaguaugcaugacuauaaaagccuuuggccaaauacguuuaaacuauauuucaacaaauauauaucacuugccuguuauugguuugugguaagaguuccagcuuuggauaaagcaaccugaguuugaaucuuuugcugcuuaauaguuggauauuuuuaggcugugagaaguuauuuaacuucugugugcuuggguuuccucaucuguaaagugggaugacaguaguacuuaccucacaaguuuagguguuaugaagauuaaagaagauaguguauguaaagcucuuagagcagcauggugcccuaauagcaugacguaaauauuaccaucaucaucaucguuaucagauguuuuaguaacauaauaauauuauggacauaauaauaguccuccuuuuuuugcuucucaccccuugggcacgauucaugaauguauaugccauuaguuuuguguagguagaugccauccugacgauagacuuuccugguaaaaaaaaaguuugcuacuauugcaggugccacuuugagauaguuggauuuaauuuguauaggguacaggcuggcuaaucucaugaaaucagcauuuuaaaacauaaauuuucauuaguuaaacuuuuuuuuuuuuuuuuaaauagcaaugugacuuaucuaaugaaaacugugaccaacacuggcuuuugcuuugggcugccuugaauuuucaguguguuuuguguaacuaauuuuuguuauguugaugauggaacagaguugagugcagucuuuucuccagagguccacuuaaauuagguuuaagugaaauauuuaagaaauguuucugcaagcuuaaggacacauuugcccuugcgugcacaagcaaaggccuuagacggccaaggucagaauucuuaacuuuaaauauuacacagagaagacauuuugcccuaugaccccuuuccaaauauugacuagccagacacaucggugugguuuagugcaaacucauuuccaugaggagaacaagucaaagugggcuaaaagcauuauuuucaccucuaaagaagaguuuaacgaagcacaugagaugaugcuuucacccauuagaaaacugaaaacaagauucauuugguaaguaggagagaauuaugucaaaaagaaauugaaagcagaauuuacauuagauacauuugaggaagauagccccaucccuagacaaucuagaagugacuauugaaagaugauuauguucaguuugauacaguggugaugggguugcuaaacguuuuugaaauuuuguaaagagcuaagacugauugagacuagucucuccagagucaaaauaccaguauuccauuuucuacaucaaagauguuuauuuuaacauuuugacuuuggugccagcucccuagaaagucauagaucucgcucaagccagaggugcccagacuaguuauuucugugccagaagugcuguuuucauuuuucaggcuucagucuggcuaauguuuucuaguucaucgcguaaaagagaacaaaauggaugcuuugaaaagaaaaagaaaugcuuucuacucaccagagccacuguaacuguaaaacaacaccuaagacaucugcauagagauggaaccuuucccuuaaucauuuauucauucaacacauuuauugaaugaaaauuuuuugucagguuccauucuagggucuggagugcaccaaugaacaagggagacaaaaagcaucugccuuucuggagcuuucuaguagaaggagacagacaagggacauguaaaaaaauuaaaaauuucauauaggaaugaauaccaggaagaaaauaaacggacuagagaaucccuggggggggcugcugccucagauagaguggucagggaagaccuuucuuuccaagaugaugauauuugagcugagaccugagugaugagaaaaagccaaccugggaagauuuggaagacagaagauuccuuacagaaggaauggcaugugcaaaggccauggggcagaagugaguuugguuuggucaaagauuagacacaaggucaugaugccaugguaccuuagcaaacaaguggaaggaugggaaaagaugaggccagacauguaggaggggccagaucaucugggucuuauggccauuuuauggaauugggugugacacgggggugacaucagagaguaucaagcagaacacuaauaucaccuaauuuauguuuuuaaaacguggcuggaugugguggcucaugccuguaauuccagugcuuugggggggcaugaggcaggaggaucacuugaggccaggaguucaagaccagccugggcaacauagugagaucccaucucuacaaacaauuuaaaaauuagcugggugugguggugcgcaccuguagccucagcuacuugggagguggaggcgggaggaucacuugauccugggagucugaggcuguggugaacuauggacacaccauuguaucccagccugggugacagagugaaacccugucucaggaaaacaaaccaaaagaaaaacagcaacucaugcugguuauuuuaugguuaagagcaagaauccuuuucugaugcauuucuuggcacaagggaggaguucaguuuuaacaacuuauauucuuucucacuguagaggaauauugacauaaauugcacauaaauuaagcaugaucaacuaacaaguauuuguugauuuauugggcaugaaaaagaccuuagagagguucuauucuaguucugucuucuccacagucuggaaagacagacuuaacagaauuuauaaucucagguuuugccuggcaugguggcucacgccuguaauuccagcacuuugggaggcugaggcagguggaucaccugaggucaggaguucgagaccagccuggcuaacauggcgaaacccuguuuuuacuaaaaauacaaaaaauuagccaggcguggugguacaugccuguaaucccagcuacuugggaggcugaggcaggagaauugcuugaacccaggaggcagagguugcagugagccgagaucgugccgucgcacuccagccugggcaacaagagugaaacuccgucucaaaaaaaaaaaaaaaaaaaaagaaaaaaaaaaccucaggauuuuacggacuuuuaaagucauuuagaccaauuauccauuagauucauggcucaucucucuccucacucccauuuucccggagucuuauagguaguuagugggggagcuggaguuagaauccaguuaucacuacuccuacuuaauucuacccugacuucucuaaucacagaaaacagugcccuugccuucugagcacuugcuuuuuuacuggggaagcgagauacaccuauaccaauuaaagucuaagauauuuauccuuucuauaagacaaaccaaaagcgagaugucaugaugagaggaaacauuuccgaguagagaggaagaguaaauauuccaacccuguauuucaccuguccuuuggcauuauaccacucugucaccuuugccacuaacuuuuaguacccuauggguccacugcuuugccuuuaaaucugcuagucagaugccccuuggcaugacugagauaugaagaaaaugaaaagggaaagaaguaaacacagcaugcaaugaccguaaaaguagucugccuuacguaguuuucucaugucauuauaucuagcuaacuccuagggaauauugguaauuauacauuuguucugcugggcuggucugaucuaccuuugaggguauguuucuuagaugggcuccucacuuacuaaaugacuaacacuuuccagggauggugacaucuuauaacucauuaagagaacuggucaucuagauauauaccuugaugacacaggugagggucaagagaaccauuuauaucaaggguuccucuuuuuuuuuuuuuucauuauccuaaguaaacacaagaaggaauucuucuuaauauaguucuaguuucuggucugugggcuauggcuguucuccagaugaaugaucucaccuaucagguaggugagucccugguuccuccuaauagcgaguagcuuggucccuuucugggauaauaauguagucauacagucccguggaugacugauaacaucaagagggugaaaauuauauacauucaaaugggcuuuuauccuaaucuaauaaaauauugcuaaauaaauggcguaggcaauguccuugagaagucucaacagucuugaaugaauuagcuugaaagacuucuuuuggaucuguucagaauagaauugcggaagcgaguacggaacuguuggaugagccaucaguaaguuauguuaggaacauauuuguguuuagcaggugugugauccgugguagacaaggagccucuggacacugaugguauuuuaucucagacuuaggcuuuucaaagagguaggaaucagauugugaauacuuagccacauuucccagaaguugaaacggaaagagaagcagacucauugccuguugaagcuugucugugugggcugagcucacucaguuggauacuuucggccaguuauuuuaaacuaaauuuagguuuugaugaaguucugaaaaauuaucaaauuucugucuaguuucagcuccagcgcauguuuaccagcaguauacuuuacuuuucauagcuccccccagaauugaaugugaaaauguagguuaguugcccacauuucuugagacggaauuuuuuggagaagaaauuuuuuauuccauccauccauccaauaaacgugcaaaauuaucagaaauagaaauggaugauauauggcccaaaauucaaaagguacaaaggagcauucagugaaaugaagucuucuugccaccccaauaccugagucacacaguuucuuagucuuuuuuuuuuuuuuuugagacggagucucacucuguugcccaggcuggagugcaguggcgcgaucuuggcucacugcaagcuccaccucucggguucacgccguucuccugucucagccuccagaguaguugggacuacaggcgccugccgccacgcccagcuaauuuuuuguauuuuuaguagagacggcguuucaccauguguuagccaggcuggucucgauuuccugaccucgugaucugcccgccucagccucccaaagugcugggauuacaggcgugagccaccgcgcccggccagcuucuuacucuuauaaacauuuauuaagggcaucucuggauuaguccaagugcuagaugccguuuauuuucugacagugcuuugacauacuugaaauuuccaagcauaauuuuacuuaaaaguaaaaaaagaaaauaccuggccagaugcagugguucacgccuguaaucccagcacuuugggaggcugaggcaggaggaucacuugagccccagaguuggagaccagccugggcaacauagugagaccuuaucucugcaaauaauaauaauaaaaauaaccaggggugugguggugcaugccuguggucccagcuacucaggaggcugaggugggaggaucgcuugagcccaggaggucaagguuucugugagcuaugaucgcaccacugaacuccagccugggcaacagagccagagcacuucucaaauaaaaaaggaccaaagaaaaauaccuaaccuaacuuauacugcucauuaggauggcacagugugauaaucuaauguaagcccugugggggccggaauuuuaaucuguuauucacugcuguauuccuuauguuucgugcaaugucugcagauauucauugaguacaugaauauaaggauuaaaaauaagagcugaguuuguuuuuauacccuuaauacaucuuuugacuuuuacuauuggaauuuccuaucuauaguuaagauguuaaagaaaaguaauuuucuaccuuuuucucacaaaucuccgaguaaggagauuucacagcuuuucugggcuaguaauugauuuuuggcauaucucaaacuuuuacuauuaggaagaucaguguaucuaaaguaagucuugcaauuugaauucaaaucccuuaguuuuuuguuuuuuguuuuuauauuuuugagauaggguuucgcuuugucaccuaaggcuggagugcagugaugugaucauggcucucugcagccuccaccuccuagguucaagucauccuucuacuucagccuccugaguaccugggacuacaggugcaugccaccaugcccagcuaauuuuaaaaaauuuuauuuuuaguagagaugggggucuugcuauguugcuaggcuggucuugaacuccugggcucaaaugauccucccucuuuggcuucccgaaguguugggauuacgggugugagccaucacgccuggccaacaucaguuuuacuuuaccauaacauugcuguuauuuuuugaaucuuuuuuauaauuuuauuucuaguuuuucacuuuacaaauuuucugugauaaccauuguugugcacaagucuuugauguacuucugauuuuuugcuccggauauauuguugaaagggaaauuaccgugccaaagggaacacaugcuuguacggcaccuaauauguauauugccacauugcuuuccagaaaggcugcacuagaauuaaccuccugagcaguguaugagcaggcuuggcucacugcaagccacacuggcucucuuuaucuuaucugucuccccaucugccuuuguuggcuuggggguguagggcuuuuaagucucuacuacaccucuaaaccuagucccauagauauaguacaagucaggagaagguuauagcagcuguguaauccaucuuucccuguaccaaaccuggaagaggaaugacaagaauucaaguguaaaucuaaccuuuuuuugaggcagagucuugcucugucacccaggcuggagugcaauggugcgaucucggcucacugcaaccuccgccuccuggguucaagcgauucucuugccucagcuucccuaguagcugggauuacaggugcccauagccacgccuggcuaauuuuuguauuuuuaguagagauggguuucaccauguuggccaggcuggucuugaacuccugaccucaaguaauccaccccccgcccccagccucucagaguggugguauuacaggcaugagccaccgcacccggccaagucucaccuuuuacuugcuuuuuauaaaucaucauucucuccugaucuuugauaaagggacaaaaacccaaacuggagaaauugcugaagggaagaagaaagguuaaugagaaacagacucuugaucacccaaaccauugauuuuuuuuuuuuuuuuuuuugagauggagucucgcucuguuguccaggcuggaguacaauggcgugaucuuggcucacugcaaccucugccucuccgguucaagugauuccccugccucagccuccucaguagcuaggauuacaggcacgugccaccacaccuggcuaauuuuuguauuuuuaguagagacgggguuucaccguguuagucaggcugcucuccaacuccugacuuugugauccaccugccucgaccucccaaagugcugggauuacaggagugagccauugcaccuugccucuccacugacuuuuuuuuuuuuugagacggagucucacucugucacccaggcuggagugcaguggcgcagucucugcucacugcaaccucugccuccuggguucaagagauucuccugccucagccucccagguagcugggacuacgggcgcccaccaccacacccggcuaauuuuuuuguauuuuuaguagagacgggguuucaccaugcuggccaggguggucuugaacuccuaccucgugauccacucgccucggccucccagagugcugggauuauaggcgugagccacugcacccagccuaccauugauuuuuaaauaacuauuuuuugguaaaccagcgugagaauuucagagauuaauaaaaguuguaaauugcuccucccucguuuuaauggugaaaagauagucaaggagauugugaaggagaaaguuauaugaauaaauaugguaaugcagcaguccuaucauguuuaaauuugcugugugcauuguacuuuauggguuaagagauuuucaaggguaauugggccauauaggauauugugcuuaguauguugugggguuaugacuguggaauuaucuguguuuuggacauuuggugguaacugcuuuucuuuuaucuccaauagaagcccuccuauacaguaaguuuugguuaugaugugcuuaguuaauugaggggaaaaacugauaaagcaggaaaaucagaaauauauauucaugcauuaaucuuuuuuugguuuuucuuuuuuauguagacggagucuugcucugucgcccaggcuggaagugcaguggcaugaucucggcucacugcaaccucugccuccugaguagcugggacuauaggcacaugccaccaugcccggccaauuuuuguauuuuuuguagagaugggguuucgccauguuggccaggauggucucgaauuccugagcucaggcaguucgccugcuucggucuccuaaagugcuaggcuuacaggcaugagccaccaugccuggcucaugcauuacucuuuuaaaaaguauguauuguggaaaauuucaaacauaaaugaaaguagagggaauaauauaaugaaccccuaugugccugucgccuaguuuaaacaguugucaucuugugaccaaucuugcauuuauaccuuucccacuuccccgcuuuuuuccuggauuuugaagcauaucccagaauccuuucauuucaucgguagauauuuuggcauguaucucuaaauagaugaagauucuuuaaacaaacaaacaaaaccaaaccccagggcuggguauggugguucaugccugccaucccagcacuuugggaggucuagguagguggaucgcuugaggcuagcuaguucaaaaccagccugagcagcacgguaguagugaggccccaucucuaccaaaaaauaaaaauaagugagcgguggauggugguaaguggcuguaguucuagcuacuugggagguugagcugggaggauugcuugagcccaggaguuccagauuacagugcaguaaacuaugguugcgccacugcauuccagccugugugacagagacccugucucuaaaaaggaaagaaagaaaagagagagaaaagaaagaaagaaagauugauuagcacauagguuaauaucaaaauaucuuaaccuauguuaacaaacauuaauguuuuuuguuaauauuaaauauuaauguuuguuaacauagguuaauauuuuguuaaccuguugaugcagggccaaggcuuuuucuuugugugcccuaguuggaguuccuuaauuuuguuuccauuaaauacacccauaauucauuaucuauaauuuccaguuuuguuugcuuuuuaaagcagaacaugaauuuaauggcauuugugaagcaauauuaguacagcaucccucuugauuuuuaugacuccuucccagucuuuuauacucaucucauucacgucuaauuuacuaugucuuuuuaagcauuugaugaaguuuucauagaaacguaucuccuuaauuuuucaucaguuuacauucuauuuaauuaaauuacauaacuguaauaaugagcaacugguauaaauagguuugggaaaaaaacaguuaauuauugguaagaauauaacuuaauaacgggaggcugggcccggcgcgguggcucaugccuguaauugcagcacuuugggaggcccaggcaggcggaucaccugaggucaggaguuccagaccagccuggccaaccuggugaaacccugucucuacuaaaaauacaaaaauuagcuggguguguuggugcaugccuguaauccuagcuacucgagaggucugaggcaggagaauugcuugaaccugggaggcagagguugcagugagccaagauccugccacuguacugcagccugggccacagagcgagacuccaucucaaacaaaccaaccacaaaaaaaccaaaaaacuuaauaaugggagcagcagaagcuuauaagaguaagagacagcuguuauuaguuggggccaguuugcauguugggggcauugguugcuuuacugagacaaggagaagcauugauuauuuuggcagguugguugagugaaggugggcuaagagagcuucugcguuaauuuaaaaugauaaagaagucaaagcuguuagaaauuugaggacaaguuauuuuauagaaucuuuuauuauuuauaguguguacuucgaggugguauuuuuguccacuuauguuagaauuugugugaacugagcugaauuugguaaugagucagugguauuaaaaacuuggugaagaaacuggccaaacucuuuaguuuaagagguuuauaucuguucacugcuaguguaguguucuguggaacaaguugacauuuucuuguaguaaguuguuuucuguuucuggcggaagcaaucuugguucauaugcugcaagaaacagaacuguuuuuauuguggaagacaggagcagagcuguguguuucuuauuaggaugaguuggacaccugcaggauuucuucucucuuucugcuucuugccuccuguugucuuuuccuucuguuagaauguucuaauauugcauaagcagcauuccgacaauaguugaauuuuuuugguacuucauuuuuuuaaacucucaaaauaauguuuuuagugauuguauguucuuggcuuacuuuccauuucuacaucaacagggauauuguuauucuagucaaaugggguaguuguauucuggcaaugaucuuuggguccaagucagcugcagaaacaacacuuucauauauuauaccuaaauaucuuacauguguaugguaauucugggagguaauuaaauguugggaugguacuuuaggaucucuuuaaaggauuucacaguucucaggaauaaaauaacuuguuugaagcauguuacucauuggccuuugaccaugcaaaaggguagccagugauuuuagccuacugccucuuccgaucucauuuuccuccuuucuuuugaggcagcagcugcauccagugcccugcucuaauugagcucuuaguaaaagggguauuguuauaccaagucacaaccucguauagcagugagguuacaucaaugguuguuagauuuuuaggccacgcauccauuuuggagucacauuaaauuuugaaaaccaaaauuuaguugcauuaccuaaauuucucuuccuuuucuuauccugauaccaggauaagaauagguuuucuguuuuuccagcucuuuguggaaccuuuuuggcccaucagaguugcuugcgacaaucuguaguuaaagaacugagacuggugcgggaaucgggauguuucugguuccaguuuuuacuagccagcaguuugacuuugggcaaauuacuuaaccucagggggcuuccaguuucucuuuaauuuauaauuuuuucaacugcuuuauugagguacauuucacagaccauacaguucacccaauuuuuuuuaaguguauucauggagcugugcgaccaucacuauaauacauuuuagaacauuuucauuauccuuaaaagaagcaugguacccauuagcagucacugcuuauuucuucaaccucucuucucagcccuaagcaaccacaaauuaauuuuuaucgauuuacgucaucuggacacuucauauaaauagaauuaugcaguggguguccuguuguauuuuacuucuuucacuugguguaaugccuucaagguucaugcauguucuuacauauguuggaaucucauuauuuuuuuauggcugaauaauauuauguuguauggauacgccacauuuuuaaaaucaauucaugaauuggugggcauuguuucuacuuauuggcgauuaugaauaauauggucuugaacauuuguguacaaauuucugugugaucauguuuucauuuuuuucuugggcauauaccuaggaguggaaucgcuuggucauguggugacuccuuguuuaagguuuugagcaacuuccaaacuguuuuccacaguagcugccccauuuuauauucuuaccugcaauguaugaggguuucuguucugucuacauccaaaacuuauuuucuuuuuuuugauuuuagccauccuaguggaugugaagaaguauugcauugugguuuugaucuacauuucccuaaugaacaaugguagugagcaucauuucaugugccaguugaucauuuguauauuuccuuuggagaaaugucuauuaacauccuuugcccauuuuugaauuggauuauuugucuuuuuauugcugaguuguaagaguucuuuauguuugggauacaagucccuuaucggauacaugauuuacaaauauuuucugccauucuguggguugucuuuucaguuucuugguaguguuguuugcagcacaagugucuuuaauuuugauucucuaguuucuuaauuuauauaguuguuuaaacucugaaacuauauguuuuauugagauuauuuuccucugugcucauucuguacuuucucccauguucauauagcucucucuuucccgggacguuuucuagccucaaagacuuuauuuuuuugauuaauuuauuuauuuugagacggagucucgcucugucgcccacgcuggagugcaguggcgccaucucggcucacugcaagcuccgccucccagguucaugccauucuccugccucagccuccugaguagcugggacuacagguaccugccaucacgcccggcuaaucuuuuguaauuuuuaguagagacgggguuucaccguguuagccaggauggucuugaucuccugaccuugugauccgccugccucggccuuccaaagugcugugauuacaggugugagccacugcgcccggccucuagccucaaagacuuuaaaaacaucugucuauguauuugccucucuaauacaugugucuuacaaaauaaucaaaccuuacaaaauguauaacaaagaaagugaaaguuccucaucucuccagagaaaacauuaacuauuuauaaccagauuuuuuccccauucacaugguaaaaauuuuuuuuaauuaaaaaagggaacauaccacaaucuaguuugccacuuguuuuuucauuuaauaguauaucuccaacauuauuccaugucaguacacuuuguccuugucucaaucauuuuaauggcugcagaguauucuauuuuauggauauacuauacuuuacauaguagccuauugauagauuuuaggguuguuucuagauauuguuuuauuuuuuugagacagaguuucucugucacccaugcuggagugcaauggcaugaucuuggcucacugcaacuucugccucccagauucgagugauucucccaccucagccucccaaguagcugggauuacaggugcgcgccaccacacccagcuaauuuuuguauuuuuaguagagacgggguuucaccauguuggcuuggcuggucacgaacuccuggccuugagugaucccccugccucagccucccaaagugcugggauuacaggugugagucagcgugcccagcccagauuuuauuguuuuaauuacaaauuuuacguaaguuguuucugcacauuuauauuugcacacuugugcuagugguuuuuuuuucuauuccauuuauuugcuauugcaguauuuacuauucaaaacacguagacuuauuuuaaaaaauaaaagaauuuuauuuagugugaccuagagucaacgucucaaaaguuauguauucuuuuccaucaugauauauacaauguucugaucuucuuuuaaagccagagucuucauuuucuugguaauuguauagaauaauuuacuagaaguggaaugcuuggaucaaaguaugagugcuuaaaaucauguaagauguugccacaucacccuccaaguaaggccaugccaauucacucagcuugagaguguaugacagugauuuuucuguucuuuuuaacccuggcaaauagccuuuuuagggaauuaaucugacaggugaaaaaaugucauuuuauuauuuguaguuacuuauuaguacauucgagcaucauuuaauuugucuguugguugucuuucugcuuugucuacuuuucuguugggcuuuuggcuuuuucuuauucaucaguugucauagcuuuauuauuauuauuaauguuuuaaaaaaauugaguuggagucucacucugucacccaggcuggaguacaguggugcaaucuuggcucucugaaaccucugccucccaaauucaaaugguucucaugucucagccucccaaaaugcugggauuacaggcaugagcugcugugccuggccuguaauagcuuuuuaauauuagggaaauuaguuaccuuauaaaauauauuacugauauuuuucuuugucuuuugacuuugugugugugucuaauauaaaaugaaaaugcuuuuauuuuuauagucagauuuuucuguuuuuuuuucucuuuauggcuugcuuuuuaaaauucuaauuauauaaaaauauuuacccauuuuuuucaacuacuuuuaugguuuuguuuuuaaauguaaaucuuugcuucaugugaaaugcauuuugauauaaaccaaaugagauaggggaugaguuguagaauuuauuagaguuguaaauuuacauuuauuuuugugauuauuaauggcuuauuccuacuugacuguaagucucaugagggcaauguauuguguuguuuuguuuuucccuugcucuuauuuucagugucuagcacaaugcuugccuuguaauacacccuccauuuauugaauaaaugagucuagguuuuucuccaggucucuagcuucuccugacacaauuaauugcauaauugcucuuuuccuucuugauuuaaaaagcaacacuaucauuuacaaaacuccaauagauacuuagguacauuucugaauucuaauccauugagugugcugucuuuucuugcuuugauacuguacagcuuuaauuaugauagcuuuauacaacuuaaaguauauuugggaggccagcuuuaagcacucuuaaauauauuauaccacaguuugggaagcucuauaaucuccuuuauuaaacuuuuugcuauaccuuuggaaacauucauuuaacuuaacaauuaaacacuuaauccauucugaaagucagccugcaaagcagaaaugauuuuugggguguuauuugguguaaagaguuuuuuuuuuuuuaggauaucauacuuaauucuggcaugaccucuuuagugucuuuuaaaaaacucucauuuuauaacuuugggcauuucuagaaaagcaacauuuuucucacaguuuucuaaugcaaaauacacagagggguagguggcagaaaagguaucgagaugauuguguuggcaccccacugaugucgaagcagauaguggaaaagacauuacuuaaaaguguuuugcagauuucggguuaaauuaaaaauaugacaauuuuaauuuaauuuaauuaaaaauaugacaauucucaggccgggugugguggcucacgccuauaaucccagcacuuugggaggccaaggcgggcggauugccugaggucaggaguuugagaccagucuggccaacauggugaaaccccaucucuacuaaaaauacaaaaaaauuagcugggccuguaaucccagcuacuugggaggcugaggcaggagacuugcuuaaccagggagguggagguugcagugagccaagaucaugccacugcacuacagcugggugacaaagcaagacuccgucucaaaaaaaaaaaaaaaaaaaagguguuaugcagauuucaguuuagccaccuugauccucccaccuugugcaugacacguuaccuuccuguggcaugcaguauuugacugauucauuggaugugacuugcauuaaguucagauaacauugcugaauaaucacuuucuuauucuuuaguguagccuccuuucucuguagaacaucagaaauucuuaaacucugaaauacagcauucucuugggauuuucuguaaugucuuucucauguaggaaccaacuucagggucuugugagcaucagagaaguuuaaggucuagggaacugagcuaauggaacaaggcaugccuaaugugauaaaauccuugcuuucuuugcaauugaaauuguuuauucuaaauaacugcuaauuuacaaauguauuuucacaugauuacccauucuguucucaaagagcauaauagggguuuugugacuuucagacuuuccugaaaaagccuaaccguggauuuuagaauuauuaagcuagaaaaauacacacauacacacacagguuuguuugggacccuuagucuccacccuggaauuaagugacacugaaaauaacucuggaauaaaagguuuuuauguagcagaauaguugacuuacagggguucuucccuuugcacauuuucucuggguagaaaaugagcuuguuuuucuuuuaguuguauuacaauuuuuuuuuuccucaaugcuagucuuaacugagagauuuuuaggcaguuaacucucccagcacagcaauaagcagcuuauuaguagauauuaucucuuguugauuuguuacccuugagauuuacugugcuugcaaaacaccugucuguauuugagcuuugcuagguaguuggcuuuuguguuugacugaagauuuuuuccaaagaaagcaaauagcuauuaggaaaagaaagagucagcaaauuucuguaugcuuucauggaagagauuucccaauuagaaagcuuuuguaggcuuaaccuuuugcccuaaaguaacccaacauuucauuauguauuccauugagguuuuggagcucggcaccagaaagcgaggaccaagguugaaugugaaaggaauauucagaggaugaagcucauagucaacaaagugcugcuucauaggcuagguccaaaaauaaccugcuugccauagggagcaagaauggagguagcauuagcugcuguuuugagcaguguuucauguccugucaugucauuccagaaugguuuuuugguuuuguuuagagacagggucuugcucuguugaccaggccagagugcaguguggugugauuguagcucacagucaccucaaacuccugggcucaagugauccucccaucucaguuuccugaauagcuaggacuacagacacacaccauugcacuuggcuagugguuuuauuuuuaguauagacagugucucgguuuguugccuaggcuggucucaaacuccuggccugaagcaguuauccuaccuuggccuuccaaagcacuggaauuauaggcaugagcagccacaccuggucucauuccagaauaauuaaaauuauguuuaaggcagccgggugcaguggcucaugccuguaaucucaguacuuugggaggccgaggcggguggaucaugaggucaggaguucaagaccagccuggccaauauggugaaaccccgucucuacuaaaaauacaaaauaaaaauacaaaaauuagccggguaugguaauuagcgggugccuguaaucccagcuacuugggagucugaggcagagaauugcuugaacccgggagguggagguugcagugagccaagaucgcgccacugcacugcagccugggugacagagugagacuccaucucgaaaaaaaaaaaauuguguuuaaggcaauaucauuuaaaauuuuauuuugggagaauguugccuugguaaauugguaaauaacaguuguucugaaagguuucggaagaaugccuuucugcuaaauugaagaaauuaacauaauuuacucuucuguaaauagggggauggucugcauugugcucauuuaaucauuggaguucaaauuaaugauuugcugggguccuguggugaaucuugagugauuaagagggagaacucaguccuugguucagaaaaguuagcauuggaauggauccucaacaggcccugaagguaggaaguguucugauuuagagagcucuuccaaggcuugugauggaacccugcaacgguaaguuuuacgaguaucaguaacuggccgggugcaguggcucacaccuguaaucccagcacuuugggaggcugugguggguggaucaccuaagaucaggaguuggagaccagccuggccaacauggugaaaccccgucucuacuaaauaugcaaaaauuagccagccaugguggcaggcgccuguaaucccagcuacuagagaggcugaggcaggagaauugcuugaacccaggagguggagguugcagugagccgagaucgugcauugcacuccagccugggcaacaagagcaaaaaacugucucaaaaaaaaaaaaaaaaaaaaaaaaaagccaggcuugguggcucacgccuauaaucccagcacuuugggagccaaugugggcagaucauaaggucaggagaucgagaccaucuuggcuaacacugugaaaccccaucucuacuaaaaauaaaaaaaaaauuagccaggugugguggcgggcaccuguagucccagcuccuugggaggcugaagcaggagaauggcgugaaccugggaggcggagcuugcagugagccgagaucgugccacugcacuccagccugggcagcagagcugagauuccucaaaaaaaaaaaaaaagaaaaaaaaauaaucaauaacauagaauguggauauacauagcacauagauacguauagcaagucaggaaguuugccuagaaggaauaaauuaacucuuguuacuuggugagaucauggaagggaauguaauuuguuuuagguggugguaauugugaguuugaggcuggcccaggaaaugaguugucagauaugcugucauccucauuaaugguucagcuuauuucucagguuuauaguuguaugaggagaugcuaugccuaccccauuuagggaacuauuagguucaaaaucauaaaagcuaaagaagagugaaauacagugaaaaguauccuguucacacauaccccaugaucauccagauuucccuucccaggggcaguugauauuaucugugucuuauaugucuugagauaguuuauguguauagaaguaaauguaaauaucuacuacuuauuuccucuuuuaacacaaauuauaguaaauaauauacaauagucugcaucuuacuuuuuucacucucguaucuaauguuaaaaaagcuacgugguauuccaaugaaaggauguauuauauauauuuuuuagauauuucauuugaguuguuuuuuuuuuuuguuuugagacggagucucucucugucacccaggcuggagugcaauggcgcgaucuugacucacugcaaccuccaccucccugguucaagcaauuucccugccucaguccccucaguagcugggauuacaggcucaugccaccacaccuggcuaauuuuuuuuuguauuuuuaguagagacaggguuucaccauguuggcuagacuggucccaaacuccugaccucagggaauccuccugccugggccucccaaagugcugggauuacaggcgugagccaccacgccuggccuugaguuguuucuaagcuguugcuaauaaaacaaugcuagaggauuuaaaaaaauauguuaggguuuuauauugacaaguaaauauugucauaauagaaacuugcuauacuuauaauaauaauacaucuauagaacauguucauaaaugucuauuugagccuuccuguaagguaaguacaacauuuuaucacuucauaacuaguaaaguggcagaaguagagguagaaccaaggucuucugacuccuauuugaguaucugucuacuuuacccaaaauacauauacuguuguggggcuguagggaagugggggugggaaaauaagaggaaguagaccuagguggggcaagcuugagauagggauguaucugucauucuagaaauugggauccuguuugcuaggaguaaguggaacuggacaucagccuguuacagggacauaaaggcacuuaggcacuggcagagcacuaugguuugauugccaucuuggaguacaguaguaugguaagccaaagagugguaguucuggagaagcuggggacugucagagcucccuagaauagacugagagugaaacagcauucacgauuugcuaaggaggcugggcuacuaggaaggauaagguaggagcccaggaguucagggcugcagugaauuaugauugugccacugcauucuagccuuggcaacagagcaagacccugucucuuaaaaauauuggucaagaccauaaaacaagaacauaggccauagugaaaacauaaaauuuucuuagcagcugugguagcaaacauguuaaugguaaggagauaacuguaauguuagucaauuuuggcuuaagacugaggacugagaaacagccuucuuccuccggaggagcaguuaagucaucuuacaacugggaguagagagacaaggacgugugaagcugauucaugcuuucauuauauaguuaauacuauuuggaaaccuguguguaggucuggucaauagacuuccaucuuaauugcuguaugcuaagugccuccuauguucuguauacuucauauaauucuugcuagccuucaacagcuuuuuacaaaguaacuauuguuuuaccuaauuucuauugagaaaaaugagcuucacuuagguaacuuguccaaaguucuuuaccuuguaagugguagagcugagauuuauaaguaggucuauaugacuccagggcucuuguucuuuccacgauaccagguauuaggcaucaaaauuggacaguagaauucuaaucacagcuguacauaaccagaaaguaugaguauggaugaguguuagcauguaaccagacaacuugucuguuauggaugauuugggcugaaagaguagaaggaaugcuaaggaaaaugagcauuggagauguugagagcucgcaaacucaugaugaauguguauauaauuuaaguaaugcacuugcugugcauauguagagccuuaagauaaaauuuccaaugcucccuucccucauuagguuuuucuuucuaaaguccuucuauauugagauuauauagcugccacuaaagacuguagcugguaguagccaggaccuggaacuuuuuggcaagaggguguuaucuggaggauccaaguauacugagaucaacauaaucaugaauucuucucccacuguaaaguuugaggagguaagaaucuccuugacuuagcaaauuugggcuuauaaaugcuagguccaacuagacuuuacuggccucaaucccuuagcauuauccugcaaaauacugauguauacuuuuuggauaauaccuuugaucuacuuucagccaccauuguagggaauuguuaguaugagagguugacauuuugguuaaauaaucacuuggaaacugugacucagcauuagucacuggcuuucugcuggguuacauucucuugucucuugccuuaauugugguaagccucagccauuugauuacacaacuaccaaagaggaugaccuuagugauaacccauucacauuuucagauaguaaaaauauuagggacaaaaucuuucauauguauuagcgagugguauggguucgccucuggagaaauguuagcacauuuuccagguuugcccgaugauauuaaaagaugaauagcuaucuuagugaaaauagcuguuuacacuuuuaguuaguaguuuuuaaaaguggaaauguaacaauaugcuuuuuggacacagucauguuauuuuauuuuuauuuuuauuuuuauuuuuuuugagacggaguuuugcucuugugcaggcuggagugccguggcaugaucugggcucacugcaauuucugccucccugguucaagcgauucuccuaccucagccucgcugguagcugggauuacaggcacaugccaccaggccuggcuaauuuuuguauuuuuuguggagaugggguuuugccauguuggccaggcuggucucgaacuccugaccucuggugaucugcccaccuuggccucccaaagugcugggauuacaggugugagccaccacgccuggcuguggauauagucauuuuaguauuugagauuaaauauuaaaccucauuuggcgaacuuuaaaaccaucagugauuugaguuaauucuaccuguuuuaccuuauuuuucaccaguguguguuuccucacugccucauuauauugccacauuuaaucuuucauuaaaacaaacaaacaaacacaacucuuggcugggugugguggcucacaccuguaaucccgguacuuuggaaggcugaggugggaggauuccuugaguucuagaccagccuggucaacauagggagauucucucucuccugaaaaaaaaaaaaaaaaaaaaaaauuaaccaagcaugguggcacacaucuguagucccagcuacucaauaggcaaagugagaggauugcuugagccugggagguugaggcugcagugaacaugaucaaaccacugcauuccagccuggaggacagagcgagacccugucuuacaaaacaaaacaacaacucuuggaauuucucuuuuccccucccuucuucuuccccuucuuccuucuauuuauccuucuguuucaucuacaaauauuugagugucacuguguucuaggcacugugccagacauugggauucguugguaagcaagagagagaggcauggccucuguccuuaugagcuugcaguuuauccuaguguuacuuaucuagucugcccugccuucaagguucaguggaagcccgaucuucauguaguccuuugacuucuuuggcccuugcaaaccuaucccuuugaccuaugcuacuuuaaaucugauucauacaauuuagcauuuauugauauaauuucuuauacugugggcuaauuguuuaaauaucuuguuuuacuggcuagaguauaguuccuuaaggacagagacugucauguuauuuuuuuuuuuuuugcaauacugagcccaaagguuuugauuucagucugcccugcugaauguugaaguuacuaguagcucuugggacuuagaaguagugaugagauaaugccuugcuuuuuaguuuauuuucuauuuuguuuuauuuuauguuucuuuuuugaaaugguauugggcuggccgcaguggcucacgcuuguaaucucagcacuuugggaggccgacguggguggaucaccuggccaacauggugaaaccccgucucuacuaaaaagacaaaaaguuagccaggugugguggcgggggccuguaaucccagcuacuagggaggcugagacaggagaauugcucgaacccgggaggcggagguuguggugagcugagaucgcaccauuguacuccagugugggcaacacgagugaaacuucgucacaaaaaaaaaaaaaaaaagaaaaagggccgggcgcaguggcucacaccuguaaccccagcacuuuggaaggcagaggcggguggaucaccugaggucaggaguucgagaccagccuggccaacauggcgaaacccugucucuacuaaaaauacaaaaauuagcucgugugauggcgggcgccugucaucccaacuacugaggaggcugaggcaggagaaucucuugaacccaggagauggagguugcagugagccgagaucgugccauugcacuccagccugggcgacaagagugaaacucugucucaaaaaagaaaaaaaaaaaaagguauuguucagucauccaggcuggaguaaaguggcacaaucauggcucacugcagccuugaauuacugggcucaagugaucuucuuaucuuagcuuccugaguagcugggauuacaggcaguagcgaccaugccugguagauuaucccuuuaaaaaaauuccuucuaguuguuugccuaauauuuguuaucugcuucuguuaaucugugcuaaaaaugaguggaaaugaccuuacugauucacuauuugcauuuauauuguuuucuagugaagggguuguauuugagguuaccauugcauagcuucucaucuaguucuccuugugacauuauaaugagggaugcauuucaugacuaaggaauagagcuaagcuaauguugaucucuuaguagcauguuguaaucuuuugggcuuaaaugcccuaucacuaugccuuaguucaugaaguguuaaaaguaacucaccuaaaaugggaagcggagaauguaauaacuuaaagaucaaaaucgaauuucucauaaagauuuuuagaaauagaaaauaaucuuuuaaugggccaacauuauuuacauuuuaugauguuagagaucaaaacucuuccugaguaguaaaugaauguggcgacuuaaaugugaaggagggaggcugugugauugacuuaaauguuuuucugaaugugcuaaaagcucugagguaauggcaaacuucaauauuggaaauagaagggauauauucuuuauuaagaaggagaauagaggguacugggggaaggaaaugcucuuuugccuacacuuaaaaauuaagaagguaaguauaugaaauugaagggguaaaagaccacagagcaggagacaaggaaaccguuauuucccucugaaauaauucuagauggugauuugaacaaaccaguugcuaaaaaacuuauaugauaauuggggcaguuugaacauugacuggguaucugauguuaaggaauuauucucuucagauggggcaguaguaugguggucauauugcagacaaaaaguacuuaccuuuuagaaauauauacugaaauacauauggaugacggaaugugucugagauuugcugggggaaaggaagaaguggucagcaguauagauaaaauggccauguauuuauuuauaacugucuaagcuggcugauggguacaagaggcacauuguauuauuucuuucuacuuauauauauguuugaaaauuuccauaaaauaacaacaacaaacccccccccccccaaaaaaaaaucuuaacaacuaccagaacuggcagaauugucaagccuaccccuuuaucuucuuucucucuaauuuuagaugggcaaguaaagccauagauucaugcugauguuuccaaaugggaaugcaguuuagauuuccauccccuuaaguuucaaucuaucuguagugcagcaucacugagagaacaagcccugcuauuuucccagcagugugguaaguuacaacaggguaggagucauacuacccaucuuuaaggcucuuccuccuuauaggugaagaaauaagauuuaaaaagcaaaacauaauuagagaauaggaaaaugugguuuaaaauuauaugucauauuuuauaguucuggccaaacauaagaaauucuagagaaaggaaagaacauuuuggguuaggaauaaccaaaggcuuuucuuuugaaacagggucucacucugucacccaguuuggagugcaguggugcauuuauggcucacuguggccucaaccgcuugggcucgcugcagccucagccuccugggcucagcugccugaguagcugggacuacaggcaugcgccaccuguccagcuaauuuuuguauuacuuuagagauagggucucgcuauauugcccaggcugguuucaaacuccugggcucaagugacccuccuacuuuggccucgcaaagugcuagguuuacaggcaugagccaucaugccagaccacaaagacauuuuuuauuaggccaguggauguucggaucaucuuuaaacaacauugaaaguugaauugcugacaguaauauggggauagcauuccagggagagaaaauacuauguuugguggagaauagaugaauuuggauuggggaacagaagauauuuuugauggguaggauggggucauuucauaaaggacaugaauuuuuaguugagacauuugggcuugaucuuauagaccuuaaggagccauuuuugggguguggggaaccauuuuugacccuuaagcuaccuaaguauuuauuaauuugguuugaugauaauauuguguauucuuaguugcaggcuuuugcauagagaguauaacuugacuuuguagccuuuacauucuuuuuaacauaaauuuguuauuuccacaguguuccaaaaguuauucagggaccagaauuaauauuuauuuuuuacaaauuauuuauuuauuuauuuuugagacagggucuuguucuguugcccaggcuggagugcaguggcgcgaucucggcucacugcagccuccgccucccggguugaagcgauucugccucaaccuccccaguagcuuggacuacaggugccugucaccaugcccagcuaauuuuuguauuuuuaguagagaugggguuucaccauguuggccuggcugguuucgaacuccugaccucaagugauccucccgccuuggccucucaaagugcugggauuacaggcaugagccaccgugccuggccacauuuugauauuuuuaaucaacuuuauugaggcauaauuuacauucaauaagauugaaccauuuuaaguuuacaauuugaauuuugacaaauauacacacccauuuaauaaccauacaaucaagauacagaacaauucagucucgcagaaaguuacaguagcacuguuugcauucauucucauccuccuccacuuccagaaaaccacugauuugcugucaccauagguuaguuuugcuuuuucuggaauuucauauaaauggccucaucuaggauguacucuucuuucaucagcauucuuuaagauucauuuauuguuguuuguaucagaguuuguuguuuuuuauugcugagugguaaucugaguaguguuacauuguauggauguaacaagauuuguuuauucauucaccuauugaugaacauuuggauugugucugguuuucuugcuuuuaugaauaaggcuguuaugaacuucauguacagcuuugcguagauguauguuuucauuucucuuagguaaauaccuuacaguggaauggcugggucauaugguugguagguuuauguuuaacuuuuaaagaaacugccaaauugucuuccaaaguugccguaccauuuuauauucucuuuagcaauauaugagauaggagaguucuaguugcuuuaaauccuuaccauugcuaaaaugauauaucuuaaauuuuaguuguuccaauaguugugucaugguaucuugugguuuuaauuuacauuucccuaaugacuaaugauauugaguaucuuuuuauguacuuauuuucaugcuguguaucuucuuuggugaagcauuuguucagaucuuuugcucauuaaaagaaaugggcugaccgggcacaguggcucaugcaugccuguaaucccagcacuuugggaggccaaagugggaggaccacuugaagccaggaguucgagaccacccugggcaacaagcgacacucugucucuacaaaaaacuuaagaauuagcugggugcuuggcaugugccuuuagucccagcuauucaggaguuuaagguggggggaucacuugagccuagcuguuuaaggcugcagugagcugugauggugccauugcacuccaacuugagugacagagcaagacccugucuuuccaaaaaaaaaaaaaaaaggauuguuucuuuauaguugaauauugagaauucuuuauauauccuggauacaaguccuguguuauauaaaugcuuuacgcuuugcaaagauuuuuuuuuuuuccgauuccauggcuuauuuuuucauucuuucagcagugucuuuugaagagcaagaguuuuuagaggccaggugcgguggcucacgccuguaaucccaguacuuugggaggccgaguuggguggaucacuuaaggucaggaguuugagaccagccugaccaacauggugaaaccucaucucuaugaaaauacaaaaauuagccagacaugguggcgugugccuguaaucccagcuacucaggaggcugaggcaggagaaucacuugaauccggaggcggagguugcagugagcugaggucacaccacugcacuccagccugggugacagagcaaaacuccaucucaaaaaaaaaaaaaagaagaaaagaaaagaaaaauaaaguauucuagugaagaccggauuccuuggcauaagacaccaggaauuuuagauugauaggaguaaaaauaaauaaagaaauauuggcucagggaauaaacuucauuaaaaucaauuuaugggccagguuuggcggcucacaccuguaauugugcagcacuuugggagacugaggugggcagaucacuuggggccaggaguucgagaccagccuggccaacagagugaagcccugucucuacugaaaauacaaaaauuagccaggugugguggugcaugccuguaauaccagcuacuaggguggcugaggcagaugaauugcuugaauccuggagguagugguugcagugagcugagaucgugccacuacacuccaacagugugagacucugugucaaaaaaaaaaaaaaaucaauuuaugaaaguuauuuuuaaauuugaagauauugaagauacuaaauuuguguuuaaaaagcauuuauuuugaucaacuccgcuguauagaauauuuugucuuaagucacuguaaaguuuccaugcccucaaaugaaauacagugccagguuuaacauucguuuucauggauuguuuucaaaaguuauugaguugucugauuugcuguaaaaaaaaugaaaaauucauuucuuuuauuaacaugauguauuuacugugauuauucuaauagacuaauggacuuuuaauuuuacuguuuaaaauaguuuauaauuaaaauuuaauauccagucuucacuuguucuuucauuuuuuaaaauaauaaaguaguuugggguuuaucagaacaagggaagaaaccaagcuacgucucauuuuauguuggguaagaaucacuagagacgaaauuauuauuauuauuauuguuauuauuauuauuauuauuauuuuugagauggagucucccugugucacccaggcuggagugcaguggugcaaucucagcucgcugcaaccucugccugcuggguucaagcaguucuucugccucagccucccgaguagcugggacuacaggcgugugccaccuugcccagcuaauuuuuuguauuuuuaguggagaugggguuucaccaugcugaccgggcugguuuugaacuccugaccucgugaucugcccaccucggcuucccaaagugcugggauuacaggcgugagccaccgccuggccgacaaaguuacuuucuaugggaucaauuccugaguuuuaucuaacacgagaauuuuagcaauuaaaagucaagugcaguucagauauauuaguuuagguaauauuuuuaguguuugaagagagcucaauuuguaagccauuuagcuacuaauuacccugccuuugcuguagaaagaacuuaaaugaaagaccuguuuuaagaugccuuuuuaaaaagcagccguuguagguauaagaguugaaaaaucaagaucuaggcagcaguggagaauuaugaagucugauaagauaauaugcuaaaauuguauuguuaauucugauuugugacagugcuuaucaguagaaaagaaaugugaucugugguuaaagacugaacugccacuaaauguaaaauguuuuuuagaugaguuggaagaaugcugaaccagucuuuauugcccaagauggcuuugagucagcaaucucaaagaauaaagaaaaaggaguuaagagugagaggcaauaaguaauaugcuguuuucauuuaagaugucuugaagagauaauuaaaaaguuguagggguauaggaauugugauguuucucugguguuaaugaagucuacuauaaauuagauaauacaggcacucuaaauuauuguuuuuccuuuuuuaaauucuuggcaguuacugacaaauuauacucaggaucaaguuuaagucucaguacaugaaugacccugacauugaaaacccugaaggauguugaccuuaguuuugaccuggcuuuauccugagcagccucugugaauucuuaaugcugugcucuuuaacagggguacuuuuuccagauguuuuugauacuguauucauuaacauauaauaaaguuaucagugucccugaaggcuaauuuuuuuuuucugacugaauaugagauauggagcgugcaauuuguacuuauugguauuaacauuaccaacaagguuugucuuuuucuuauaagauggggaaucuuaagaaacuucaggccaggcgugguggcucaugccuguaauccuagcuuugggaagcugaaguggggcgaaucacuugagaucaggaguucgagaacagccuggccaaggugaaaccccgucucuacuaaaaauacaaaaaauuagccaggcguagugguggaugccuguaauuccagcuacuugggaggcugaggcccgggagacagagguugcagugagccgagaucaugccauuacacuccagccugggcaacagggugagauuccaucuaaaaaaaaaaaaaaaaaagaaacuucauuaagaaguuaaagccuggguaugcucuccuugauaauuucuuuuuacucacaucuuuauugguaaaucaggccagaaggauuauuuaccuuuucagaaagggaaacuagguucuacgguuugguuacagauagccuggcagcugacuuuacauugggcagaggagacugccguacuuagugguucugagaaaccaagagaguauugccugcuacagcuaugagaaaagguauugaaucuucccccuccuuugugggggaauuccaaucucacuaauuuaugguuucaguguaguuauggucauagcuucugagacguggguacucauugaagcuaacaguuuuagagaaaggggaggguguuuaauuccaauaacugguaguuuauaucacuuuaauaauuuagacccaaugauaugaagauuaguuaguauaaggcagauauacauguaauacauucuuuuaaauauuguacaaggaguaagaaaccccuuuaaguagucauguaauucauuauagcagcugaacauuucuaagugcaacauuauaggaaaccaguaaagcugauuucugauuuaucugcagcaaaagaauuuaauauuccaacuucagcaaaaggcaauuaaaaacaaacuuaaaucacauugugugcuuuuaauacguauguuuuuuuccaugcugucugauguauuuuaguucuuagucauuuacuuccauuaguuuccaaauugguugagggaauuaaauugguagccaaguuaccuauacaagauuuuccuacuguguaugugaaccacucuuucugggaaaauccucccguuggcacuuuucuugaaggcaugcacuuuuuccacacuuagugauuuggggacugaagccugcauuuagccuguauuuagucagaggugacaaauggcuaaauuuuuuuuuuccaguuuagagauugagaaaugauucagaauugaaacuaaagugaauuuggacuuacuguauuucuuugcaauuacuuuuaaacaauugcugucuguuacuauuaggcauauuuuggaccuauggguuccauuuugggccgauauuugguguuauguuguuaaauuucuugccuggcuuagaugguucauuguugaaacuaaacuggaacuagguuugaucagagggccaauggaaaugcacguuguggcccauuuggggaggacaaaauuugacauauuuuuacuuuaagaauucuuaggaaaauuuggauaacgugagaauauauuuccaaaggguuaaguaauuuucgagggaaaaucagaaagcuuguaauuccuacugaaaauauuagccugcugaaauauuagccuauuuccuacugaaaauauaacauuagcaggccgggcacaguggaguucacgccuggcuaauuuuuguauuuuuaguagagaugggguuucaccauguuggccaggcuggucuugaacuccugaccucaaaugaucugccuaccuacgccucccaaagugcugggauuacaggcgugaaccacugugccuggcuugacuuuuuuauuuaaaaaaaaaaaaucuauacccaauugcccuaucaguuuaucauuuacucacuuauuugaaacggucauauuaacauacacucuuuauuuauuuaugugccuauacuuuguuuuaauuacuguaucuuuagaauauguuucaaaauuucauuaacuauuauaauugauucucuuuuuuuguaacguaucaucagcaaauaauaauuuggacucuucuaauauuucugcuuauuuauugacauuuucaaagaauagcuuaugauugauaauaaucauaccagcgaauacagugcuuuucaacuuaaauaugcacagcaauuaccugaggaucuuauuaaaaugaagacucaguagggcuggaguggccugagagucugcauuuugacaagcucccagguaauguugacuuauggguucauagaccuuauguugaguuacagggaacuaagauuuauugaguacuuaauuuguucuggucagugcuuuuacaucugugaacucguuuaaucuuuaaaacuccaugaugauuauuauccccaauuugccagugaagaaacugacacuuagagaaguuuauaacuuacccaaagugacgcaaccauuaaguggaagagccagacugagcccaagcagaguuugcacucugaaccucucgaauauauugcuuuaccacaugcguguucgcucacacacacacacaacagacauuaucuucucuugugugacucaaaugguaauaccuuaaaauuuuuuuuuuaaugaauaggcuuuauuuuaucuauuuuuugagauggggucuugcucuguugcccaggagugcagugguaugaucgcagcuuaccacagcccugaacuucugggcucaagccaucuuccugccucagccuccugaguagcugggacuaccggugugugccaccaugcccaacuaauuuuuaauuuuugauagagacgaggucuuacuguguuagcccugccuggucucaaacuccuggccucaagcgaucccuucaccucagccuccaaaaguucugauauuacaggugugagccacagcaucuggccaggcuuuauguugagaaguuuagaguuuacagaaaaguugagcagaaaguacggagaaaucccacauaucccauuaucucugccuguccucacgauuuucccugauauuaacaucuugcauuagugugguacauuugcuacaauugaugagcaauauugguacauuaacuaaaauucauaguuuacauuagaauccauaguuuguguugcacauuuguaagaguuuucacaaauuuguaauguugcauauccauuauuacaguaucauacagaauaauuucacuacccuaagaauucccugugcuguaccuauucaucccuuccucuccucagucccuggcaaucacugauuuuuuuuuuuuuuuuugagauggaguuuugcucuugucauccaggcuggagugcaauggcaugcucucggcucacugcaaacucugccucucggguucaagcgauucuccucccucagccucccgaguagcugggauuacaggcaugcgccaccacgccuggcuaauuuuuauauuuuuaguagagaugggguuucaccauguuggccagguuggucucgaacuccugaucucaggugauccgccugccucggccucucaaagugcugggauuacaggcaugagccaccucgccuggccaaucacugaucuuuuuacugucuccauaguuuugauguuaccagaauggcauuauugcauguagccuuuucagauugacuuuuuuucacuuaguaaagugcauuuagguuuccuccaaguuuuuucaugguuugauagcucauuguuuuuagcacuaauauuccauugucuggauuuccacuguuuauuuacccauucaccuauuaaggaacuuguugguugcuuucaacuuuuuucaacuaugaauaaagcugcuauaaacaucugucugcagguuuuguguggauauauguuuucagcucauuuggcuaaauaccaaagacagaacugcgugaucauauaguaagagaauguuuaguuuucuagaaacugccaaacugucuuacaaaguggcuguacuauuuugcuuucccaccagcaguaaaugagaguuccuguuguucuauauccuuaccagcauuugauguugucacugcuuugaauuuuagccauucuaauagguauguggugucucguuguuguuuuaauuugcaguagccuaguaacauaugauguuuagcaucuuuucauacacuauuugccaucuguauauaucggugagguaucugaucauaucuuuugcccauuuuaaaauugggauguuuguuuucuuauuguugaguuuuaagaguucuuuguauauuuuggauaccagugcuucaccagauagguauuuugcaaagauuuucuucuagccuguggcuuguuuaugccuuuaguuuuuuaccauuaaauauguugcuugcugucugguugugacaaauaaucaucaaguuaagaaagcuucuuucuuugucucucuaagagcuuuugucaggaauggcuauucagggaaguccuugaaaauuauuuggcuaaacaaauagauuaagcuuuguuuuuagcaagacauccuguuuuauuccauauaauuaaaaacacauucuuuauagugugauauuaagacuguaacugagacuuuaauuccuauuccuucuaaaucauuuucucuuacucugugauuuuguaugccuuuaauguccauguugauuacuuguccagcaucuuaaucucaucugacuuggucuuucuucucccagcuaucuguucuuccacuucucuguagcaauuuauuucuguggccaaacguccacuucuggaauuacaaaucuguaaauuuuucucuuugaacacaauuuccugucuuuucaguucuuccauuugcugaguuuauuuucucauuucacugaggccgccagccccuuaaaucuccauugucucccaauuugugacauucuuccuggcaucacuuuaucccauauggaugccauaauuggucacuuucaaugagucaucaguauccgcaguucuccugcaucuuuguucuucuuucccacaugccaugcagaucuccagcuguggauuaacaguacugcccuuuuucuguguucccgcucuagggccugaagaaaugauuucaucauauuaauuuguucuuuugcuaauccauggguuuuagccucaucugugcuuauuauucucuuuaguaguuuucucacuuguuuggaguugauuucauuucuccuucaccagaaugacaguucuuucuaaaucuuuccacauuuuccuuugguucgugucaccuuccuccauugcagcugauucuacacuucagcagagugaccuuuaaaaagagagaaaacaacaaaucuauuauguuauuuccuguacaauacuguucauuauaaagauggagguaauuuuuuuuuuuuuuuuugagauggagucucgcucuguugcccgggcuggagugcaguggugugaucucggcucacugcagcuuccgccuccuggguucaagcgauucuccugccucagccuccugaguagcugggauuacaggugcaugccaccaugccucgcuacuuucuguauuuuuagcagagaugggguuucaccauguuggucaggcuggucuugaacuccugaccucaugaucugccugccucagccugccaaagugcugggauuacaggugugagccacugcaccuggccagagguaaaauucuuaaguuuaacaggaucuuucugguuuucuagccucaucucuguccucuuagcgccuuagcuucacuggcccuuuuucagauccuucacaugccaagcucauucuuagcacagggcuuuguauaugcucuuuucucugcuggacaccuuuuuucuuggcauguuuaauuuguauuuaucuuaaggacuuagcuuauguguuccuuucucaagaaaguuuucccugaccuuccauuugccuaaagguagauuagauucccucugaaauuauuaauaguaaugaugguaacaacaauaauagcagcaaccuuugaguguuuaugaguugcagagacuguucuuagcacuuacacauaggaaguuuuuugguuuucauagcaacccuaugaguuguauagguggguaaauaaguaggaccuagaauuaucugcaucuuauagaugaggaaacugaagugaggaauguuaagucacuuguccaaagucacacagccauuugguagcagaguuggaauuugaacccgggcagaccccagugcccacguucuaaacugcugugcucuacuguaauggugaguauaacuguguaauguuuuuuguuaaugccuaccuuuguugguaggcucuaagcuccucgaggucagaaaucauaccugucugguuaauuuccauggccuaggacggagccuggcauggaguagucugugaccgaguacuuguuccuauugaaugaaucacagcuugccagucuacuaaauugaggaaauagaggguuucagugugauccuuuucacuuuuccuccccacugcuuccaaauauuaaacucccuugguuaaaagaauaggugccuguacuuauuucaaaaucuaaccccucuaccuguuugccuuguauauucuaggaguaauuuauguacuucguaagaaaaauuagugcagauguacauaaaguaaagguauacgucuuccauuuuuuccuccuuuaacguuuuauacuuccaggugucaacugcuaguaguuaaaucuucuucuguacauguacacauuuuguggacacuuaaaauacacaaggguaauguauguaguauuaucuaaguuuuuuaaaaauuuaauuuugauauugaacgauaguuucacaagaugucuccauugagggaaacaagguaaaggguacaggagaucucuguuguuucuuacaacugccugugacucuacaauuaucucuaaagaaaugguuaauuaaaaaauaaacuauagaaauauuuucaugucagcguauugaccuguuucuuuuaaauggcuauguaaaauguuauuauauagauguguauuacuuuauuucacguuuccccuauugauggacuuuuaaguuccuuccauuuuucauuuucaccaauauugccaaagguggaccauccuugaauuuguagguauauccuugguugguauauaugcacagccaaguuuuagaagaggagaucaaaagaugggcauauuugaaauguugguaagaguuggccagaccauccuccagacaaguuuauacuuucguuagcaggugagauagaagcucuguguguucaccugcacuguccugaucccauucugccacuucuucuuggggacuuuauaucuauaucuauaucuauaucuauaucuauaucuauaucuauaucuauaucuauaucuaucuauauauuuuuauuauacuuuaaguucuagggcacaugugcacaaugugcagguuuguuacauauguauacaugugccauguuggugugcugcacucauuaacucaucauuuacauaagguauaucuccuaaugcuaucccuccccacucccuccaccucacaacaggccccagugugugauguuccccuuccuguguccgaguguucucauuguucaguucccaccuaugagugagaacaugcgguguuugauuuuuugucccugcgauaguuugcugagaaugaugguuuccaguuucauccaugucccuacaaaggacaugaacucauccuuuuuuauggcuaaauaguauuccaugguguauaugugccacauuuucuuaauccagggacuuuguuuuauuaacuaauccuuuuccauuuaauauaucuacuucccuguugguucucuucugucuccucauccuguagcacauccuccaaacugauagagcuuugguugcugucaguucuuuugugcugcuauaggagaauaccugacacuggguaauuuauaaauaacagaauuuuauuuucucauaguucuggaggcugggagggcacuggcagguucauugauggggauuuggucucugcuucuuagacgaugccuugaaugcuguguccucacauggcagaaggcagaagggcaaaaagggaguaacucccuccaucaagcccauuuuuaagggcaccuaauugcauucaugaacggaggaacccucaugacuuaaugaugucuuaaaggcccgacuucuuaauaccaucacguuggcaacaucugacuuuuagaggcggagacauucaaacuguggcccuagccaaguccuuugugugcuuuuacuuaucuuuacaaccauccuaugagauagugccuguuucucugccuacuuguuaagcgauuauauucuucuggauuuuguccuuggcuccucuauccaacccaccuguagccccaccuucucuucuguucccucauccaaaccagagagaccaggauuugaaucuggcuccauuauuuucucccuaagagacacggaaugauuuacuuugucucuauguuucuguuucuuucucuguaaguaagaguggggagacuagagcuaccuaucucaggauuguguggaguaaaugaauaauguguguaaaacauuuaaaauagugucucauguacacuaagugcuuaauaaaugcuaauaauaggaauaguaacaacaguauaguuacauuguuauuauaaaucuguaucugugguacucuuagcuuaaguucguacaaaaauauugagcugccuguuagaaaucuacauuuggaugccuccccagauaucuuaaacucaguuuaucuaaagucagagucuuucuguggcuucagugcuuagugacuguguccgugaauaaacuacuuauuuucuuuaagccuccauuucuccauuuaugaaagggugauaaugaacuuauuuuaucaauauuaaaugagauaauucuuguaaaaguauuuagcauagugcugguauauacuaauaucuuaauaaauauuaguugcuauuauuauuauuccuuuuaaaugcugauccccuuuuuguccuguucugcccagaaaaagagccucaggauagcuuugccugucugccugucuuccuuauccuucauaugcaaccagucagcaaguacuguuauuuuguauuuucauuuuaaacaucuuaauuuuuauuuauuuuaaaauuauuuauagagauggggucucacuauguugucuaagcuggucuugaauucuugggcuccagugauccucccaccucugccaaagugcugggauuacaggugugaaccaccacaccuggccuaucaaguacuguugauugugcuuccgaaacaugugcuugcauccaaccacuccuuaucauuucuugacacaauuauugugguaaucuccuaauugcucuccuggccucuuggccaucuuguaccuuucauccugaguuaucuuuauaguagguagaucugcucauaucacucagcagaaaggccucugaugggucucucuuaccugaaauauaaagccuccaaggcccacuacaccacagucaucuuuagagccuccccucuuguucugggacccauggguccuacaguauaugcagacuacugacuguucugugacugcacccuguacucuaaaucucauaccuuugucccugaccugcuguugcuguaccugccuucuuuuugcuuagaggguuguccccucaagcacucccugcuaauaagcacucagccuuccaccccaaacaucuagucugucuggugaauuccuggugauucuucaguggucugucucaaauauaucuucuacgcucuuuucucuuuagucuuaacugccauccaaggcaacauuaguuagucccucauuauaagaggcaauauaagcuggugagagguauauacccacaguccuagcuacuugggagucugaagcaggaggauugcuugaggccagccugggcagcauagcaagaccuugucucuuugaaaaaaauagaaagaaaaugcugggugugguggcucacaucuguaaucccagcacuuuggaaggccaaguagggaggauugcuugagcucaggaguucgagaccagccugggcaauacagcaagaccccaucucuacaaaaacuaaaaaaauuagcugggcaugguggcacaugccugugguuucagcuacucuggaugcugagggagaaggaucacuugagcccaggaguuugaggcugcagugagccaugauugugcuccagccugggugacagaguaagaccuugucucaguggaggggguagggugggaggggggaaagaggcaauauagugguaaguuaaaaucccugaguuuggagccagacugccuuuguuauuaagguaguuguauauaacugggaugaaacuguuuaacuuuuuugugucucaguuuucucauuuauaacaaaugaguaauauuagucuugcugugaggguuaagugaauuaauguagggaaaaugcauugaaagggcuugcauauuacuaaguacuucauaaauauagcuauuauuauuauucucaaagcauuucuuacauacuuaccuauaauagcauuugccacuuuacuuuuuuuuuuuuuuuccaagacagagucuugcucuguugcccaggcuggaguguaguggcaugaucuaggcucacugugaccuccgccuccuggguucaagcaauucuccugcuucagccuccugaguagcugggauuauagguguaugccacuaugcccagcuaauuuuuguauuuuuaguagagacaggguuuuaccguguuggccaggcuggucuugaacuccugaccuugugauccacccaccucggccucccaaagugcugggguuacaggcaugagccaccgcgcccggccugcaguuacuuuuuuguguauauuucccaauagacuguggcuuuuuugaaggugggcuauuuuaaucaucuuugugucaucaguauguaguacacagugggacccaguaaacaaucagaugugcuguuuguguagcccagaauaaagugccagguccuccugcauugcagcagucagcagcaugcaucuggaaaguauugcuuucugaaacuacggcauuagagccacaaagcuguuugggauuggaccuuagcaagcucuucaaccagaaauuugcuauuacaaugaagcuuccuaucugcaauagguagauuguaacugacagcauguagucauuggaaggagguuaaucccagagcauaagaggacuucugauuuauuuuugcuuaaagggauacaauccaaggccacaaaggcugcuauaagacuuuuguuuuguuggggauaauaaagagagcuguuucugccuuuuccacuuucuucuuauaaaccugcugaagauugaaauguuaaaaugugauucagagaagagauuucuuuauuguaaacaugauagagagcucagaaugaaugccggagauagacucuuuauagaggauuucaggguauuaaacucuuaagccccuuauggucagguuuuacugccaacccuuaacaccccaccaugccugggcuacugcaauaguaacuggucuuucuaccuuuagguucgcugcagucucuccugccuacugcuaugauauuaauauuuauaaagccuuacuuugacuuuucucaugcauuauaaaaaauccucgcaaaauaccccaucauauacaaggaaaguuccaaguuuuagcuugucauucuggacuuguauuaggauucuccagagagagagagagagauuucuuuccuuucuuuuuuucucuuuuuuuuucccaggguuucacucuuguugcccagucgaguccaguggcacuaucuugcaaacugcaacuuccgccuuccgguuucaagcaauucuccugccucagccuccugaguagcugggauuacaggcgccugccaccacgaccggcuaauuuuugcauuuuuauuagagacgggauuucaccauguuggccaggcugaucucaaacuccugaccucgugauccaccugccucagccuuccaaagugcugggauuacaggcaugagccaccacgcccggccuggauagauggauuucuguaauaaaccucuauaggccaggcguuguagcucaugccuguaaucccagcguuuugggaggcugaggcgggcagaucaccugaggucaggaguuugagaccaggucggccaacauguugaaaccccaucucuauuaaaaauacaaaaauuagccgggcaugguggugugcacuuguaaaucccagcuauuuggaaggcugaggcagacaaucacuugaacccaggagguggagguugcagugagcugagauugcgccauugcacuccagccugggugacugagggagacucggucucaaaaaacaaaaaacaaggaaaaaaaccccaaaaccuucauaauaaguuuccauaucuauaucuauagauauagaagagguuuauuuuauauauauaauagauacauagauagguauaagaggagguuuauuauggaaguuggcucaugugauucaugugaucauggaggccgagaaauccuaugauaggccaugugcaaccuggagaaccaggaaagcuggugguguaauuaaguuggagucugagguccugagaaccaggggaaucaaggcugaaggccugggaauugggaagggguggugugcugguguaaguccuggaguccaaagacccaagaaccaggagcuuugauguccaagagugggagaagauggauaucccagcucaagaagaaagagugaauuugcucuuccucugccguuugcucucucuggguggaaaaggguaaacagauuaugacgcccacccucauuggugagugugggucuucuuuauuuaguuuacugauucaaaugcuaaucucuugcagaaauacccucagagacccaccuagaaauguuuuaucagcugucugggccauuccuuagcuuagucaacuuggcacauaaaauuaaccaucacaggacucuucugcagucugacucugguuaccuuuucuaccuuaucuuccacuauauccuagaaugagcuguguagcuuaccuggccuaguugugaguccuauaaugugaauugcauuuuauguuuguaucuacccagaacauuuuaccuuuugaaauuuugccucuccuuuaagauccauuaaaaaaaaacuauuuauuuauuuaucuguuuauuuauuuauuuaauuuauuuuuuuugagaugaagucucacucuuguugcccaggcuggagugcaguggugugaucucggcucacugcaaccucugccucccagguucaagcgauucuccugccucaagccuccugaguagcugggauuacaggcgugugccaccacgccuggcuaauuuuuguauuuuuaguggaaaugggguuucacccuguuggccaggcuggucucgaacuccugaccucaagugaucugcccgccucugccucccaaaguacugggauuacaggcaugagccaccacacccagcuuauuuugaaauaauuauagaaucauaggaaauuacaaaauuaguacaucgaguccuguauacccuucccccaacuuucaccaauggugauaucuuuuugugugugugugugugugugauggagucuugaucuugucgcccaggcuguugugcaauggcgcgaucucagcucacugcaacuuccgucucccagguucaagcgauucuccugccucagccucuuaaguagcugggauuauaggugccugcuaccaugcccggcuuauuuuuguacuuuugaagagacaagguuuugccauguuggccaggcuggucucaaacccugaccucaggugauccgccugccuuggccucccagagcauugggauuacaggcgugagccacugugcccggcugcuaucuuauauaauuauacuauaauauaagauccuauuuuuuuuuuaagagacagguuuucgcucagacgcccaggcuggagugcagugcugugaugcuagcucacuauaaacuugaacucugggcucaagugauccucaggaggaggauccuagcuccuggguagcuaggacuacagucacgugccacuaugccuggcuaauuuuaaaauuuguauagagaugauaucucgguuuguugcccaggcuggucucaaacuccuggcuucaagugauuccuccacuucagcuuccaaaaauguugggacuaggugugagccauugcaccuagacugauccauuuuaaaacucuauuuugaauaaaauuuucagggguaaaaaagguuuuuuucuuuuccuuuucuuccuugcuucuuucuuucuuuuuuuuugagauggagccuugcugugucaccuaggcugguaugcaguggcgcgaucucggcuuacugcaaucucugccuuccagguucaagccauucucaugccucagccucccaaguagcugggauuauaggcaugcaccaugaugcuuggguaauuuuuguauuuuuaguagagaugguguuucacuguguuggccaggcuggucucgaacuccugaccuuaagugaucucccggccuuggccuccuaaagugcugggauuacagucaugagccacugcguccagauggaaaguaucuuuuuaaacuuuauaucccucccuagaauuuauccccuaauauaugguguuuauggaggugguuggaaucaacuacuuuuuauaaauauauuauuaaagaguugacaaccccuaaaaaucuuuuagaugcuagacaaaaaaacugagagaaaucaugaaguauuuuuuuaaaaaauuuuuugagauggagucucacuccagugacaacccagguuggagugcaguggcacgaucucagcucacugcaaccucugccucccagguucaagcaauucuccugccucagccuccugaguagccgggauuacaagcgugcgccaccacgcccagcuaauuuuuguauuuuuagcagagacgggguuucaccauguuggucaggguggucucgaacuccugaccucaugauccacaugccucagcuucccuaagugcugggauuacaggugugagccaccaugccuggcuagucaugaaguauuuuaaaggacguggguucugacacucuuaaauucaauaggccaaaguuccuggcauuuuuuucuuggauauguaccgcauagaccuuucuuaguagauacugggagaaagaaguugguuuaauaaugaauuaaugggaaaguuuuuuuuuugagacggaguuucgcucuuauugcccaggcuggagugcaauggcccgaucucugcuuacugcaaccuccgccucuaggguucaggugauucuccugccucggccucccgaguagcugggauuacaggcaugcaccgccaagcccggcuaauuuuguauuuuuagcagagaugggguuucuccauguuggucaggcuggucucgaacucccaaccgcaggugaucggcccaccucggcuucccaaagugcugggauuacaggcgugagccaccgcguccagccuggaaaguuuuaauugaccuuaugucuguauaauuaaauguauuucauuaacuuuuuaaagguaaauaaaucugggguuucaucuaagugucaaaaauaugauuuucaccaauggccuacuuauuuuugccauuauuugcauaaauagcuuucugguuuuucucaaguuaaccuguaugcuugugaugugaaagucauaguauguauaaaaaauaguaccaagaugaaguauagauggucauucugaaccauuauuccuuagcagagugaacuauauuuaagguuuuagaaauaaaucguauuuccaugucugaauaagaccuuagucuuauuuaaauaaauguaggggagauggagagaaagaauaagauuugccuaagaauacuaauauuaagaugaauggcagguaggacacacugaggcugucaggcauuguucucaguguuuuacauucaccaucuugcuucauccucacaacagacuuuaucauuugauuagaaaaaaaucaguacgaucuagauguucucauugaauaacauuuuuucauaaacaauuuaauuucauuuaauuuauauuguuacuauuuuuuauauaaguaaauaugaggucucacuauguugcccaggcuggucucaaacuccugggcucaagcaguccucucaccucggccuccgaagugcugggauuacaggcaugagccaccacaucuggcccugaacuauuuuaaugcaacaaguauuuacugaguuccgauaaaugaaccaagucuggugcuuuagaaccaugaucucaaacuggaggacaugucuaagaauaucuaggcuuggacuguuuuaagagaauaaauuuccagauucucuauauuuuauuuauacucuuuccugaaauugacuuguuugaaggcaacacugauauaaugcuaguccaccuucccuacccucccuuuagcccugugccuucuuaugauuaacagaagacagccauaccuuucacccaucuugaaucucaccauuguaccuuucuaugagguauaaaauccuccaggauucuaacaaagggauagucaaaacacuagugucacgugugaaacuuccuuuuaucaagguaucuuccuccauacaucuuauuaagagaugcaucuccaaaaaaggaaauuacuuuuuauguuuaguucucaaaauuuguaacauuugcauugucuucaucgauuguguuuuacuauaauaguaaccauaccacaauccaacauaaauaaacaauaauauacauguuuucauuaaggaaaguaugauaaaaguuauauuaaauacuguggaagaagcagaauagaaauacaguuucagggagaccgauaaauggcauagcauuuuauauaggaaaaaaagauucuguuacaguuuuaaaauauaggaugggggauaucagauugcccagguguuuagauuuuauuggaauuagugauacaguaggguuuuuuguuuguuuguuuguuuuuaagacagggucuugcucuguugcccaggcuggagugcaguggugcgauuuuggcucacugcagccucugccucccaggcuaaagcaauccucccaccucagccuccugagcagcugggacuacaggcgaguaccaccgugugugacuaauuuuuguauuuuuuuguagagacgggguuuugccauguggcucaggcuggucuugaacuccuuggcccaagugauccaccuccuuccaccucccaaagugcugggauuaugggcgugagccacuuugccucaccaauauaguagguuuaauagcuuuaaaauuagcaauauaauaguguuuuuaggugucaguucuaaauagacauagauugauauauaaaugaaaauauaaccuuugcagugauuaaaacuuguaaugaaaauuuuagaugucaaccuaagaauauucaaggagacaccuuuuuccccccauuaaauuuguuuuagcagguaugugagcaaaacuuuugaauagugccgcaaaggauauagagaucaagaagaaauaauuuuugcccucaagaugcuuguuaguuaaauggugaagcaggggcauagauacaugguuuggcuuaaauaaagccuuaauugugucaugguauuuugcuguuugcuuaacaugggcauugugccucaguguugugucaugcuuguuaaaaugacccuugagugguaguuuagcucauaugugcuguguuaccacauaggcuauugugcagaacagugaggaauuguauauugugaaagacagauggauaggaacagugcccacugcacuuaccaccaaugaaugguagggcuuucucucauugucuaguugaugugaucauaaaaaacauuagacuggaagucaggacacccuaauucucauccugagucugccacagaacguaugaccuuggcuaaaucauuuaacgcauuugaacucuaguuuccucauauaaaaaaaguuuaaacuggaugauuuucuaccugugaaguuuagaguucauacauuuuuacacaguauaugcguuuuagaagggauaggugcagcagauuuuaagaaacagaugccaaaauaauggaguagauuacuuacuguaauaugcggagaagaguagcuuacuaauuauuuaucuaagugugauuaggacagucuguuauauggcuugucguaaguguugugggucucaccacugcccuuuuuauuuaaaaagagaauuuccucuacuuuugagaauuagaacaaauacuacacaggauuaguaagcgagaauaccaauuucagcuucaugccagugccucuagugaaaaccacauuuuugcaguguucuagcagaauauuaaaauggcuuauggauuacagacagcucaggcuuuggucuuuauaggucagagguggaaaccaacggagcaauuaccguucacucuuaugggcggggcuucuuagguuccuuauggagcuaaagugaaacucuggaacaguuccacuagaauggcuuuccugggagcuuaugaggcuuacauucugaaacugauacucuuguaguacaagaauaacuacaaacugauguggaauuaggaggccagagaggggagaagccacauguagcucucauucucacaaguccuuuggcuggcgaacagagguuuuucccgucacuaagcagauauuugguuauauauugacaaauccucucuaaacaauucuuagaauagaagacugauucugucuugugcuuuggaggugaaggggaagagcaauguugaaaugagugaaauuagcuugugaugguuuaacaucugcaaauaucaucuaucuaaccagucuuuaucuccuauguguguucuuaaauaugguccccauuguuugaagccaagaaagauaacugaggaaauucuauggcugauuugccgauguuauuaccaauuauuuauuagccuuaguaucggauaguuugacugauuugccauguuguuuuuuagaaaugggggucuugcucuguugcccaggcuggagugcagugacgcaauccuagcucacugcagccucgaacuccugugcucaagugauccuccugccucaccugugaguagcugggacaacaagcguauaccaccacuucuggcuaauuucuuuuuuuacuuuuuauaaagacggggucucccuauguugcccaaaggcugaugauuugccuuuuuuagguagaaaaccuggacugggcccucaaguuuuuaacuuuuuuuuuuuuucuuggugauacaaaauguggggugaagaggucuguuaaagugaccaggcuuggugcuauuuaaagccgaggagggaaauacuguuuccuggcaggcuuuauuguguuuuuguauuauuaaaucucuuaagucagcaguuuacuuuuugucuaguuguaugucuuggcuugucuaaaugaaucauaauuaaaauuuagucacugggacucuuaaucuugucuaagcaggaauuauaguuuagagauacuauaccuugcuguguauagaauaagaaaaguauaagucugcuaugaucacugagauggguuuuuauaaguacuaaacuuuuuuagaagcauaguuuucuuuaucaccugucccccagaaaguuuagaaagugaaaauuaaaaaguaaguaaaaauaaugguauuggaguuauaauuuggaaauuuguuucauucacuugcauuuuaauauuuauuauguaaacaugaaaugauaaauuuguuuccuuugaaaagauucaagaaauagaauaguuuuaaaaguagucuuuuacauuccuuugcuuauugacaaaaucaucaucaggaacaucgauucagggaaugaggcuucugauccaucucaaaacgaacauuacuaauauuugcuauggucauuugacauaaguuuuuauugagucagaacuauacuggggcaguagccuucaagccaguuaaacaugaauuaagaacuugugugccagguacugcacuaaauguuaauggcauaaaggugaauaaaacaucguuuauacuguguuuuguuucacacaggauuugagauggcugacagaaaguaacuaaagugagauuguaaaauguaacugagguucagaaccagggaaaagauaaauuagauuuggaggccuagauaugguuaaauaauuaauuagacaugaaacccuauggcugaacaguucaguugaauguugauuuuaguagugauaugauacagaagcuaagcuuuguuauagucacgcaauguugaggcaugguuaauauauuuagcaggauuaugaagaguucaggcauuuuuuggaaacuccuaugaauaugucaucuagaauugguuuuguaaaaugguagugcuuguacuguuuaguuacauguguugaauaucagauggauuucaguauuuuuuuaaaacuuugcuuaagccucuuaagccucauugaguggggagacugcaguguaaguauccaggcugaagacugaacuuccaccuuauuuuuaugugguaaugaguuuuuguuuagaugauauauauguuuuaauguugagauggaaaaaguagaagugaauugcaguguagaaacuacucuguuuccuuuuuuaucuauuuuuauuucagucauuaagcuuuccccaucuuuagucuauugaguuguuucauggcacguucggagggauggugggaaugcccuuugcugaaucaaaaacuacuguuucuccaacuucacagguuagagaagcucaucaagucaauaauuuauaauuuuaauauggaagcuguuuugggaacucuugugggcauaucuugguuuuaaaagaagaaaaaagauuuacugauuuaagagguauauaaacgcagcuugcugacaguagcuuuugauuuuauugguucaacagauaucauuguugcacaauacauaaucuuucacuguggcagcuaaugagauacaaaacugcauaauugcaccaacaguuauuuuccuuauagaauuuggcggcuacuaaguaaacaacuuuuaaaauuuaucuuaauugguuuaguuaugugccaucauugaaugagucuuaacauuuuccuucacgcuguugcacuccacauucuuaguugaacagagaaagauauuauuuuaagggagggcuugaucuuuuagcauuuuagccaguuggcuuuucuuaauuaggaugauuacucauauuuagaugaaaucuaacugagaaaccacagcaaaaugcuuacugaaaacauucggguagucaguguggaggaaagacuccuggaaaauaaaaugucucaagguuguuuugaaguuuauccucauuguuuuuauuuauccuuauguguguuaaguauacgaggauuccugguuguacugguauuuuggcaaaguccuguacuguuccucaaaugcuucuaaugcagacacugacuuuuaagaaccagacacauguagaugugcagcgagacaacacucuggccuuuaaccauugugccuccuuucuuaccugcgaauugcguuuacuagcguauuucacauuucagccaauagaucuaaagaauacaaaugagaacauauaggaccugucugcaaauagguuuuaacuuccagagauuagaaguagcuguugagagcacuguggguuuagugagaaagagugcuuuggcagaaugggcagugucuacuguaggcuaaaaaugggggaacuauagcauaucaugagccuucuguaacccucgaagucaguuauuagcaguugaacaugcucuuuggucauaauggcaguccccaggcuccagauaauaauuugagcagggagcugggagaaauaaggaggacaugaguacaugggacaaaagugggccaguaaagggaaaauuacauaugaauggaagaauagagaauggaaaaugguaaacuggagagaaaaagaugaaaaagacaugaaaaaaaagaguagggauaaacgggcucuaccuguuuccuuuucugaucaguaaaggaaaauacuucuugaaauccuuagggcaucuuuggacaaggaaaucagaaguaauucaaauuguauuguugucagaguuuagucuuaaaaguuguguugccagguagaaaacaaagcaugauaaucauuuauagaacuccuuuaguugguuuacuugccucuuaggguaaaaacaaaauuagacuuccagaguagucugugaucuuggaaaagucuuucugaaaaaugauuauagaacuguuaagacaucucccaucucaucucauauggcaucauacuuuucccaauuauuuucagauauuuuagcaucaaaguuuucuagaaugaguuuuguagaacacuaguaucccucauugcuuaaauauauuaggaggaaaaggauuuuuuuuauuaaauaaguuugggaauauauagaguggacaaaauuaguuuuaaaauuacaggucauuugagaggucuugaaguaccagugucuuguggaucccugaagggcuagaugaggguggggcauguagccuuucucaaauuuaugugacuaccauacaguuugaggaaagcuggucuauauaaaugcauuaccugugaaaccuggcuuucuuccacaucuccucugacuugcuuugcuauuuuuuuccccaucucuuacaguacuuccugcuaucccccaaauugggggaauucuuucuuuuuucauuuuaaaauaugauauucuggagaucugaauucucucuuuuuacauuuuuauauguguauuccacuuugagcaauauuaauacuagcuuacauuuuaaaauacgauauucuggagauccaauguauaacaugagggcuauaguuaauaauauuguauugcacugggauuuuuuuugagaguagauuuuaguugcccuugcuaaaaaaaaaaaaaaaaaaaggaggcagguaacugugaggugauggauaaauuaauuugcuugacuauaguaaccauuucacuauauauaaguauauaaaaacauuguguuguauaccuuaaauauauacaaugaaaaagaaaagaaaagaaaauaugaugauaguauuuauaugugaacucuuuauuuggaucuuuaaguuucuggauaaucuggucccuaaucuuaucuacauucccagguuuauucaucaccagucuuccaugguaagucuucacuugagcucaauuuacuauuccaugauuauauucuguauguggaauguucuccucuacuuuuuguauuauggucuggcucaagugcaccuuuuccaugagaccuucccugauaucuuuagcuagaaguaaucucuuccuuggcacaucuguagcauuuauguacuaauaccuauaguguuauuuacagauuuauuugugguuauuuaugcacaugucuuagauuucgagcuucagaagagagggaauagcaugccauaucacccagaagcuuguagcuuagcuauugccuaguaacauuauuaacagaguaauaaugucagcuaacauuuguuguuuacuauaauaaaugacgagcacaguucuaaaugcuuuagauaauuaauguagugaagaaguagaguaacuuacucagucacaugcucaguuagugauggcgccaggauuugaaccuaagcauucuucugcucuuuaucacuauacaguacugcuugcuaugauaggugcucagugagauuugaaugaacaaaugagcagacaaggcuuugaaaaagagggcccaucaucuguggcucaagcucauaaggcacuuucuuuuccccuuuucaaagcugacauuuaucauuuaucuagccauguaauguuuucagugacuaagaacaauuagcuagaguucaggugggcugugggagugguagagaugaguguguggggaaauguguuuagucacuguguuuauuuuauuuauacacuagaaccugcugcuauccuuguugaagaaauaguggugaguccaggcuuuggagucaggaaaaccuggaugggaguuucagcuucuucauuuauuagcaguuugggcaaguuucuuaacaguuguaaaccguaguuuucuucuuuguaaaauaauaguaacuacuucuuuagugucuaugugaggauuaaaucagaugaucauguaaagcacuuagcuauaguaccuacuacauauuaagugcccaacaaauguuacuuaugauacaauagguuuuacuuaacauaaaauuaacuccuaauuucuuaaaaaaauaugucuuuugaauguggaccuuucgauuuuagucagcuaaagcauuaagucuguuuucuuccacucccucaacuucauaguaacaugucuguuuauaauaugcagugagaauuguaguguacauugcaccauuuauacacugcaaacaucauacauuaguaacaagucugucaugaacugaguuaauuguaggguuuguucugaacauuuucuugccaggcaugguggcuuacgccugugaucccagcacuaugggaggcugaagugggaggaucacuuaagugaguucaagaccagggcaacauagcgagaccucaccucuacaaacaaacacaauuaaaaaaauauauuuuuucauuguugagcuuuauuuucgguguuuguaauaugaagacaauagguaucuuuuuauuuaucaaauaagguuuauuaauuaugcuuuuucuuuuaaaugacagccuugagucaacuuuuucugucuuugugcuaagaauuacaguagucucaacguagagccgaggugauucugaucuaaagaugcuccgugaaugugcgauauuucuuuuucuuuuuuuuuugagauggagucucacuccgucgcccaggcuggaaugcaguggcacaaucucagcucccugcagccuccgccucccagguucaaacaauucuccugccucagccucccgaguagcugggauuagaggcacacaccaccaugccuggcuaauuuuuguauuuuuaguagagaugggguuucaccauuuuggccaggauggucuugaucuccugaccucagaugauaugcccgccuccgccucccaaagugcugggauuacaggcaugagccacugcgccuggccgcaugugggauauuucgaagaaucuuagcuuugaugcaucuguggggaagaaaugagugauuauuaacaaagguaaaaggagaggagagucauugcaaauaaagaaucuuguagcggccaggugcgguggcucacacuuguaaucccaacacuuugagaggccgaggaggaucaccugaggucaggaguucgauaccagccuggccaacauggugaaaccucgucucuacugaaaauacaaaaauuagccaggcgugguggcgggugccuguaaucccagcuacucuggaggcugaggcaggagaaucgcuugaaccugggaggcagaggcuguggugagccgagauugcaccacugcacuccagccugggagacagagcgagacucugucucaaaaaaaaaaaaaaaguaucuuguagcaguuuauucuaggccagagccacaguuuguguugauuuggcuagaaauuauuaaaguugguauucugugaaauuuuguuugagugguucuuuguuugguugagcggguucagaugaggcugagaaaacaggaagauugugcuuggaagagggggagaaggcuuccuuaggccaaggcaggucagucauucuauaaggagagucucuauacaggauguuucugcuuuuaaaaauauggucugauaugcaaauucacuuaucuagugcaaaugauucuggcaaagguuucuacuuucuugauucaggaauaagacaaaagaguuuuccaccccauaguacacaacaaaaaagaggcauuauaaaacuuuucagaacuacuaaagugguaugauuuuaugauuucuuguugaauucagcauuugaaaacagaagaaaugugaaaacagaggaaaggugcuuagcauaggaauuaacuuguuucuuggcaaggaaaccagggucagguguuugaaucacuuggcuuuguggugguucuguugguuuuuguguguguguuuuucuucuucugcuggauuaucaucucuuuuuuucugccuuggaaacuguugcuuuaucuagggcaaucaccccacuuacacaggaggcaaauucaaagcugguugccuuauguuguuaaaagcugucagauucacauccuuugccauauccuucuucaggagucaggacaaugaagacaggagucuaaacauggggccagagugagcugccccguccucaguacuaacaccuauuccugacagcuuaaguugcuucucagccuuagugaagcuuucucagcuauucuggcucaugaugaucauucccuccuuugaacugaaauagccuaauugucucugagucauguggcaauuagucuuguuuugcuuucugauaucucuuguaguugacuuuuauuguuaauguaugcugcuugaaggcaagggcuguugugaauuuauuauauugcuauauauuuuacagagacucuugauuuuucccugguuuaccuugggaaguuuuccugccucuuaaauggcgagaggauccuuuagaagauuuccuaacucucagaaucuuuuagauuuuucaugucaugcuguguuugcuauggccuugaaaaagcaguuuuucccuuuuuugcagcagacacaaccaagauucuggauaaagaccaggcaacacaauuuuccuagaguaauacuuaccuugaguaguuucuuauggggaaaaaagcccccaauauucuuaggcuuaauuucuaugaucaaauauuuuaaagauagaaacaaaugauauauaguaguuagguaugggggcaggcaaacaagcaaaauguuaagaucuugcaugacuaauuaguacuguauaaaacacauuuaaauuuuguuguacccauucuuacauuagaaaugaauugauugauucauaugguauugguuuuccuuuaagggauuuauuucuuaaugaaucagagguuucacauugaaaaagaaucugcguauuuuuauauacuaucccaacuuucaucugaguuauuucauguuuuucauugccccauuggaaaccguauuuugccgaagagucauuuaauauauuuuucacacuggcuuugauuuggugacauguagcaguucuggaagaauuaacgauauguuaacacaaguugacugugauagaauaauuacaauaaauaugccuauuuuccuuuggggagaaaagucuaaaauucugcuuuauagaagcuauucucagcucuaaaagagcauauauguagaucuucauuucuuuucuucuaacaauuuuaggggaaaauacaaaccuuaaguuauuuccugaaauauuucccaggaugauuacuaccuuggauuuuaaggcuucuuucuucacaaguucugacucuucuauaagcacaaucagaauggucagaaugcugacucuccuuuagguagucagaaugggucuuccaaaccuuuguaugagcccauuagcugccucagcuuucccucaacuuucaggaaaacacagguuacauauucuuuacguuacuaugagaaacuaccuacauuauuuuuuuuuaaauuuuauuuuuggcugggcacauuggcucacaccugcaaucccaacauuuugggaggcugagaugaaaggauugcuugaagccaggaguugcaagacaagccuaggugacaaagugagaccuugacuauaaaaaaaaaaaauuaaccuuuccggcggugaugaccuacccacacgagaacaugccucuugcaaagggucuccuucaucccucuccagaaaaggagaagaggaaacacaagaagaaacgccuggugcagagccccaauuccugcuucauggaugugaaaugcccaggaugcuauaaaaucaucacggucuuuagccaugcacaaacgguaguuuuguguguuggcugcuccacuguccucugccagccuacaggaggaaaagcaaggcuuacagaaggauguuccuucaggaggaagcagcacuaaaagcacucugaaucaagaugagugggaaaccaucucaauaaacacauuuuggauuaaaaaaaaaaauuaaaacaauuagccgggcaugguggcaugcaccuguagucccagcuacucuggaggcuaaggugggaggaucgcuugagccuaggagcucaagguuacagugagcuaugaucacaucacugcauuccagccugggugacaauagcccuauaauguagguaguuacuuuuaucugcauuuuacaaaugaaaagaacugacagacauugaguuaaaauaaccaguacaaaaaucacagaugggggauagccaaagcuuuaaaauggaauagcaggaaguuuuaauuugcaaauagaaucauuaauguuuaauagaaucauuaauagauuuaauagaauuaaugaauugauagaaucauuaauucauacuuaguuuggagugauuguugaacacauuucucagcuaauuuaggucuucauuauauuuuagaacauauuaucugcaucauuaaaaaauuccucauuuccucauugccuaucucugccuuuuauucacucaguuuuaaaauaaacagauuuuguuuauacugcuucuuuuauuaauauuuaugguaagauauuuuauacugcugauaaauggacauuaaugauauauagccuauuguuugaaaaaagcauuuuggauuauagcccagaacuggaaacaaccaagagauaaauaaauggugguauauucauacaauaaaauauuacucagauaaaaaaguucaguucaaaacuuucaguuuuaucauugcauuauuugcaguuguaaaacaugguaacaucacaaccuuauguuacaaaguuauuaaaaauauuagcaagguacacugauugcuguagccauguuacaauuaagcuaaaggaauuucuuguuaaccaaaagcaaaaaauaaguuugguuuuuuuggaucuuaauugacuauuuauaauagaacuugccuuuggguagcgaacagauucacaaaugaaagaggagauucuggaacuuacuguauaauuccagguaacucuguaaaguuugaaauguaaagaccaugccuuaauacaauugauaauuggaaucgugcuggcaucuucuuaacaucucuugcuugucuguggagcauggcaugauuacuuauacauuacuacauuuaggaaacagccuuuauaagacccacuuuuucugaaguuuuugguguuacucuuuucuuaaccaccaguacugaucucauuauguuuuggccgacuuacuugagggcaugcuaaaaagugaucuaaauacuuaauuucucccuucaauugugcaucguguuuuacaaauaaaccguaucuuuacuuucauuuacuugcaugucacugagaaaauuugagaucuuuagcauucauguccuugccugaaguauaaggauuucacauaauuucagcuuuuaucauucaagucuuauagaugcuuuucucuugucucuguuuucaaauaauggugcuaauuauauuuaaggggcaguauguuuauucaauauaguuauaguguuagcaguguaggauuuaacaagcuuuuccucuggaauguauacuaguucuucauguucuaugugauaacuuauacagugcuaugguauuuuuguuguuagauuuaaguuuucuuugaauuuuuuuucuguccauaaucuuaggcuuucuuuuugugcuuacuguuuuuuucucccccagaaugauacauggcagcgauuauaaaucuguuuuauaaaacuuaacuucauuaaacauaugaagaacgugggauuauuuuucuugucauaaaaggugaccuccagugacaaauggcuauuacauuauuuaugugagauuccuucauuucauauacuguuaucaauguguuugauaaugguugaagaaccaguugguguugguuucuaauacuaauuaauaauuugccuugagccugaucaaucuucuuauauccauuaucagauuuuuuucuucaaaucugaaaauguuuucuuuucuuuuccuuuucuuuuuuuuucuuuucuuuucuuucuuuuuuuuuuuuuuuuagacggagucucgcucuuuccccccagacuggagugcaguggcgcaaucucugcucacugcaagcuccgccuccuggcuucacaccauucuccugccucagccuccugaguagcugagacuacaggcgcccaccacgacgccuggcuaauuuuuuuuuguuuuguauuuuuaguagagacgagguuucacugaguuagccaggauggucuugaucucuugaccucgugauccaccugccuuggccucccaaagugcuggaauuacaggugugagccacugcacccagcuauuuuuucuauauuuuuauguaguucauugaggguaauaauuuuauccuacaacaaacauguaaguuauugaagaauauuggaguuuuaugauaaugcugucauaaauauaaaagguaggguaagagggauccaaauagagcucacuuauauugucacugauaggcagucacgcugugcugauagaauguggccugacacuugauggagugcagcauauguauacuugggcaauuugagcagauauauacggucccgaguuuaaagaagagaacaaacaccagugcacagcuauaguauuccuaauauaggaugcauuuuaaagaauuucacauucuacaaauggagagagauggcaggagaagccuuauuuuaaguccugcacuaaggcagguuaaccucauggguguaauuaccuggaccuuuuuguaaggacaaaauauuuaaucauuaaaaggcccucuguaggguuugaaauaucuauauuuuauauaugaaugcuucuuuuauuaauauuuaugguaagauauuuuauacugcugauaaacggacauuaaugauauauagccuauuguuugaaaaaagcauuuuggauuauagcccaaaacuggaaauaaccaacagauaaauaaauggugguauauucauacaauaaaauacuacucagauaaaaaagaugaacuuaaucucauaaacauuaugggcaacauagugagaacccaucucuuuuaaaaaaaaaaaaaaaagaaaagguggguguggugaugcgugucauagucccagcuacucgggaggcugagcuaggaggauugcuugagcccgggaguuugagguuguagugagcuaugaucaugccacuggacucuagccaggagccugggcaacagagcaagaccuugucucuaaacaaggcaaaacaaaaacaaaaaaacaaaaaucaauugcauuuuuauauauuagcagugaacacauggaaauacaugcaauaccauuuauaacaguucaaucaaaagaaauacuugagcauauaucuaacaaaacguauauaggacuuacuuguauacugaaaacugcaaaaugcugaugaaagaaaucaaagaccaaaauagugagagauacuguguucaugauuggaagacucaacauaguaaagaugucaguucuccucaaauuaaucuacaaguuuaaugcaauuuuuaucaaaagcccaggaagauuuuuuguagauauaggcaagauuauuaucaauuguguguagaaauacaaggaaacuagaauagcuaaacugaauaaaaaaauuggaggaaucacucuaccugauuucaagacuuauuguauagcuccaguaaucaagauuguguaauauugguagaaggauagaccaaagaucaaugaaacagaauagaaaagcaggaauaacagaauagagaccuauacagauauccucaguaaauuuuuaaauugagauauaacuuacauaccuguaaaauucagugguuuuuuauuauauucacaaaguuguauaacauucaccaucauuuaauuccagaacaugaucaucacuuaaaaaauaaaugcuggccuggugcgguggcucacgccuguaaucccagcacuuugggaggccuaguggguggaucaccugaggucaggcauucgaaaccagccugaccaacauggugaaaccccgucucuacuaaauauacaaaaaaaaaaaaaaaaaaaaaaaaaaauuagccggguguggugguacaugccaguaaucccagcuacuugggagggugaggcagagaaucccuugaaccugugcaguggagguugcagugagccaagaucgcgccauugcacuccagccugggaaacaagagcaaaacucugucucaaauaaauaaauaaaauaaaaauaaaauaaaauaaaauaaaaugcuguauucauuggccauugcccaacugauuuuugauaaagaugcagaagcaauucagugcaggaaggauagccuuuuaaauaaauggugcuggagcaacuggacagcuauaagacaaaaaaaaaaaaaggaaaaaaggaaaaaucugaccuaaacuucacaccuuauaaaaaaauuaacugagaguggaucauggacuuaaauguaaaacauaaaacuaaaaaaaauuuuagaaaauaacaggagaaaauguuuaggauauagagcuaggcaaagaguucugagacuugacaccaaaaguaugaucuagaaaaggaaaaauugguaaguuggacuucauaagaacuaaaacauuuuggucugcuaaagaccauguuaaaaggcugaaaaggcaaacuacagacugggagaaaauauuuuugaaccacauauccaauaaagacuacugucuagaauauauaaauaacuccaaacucaguauuaaaaaaccccaaguaauccaauuagaaaacagcaaaagauguuaaggaacauuucacugaagaggauauacagauggcauguaaccccaugaagagauguucaacaucauuagccguuagggaacugcaaauuaaaaccacagugagauaucucaaaauagaguuuaauuuuuaaaaagccugggugcacuggcacacaccuguaauccuaguacuuugcgagguugaggugggaggaucaccugagccuggaaagucgaggcugcagugagcuguaguccugccacugcacaccagccugggcaacgggaaugagacugugucuuaaaacaaauuguuuuaaaggaaaaaauaauaucauuaaauucaguaaaugcaggaaaaaaggcuaaagcagaaaaaaaccacaugugaucucaauaacuguauauaacuuccaguaacauuuuguuguauuuuauacauuuuuuugcccucugcauuuuuauauuauauaguuaacugaauaugcaguugugucuugcuuuuuucacaauacucaauaucaugaguauuuuuaucacuuaaaauuauccaugaauauagauuuuaaauggcucauaaucuuuguuguauggauguacaguaauuuauuuaaccauuccuuucauauguuuaaaguaguuccauuuuguugcuauugcaaauaaugcugugagaaacauuuuuguauguaaacuucugucaggauuucugauuccuuccuuacaauacauucuuagagguagaauuacugugucacgacgugggcaucuuagaggccuuuguuaacuauacauugccaaaauacuuugcagaaauauaguuucgauuuaugccccuuuuauauucuuacauuucuccuuucucuaggaaaauaaauguucauguuacucaccuucacucaagguuuccaaacacuuuuucuuggcucuccuccuacaacucuguucucagcuuuccaaaauuguuucucuuuacuccuuagauaucuggguuuccuuagguucugugcucucccucuucucucuauguauauucuucuuugagcuaaucagaaccagccccuugccuucaacuacaguuuacaucauaaugacuccuaaaucccauaucucugcugaguuuugggaaccaguucuaacaccauacuagauauuuuuaccuuaugcuacauagccaucacaaauguaacucccuuauccaaaacugaacucauuauccaaccacacuaacuucaucuccacugauggcaguaugacccauccagugguagaagccagaaguuugggaguuagccuagauuucuccuugaauuuuguguaccacuggucaaucauuacauuuuaagauucugcuuccaaaauagcucucuaauuuguuaccuccccuuuccacugccuuaauuuaggcccucauauuuuuuguacugcugcauuggugucuuaacugauacgcccauuucugaccuaguuccaucccucaguuucauccuucacauuaaaaccauuuugucuuuuaauuuuuaauuuuauuuuugagacagggucuggcucuguugcucaggcuagagugcaguggugcaaucuuggcucacugcagccucugccuccuggguucaauucauccuuccaccucagccuccuaaguagcugggacuauaggugcuugccaccaugcccagcuaauuuuuuguagauccaggguuucaccauguugcccaggcuagucucaaacuccugagcucaagugauccaccugcaucugccuuccaaagugcugggauaggcugggcacagugggucacaccuguaaucccagcacuuugggagaccgagguuggcggaucacuugaggucaagaguucgagaccagccuggccagcauggugaaaccuugucuccacuaaaaauaccaaaauuagccgggcguaguggcgggugccuguaauuucagcuacucgggaggcugaggcgggaaaaucacuugaacccaggagguggaaguugcagagagccgagaucacaccacugugacaaagcaagauucaaucucaaaaacaaaauauacaaaaugcugggauuacagguaugagccaccaugccuggcccaguuugucauuuuaaugcaugcaugucagcauguuucucaccgucacugucuucugucuccuguaaaauaaagccuguucucuguagcauggcacccaugagccuggucuugauuuccuuccuccaggcuacuuucaugauuuaucccuggccaugccugauauggcucccagucaugcugagcuaguuuccucaacauauuagaauuguuuuucaggccuuuaugcuuuugcucauguuuuuuuuuuccuugacaugcuucuuucuucuauccauuugccagauuucuuucacauccuaagauucagguaacaucauaaccuccuauggaaagcaagcccucuauaggaauuguuaagggcuuccuugucuguguucccacugugccauguaccuacuucuuucugccaccuccuacauugguguacuuuuguuguuguuguuaagcugucccuauuauacuagauuguaacacaugcuuucuaccgccuagagcaggaacuguguacucuuaauuguuuccugagggcuugagauuagcaucuggcauguaguagguguuuaauaaauauuucuugaguagaugaagauaugagugaaugaaugaaggguuucaugcugaaaaaugaaaaaaggguuuaacuuuaagaaaaaagucacagauuuuggagucauaggaauugaguuugaguccuaccgucauuucuuaguguugauauaauuuuaagcagguuguuucccuccucugaucuuuaguucuuuugcaaaagggaggugguaguaguaguaguaauacuauuaacaguaguaguaguaauaauaaaagugcuuuuaaaauaaauauucugcaaauuuuaguuaauauuguuaacaguaauaaaaagcaucuucuauauguaggcugcacaugcauaaugcauugucuugaacgaagugagaggagaauuacuuaaaacuuuggguagacguacucaucaauuacaagaucaauuuacuugguuuugcuauaauuugguugccauuguugacccauugcuuuauugucccauugucucaucacuugcucagacgcugaagaugggucagggggagucaguuuuagaaaacagccuucccugggccgggcacaguggcucacgucuguaaucccagcacuuuuggaggcugaggcagguggaucaccugaggucaggaguucaggaccagccuggccaacauggugaaaccccaucucuacuaaaaaaaaauacaaaaguuagcugggcaugguggcgggcgcguguaaucccagcuacucgggaggcugagacaggaggauugcuugaaccuggaagguggagguggcagugagccgagauugcaccauugcacuccauccagccugggcgacaagagugaaauuccaucucaaacaaacaaacaaacaaacaaacagauauaaaaaaaagaaaaaaaaagaaaacagccuucccugaaaguuguuugugaugcuuauggucuaggaugugaaauuuacaggaugaugaaacaugcagauauuaauaguguuccauauuauuuuugaaugugguuugacuuuucuaacgaucagcagugacaaacuuguguacuaccagucaacccuguuuuccauguuuucucuacagagauguauaguuagagcagagaugacuaauguguuuucaagaaaugcuacuauaaccuuuaagucugauggguagauugagcauuuaaagcuguugcuuuuucaucgcaucuggaugacuguauguuccuaccaaaugaaucacuuuaugaauaugcaugagcuuauaaacacaacuuuuuagaaaaaauucuuguguucugaaacaaaauuacguugguaguauuuuccaaguuuuccguaagaaguagcuuugcauuagcccuagaaauuccuugaauaauauguuuuuacccccuuacuuguauuacauuuaaugacaucucuggcuuuauuuucuccauucuuuuuuccauggaguuucuuaauuucacuguuuuugccuugcccuuuagacgggugaaacaaugaugacucauuuuagauugaugaaagggacagcuuagcagcuggagagcugguagacacuagagcacuaaauugccagcaccagccuucucuucauuguccacguaaggcuuguggcagagguaugcccauucagucauuuauuaauauguaauuuguagguuagaugacuucaucaaauuauauuuacaucugaccuggagguucaaccauguuuugcuuugggacauuuuuaauuguuaaaaaucauaguuggguucugaucaauauguacaugcugaaguucuuauuuagccacauuaugggcuuuuuugguuuucuucagcaugucaauaguacacagcagcucagaauggucaaaauuguuucauuagugccuuaacaaccauucaugauauaucauauuguagaaugcaaguauagucacgcacugcuuagcgauggggauacauucugagaaaugcaucauuaggugauuguuuccuugugggaacaucauaagaguguacuuacacagaccuagaugguauagccuacuacccaccuagggcuaugugguauggucuguugcuccuaggcuacaaaccuauacagcauuuuccuaacucaauauuguaggcaguugugacccaacgguuaaguauuuguguaucuaaacacagcuaaacaggaaaggugcaguauaaauacagcguuaucaucuuacaggaccucuguugguauauggugcacgacuguauauccuuuaucuacauuucccccuuuuggcuuggauagaccaucaauuccuuggguuuacauuuauuucauguaaucuuaaaggauuuuguuuuaugcauggcaccauuuuuuuucaauacaaaugguuaguauaaaacccaaauuugagaauuugauaacaauggcuuaguauugaacacaaguguuacauaaaguuguggaaaaagccuuagagagguagucaggggauuugaguuccaggucugacugugcacuugacucaccacgucaucuugguuaauaaucaccuaacaauaaaaauaauaaccuuaauuuauauaaugcucugcagucugcagagcacuuuuaaagaaaguauaggcugggugugguggaucacaucuguaaucccagcauuuugggaggcugagacagguggaucacuugagugauuaggaguucaagaccagccuggacaacauggugaaacucuguuucuaccaaaaacacaaaaaaguagcuggguguggugaaacaugccuguggucucagcuacuccagaggcuugagccugggaggcagaaguugcagugagcugagauugugccauugcacucuagccugggugacagaacgagaucuugucucaaaaaaaaaaaauuguauugggcauagauaugauuauucacauuuugugaugaggaaacuaaaauucaaagacuuuaagagauuugcucaaggucacauaccgguaagggcuagaacuagcauugauuuuuaucacuuuccuuucagucauaccaugcugucucucauuuuacuuuuauggguaucaguuaugaaauaaggggguuggaccggaucagugauuuuuuucaagcuacauuuacagagagucuuaggauucuuuugaguggccuccagguuugcuuguggaaugaagauugaaauauagggaaaggugcuuagcuuugcaccagaguauccacacugagugagguaguaguugcucauugacaguugagaaacuacugcauguuauuaccgauggaugaguuugugucccuuuaguaugacuggacaaaaagaaaguggaaagacaucugauauaaacuuuugagguuuuguuuuuguuuuuuaaagaaugggguagaauuccauagcuacuuaaagcuugcaaacuacugcauuagaugauuuuuuuuuuuuuaagguagggucucacucugucacucaggcuagagugcaguggcgcugaucucagcucucugcaaccuccgcuuccuggguucaagugauccucccaccucagccugcuaaguagcugggacuacaggcacaugccaccacgccuggguaauuuuuguauauuuugguagaguugggguuuugccauguugcccaggcuggucuugaacuccugagcucaagcaaacaaacugccuuggccucccgaagugcugggauuacaggugugagcuaccaugcccagccagaugguuuuuaaggaauuuuucagccugugaguuuguaaaauauugcaaccuuaacuuuggugguguuaccugaugaaucccugaugacuuuacagcuguugcaggcuuacaucaguuuagaguuauggggcauuauugaagcccuguuuaucuuccaagauagucuuuauucuucuuugcuaagguggcuauuuuuaguaaucuuuagggaaaagaggcacaauggcagaaaugagcauguguuauuauuaguauauuuaugcagccaauauugguaaugcuuuuuuuuuuuuuuuuuaaagacuguguaggagugaaaggggaguuuuccuuuccgccuuugagguuagcugaaaaucaacugacaaaagucagauuaauaggagaaaaggcauaaacauuuuuauuaacauguauggaggaaaaucacagagagauugcccacaacccagugggguacagaugcuuauguacccuuguuuuuagaggaagggagauggggagguauggaugauuuuacagggcuaguaaaugauuuuuaaaguuauucagugggcuuggagaauauacaguggucugggacaaaguuuuuugggccuacagagcagauagugguuugugacaaaagucuguccaggcccgggugugguggcucaugccuguaauuccagcacuuugggaggcuaacgcaggugaaucacuugaggccaggaguucaagaccagccuggccaacauagcaagaccccgucucuacuaaaaauacaaaaaauuaguuaugccacgguggcgcacaucuguaaucccagcuacuugagaggcugaagugggagaaucacuugaacccuagaggcggagguugcagugaggugagauugcgccacugcacuccagccugggugacacagagagacccugugucaaaaaaaagauaaaaguuacucccaagcacuggcauagugcagugugcaauauauauauauauauauauauauuuuuuuuuuuuuguuuguuuguuuguuuguuuguuuguuuuuaagaauauuagcugggcauaguggcacaugacuauagucccaucuaccagggagguugagacuagaggaucacuugagcccaguaggucaagggugcagugagcugugauugugauuccagcuugagcgacagagugagucccugucuaaaaaaaaaaaaaaaaaucaucagguguauugacauacuucagucucucuuccugcaauauuaguucaguuaaugaaaacucggggaagggacagagauaacuauuuucuucuuuggcagguccagauuuaggcagauaagggaacuucagagaacaacuucucccugugcuuuggggguggugaggggauggucagagaggccuugaggauuguacaguucagcaugucaaagugccauauuuugagguaucgguuucugggccucaacaacugcuaauaagaaugauugacuuuggaguugccuuggaguuauuucaaaaagugaaaauguuauuguuuagcccacacuaguuaucuuaguugucauuuguguuuucuacaaucugccaaugguuaaaccuggcauuucuaucaagaaggaacucuuuuugcuuccagaguaaagguauuuuuauuauauuaacccuugaaauagauccaguuauguauucacuuugcguuuguuucugaacaaaauaaaccugugugguaagauggaaguggguuuuucacuuacaauauuaguuacuuacauuuguaccuuuuuuuuuuuuuuaacuucuucacauuuccucccuugcccuccacaaucugauaagcaucucauugaugacuaugagagacuaauuuaggccgugugguuauaaaugagauuucaauucauuucuucuucucuuaacccgucucagaggagauaucacagggugacuuucuauguugcguuuugacacaaggacaguuuguuuuugcuuuggcugauggauggggcagcucuaguugaugaaugugguuuauaugcucacaggcagaugaaaguguccacucugcccugagacccucuccuuucugcuuagugguguuaugaaagccccauggguauuugauuuuucaagaauuaaucaguacacagaaguugaaauguagaccaaaggaaagaauauguuuuuucaguuaggcuuuuugucuuuuuuuaauuauaugggguuuacccuuuguguuucccaacucagggguuucacuauuaaauaauugucuuugacucuuaaacuuuuuagguaaaauuuauauaccaggaaaugcauagauauuaaauauacaguuuaaugagauuugaugaauuauuauaaccaccaccuuaaucaauagagaaaaucucuauaucccagauaguucccuugugccucuuuccagucaaucucuagacacauuuacuuguauaauaaaaagauuuugacauacccaacuacaaaaugaucagaucuuuguuucuguagcaauggguagaauaaaauaaaguaggauuuacuuaaaacuaauauuuucuuuguaggcaggccuguuguuacagguagaaggugcucaaaagcugguuucuuaacuaauuuauggauuauuuuuauuuuuuauuuguuauuuuguuauuuuuagguuuuuuuuuuuuuuuuuuuuuuuuuuuuuuuuuguagagacagaggcucacugugcuauccaggguggucucaaacacguuggcugaaaugaucuuccugccucggccucccaaaguguugggugugagccacugugcccagauuuauuuuauuuuauucuguuuuuuuagagaugacgucuuguuacguugcccagacaggacucgaguuccuaggggauucuccugcuucagccuccugaguagcugggacuauaggugcacaccauggugccuagcuuaauuaauggaguuuuugauaaugguugacaaagauagugguaagcaaagcagcccuuauauagacuuuacaucuuaaaacauaauccccuaugugugaaauugagaacagcuuucuagaauaauaaacagagaucuguaugcuaacuaaaaggcagagagaauauuggcucagccaggcccucacuuuuuuguuccucccuaucuguaaaacaucauuuaccucaucagcgugcuacggacauggguuaauguuuggaaaauucuguggaaagagugggguucugacaaugugcucugaccaaggcaguuuagcaaauuuguacuaaguggcugaccuuugauaagcaccacuccuuccccaccugaccugugauuccauuuuucuuuugugcaaauaguucugaagguuuaauguuuauuuuuuacuacgaugcaguagacuuucuucucucguguagaaacugcucgaaugacuguggaugacuccuagaauauaggaauaacagaauugguuucuccuguacucucaacacaaaauacuucugugaccaaaugugugggaguguguccccacacaccaagcagucaaccaguucugcagcagcugccagcugguguccucuaaugcaguucaguucaguucaguucugacacugucuaccuggagauagcgucagaucucacagauugagggcucagucccacaagucuguccccagucuucagugccagucacaggcuccaggugguuuuaccugugcuucugaccugcuggcuauaaacugguuucccaauauccccuuauuggguuccaugaaauuguuagaguggcucacagaacucaggaaacauacugaccaguucauuagaaaggauguuuuaaaggacacaagugaacagccagaugaagagauacccagggcaaagccuggaagaguacugaacgcaggagcuuccaucccgguagagcuggggugccucacccucccagcaaguggauguguuccucuucacucuccuggaugcccccuuuuagguuuuuauggaggcuucauuagguaagcaugauugauuaagucauuggccauugguuaucagugcaaccuucagccccucuccuuucccuggagguugagggugggguuuugaguucuaacuguaugagcacaggguugauuccccuggcaauuggccaccaguccugugguuaucuagggacuuugcaaaaaucaucucauuaacauaagcucaggugugguugaaaggggcuuguuauaaauagcaaaagacugucuuuugcuuuuaucacucuggagcuguucaggaaccaguggcaagaggccgaauacaguauuuuaaccaaagucacuuaggaaauuacaaggguuauauaggagcuuuaagccaggaaccauggagauauauguauguguauauauauaugcacauauacacauacaaauaucaccgcgacccaugaugcucuucucaagggccugugccuucugauaaacggcugaguuggcuguuacacuuacuuuuucgagcaaaugaauguguaguuucaucuggcucauucgucaaaccccggguuuggaagguuguauguuuuuauuuagcuaguagcaguugaugugguugagguggggcuuuucuuuggggaagguacagcuuugaauggcuguuaucuuucaaguacaaauaguguagcuccuuauggcucaauaguaucaauaaacuguuuuauuugcuuuccuuuucucuuccuuuuuuucuuuuuuuuuaaacggagucucucucuguugaccaaucugaaguacagugguguaucuaaacucacugaaaccuccgccuccuggauucacggugaaaucccgucuguacuaaaaaauacaaaaauuagccgggcgugguggcacgcgccuguagucccagcuacucaggaggcugaggcaggagaaucacgugaacccgggaggcagagguugcagugagucaagaucacgccacugcaucccagccugggaaacagcgagacucugucucaaaaaaaaaaaagaagggguugacugccaaguuuaaauauuggcaggagaugaggagauuucaguuuuuauggagcuuuguuaaugagccgugacuguuuauuacaagacuuuuacuuuuaaaauuuacuuaguaauuauuuacucauaaaacagcuacuuacuguaaccaguaggucaguucuacucuugaggcuucacauuucuucauuuguaaaauuaguacuuguauugguguccauucccuuucugaaauucugugauauauacauuuccuuuaaaauguuacaauugaaaaaaauaaaguuacaauaaagaccgugugcgguggcucacccuguaauccuggcacuuugggaggcugagguggguggauugccugagcucaggaguucgagaccagccugggcaacacggugaaaccuugucuccacuaaaauaugaaaaauuagccagguguggcggugugcaccuguagucccagcuacuugggaggcugaggcaggagaauugcuagaacccgggagguggagguugcagugagcugagaucaugccacugcacuccagccugggccacagaguaagacucugucucuaagggaaaaaaaaaaguuacaauaaaagccaggugcaguggcucacccuguaaucccagcacuuugggaggccaaggcggguggaucaccuaaggucaggaguucaagaccagccuggccagcauggugaaaccccuucucuacuaaaaauacaaaaauuagccgggcaugguggcaggcgccuguaauuccagcuacucaggaggcugaggcaggagaaucacuugaacacaggagguggagguuucagugaguugagaugcacuacuguacuccagacugggugacggagugaaacuguuucaaaaaaaaaaaauaaauaaaauaaaauaaaaacaaugauacaauaauucagucuuguuuagaguugccauuuucugaguguucuggccauagcauuucuucuucuugccuccuucccagcaacauuugcccacuugcuguggacugcaguuaauuaggcugguuuggagcucuuuccuuccuguuccauuuguguuacaccuaaagcaucucaugaagaugauuuagauuaguuccugccaucaaagauaauccaguuuaggaugaagucaacaguauuuuaaggguggaguucucuuuuggaacugucauuuggucagaauuagugaaugcuguuguagagcugaccccugcacaacacagguuugagcugcguuuuuucuuuuuaaaacaauccacuuauauguggauuuguuuucaucccaaugcugaucaaaacagugguaucugcaggaugugaaaccugucuguacagagggccaacuuuuuguauaugcagguuccucgggggacugcaggacuugaguguguguguaauuugguguacucagggguccuuccuggaaccagucccccaguauaccgagggacaacuguguugagauaucagcugcggguuuccccccaagcuguuacucaauuuucacauuaucugggguuuccucuguucucauauuacccccgaagauuuuauaccaauuuagggacaucguguuuuccaaauccuaaaugaaaagcaggauaugaaguguucguauuuucauguucuaugguauuuccucucaugcucgauuuauuuauaucuaaaaucaugucauguaauaguauauuaauaaugcuauacauuugguacuuugccauucauaaaguguuuuuacaaauauuguuuaauuugaaccucaugauaagcuaucuagacagguauuuucucagacagaugaggaaacugagauuuauagagauuaauuuguucaauuccaaguagcuaauugaaauccauacgaccuuucucauuuauaggauuuguagauccuaccuccuuuaggugcaaaggaguuguauaaccaguuuuuuuucuacuagaaugaugaccuaaucaggaguaaaugacuuuuacuucaugugugacuucuucauacucacagguacuuugauucuuucaauguguguuacaccaauuugauaguaucuugccuuaaaaaaacauuuguuuuauugaauguuuacuauguacuaggccugugcuuagcacuuucaaaaaccuuuuuguuuugaaagaaaagagguauacugaaaaguguauaauaaaauacacagcuuaaugagcuguuauaaauacuccuauauacaacacacagaucaagaaauagaacauuuuuagcaugccuaggagccagcuuuuugugugcuguguccaaucaacaugcuaacuuuuugauauucacuucuuuuucuucuucuuauuuauuauuauuuuuuuagagacagaaucuugcucugucacccuggagugcaguggcaugauuauggcuuacugcagccuuggccuccuggccugaagugauucucccaccucagccuuccaaguagcugggacuauaggcacgugccauugcacucagcuaauucuuugcuuuucuuuauugauuuacuuccuaaacaagcaucuuuaaacaauauaguuugccuaguuuuuagcguuauauaauuggcauuacacaauauguauucuguuguaucagcuucuuacauccuguuuuauauuuuucucuauuauguguagcaguaguuuguucuuuuucauugcuguauaguauuccacugcaugaauaugccacuauuucuucauucuauuguugguggacauuuguggguguuuuccuguuuggggauacuaugaauuugcagcugagaacauuuccucacccucccagcuuuauugacguacaguuaacaaaauuuguguauauucaagguauacgccaugaugucuugauagauauauacauuaugcagugauuaccauaaccuaacuaauuaacauaaagaacauuauuuuauuuuuuaaauuaaaacaauuuuuucggagacagggucuugcuguuuugcucaggcuggucuugaacuccuggugucagauuauccugcugccucagccucccaauuagcugggauuacagucaugaaccacugugcuuagcucaagaacuuucuuauguguuuauucuggcacaucucagcacauauuuguguuggggauauacccaaaaauagauaggucaugggauuccuuccuuccuuccuuccuuccuuccuuccuuccuuccuuccuuccuucccucccucccucucucccucccucuccuucccucccucccucccucccuccuuccuuccuuccuuuuuuuuucgcagagucucucucugucgcccaggcuagagugcaguggcgugaucgcggcucacugcaagggccgccuccuggguucgagcgauucuccugccucagccuccugaguagcugggauuacaggcauacaccauuacacuaggcuaauuuuuguauuuuuuguaaagacgggguuucauuacauuggccaggcuugccuugaacuccuggccucaagugaucuaucugccuuggccucccaaaguguugggauuacagaugugaaccaugaugccuagccaggauuucuuuaucuucaguuuauuagcuacugcccaacuuuuuucuuuuuuaaaagccagucaaauuuagcaaugggggguuguauaccaacuuuagugacacuaaaguuaauaaguucugauaacccacuaccauaggaccagccugucaaacauuuuucuaaagugguuguaggcugggcacgguggcucacgcuuguaaucccagcacuuugggaggcugaggugggcggaucaccugaggucaggaguucgagaccagccuggccaacauggugaaaccccguuucuacuaaaaguacaaaauuagcugggcaugguggcacaugccuguaauuaguuugggaggcugaggcaggagaaucacuugaacccaggaggcggagguugcagugagcugagauugugccauuguacuccagccugggcaauaagagugaaacaacgucucaaaaaaaaaaaaauuagcuggacaugggguuguaugucuguaaucccagcuacuccagaggcugaggcaggagaauugcuugaacccaggagguggagguugcagugagccaagaucgugccacuguacuccagccugggugacagagcgagacucugucuccaaaaauaaaaaauaaaaauaaauaaauaaagugguuauagcaguuuaagguacucaccagcaguauaggugaguucccauuucuucagaucuucucuaacacuugcuguugucaacuucuaaauuuaaaauuuuaaaauuuaaauaauuaaauuaaaaauuccuaauguaguaggaauauagugguaucucauugugguuuuaguuugcauuucucugguuaacaauaggagcaccuuuucaugaguuuauuagcugugauauucaagucuuuugcacauuuuucuuuuggguuauuugucuuuuauugacuugugguaguucuuaaaaaaauuuuuuuuaaauuaaaaacuuuuguguauuuuggagacagggccuugcucuuuugcccaggcuggagugcaguggcgugaucacagcuugcuacagccucaacuuccugggcucaagugauccuccugccucagccuccugaguagcugggacuaaaggugcacacuaucgugaucggcuaauuuucauauuuuuaguagaaacagggucuugccauguugcccaggcuggucucaaacuccuaggcucaagccauucaccugccucggccuccuaaagugagagauuccaggugugaacuacccacuuaaaaaucguuuuaauuuaaaaaauaaaaugaaaagaauguucuucauguuaauugguuagguuaugguaaucauugcauaauguauacaucuaucaaaacaucaugguguaugccuugaauauauacaaaucuuauuuguuaauaaauuguugaggaaauaccuggccgguaguucccucuauauuuuggagaugagccccccuuuuuuuuauuguacuuguuacagauaucuuuuuuccccucuguagcuugucuuuucccuguuaguugugucuuuugauaaauaaauucuuaauuuuaauguuguaaugaaauuuaaucuuuuuuucuguaugauuagugcuuucugugaguuaugacauaaagucauaaagauaaucucuaauauuaucuucuaaaaguuuuauugcuuugccuuucacauuuagauuucuuaagggcuaaaauuauuagauaacuagguauuaguugauuauauguaauuaguaaacaaauauuuauugugacuucagcuauguagaagagucagugguagauacuaagagauguaagacuugguuccugcccuaaaauaaucaacauucuguuuguguaaguaaggcccuuggcaucagcacgauguaauagaaagaacacugacuggacugggccugguggcugaugccuguaaucccagcauuuugggaggcugaggugggaggaucacuugagcccaggagguugaggcugcagugagccgugaguacaacacugcacuccagacugggugacagagcaagaccauccugucucaaaaaaaaaaaaaaaaaaaaaagaaaagaaaaaaagaaauaaaacacacacacacacacacacacacacacacacacacccucccccccccccccucagaaucuggagacuuauauccauguccuuuuggggaccuggcugugacaccaccuuugugauuuuagaaaucuccuuuccuucucugggucucaguuuuaucaguaaaauaagggauuggcuuaaguauguaguucuugauuuugguuccucagauugauaaggggucugaguagauagcacuggaagcauuuuuuuuuuaaagcuaaaaguauacauuuuuagccauggugaugccacacagguuaaccaaaaaauaaaauaucuuugcuuuuaacuggagucguguguccuuucugugugagaacugaguuuaacagcuuugauuuacaauaaaaguuuuaacuuaguuuuucaaaaaaauacacuucguuuauugauaaucccaguuugguauacaaaguuuuuuuauguuuuuuugaaauggaguuucacucuugacgcccaggcuagagugcaguggcacaggcuuggcucacugcaaccccugccuccuggguucaagugggucccagccuaucuaggauuauaggcguguggcaccaugcccuggugauuuuuuguacuuuuaguggagacgagguuucaccauguuggccaggcuggucucgagcuccugaccucaggugauuugcccacuuuggccucccaaaguggugggauuacaggcgugagccacugugccugaccuuauacaaaguuuuaaauaacauggccuucugacuuuaacuuagaaaccaaagagugguaggaguagggggaagguauuaaauaacagaaacuaucuuuggugauuaaaaaguuggguaccuacuauucuaauaacuuuuaagggcucuucuguagguuaguguaaaaguaauugugguuuuugccauuaaaaguaauggcaaauggcgggcgcuuguagucccagcuacucgggaggcugaggcaggauaauggugugaacccgggaggcagagcuugcagugagccgagaucacgccgcugcacuccagccugggcaacagagcgagacucugucucaaaaaaaaaaaaaaaaaaaagcaguaauggcaaaaaaaaaaacccuaagaauuucaauauauuaugagucagugaaaauauaguauuuguuguuuuguuucccuaagugcccaauugagagaucuggacaauuacuauuauagagauugugaggauggacagagaaccuuuuguugacugagguagucaaagaaggaaggcuaccagggugagcuaggauugagcagugagaaggauuguuucuauguauggagaaaaaugggaaagagggaauuguggacagagcaguguaagcaaggauacggaaauagcaaaguacaggucauuuuuagggacagaagaugaaucaguuuagcauuagaagaugaugaaaaaguagucugaaguuaaaguauggaaagccuucuucaaacauaaggucaaauacagcuuuggaaaaguuaacaguuacaaguaugaugguguaaugaagauucuaguucuucuguaagccaagcaggggccauuggcuuuaggaugcccucuaugcuccaauauaauggugcugccuggcaucauugaaaacauuaaaaaaacuuuucuaaaaaguauuugaggacugggcaugguggcucaugccuauaaucccaacacuuuggaaggcugagaugagagaauugcuugaguccgggaauucgagaccagccugcaacauagggagacccugccucuacaaagaaauaaaaauaauuagccagguguggggguacaugcguguagucccagcuacuugggaggcugggaggaucacuugagcuugggagaugaaggcugcagugagcugugaucaugucauugcacuccagucagugauagagugagauccuguuucugaaaauaaaaaguguuuaggggauaaccagauugggcuuguauugauagccagaccgccaagcaggaaacuuuauguauuuauuuuuuaagaguuggagucucuuucucucuauugcguaggcuggagugccacagucguugggacuacagguacugccaccaugccuaauuaaaaaaaauuaaaagauggggucuugcuguguuguccaggcuggucuugaacuccuggucucaagcaguccuucugccucagcuccccaagcucccaagggaguauaggcgugagucaccaugccuggccagaaaccuuauuuugugguaguuguucagcuauaccuugcagaauuuuuuaugugaauccucaguaaaucccaaacagcuucucucaguacuaacacauggcugauaaaugguacugaauucuuuguaaaucucaccaaucucaacagaauuucugguucgggguaaaaaaaaaaauuuccguuuaauuucuguagaaaauaaccacucagaauccacucucuguuauguguaacaauggacagaaauuuuacuguuguugguacaaaacaaugacucaucccaaaucaucucuuggaauuaagaauguaaucguaauacacucauacucauauguacgugcucagacagucccuuucugccuuucuuuuuauuaccccuucucacuccgcugugguuuagcuugacuaaucuauuugcagcacaucagcauccuuaaugcagaaaguuugcagcuucuguuuacagggggaaaaaaaaaggaguguggagauugcagauuucaucucuuuuuucuucuuuuaaaauuuauaauuuccuuuuuucaggaggagggugauuauuuucguuuuuguuugagacagggucucacgcugucccccaggcuguagugcaguggcgcaaucuuggcucacugcaaccucugccucccaugcucaagcgauccucccacgucagccuccugaguagcugggacuacaggcaugcgccaucacacccagcugauuuuuguagcuuuuggagagacaggaucuguccauguuggccaggcuggucucgaacuucagagcuccagugacccagccaccucggccuuccaaagugcugggauuacagguaugagccaccgugccuggccuacauuuugucucugacauuucucaaucuaaaguauauguauauguacauuuauacauauguuauuuacauauauuuuuuucuuuaaaaaauuauuuuuugguggacugagucgcuuuaauuaagacucagucauuuuaaugaagugggguuauuuacuuugaccuuccuccccaggaaauagcacuuaaauacuuaaaggaaaaauuaaagaggaccaaggccaugguggcagggacugggagcaugguggccauacagccugauaagccagcagagaagagucccacaguaaacugacacaacccuggugauguaggugguuuaggcacagaaaaaaggaaagucagauuugaguacccucagcaggccuuguacuggucacccccaauacccaugagaacacagcauccuaguccucccuggcuuaucggugcucuccacaugggggauaccugucacagcuuuuauuccaggacuggggaagucacacuuuucugcccaccccacccauuguuuugcagagaagaaucucuaaaaccuucauuacucaugcugaaagugcuauagguauuuggaaugggagaaugggaaagaguaaauucugaaugcauuggagccuuaauuugcugcccuuucuuuccuucccucucucaucuucaugaaggagggcccauugugaauaaggaagaggggaagccugucugggagaggcuuuuuggguacugggcuucccaggaagaagccacuucccaccguccccuugaugaucaugugacccuuuucuccaugcagccagaaucagcuucuuuggggaugaacugguaauagauguugucguuaguguuauuuuuaaauuuuuagauauuuuuuuccagaugcaucuucaaaauguaggcuuuggagguugauaagguuuugugggauugguaaguguuaaucuagaaguugggcaguaaacaagaauaguaccuuaucagcauuaaaacaaagcaucugaaagaaauguuuuugaggaguaguugaauauuuaguugguuaaaaauuuagacucagaaaauuuucaggaaggugauaaagauucacuaaucauuaaguagggaaucucuuaaagguuuuauauugauuugauacauuagagaaugcuauaauaauaguguacuuugauugguggccuauaaaguaauugugccuuuuaugguauuuaugaauugguuauauuuuaaacaauaaaucuugacuuuugcgucagaguuucucuguuuuguuuuuuguuuuuuuuuuugagaccugcuuugucacccaggcuggagugcagcagugcugucauugcuaacugcagccucaaccuccugggcucaagugauacuccugcaucagcuuccugaguagcugagagcacaggugcgugccaccauucccagugccucacuuuaggcuaaguuuuucauuuuuuguagagacagggucuugcuuuguugcccaggcuggucucgaacuccugggcucaagcaaucuucccuccuuggccucccaaagugcugggauuacaggcaugagcuaucaugccuggcccugcaucauagauuuuuuuuuuuuuuuuuuugagacagugucucacucugucgcccaggcuggagugcagugguacaaucucgcucacugcaaccucugccuccuggguucaagugaucuccugccucagccccccaaguagcugggauuacaggcgcacaccacuacaccuggcugauuuuuguacuuuuaguagagaugggguuucgccauguuggucaggcuggucuugaucuccugacuucaggugauccaccugccucggccucccaaagugcuggaauuagaggugugagccaccgcaccuggcuacaucauaguuucuuaaaaucaccaacuguuaucuauguuuuccuauuuuaauuagucuaauuuuuaauaauuuauuucuggguuaguuucuguacuuuugguagaauugcagacucacaacaggcuucaggaaaguaauuuuaccaaaugcaaggcuauuugcaauuuaguuuucugauucagaagccauaacucugugcuggauuugauuauucauuauuuaaccaaacauuuuucaaaugccuuccuuauuuucugucuuaacugcguagaauuaagcccauuuccaaaaggauuuugagguaauucuggaguuugagauuaauauuuuuaaaaagaaaccagaguucauuuucugcagagaaagcuuuuaaucaaauauacauauaguacccuguguccuuaauugaauugaggguuugacuuuucuccaugcagaauucgaguugauauuuuuguaguuuaggaguuuugacuuuucucuuuugccuuuauguuaacaaacuugugaguuugcaagguuauaauagaaagaguauauaggguuuggagucaggaaguccuagguucaaauuuuagcuuaaugagcaaguuacuuaauuuuuccaagccacagguuccccagcuaugaaauggaauaauauuacccaucuauugggguucuuguggggauuaaaucagaugaaagugcuuagcauagcauauaaauguuaguuuauuuuccuuuggcaauuauuuaggcuuuagggcaaaauugccuacuuguuuuggaaugaacccaaauuuuaugguuaauuuuaggcuuuuucuucaguuagacuuuugauaugucuaacuccuucccaauuuuuuuuuuuuuuuuuuuuuuuuuuuuuugagauggagucucucucuguugcccaggcugaagugccauggugcgaucucaguuuacugcagcuucugcuacccggguucaagcgauucuccugccucagccuccugaguagcugggauuacaucacuaugcccagcuaauuuuuguauuuuuaguagagaugggguuucaccauguuggccaggcuggucucgaacuccugaccucaggugaucuacucgccucagccucccaaaguguugggauuacaggcaugagccagcacaccuggguggcagugcauuuuuuaaugaggaagauugaacaacuugacagaagggugagcucauauucugaacucuuacaguucaucuaaugucaaauuucuagaaaaaaauuaucuaaaucuaaaaguuaguaugacacuccauaacauuaauugugagucccugagggggcagcuauaaagauaaaauggaguauaggaucccccaacacacauaacacaaacgcuugugauugagugugcauuggcacauguacaccugugugcucaccccuccucucccuuccuucaccucuaucaugaguacagguguguugcuuugaauuggugaggagugggaaagagaguccuuuuggugacaagaaagcaaacugguuuuauuuaguucaccaaaauauuguuuugauccuuuuuuguuuguuuguuuguuuugagacagagucuugcucucucacccaggcuggagugcaguggcgugaucuucgcucacugcaaccucugccucccagguucaagcgauugucucacaucagccucccaaguagcugggauuacaggugcucaccacccagcccggauaauuuuuauauuuuuaguagagacaggguuucacuguguuggccaggcuggucucaaucuccugacgucaggugaucuaccugccucggccucccgaagugcugagauuacaggcgugagccacugugcccagccgauccuuuuauuuucaauauaaaacuguugcuguaagcacgagcauguccaaagggaacaccaugggauaguagugaauugagggugauaauccaguuuugaggcuuaagucugcaauuccuggauuaauuuggcugcucuguuauugguggcuuugcuaggaucauuuucaaaucacuuuauuuuccuuuaugguaaguguauuaauaguauuuaauaacaagauuaaucugggccaagggcuuuccugugaaaguuacuauuuucauuaugggagaaaaauagagcagcauggccagugugcauuuuuguuaucccauccuuagguaagugaguuuagacagccugagcuaaauaccuagauuugcaaaaacaccuccuacccccaugcuuuccuuuuaccauuuaaaauuguuugugaagaucuuuuuuuucuuucuuucuuucuuuuuuuuuuaaacacagagauagggucucacuguguuguuuguuuggguuugcaacuccuaggcuaaaggguuccucccgccucugccucccaaagugcugggaauacaggugugagccgcagugugcagcagcuuaaguuucugaucucccucaccaccucgcacuuucacuccucauaccccuuccuuguuuaauagaaggauccuuuguuuugaguagucuccaaguggaguauuuuggagagacuuugaauaaauccuggcccaagccugaucacaacacuuggacauugagcuuaccugcauucugcuguuggguagauauggaaucucugccccucuugaucaaagcuacauagcccauaaggaaacauccauugagcagccuucuuuccuuucacuuaaucaauuucaauguauugugguagaggucuuugugauauuccauuuuagacuauaugaucuuuaggaaugcuuaacccugcugugccaaagaccaggggaaggcuguguauucaaacucauuuguucucugcuuuuuucuuuuuaauuauuaguaguuaacucuaaaugaaaguauagaacuguuuaguuugagcaaggaacacuauuuguuggccucugcuuucuguuccccuuccuucccuucccucccuuuacuguggcaucaugauucuuccuuccuguauucuuggucauucucccagcaccucacuuuagcccuacaguggagauucuucuguucacuaauaacugcaguggugucaguuucaguagaucagccuucgucuuccuuugcuugaauggaguguuuaacaugcuggauauccugccucuuucugcugaagcaucuuuccuggggucauuuugacuugcugcuuauauaacuauuauguccuuuggguuugugauacuuuauauuaucaaaagcagcaaaagauaguaauagaaguaagauuuuuauuacucucauucuaugaaucagauguuauuaucccauuuuagagauaaguaaauuaagagagugguuauaccugaaguuccagaguuauuaaaugacaugacuggauucaaacccaagagagccugacuucaaaaucugugcauugaucucuacugagucugaagguuacugacccagugaaccagucacuguucuguuucuaagaaacguuuagguucuggcucuugcagggaucuuuauaguccuguauuugcaaaaacaccucccaccuccaugcuuuccuuuuaccauuuaaaaauguuugugaagaucuuuuuuaucuuuuuuuuuuuuuuuuuuuuuuuuucugagacggggucucgcucugucaccaggcuagagugcaguggugcgaucucggcucacugcagccuucaccuccuggguuggccaggcuggucucgaacuccugaccucaggugaucugcccgccucagccucccaaagugcugggauuacaggugugagccaccaugcccagcccacauuuuguuuuuauauucugaguauuauauaguaaaaaaggagaagaguucauugauacagucuuuuaaaaacugaucucaaugauauaguaggaaaaacacuggauuaggagauagggguuuuaaguucuaauccugccuggcugugcccuuaacuagcuguaugagacuaggcaacauuuaccauuuccuucccaauuaaauugagguagccguacuagauuuaucuaacaugccuuucauugcucacaucaugcgacauuaagcuuuaauuagaaagcuuugguuuugggaccucuuuguuuucccauaggcuuuaaccuuguuuccuuucuuauugcccagcaggaauuggacuagaguuggccaaaggugggaugaggagaagagguaggaaucuuacaagaguugguuggaguaaaguuauugacaggugggaagaaguauuccugugacucugugguuguucccuuguaagauuugaaggaaaguaaugagucaggucuuaauaauagugccucuauguuauuuccuccaccccauuaucuuuugucagaauugauuagcaaaaugcacuuacccaaguauuuucagggucccuguuuggauagucuaaauaacguuguucuuuuuuuuuguuuuggagacagggucucacuuugucacccaggcuggagugcaguggcacaaucuuggcuuacugcagccucgaccuucugggcucaagcaauccucccaccucauccuccugaguagcugggaccacaggugugcaccaucacgccuggcuaauuuuuuguauuuuuuguagagaugggguuucaccauguugcccaggcuggucucaaacuccugggcucaagcgaucugcccaccucggccucgcaacaugcugggauuacaggugugagccacugcucccugccuuuaguuaccuuuaucaaccuaugguccuaaagguagauucauugaacuugccugucagugcuuaaggaucaguccugucuuaguucagacaaguuaaauucaggguugcauucugucaacuuuguuucuaaucaguggaugaucagaugauauuuggagaggauuuuuaauauaugugaaucuuaugguggcauucuguuacuuaauaaauacuuuaauuucuuagcuuuuuuccccauauucuccauaauuuuuguagauagaugcucagacgaaggcagcaguagcacauggauaaucagaguuuuuuguuuguuuguuuuaacauuucucguuaaaguauaauguucagcaauggggaccaaucuauacuccucaucuguagucugucaauaaauagguugcuccgacuuuaaauucucagcuugaauuguuucuuuuuuguguguggaauuuaugacccucugugauguugacccuaccuaaagcaaguagaauagcuacaccagcaaaaugaaauaccauaacaacaacguaugcuuauguuuauauagugcuuacugugugccuggcauggcauugaauaaauauauauauuuaauaaauagaguuggggucucgcuuuguugccuaccuuguguugaacuccuggccucaagugauccuucugccuccgccccgucaaagugcuaggauuacaggcaugagccacugcucccagccagcauugaauauauuuuuuuuuuuauuucauccugagaacaaccuuaugagguacuuucaggucauacuuuuauuacccucauuuuauacuagaaaaauugugcuuuaagauguuaagcaaauugcccaaagugcaaaaccaguguguuggagcuugaauuccaaaccagaucugccugagucaagcuuuucuuuuauguucuuauuuacuaaaggcuucuugaacagaaguaugugagaguugggcacaugcagcuuggucaauucuauguaaacccggucagauucugaguaguguagaucugauaaagucaaugugaauuucuuaucauucguugcaagagacuuaauguagcaaaaaucaguaucauaggaaacgagauguuacugugguaggcacacuguucucucucagcuaccucauuuuuguuguuauuggugguggcuauugcucuggcaacuacaaaggcagcauuuacuugacacggcguguaugcuuaaggcagaacacugacugcuuuucauugcuggcaaauccggacuucaucaguacuggcuaccuguaaggaaugugagcauguuggauuuuagaacaggaaaaacacaacuuccaccucauuucacaguagaguucacuuagggauacagacuuuuuggugacaguaacuguuacuuucugcuuauuaauucagauacuugcauaaugcuaaccugguagauauugucagaugacaagccuuccuccuacauguucucuauaaaagaacugcuagugacaagcauuuuauuauauuaaaaauucuacuucauacuguuuuaaguuaaaauguauuuauuaugaagccaauauugugaaauguuuuuuucuuuuuccagaaugugguuuuuuuuucuuguaauggacuaagaugcaggcuuauuguguagaaugaggagcuauugcccagauggaccuuagugaaaguaacuuaaauaagcaaguagauuuugcuucuguuugggaaaaugaucuaagacggaugcugguauuuugggcagguggagacuaauguuuuaucucaauguuugcaacuuaaguucagccuacuuaagggcugucccuuaaggguguccaauuguuuggcuucccuggccacacuggaagaauuguguugggccacauauaaaaauacacuaacacuaacaauagcugaugagcuaaaaaaaaaaaauugcaaaaaagugugauaauguuuuaagaaaguuuaugaauuuguguugggccacauucaaagccguccugggacgcauguagcccacaggcuggguuggacaagcuuggucuagaaguuuucuagauuuuacuacaauguucaaauggcaaacuuuaaaaguggggaaaggaauuuugggugagauaaaaagacagguuugaaaaagcauacaaguucagggaacugcaaaugguuucuuaagaccaaagcgcaaugucagugugaagaaguggcaggcaaugggaaaggauaaaucaguggagcccagacaaugaaggagcuuuguacuugaugcugaggaguguggauuuguuucugcagauaauggggaacuucugauuuuucuuuuuuuagguggacagauagaaucaaguuugcuuuuguuaauucaugugacaauguagaagguggacugaagguagggagaguauuguauucauuggagacucauuaauuguuagaagacuauuguaaucauucaagcaagaaauaaugaccuaggccagguacagugguucaugccuguaauuuuagcacuuugggaggccgaggugggagaaucguuugaggccuggaggcagggucuugcucuguugcccgggcuggaguucaguggugugaucauggcucacugcagccuccaauuccugggcuugugauucucuugucucagccucccaaguagcugggacuauagacgugagccacugugcccagcucaaauuacuuuauuuuaaauuuuuuuuuuuugagauggaaucuugcuguguugcccaggcuggagugcaguggggcgaucucagcucacugcaaccuccaccuccuggguucaagugauucuccugccucaaccucccaaguagcugggaauauaggugcacaccgccaugccuggcuaauuuuuguaguuuuaguagagaugggguuucaccauauuugucaggcuggucuugaacuccugaccucaggugaugcaccugccuuggccucccaaaguguugggauuacaggcgugagccacugcaccuggccucagauuacuuuuuauacauugaaagaugaccuagaaauuagucaagacauuaauuuagauagucauacagucaagugacauaaaccucagagaagaggaagguuuccgugcuaucgccccacccacuagaguggaagaacuuugagggagauagaauagugauauuauaaucuaguuccuauagauaaagaauguuugccaagaagguuaacuucuguagcugagcuccuuugcugagaagaugaaggaacacuguuuaauggauagauuuagucugugauucucuguggaggugauuacugucaguucucuuuauccuagcagcauuuggaaaacugcagcuaagcaacccgucgucauuuccuaauguuacuauaaucuggugucaaugacuaaugaucucauugggcuaguuauucccuuccagcgaugcuggcaucaggaagcacauuaauagucuguaagaaaugcauucauuaaaaaccagguaaucacuuuggagcugguccuggcagugucugaauaaauuggacaaguuagagaaaaucuugaaccugaaagcuacuuugucuuucagcuugguuugggcaagguaggaagagaugaaucaguuauaauuugaugggaucuaauguuacuuuuauaagauacaucacuuuaauaugaugcuucaucauuaauguuuuaguaaucugacagcauuagacagaauugauauuccccuuauuuuauuauuucuuggcuucaugacagaacugugcauuaaaaggcacuuaagauuuuaaaagggauaucuaagaaagugguuaaaaaacaaacaaaucccaaguggcuugaucugacuuacaaacucuaacaauguguagcuaauugcagauagauuuuauuauucacaguauugugucaagucuccugugcacaucuucuguauuggagcauaaguaauggagauguuaucuugcccaacauuagguuugaggaagucguuuuuaagacagaaauaguagaacaguguuauuccauacuguacuuuccccuuuuauauaagcuugcuaaaauuaagguugggcaauaggcccuugagcuaaaugugaccugauagaaaguuuuagcaacaaugaaaaaaauuauaacuaucuaauauacauaucuaauauuagauauuuaccuuacuuacauaucaugcacaaucaaacaaauggcaauuauaacuacauucuuuuuuacuugccauaauggaaaaacuuuauuaaacaaauuaugcccacuguugcucugggauuuggggacuagguaggcaugauuucaauggaaaauaauuuaguaaugguaugucucaauaauguaucaacaaccuggaaaguauauauucuuugacuuaggauuuucauuucuaagaauuugucuuauagaaauaauaguaggucaaaacaagaauguagucauaagaguauuuacugcaauguuguuuagaagagggagaaaacaaaugaaaaugggcugggugcaguggcucacgccuguaaucccagcacuuuggaaggcugagguggguagaccacuugaggccaggaguuugagaccagccuggugaaaccccaucucuacugaaaaaacaaaaaagaaaagaaaagaaaagaaaacaaaaugccacaaaaaacaaagagaugaaaaugaaaagagaucucacaagacauaugaauauguugcacuucaaacugaugcaaacagguguccaucuaaauucaauagugggcaguuagaauuugaaacuuaguugucauugaugauugcccugugcucagaggaaucacagauuaaaaaaauuuuuuuuagaaagaauugaaguugaguuucagaaaagucagacauuuaaguuuacaaccguaguuggagugcaaacacauauaugucuuaauuacaaaaugucuguucuguuaguacaacuuagcauaaagaagagauggaccuacaagugaaguauaucaacugauaagaaacaaaaugcuuuaaaacuuuggauucaaaccuaugauuccagaacuguucuaacauuuuaaacaauauggucaaacucuaggcaaguuugguucccuuguguuugugaaacuauauuuuucauacaucuucugaaguaaaaacuaaacacucucauuaguuguuuaaaucuggaauuggauuuggaauuugccuugauuuuauauaccuuuguucuugaggcuaccuguauuugucaguuuuaucuuaacuuacucaaaaugggucacuuaguaaaaauaauugucuaacuauacacuuuuaguuugauuaagcuuuuuggauuaguuugggauuuugacuaaguuucuauauuuguaugaucaauaauuucauacuuauaguaaacaaaaauuuauauaucuguacuccuauagauuuaugauucuguggcucuaaaaauuucagugcucuuagaguuguggaaagagcagagcacuagauuaaaugaaaccucugugugccaggcccuagcugggcuuucucgaggcauuagagugauaaaguugguugaggaaauggugaaagccauaccuuuguccugccauuuuuuuucuuuaugagaucaugguugaagucccugacucucaugauagugaaauugagauuuuaaauauuuguuucucuuuacaucccaaauccauuauagcuaagaggaggaauuucagauauuuuuccaagagcgguugucaauuuuuuuuuuuuuuuuuuuuuuaagacggagucuuguucuuucgcccaugcuggagugcaauggcaugaucucagcucacugcagccuucgccuccaggguucaagugauucuccugccucagccuccugaguagcugggacuacaggcgugcgccaccaugccuggcuaauuuuuuguauuuuuaguagagacgggguuucaccauguuagucaggcugguuucaaacuccugaccuugugaucugccugccucagccucccaaaguugucaguauuuuacuuacuuuucuuuccuugcauauuggaauagcuuuuuuuuuuuuuuaaauuaucauauacacuaccuguggagguaaaaacauaaacuguuguuuucuuggaggcugaggcaggaggaucacuugagcccaacaguuugagaccagccuggguaacauagcaagacccugucuuuauaaaaauaaaaagaauuacuggguggugugcaccuguaguccuagcuacuugggaggcugagucaggaggauugcuugagcccaggaauuuaaagcugcaaugagcuaugauuauggcacugcacugcagucugggugacaaagugagaccccaucucuaagaauaaaauaaaauggaauuaacauucacugucaacaaaggcacucuugugccguuuuuguccccuucuugacuguccuggucguaugagaucuguuuuuccucuaaauucauuguauacuauuuucuuuacauuguacauuuggccaucucugggaaaauguuaagaauguuaauguucucauuuuaguauacugauaucucacuuuucagaauaucaccuuccuaaucuuuuucuuuagucauuuuauccaguuguacuuauguaagcuaccauaaacuuuuucugaaucaaagcaaaauauaaauuaauaaauguuugcuucuuuaauaguguauauuuuauuccuuuuaucaaauuuuuaagucaguaaguacugugauuuaagaacuuuuuauccuauaauacugaauaaaguguuuugauauagaauacgguacauagauguagauaugcauuuagugccuugcauauuuguugaaugaaugauuacuacacauaugagcuaagucagcuguuuggggucuucuuuuugccugcaucugauuggcuugucaagcagacugacugcccaccuguuagacccauaugggcuggcugaguauauagcuaguguuuugcucagcacaccugcuugugcgcauggauugaugucugcucuuaaacuaguugccaaggagucaaguguauggcaaggugaaggaagacuggcagugaagauaucuuaaagagguaaucuaauaauaauggccagugguuccccugaaucuuguuugcucaaguuguucacaucagagagauguaaaauugcuuucauuuggguggauuugggaauucuuuuuugauaaugggaaaaaaugagaagguccucuaugauauuguuguggauggaugugcauauggucagagaacaugaaccuguuaaauuuugagcuugaauacuuuucauuaacaacuuaauugagaauagcuagauagcaucuauuguuuauucuuuuuauaacaaguagagaaauagagaaaugucuuuuuuuuuuuuuuuuuuuuuuuuuuuugagagagagucucccucuggcgcccaggcuggaguguaguggcgcgaucuuggcucacagcaaccuccgccucccgaguucaagcgauuccuaugccucagccucuugaguagcugggauuacaggugcccgucaccacacccagcuaauuuucauauuucuaguagagaugggguuucaugauguuggccaggcuggucuugaauuccuggccuuaggugauccacccgccuugggcuccccaaguguugggauuacaggcgugagccaccgugcccggccugagaacugucauauuuuuaauccuguugggucucccccuucuccugucacuguauuugagcaaguuuauauaaauuauugauauuuuucuggccacaaaagugcagcuauauuuaagauaauauuuuuuuauuuucacccucuugacauaaucaagccauaacaugaaauggagauuuauuauuuauuguuuauugaauaaaauuuuguuccuucuucuauuuuuuuuggagacagaaucucauucugucacccaggcuggagugcaguggcacaaucucggcucauugcaaccuuugucucccagguucaagcgauucucaugccucagccucccgaauagcugggauuauaggcacacaccaccacaccuggcuaauuuuuguauuuuuaguagagacaggguuuugccauguuggccaggcaggucucgaacuccuggccuaaaaugaucugccugccuuggccucccaaagugcugggauuauaggcaugaaccacugcacccagccagaauuuuguuccuuuuuaauaauuaauuaauuaauuaauuaagaugaagucucacuauguuguccaggcuagccuugaacuccuugggcucaaaugauucucccaucucagccuucuaaguauuugggacuacaggcagguucuaccacaccugacuuguuccuuauuuuagauguugaaaauaagcaagugaaauaaaggcuuaucaaaguguacacagcacuuugcuagauacuguggaugauuuuucagggaagaugccauuccuccccugaagaagauaauuauuguagaguuagagcuaacagacaaaauagaugauauauaaauuuauucuuaggagccagguuguugagaggauuaagagcaaucacuagacgauuagaauauuggggacuuccaaaacaucugaaguguaucuagaauaguagauaagaucugcacagguaggaaguagggugagccggguguggcggcucauaccuguaaucccagcacuuugggaggguugagguggguggaugccuugagcgcaggaguuugggaccagccugggcaacauagugaaaccuugucucuacaaaaauacaaaaauuagcugggugugauggugcacaccuguaguccuagcuacucgggaggcugaggcgggaggaucuccugagccugggagguggagguugcaaugagccaagaucacgccacugcacuccagccugggugacagagugagacccugucuuuuuuuuuuuuuuuuugagacggagucuugcucugucgccuaggcuggagugcaauggugcgaucuuggcucacugcaaccuccaccuccuggguucaagcgauucuccugccucagccuccugaguagcugggauuacgggcaugcgccaucaugcccagcuaauuuuuguauuuuuguagagacaagguuucacuauguugcccaggcuggucucaaacuccugaccucaggugacauaccuaccucagccucccaagugcugggauuacaggcgugagccaccaugcccggccugagacucugucuuaaagaaaaaaagaaaaaaaaaggagugaaaguagaggugagaagugccuggaaaacgggacuuuuaaacugagcuugcugcagagguggacacaaaaauuuggggcuguuuuguuugaggaaugaagaauagcaggacaaaaacagauuguuuugggguugguauuaauaauuguauagguagcguggggaaaacuuuuagagagccuuaaaagcugaacccguauguuuuaguuuggugugaguaaacguagauuccuggugcucuguaacaggaguguuugucgcaguuuaguccgacagugauggcuuauaguacauaugauuguggucaagaugaggagauuaauuagcuaaucccaaagggauuucgugaucauuuauugaauccuuaccaccaagcacuuuuugucaugaaucauuauuucaucuaaaccuggcaacugcccugugaguuugauauuguuauaauccucaccguaacaagugagaaugcugauacccagcaagggcaagcaccuuucuuagggucacaaaacgaggaaggaguagagcagucaguguggcuccaggaaccagaaucuuaaccacuaugcucuaaaguguuuuucagagaaaggaagauuaacauucuuuccuucgauguauuuuuuuccuugcuaauucccuaucuccuuaccuacaauguggcuuagugaucuuaggacaaagguuuggcuuggagacuucaaagagguuuguccauuucagacucuucaaaaacaguuacugguuacuuacaaauaacacuuuguaauucaauaacugaaaaaucaaaacaacuuuaaauagauuuuaaggcuggagaagggaggcuagcuaauuucauaaauuuguugaaguuugauuuucuuuacccuaguuguaucauaaauaggaaugguuuuuuauauuuauacuuguuuaaauauacuguuuauaccuguuuaaaugcuaagccaacaaaagcucucugaaagaauacaugcacacaaacacaugucuguuucgucacggauguguaacucacucaugguugcuccuccugaugucugugugccacacaguucggaaaaggcacuugcuuggcugucacgcuguaaguucccuuugucauuugugacaauuggucucuuugcuguacaucuuuugggaugaaggauugagcucuuguaaaagcauuucagagguuuuucagcuaaugauuuuuccgcucauucuuuacuguuugguuuccuaggcaacccauccuccccuugcacccugcugacgucuguucagccccucuuccucuccacuaccccucccauuacucaaguuguuuuuucauugcugcuuuaggauugcacuaaaggaauauacauguuuuccuaaauaucugcuccucuauacuuuuuagaauauauuagaaggaugggaagaaaaaaaaucauuuuuagaagcuaaguaaccuguauuuuuaggucaguuauaacaggguuucauccauauaaggcuaaauuuauucuguuguuucuagguugguuuucuuuuuuaaaguuaaacaauaauaaagaaauuguuguccauuuaaaccaggaauuccauaauuaagcuauuuuaggaauguaagguguuguauaggaaaaaacagucugaaaauggugggcauaguugcguuucuagaugguuaugcugugauuuauuuuuuuaaaaaaucaguugugucuguuaaaagcauuucuguuacuguggggagggguuuuuaaaguuuuaaaaaucuagcuuuugggugagugcaguggcucaugccaguaaucccaccacuuugggaggcugaugugggaggaucaccucaggccaggaguuugagacccaucugggcaacauagugagacucuguuuauuaaaauaaaaauaaaaguagaaauaaaauaaaauaaaaaucuguuuaguuguuguucacauuugguccuuuagagauacuuuuuugagacagaaucucacucugucacccaggcuggagagcaguggcaugaucacggcucacugcagccucuaucuccuggacuuaagugacccucccaccucagccucccaaauagcugggacuacaggugcauggcacuaugucuggcuaauuuuuaaauuuuucuguagagaugaggucccuccauguugccuaggcuggucuugaacuuuugggcucaagaguccuccugccuuggcuccccgaggugcugggauuauuauagucaugagcuacugcuccugaccuagugauaacuuuuugaauuccaauuccuugauccuuuagcauccuaggcaaagacaaccauuucugcuggguaaagcacagugaaaagcccugcuucucuguauacaaaugaaacagauuguacaauuaauauguauugggugcugcaugguccauccuaacaguagugcuaauugccauaucauuuauuuuuacauuuggaaguauuuuacuuuggccucaauguaauuuuguuuuuuuaaugcuguagaguguaugggauauagguaaggaguggauaagaaaggaaacaauagaaucagaaauaguaagaauugcuauauaaaugccuuucccuguaaaugcacacaaauauaugagguguuuuuuuuugggggggggggucuugcucuguugcccaggcuggagugcauugguaggaucuuagcucacugcagccuccaccuccuggguucaagcaauucucuugccucagccuccugaguagcugggauuauaggcgcccaccaccacgccuggcuaauuuuuuguauuuuuaguaaaaaugagguuucaccauguuggccaagcuggucucgaacuccugaccucaaguguucugcccgcuuuggccuccgaaagugcugagauuccagguaugagccaccaugcccggccacgaguuuuuuguauguaugucuaaauacguagaaagacaagauuuacccccuuuuuuggugucuguaauaaauuuagugauauacguguauggguguauauguauauagauauguaugcuaugaguuagaaaugaaaaaccugccauaaaagcaagaggaaggaggaguuaauuuugccugaagaugucagagaaggcugcauugaaaaaauuugccauagaccuggugauaggagauugaaugggccuuacuagcuguguauagugguuuguaccaaaaaguauggggauaggaggggaaaguggcugggaauauuggaaaaucuaguugaaagauagguugaaggccgauugugaaauaguuucacuuacuuuaucauuuaaguaauagguugguuagaccuuuuagaucagaucaguauuuugagaguaucucuaauaguauagaauuauuuguacuucuugacugaaacuauauguuaaauaaugaauuuguaacuuaguuauuagaguguucaaauuauaccuguuucucucccuucccucaauuuuuagaaagcauucucuaaugaggcagggguuuuuguuuguuuugagacagcgccuugcucuauugcccauacuggagcgcaguggcaugaucucgacucacugcaaccuucgccucccggguucaagugauucucaugccucagccucccuuguaggugagauuacgggcgugugccaccaugccugguuaauuuuuguauuuuugauagagacgggguuuugccauguuggccagcuggucucaaacuccuggccaccuuggauccgcccaccuuggccucccaaagugcugggguuacaggcaugagccaccaugaccagccaaggcagguuacuuuuauauugguuaaaagagugccugauauuaaauccuuagucucccacuaaccagcucucucucugaccuuggaugagccuuaaacuuugguuuaauucauuuguaaaacaagcauaauaaugccuaccugaaagaacuguugugaggauuugauugaacgggauaauauguaaagcacagcucuugacacacuguaaauguagcugaaaaauaguagugauuauuuugugguaacagcuuucauuguagaagaaaauuaauggaaugugaaggauuaaugauuuugggagguggaggggaggagaccuuguuaaguagauuaauuaggaaguuauugguuuguccaaacagugcuuuuaggugacaagggaauucaguguggaagaggagguuugguaggagaagaaaauauaaucaguuuaguuguagauggguugaguuuaagguacccaaggacacaaagguaauacuguggagguggcuguuggaaauacgaagccuggagguacgaauguggaaguuauugcugucugguuggagauacuugugucugggaagagugaucgagugaguaguggccuauuaauguuuucuuuuuuuaaaaaauuuacuuucaauauacugccaauaaaguaauuugcacuguuauacuaagguauuagaccacguauucugaguucagauuuguugcuugacucguuaauguauguagguuauacccaguuuugguaagccuccugaccuuuggccccauucacagcauuaucucuaucucucaaagggaaaaagaaguucauucuuugaacuggggagugcucugauguuggcaggucuacuccuccucaggucuagacacucuuggccuccacagugguuuuauucaggaaaguucucaccuuugaauuguagacuuagugcagacuugcugguaguuggcuaggcgggaucacaacagugauugguauugguaaguacauguauugcugccaagaaguugcauaguucauguguucagucauagccuuuucuuuauaugacgaccccgcugaaauacagaauggccugcugccuucucacagaaggucuacuguuccaagcuuauuuuuuucugagugagaagaaaaggucuuuugccacuguuuucagacugaaauuuaaauuucagcugccuuggauccuauauaauaaaagauugagacacagaaauuguucuauuagacuugaaauuucaauugcuuuuacuucccaguuuguaguaguguuugaaccuaaaauccuauguguguuuuuaguuaccuuuucaaguuaaacuuucagaaacuaucugcuuaacuuaaaaauuuacucuuguuaauugcccaaccacaucuuacuucaugugucaaaaucugccugauauuuuuaauuuggaaguccacaguagugggaagucauaggaacucccagucaggguauucacaguaacuacucacaguaauaggaacucacagucaagucuaauuuuucauuuuaauuuuuccaaucccuucuuuacuucuaguauacuaauugaaaaaaaaaaacuuggguugccuuuaguuucaauuuauaauuuuuauuaggauuuuacugauacuguaucuuuuugguacuggaggucucagaggacugaccugguucuacuuguuugcucuugggauuuagaacgauaguuucuauuguguugagccagcaacauuuugcuuauuuucaagaggcagaguggcagaguacuaaauugcaagguugugcagaccuuaaauaaguguauggugagcuauaaaguuacaauguuaaauuaguuucuggcuggcccacauuguuuccaaaguugacuuugcauuuuaaaagaccuuacugauuuaaaaagcgaauagagaacugcuuggaaacacauaucaucugagagacauucgaacaugcggggaaaaaaaaaaguggaaggaaaggugcugcuggcugggcaucauagacuagaaagcugcauuuaaaguuuaaacugcuuggguaagacauguuuuccugguuuauccucauguuuuuuuccaucuguguucucuugccauuauuaccaccaaauacaggagaauacuccuuuacuuauuguagucuuauuugggagacagacuagaguguggauuauguagggacagaaagggagacuugaggguuuuuuuuuguuuuguuuuguuuuuucuuccaguauuuagguucauugauguacagggcauauguugucuucuuuuagauuuuucagugaaguuuuguacuccucuccauaaaacucucacacauuuauauuuauacauauauauguaauauauauauuauuuauuuauugagaaagagucuugcuuuguuaccuaggcuggagugcaguggcaugaucauggcucacugaaggcucaaccccaaagacucaagcaauccuuccaccucagccucccaaguagcugggaccacaggugcacauuaauaugcuuggcuaauuuuuuaauuuuuaaauuauuauuauuguagagauggggucuugcuguguugccuaggcuggucucaaacuccugagcucaagcaauucaccugccucggcaucccaaagugcugggauuauaggugugagcaccacuggcugggccaauguuuuuucucuuauaauguuucuucugauacuuuguggcuauucugaauguguucuuuuaaaaauuaucauuagaaaguuacuucauuuuucuuuuuuucuuuuuuuuugagucagagucucgcucuguugcccgggcuggagugcaguggcgccaucucggcucacugcaagcuccgccucccggguucacgccauucuccugccuuagccucccuaguagcugggacuacaggcgccugccaccgugccggcuaauuuuuuguaguuuuaguagagacgggguuucaugguguuagccaggauggucucaaucuccuugugauccaccugccuuggccucccaaagugcugagauuacaggcguuacugcauuuuucugcaccaggaucucuuuauuuuguacuuaggcuuugcuugcucccucuuugcuuuaguuucaucaucugugaaacaaagggguuagguuagaauaagaaauuuccaaagaucuuucuacuucucacaguacguggugcugugucgagguaacguccuuuacauaccucaugaaguuagugcuaguuguaccauccaaaccacacauaaguucugugaauacaaccaaacagcuuuguucacauguauuugcauguguuucaacuuaccguguucucugcauaaugauucuucaacaguuugagguaaagagugaauauuucaguuuaaaaauacagucaaaaguauaguuucuuauucugguggacgugguuuacuacuaccuccucccccuguguuuuaguuuguugcugugcuaguuuuauugcauauuuucucuccuaaaaauagauggucuuuaucuaaagcguaguuuuuauaaauauuugcaucucaaguaaauuuuuuccuaccacauggauuucauguggugaguuccaugaaagcagguuguguuaagagggcauucuccuaguaccuguuuauucuuuuccauaccucugccccaaggaucuuguuuacugaugucagaauacuggcaguuugaguaguacucuugaagaguuauuuuuguauuuauuucugcuggauugaaggagguagauguuguacucauuaucucucagaacaucuauucaauccuaacccccaaaauauaccuuagaaacaggcucucuguguuuuuuuuuuuuuuuuuaaucuuuuaugaagacauacaauacacacauuucucuuagaugcuggccaggaauuuguuugaacaaauugaaauggcaaguuuuaacccuaauuugaauagaguuccagaaaaugaaguuagggcagagguuggugaggggucauauuggagugucacugagcuaguaccaauuuguuuguuuguuuugugguaaaaugcacauaauauaaaacuuagcauuguaaccauuuuuaaguguacgguucacuaguguuaaguacacuuguauaguugugcaaucaaucuccaggacucuuuucaucuugcaaaacugaaacucuguacccauuaaguaacaacuccucauuuccccuucccuccagccucuggcaccaccauucugcuuucuguuucuaugaguuugagccaguauuuguuuagcuuuuucauuuuugucuugagaacuugaccuucuuuaugacagcuaaauggauguugaacaugaagaggagaguaauccaguaaaacugguagccacucuucaugauccaugaguguugguaguugccaaccccgaaauuagaguaucagucagucuucuguaaugcaguuuggaaauugcuauuccuuguguuugaggaugaugacaauagcuagugacuaacacuuacuugguacuuauuacaugccugagguuagaggaaagaccugcuucugggaagaaagaguaaaggaaagauugggugcaugacaauguauagauacauaaaggaaguucuugucuguuuucucuguuaagcucaaagcuaagucaucuguugaaaguuagggggcucagguugguuaggagguuuaaauaaagugacagauguuugcaauuaccaggaaaugggauagagacucaucagggaaaguagaauaauacuaacaguauuagugguaauaauaacaacaacaagaacagcuaauaaugacuaguuaucuguucuaugccagcuacauuuuauguuguaaucuuuauagcaaccuuauuaaaguaguuguuauuacagguaagagacuaaguugcagaguuaggaugccagugucacucugcugccccaagcccagguguucuuuccuuuuucugcacuguuaauggcauugggagugucugccugacacuacaaaccagaaguuuagaguauaauuuuuagaaauuguucuucagagaaaggaggaagagugggcugaaguaaacgcuauaugucuaaaauaucacaauuauguugacuuuuuuuugccaccagaaugauugaugcccuugaugggucauuucacuaaauaaagugaguuaccacagcccaguagaaacccagaucugguugugugaccuuaauagagguaucugaaauuauaaauugauuuucuuccaauagcccgcaucugaaauaacuggauugagguucaugucaguaaauucuucaauuucuauguagggaaaaaugaggaccuuuuuguuuguaauuauucuauuuauugaacaguuauuaguuguacuucuaaucuguacuagaagacuauauuacaaaguguuuauuuucccuaaacaauggcuucucuugauucguguucauuauugcccuaaauaaauugaaauuuagaaaaagaaaaacccaguuuucuuaguaucauacaugcaagcuuaaguuuucuuauuuguuuguuuuuauuugacauacaugaagguuauuuccaaagauacaaauggaggccaaaacaguuugacauaaagcagaccaaaacagauugaauuauacuguaccucuacacugacuagcauuuugaugucuagauggauaaguaagcauagugcuaauuuacaagcgcaaacucaacuaguaagauuaacuaauuucuaggcuguaaugaauuuauauaaauauucuuguuauucagaugggaaaccucauaacugugcuguagauuagacuugcauugccuaaaacuggagaauguaacuuuuuuuguuuuuuugacaaacccacagccagcaucauagagaauguaacuuugccucccaaaucuguguaugucagaucacuuauaauuggagcugcacaguucccucuucuagguuugacucuuuaaacuugguaacaucucauuaggcuaaaugaauucuccaugcccuauugucugucuugcuauguugccuaacacuuugauuuuaacauuaggaaaacaacuaccaauaaacaugagauaaaacacaaaauagaugaauaccacuagcuugguaauauaaaccauuauauaacagggauuugcugcagacucuuuucacacauagaaaacuuuuccaaaagacauuuuugaaguuucgcuaugaagaaaguuugccagugacugaaagaaccuuuuguaggucccuauuugggagugcgguaacuggugcuucuggacucuauacacagagauccaaggcuaggaaaauaucucaggguaaagcuaucuaaguuuuguauccaaaagcuauuaauuucuucaguuaugagaagaaaccacaaauugcguaauggccuugguauuuuguugguauggagagaaggaugaucucagaagacuuguaggccugucuuggggugucugugguguguguguguguugcuuuuuuuccaacuuauaaaaaaacucaacaaucaaucuuagccacguuuuugaaaccguagauauucuaaguuagcaaauccaaaucaguacacgaaacaaccauuuuugccagcaccaaaugcauacuuugcugagcuuucguaucugggcuccagaguuuauucauagcaaauucugacaucugcuaaguucuauuaugacccagaggggagcgaagugaaguaggaugaagaaucuggaaacgcaugcugcuuauaggguaaauugcauugaggaauuugcauccauguagccuuuccccuuauggaccacugugacguuuaguaggcugagcuaaaaggucauauugcucaagaugaauaacaauaaaugguuuguucagugacuuguuaagccuacugccagugccuacuaauagccaaaauagcuauuucucuucugggauauaugaguuuggcugucaucuuuuugggaauaugguaauuuguagccaucacuuucagugugguggggagaucuaacauuuaaaaguucuuaucccagugguuuacagaucccuuuucccccacaaaccgcugcugcuucuuuugaaccuugaaugcuaccaugguuuaauuuuuuuuuuuuuuuuuuuuuugagucagggucuugcucugucacccaggcuggagugcaguggcaugaucaugacucacugcagccccagccgccuggacucaagugcuccuccugccucagccacccaaguagcugggacuacaggcgugugccaccacaccuggcuaauuuuuagaugggauuucgcauguugcccaggcuggucaagcaguucucccaccuuggccucccaaagugcugggauuacaggugugagcccucaugcccggccuuccuuugcuuugcuuuucuucaguugugguucaguucuagaccauguuuacaguagauacaggggcacagcucccaauaguguuuaaaacaugugaaguaucggggcagaaguuagcaccucuaauaaguuuaaauucccucggauuugcuuuauaggaaguauguuaagaacauuuuccagagcauuuucauucaacugauauauuuuacauagcugccuuauuaaaauacagauguauucuugaaauuauugaccaauuuuuuuuuuugagauagucuugcugugucgcccaggcuggagugcaguggcacaaucucggcucacugcaacuucugccuccuggguucaagcgauucucuugccucaguuucccgaguagcugggauuacaggcgcccuccaacaugccuggcuaauuuuuguauuuuuaguagagauggguuuggcauguuguccaggcuugucucgaacuccugaccucaagugauccauccaccucagccuuccaaagugcugggauuacaggugugagcuaccaugccuggccgaucaauuuuuuuuuuuuuuuuugagacagagucucgcucugucgcccaggcuggugugcaguggccgaaucuuggcucacugcaagcuccgccucccggguuuaugccauucuccugccucagccucccgaguagcugggacuacaggugccugccaccacgcccggcuaauuuuuuauauuucaauuuuuaagaaaugaaauaagaugaaugaugaguaauuccuuuuucaguaauauaguagauuagauauucagagaaauccccucgggucagaaauuuuuuuuuuuuuuuuuuuuuuuuuugagacggagucucguaccgucacccaggcuggagugcaguggugugaucugagcucacugccaccuccgccuccuggguucaagcgauuauccugcuucaaccuccugaguaacugggacuacaggugugugccaccaugcucagcuaauuuuugcauuuuuaauagagaugguuuucaccauguuggccuugaugucuugaccuugugaucugcccgccucaaccucccaaagugcugggauuacaggugugagccagcuggaacauuuuuaaaugaggcuaggaaagguaaaaauguaugagcacauauaauauacauauaacguucuggaacuaguguaagaaaaauaauugaggccgggcauaguggcgcacgccuguaaucccagcacuuugggaagccgaggugggcaaaucacgaggucaggaguucaagaccagccuggccaacauggugaaacccugucuccacuaaaaauacaaacaauuagcugggcguagugguaggcgccuguaaucccagcuacucgggaggcugaggcaggaggauugcuugaacccaggagguggagguugcagugaacugagauugccccacugcacuccagcccgggugacagagugagacuccgucugaaaaaaaaaaaaaagcaucauuucauaaggcagaggaagcccugaaggugguggugguucugaggguuucuuguaggauuagaggaaaguggagggacaagagacaaguaguaccuaagcauaguggaagguccuacuggagacugucccagauggaacugggacccuggagggugcaagucuucagugcaugaguagaaaaaagauguccaagauguccugcaugcagagacuugccucuuacugucuuggaucugguuggagaggggaaagaagccucccaugugauugccuaagcagacgcccauacucaaagauuugcagucagauuuuauacuaccugugaggacugaaaaucucuaaacugaaaacuuaguugaaaguauuccuauuugguuaugguucccagugucugggagaaucaaauucauaucucuuuuaaauuaauuaauuaauuuuagagacagggucuugcuauguugcccaggcuaguguugaacuccuaggcucaagcaguccuccugccccggccucccaaagugcugggauuauaggcaugagcuaccacgccuggcgaaaacacacuuucuagucaggccuuaaagacuuuuaauagaggaaguugcaagaaaugugaguuugcguaagaaaauaagcaacuaugaguugguuauuuugagucagauggggcagauucuauuuuccagauauggaaacaguauuuccugacuccugcucuucuagaaccucacuauuguacuaucaagaaguagaaucuuuuucuguugaagcugggcaguccuuugugacugcuuugaccaaaagaauaugacagaagugauauuauuucauuucugaggcuaagucauaaaaauaccacacauuucuuuauucucuugggaugcucauucuuggaacccaucagcauacucugaagaagcccauggagagauccauguggaaaggaacugaggucucaggccaguggcaccagcuauaggcuuccagcugauggucaguacugacuugccaucuuuuuaaguaagcgauccugcaaguggauccuucaguucucuaucaagcugcccugggugaugccauguggagcagaggcaagcucuucucucuaagcccugaacagauuacuaauuugugagcaaaauaaguaauuauuguuauuuugauccacuaaauuuuggagugguuugauaugcaucgauugacagguaacuaaacaucggugguaaccaucagucuuauaaagccuacagauguuuaaagaaauaaaggaggagguuaaaaauaugaugaggagacucuuaaaacugaugaggaaaauauggaagaagaacucagucucuguagaacuucuagaaauaaaaaacaugcagaugcccccagacuuaugaugaugaucugauuguaauuuuucuuucuuuauuucuuuuuuuuuuucgagacagggucuugcucuguugcccagcuggaaugcaguggcaugaucucagcucacugcagccuccgccuccuagguucaagugauccucccaccucagucucccuaguagcuaggaauacaggcaggcaccacuauacucagcaaguuuuuuauuuuuaguagagacaggguuuuaccauguugcccaggcuggucuugagcuccugagcucaagugaucugcccacuucggccucccgaagugcuggcauuauaggcaugagccaccucagcugaccugauuaugauuuuucaacuuuacgauggugugaaagugauauucauucaguagaaauuauacuucaguacaguauucaugaaauauucagcacuuuauuguaaaauaggccuuguguuagaauucaagcugucuaaaccaccuuguuuuguuuuguuuuguuuuaggcuuuuagcagugugaagccauuguuuuuaguuucucucucuagugauaagcggaaaagaggguugaggaaggggcuuuaccgaaccaaccagaaacaggaacuaagaacccaagccuguguucccucccuuggacaccccuguaagaugauuuugcucagucguaggcuaacaucaguguucugagcauauuuaagguggaccaggcuaugauguuugguaggcuagguguauuaaaugcauuuuugacuuaguaauauuucaacuuaugauggguuuauaaggacauaagccccuuguaaauugaggagcauuugcagcgaaaaauacaguggaaagaggauacagaguagaguaaauuaaugaacuggaaaauggaucugaagaaaauuucuagaauuuaguacagagaaagaagagauggaacauaugagagguuuagugacauagagaaugagacgauaacaucugucugaucuaguggaucccaaacuuuuuaaaucuuaggaucccuuaugccuuaugcucucucucucucuuuuuuuucuuuguuuguuggagauggagucuugcucuguuggccaggcuagagugcacuggcaugaucuuggcucacugcaaacuccaccucccagguucaaacgauucuccugcuucagccucccaaguaacugggacuacagguguccauuaccacgccuggcuaguuuuuguauuuuuaguagagaugaggucuugccauguuggucagucuggucuugaacuccugaccucaagugaucugcccaccuuggccucccacagugcugggauuauaggcaugagccacugcacccagccuacucuuuaaaauuauugaggacccaaauugcuuuuguuuaugugaguuacacuuauaauuuggccacauuuuugcauauauguuauagauccauuaaaaguuuacuuuaaaaaagaaacaucauagagugagaaggugagccacaacuugggaaauguacuaacaaagguuuguuagccagaauauaaaagaacuccucaaauaaaaaaaaaaauuaggaaaaauggaaauaggaaagucaugaaaaaguuaauuuuacaggaguagaaacaaaugguucaugaacauaugaaagauccucaacccuuuuaguaaucaagaaaaugcaaauuaaaauggcaaggaacugucuaucuccugcucgucuccuuucccccaccaaacagggaaaaauuaaaaauauaguuacaguuguuagagaugauaugagcaguaggagcagucauacuguuagguaccuucauuuuugaaaacaauuuggcuuuaccuagugaugccuagguauguccccuagugaaauucuugugcgcauggcuuaagagacauauguaagaauauuuuaauuauuguucauaguagcuaaaaauccaaacaacucaaaugucuagcaacuguaaagcauaaauacaguugguauauuuauaaaagggugaccucugagcauaaaaggaauuuaagugccacuacaugcaucuucguagaggaauauuccaaaauaguggggaucaaaaaaggcaguuagaaauaauaaauacggggugggugcagugguacaggccuguaaucccagcacuuugggaggcugaggcaggaggaucccuugagcccaggaguucaagaccagcuugggcaacauagcaagacccuuucccuacaacaaauuaaaaaaaauauuaucugggcauggugguguguacccguauuucuaguuacucagaaggcugagguggaaggaucucuugagcccaggaguuuacagcuacagugaguuaugcucauaucacuccacuccagccuguacaucauugugagacccugccucaaaaaaaaaacgaguaugauucuauuugcauaaaguuuagaugcaggcaaaucuaaacaauauguuguuuggggauacauauaugguaagauuauaaagaaaagcaaaugaacaaacuucaggauggugguuuucuuggagugggaugaggugguacuggggaauggaagaguacguaggaacuaugguuugaauaugacauauuuuacaauaaaauuuuuuauaagcuuguuguugaaaggaacccugaggugauucuuuuuucugaagaagacuuuugguaaugcggauaguaauuuuuuuuuuuugagacggagucucugucaccaaggcuggagugcaguggugcgauuucggcucaccacaaccuccgccuccccgguucaagcaauucuccugccucagccuccugaguagcugggacuacaggugcaugccaccaugcccagcuaaguuuuuguaauuuuaguagagaugggguuucaccguguuagccaggacggucucgaucuccugaccucgugauccacccgccucggccucccaaagugcugggauuacaggcgugagccaccgcacccggcuugcagauaguaauucuuaaucuuuugguacaugcucuugcacauaaaguuuuacaguaaauauauuuuucauuuuuuuccugaauuucuuuaugucaaccuugcuaaauagagagcgugccuaggaagaagaugaaacuaggagaauucauccacaagcuuaaguucaaugguuguagccuuagaaugagaaauuaggccuuuuauucuaccugucuuaaaauuagcuuauuauuguuaaaaaccaaagacuguuucuuaguuuguuuauuuuuauuuuuuguucaggagcagaagcacucuuuugccccuagcccuagccugcaucugcuguuuguuaaauaccuccaugaauugacaucucuuccuuuuccgaaggaaugugaaacccaauaauuacacacagaccugaccuacuuuggaagaaccagaggacaaagaaacccuagauuucuucgucuuuuuuuaacuaaaaagcagagauuuuugggaggcgagggccagaacuuccuguaucuauucuucuuugaagagcccaacucaccuaagaaauuucuggcugggcaugauggcucaugguuguaaucccagcacuuugugggacugaggagggaggaugccuugagcccaggaguucaaaaccauuccaggcaacauaacgagacucugucuguaugaaaaggaaggaagggagggagggagggagggagggagggagggaggaagaagagagaaguuuucccuugugugugcugcuuguaggcuaguggacuugauucuaaugaagccuuugcaugucugcugauccggaaauauuuggccuuuucccaaggcucuauggcuuugggaaaauaaugaugaaauaccuauuuauuuuuuauuuuuaauuguccuauuuuauauguuugauuuuuguaaacaccucagcccuuuuuaaaaagaaauaguuggaauauaaacauauauucucauuaauuaauaaaucagcuggaugacuaguccaaacuauuauuccauuaucauugucacugcccuguaacuuauuuuaguucuguguuaguuauauuuaccuguuguuauuuugcuaauuugauaguuuauugugaaaacaauuuuuaauauuugucuacugacauuuuuuaaaauagaaaaaaauucuccuaaaccacaaucagaaaucuuuucauuugauucauuaacaguuacuaaaacaccacaacugcguucuggguccuaggcccuguaggggggcucacacaacuucacuaaacaccagccuuagcagaggaagauaacuaucaauaucuggaaugucaagaacuagaagaaacaagauaaugugguccuagcagacagauaaaugggauagauucaagaauucagaaauaaaaccuuacacuuauggucauuugacuuuuguuaagucugcaaagauaauucauuggagaaagaagagucuuuucaccaaacagugcuggaauaaguguauauccauguucaaaagaaugaaguuggaccuuugcuuuauaccauaugcaaaaauuaacuucaaguggaccacaaaacucucuaagaguuuucauagaguuuuauaguuuuagcucucacauuuaugaagagaagaaaacauacgagcaaaccuuccugauuuggaguuaggcagugguuucuuaaauagacuaccaaaagcagaagggacaaagggaaaaauagauaaauggacuacaucaaaauuaaaaacuuuuguucugcagacaauaccaucagaaaauugaugacaacccauagaauggaagaaaauguuugcaaaucguacaucugauaagggacuuguaucuagaauauauaaaaacuuuuauaacucaauaguaaaaagucuaauaauuuaaaaauagaggaaagauuucaauguguaaugccccucaaaguguaugcaguuaguccacaaacacauggaaagauucucagcaucauuagucauuaggaaaaugcaaaugaaauccucaaugagauaccacguauccacuaagauggcuguaauaaaaaaagauggacaauaacaaguguugguuaggauauguggaaaguagaacuuucuggcauugcuggugagagagaauuuaaugaugcagcagcuuugucauuucuucaaaauguuuaauguuccaaaaaauguuaaaaguggaauuaccauauaacccagcaauuccacugguagguauaaacccaagauaagugaaaacacauucacauaaaaauuuuaugaauguucauggcagcauuauucauaauagccaaaaagcagaacaaccaaaauguccaucaacuaaagaauggauaauuaaaauuaauauauccauacaauggaauauuauuuggcaauaaaaaguaaugaaguacugauacaugcugcaaggugaaugccccuugaaaacauuaugccaaguaaaagaaacaagucacaaaaggaccagauauuguaugaucucauugagaugaaauauuuaguauaggcaaauuuauagaaagaaaguggauuagugguugccuagggcugguggagggauaggagugggggaaugaggagugacagcuaaacagguaugagguuuuuuucagucggaacaaaaauguucaguuagauugugaugguugcacuauccugugaauuuauaaaacacguugaauuuuacacuuuaaauuggugaauugcaugguaugugaauaucucaauaaagcugcuuuuuuuuuuaaauaacuagaauacaaagaaagcagggaaauucuugcugaggagaaauacuaaugugauuauuugucuuguuaaugaauuucauguccucguucgggcuaaauauuugucaauuuuuaaaaaaaucuacuuucagaaagaguuucagguaucuuuaacagaagaucaacagauuaaaacaaauuuaaaagaauuagggccaaauagucuagggaagaggagagauggauacuauuuuaccagaaaacuuaggcuaaguagagcuaccacaguucacuuagcuuuugcuuucuggcaguacaggccaacaagaaaacauggauuccuuaacuaacauuauuaaauaaaaggaaaaaauacaauugagaaaaccgauuucccagcaccacacuguaagucaaaacuuaauacccugugacuugauaucagguucacaaaacuaugucuaaaagaaaaauucuucaauaauacauuuuuaaaaaagauuucaaggccagguacgguggcuuauaccuguaaucccagcacuuugggaguccaaggcagaucacuuacagccaggaguuugaguccagccugggcaauauaacaagacacugucucuacaaaaacaaacaaacaaacaaacagaaaccccuaugguggcacaugccuguaggcccagucgcuggggaggaucacuugaggccaggagguugaggcuguagugaacugugaucgugccacuguacuccagccugggugacaaagacccuguuucaaaagggggaaaaaaaggguuccaaaguguucuuuauauggaaaccauuuugauucuggauauaggucuagugagucuagugaagaaauguuguuuguuaagcgaucugguuacuugaacugacggaaagcagaaagcuguuguuuagucugguaucuccaacauuaaauagaaguuuccuaacaaaacaauuuaagacugaauuugaauguagugcuagaagagcagagcauuccauuaugauguuugcaguuaacuauuuuagaauagcuuuagauguguagaaaaauugcagauacaguacagaggucccaaauaccccacggucaguuuccucuauucuuauuaucuuacaguaauaugauacauuugucauaauuaauggaccaauauuaguacauccuuauuaaaguucauacuuuacucaaauuccguuaguuuuuaccaaaauguccuuuuucugugucaggaucuuguccaggauaccacacgccauuuagucaccaugucuccuuagguuucucuuagcugugacaguuucucagucuuuucuuguuuuugaugaccuuaaugguuuugaguaguacuggucagguauuguagaaugcuccucaguuggaauuugucugaugucuuugucaugauuagauugggguuauagguuuugagugguaagauaaccaagguaaagcgccauuuucaucacaucauaccaagggcacauacuaucaacaugacuuauuacuguugaugcuaaccuugaucaccuggcucagguaguguuugucaaguuuuuccacuguaaaguucuuucuuucccccccuuucauaauguacugucuggaaggaagucauuagaugcacaugcuuuugauagcauuuugugcaauugaaaaaaguaacuuuguuugguaaacuaaggagccugacauauuuacuuuuccaguggagagcuuaccuauguuuacacagaguuugcuggaaucucuacaaguaaggcuaaagcaaagcuuuucucaagaaagagcuuuaguuuuguucacaugcuugaacucuugcuugaaacugcuacaguucuguacuauaaauuauggaagagauuuccuuggccuagaauuucuuggagaugauaguugucuaccuuauaaagaaccaugagcuguuaguuuucuauuacuauguagcaaccugccacaaauuuagcagcuuaaagcagcacacauuuacugucuuacaguuuccaugggucuugaguccuggcauggcuuagcugagcccucugcucagggucucagaaggcuguacaguauuaaauggacugcauugucaccuggaggcuuaacugggaaaguaguuacuuacgagaucguucagguaguugguagaauugcuuuaugagugaggaucccagcuuuuuguuggcuguuggcuggggcuucuaaagagacugauccuagagagacugcccgcaguucuuugaugccacccacaguuccuuuuccugagggcuuccguaacauggccauuuacuucauuaagcucucuagcuccacuuggaagaaagggaggauauuacauaaaggcaugaauaggucugucauuauguguguguguguguguaugugugugugagagagaaccauugggggccagucaucauggggucuguuugucacacagaauaugacuuuuauuuuuauuuuuaauuuuuuuugaggguacauaguagguguauauauuucauaauaugacuucugaagagaauauuuaauuuugaguaggacugcauccaguaagucugucuugaugaaaauuagucacagaguacaucccaaauguuaguuuaacccaauagagcugguuguaguaaaaagaauaaacuuuacuuuuaaaaauauuggguacaagguuaaauggagguagguagagcuguucaaugcagcauaccagcuggggaugaagaaagaaguuggaggauaggugaaauacggggauauguuuuccuuguuucaaaauuuugcuaaagucugaugcugucagucauccauucuuuuauuagucaauuaucucuguuuauauuuaacaacucauuaccauaaaaucuacuuuugagaaggagcaaaacauaaugaaguggagggcucagguucuugagcucgacugucuggcuucgauuccugccucugccauucaguacuguauauccagggcacauaacuucauugguaggugucucagaaacaucuguaaaaugagaauaauaguaccuacuccauaggguuguuguauggguuaagaguuaaugccuguaauuauucuuuucuuuuuuuuuuuuuuuugagaccgagucucgcucuguugcccaggcuggagugcagugaggcgaucucagcucucugcagccuccgccccuccagguuuaagcaguucucugcucagccucuggaguagcugggauuacaggcgcgugccaccacgcccagguaauuuuucguauuuuuaguagagacgggauuucaccaucuuggccaagcuggucuugaacuccugaccucgugauccacccgccucggccucccaaagugcugggauuacaggcgugagccaccacgccuggccauuauuccucauuuuuuucaagugcaguaaagaugucauaguuauguuuaaaaaaagagaaagacuccuguuugagguauauugaaguaguuacagaugaaaugauacggugauugggauuuuggagaaacuugguagagauauagauaaaacaauugacuauaaaguaauaauucuugaagcugauugaugcuuugaauuauuuuauugucuacuuuuguuaauauuugaaaauuuucauuacaaaaaguaacaaaaaaauuuagugccuugggacauauuaggugcucaguauauuuuaccuauucuuacuaugcuuauguuuaauauauuggaauuaacuagucuaaaacaaaaaauauaaaacaaacuaaaauugacucuuugaguuucucauuucuaagugagaaauuugauaauggaaacaucgucaaauuuggcugacauuggauuaugcaacauuucuuagacucggauucuugguuucuguguucaugucuuucuggugugguuguaauuuacaguuuaauuaauuugaccuacuuguugcccguuucacauuccauuuaauuuagucugccauuguuuguucuguaagugggauggaaauuaaugucaauauuauuauuuaguguucuuaguuuuaacagugggaaacauugacuuuaccaauagugaaaauauuagcaaaugccaaggcuuuucugggcaaacagugguguuaugcuuuaguuuuaauguauuuaauugaggaaagaaacacuuauucaccaagguuaucucaaaugugguaaaugcaguuuucugcuuauuaucauaugguccuacauuauauagcacuguaaaacuagaugacuuagggcuggguguggugacucaugccuguaaccccagugcuuugggagccugaggugggaggauugcuugaggccaggaguuccagaucagcuugggcaaaagagcaagacccuucucuuaaaaaaaauuaauuuagcugggcaugguaguacaugccuguaguccugacuacucaggaggcugagguggaggaucucuugaggccaggaguuugaggcugcagugagcuauuaucacaucauugcacuccagcguggucaacggagcaagacucugucucuaaaagaaauaacaaauacagccgggcgugguggcucaugccuguuauccuagcacuuugggaggcugaggcaggaggauugcuugagcccgggaguuugagagcagccuggacuauagugagaccucaucuuuacaaaaauaaguaaauaauaaacagauaagagaaaauaaaagaaauaauaacuaaaacuaaauggcuugauuacuuuaacuaaccaagauugagaguuguaugacuaguagugauucugauuuaugugaaugaacccuuaggacuuaaaugucaauuuaaaaacuuaaaaaagucaaaacccaagucucccagaguucgaauuaggaauuggcacagugagaaccuuaucuugauaacucucuuucuuucuuuuuuauagucagggucucacucugucacccaggcuaggaguguaguggcuugaucacaacucacugcagccuugaccuccggagcucaagcaguucuugugccccagccucccaaaaugcugggaccacaggcacaugcuaaugugcccaaccaauuugaaauuuuuuuuguagagacaggauuccacuauguugccuaggcuggucugaagcuccugggcuuaagcgaucaucucaccuuggccucccaaagugcugggauugcaggugugagccacugugcccagcugauaccucugcuuucaagucauguaauagaugaaaacauugaggauuagagggguaaagugauuuucccaaggucacaaacauaucuuagagauacagcuggaaauugaacucucaaucucagcacccacugcauucgucuuuuugcugucacagugauuuccaaacuguucugcagagcccuaggcuucuaaaaaguuuugucuguaaccaggauggauacucuuuuuucugucuuauguguuaggguuuaugugugauuuuguucagaaggaaaaaguuucuacugcuguguaugaucauuuuuauauccuuccuacacucugagcuccuuauucugugcuguuuucuacccagaaaaguacauuugauucauugaagggauuuuuuuuuacuuaguuucaaaaaaugccaacuugaucucuuaguuucaaaaaaugccaacuugaucuaucaagaaaccugugacccagagaccucaggaaaguugcacaaagacuuuuaaauauggagggauaauuaguuuuauuaugacauuauuaucaauuaacauuuuacuuccuucuagcucucuacauuuucauuuucucaucucauaaaucucauuccuuaugauuuuuugguggggauguguuacuuacggucucuuauuuuccuagaacaauauuuaugcaaauaugucuuuuuuuuuuuuuuuuuuuuuuugagacggagucuugcucugucucccaggcuggagugcgguggugccaucucggcucacugcaagcuccgccuccuggguucacgccauucuucugccucagccucccgaguagcugggacuacaggcgccugccacuacgcccagcuaauuuuuuguauuuucaguagagacgagguuucaccguguuagccaggauggucucaaucuccugaccuugugauccacccgccucggccucccaaaaugcugggauuacaggcaugagccaccgcgucggccgucugucuaucuuaaaugaaacuauuucugauaucuggagauucuuuuggaucucauuggcaaugaauuaggggucauguuaauuggcuuaaaaguaguauugucauaagacauaaaagaggggcuaauaguauaauaguuggguuuuacuuaaauuguggaugcuuuuaaugauuuuuaaaaacccacaauguuauuaacuauacucaauacuuuaaugaauugauacacaguuacgacaauuuccuuuacauaaaauccuugguucuaccuuagcaucuuuuugaaauucuacacuuguacucuaaugcaaauuuaggaccaucagagaaggucaguauuuaggaugucuguaauccugcuacaggaaaacacaaagaaucuuguuaaauguuaacucuguuauauuaagcauauacuucauguagcugucuuuugacaucuguuguggcuauguuuaaccuauauaauaauuuuauauuucaguggaaucauucucaguuuuuucuauggcaauguuguuuaucaguuguccgcuuaccaccuuuaaaauaaauaucagaaauuuggccaggcacgguggcucacaccugucaucccagcccuuugggaggccaagguguguggaucacaagguuaggaguuugagaccagccuggccagcauggugaaaccccaucucuacuaaaaauacaaaaaauuagccgggcaugguggugcgcgccuguagucccagcuacuugggaggcugaggcaggagaauugcccgaacccaggagguggagguugcagugagccgagauggcgccacuguacuccagucugggagacagagcgagauuccaucucaaaaaacaaaaacaaaaaaacccagaaauuuaagaauuaauuaauguuuacuauuagacuuccagggauugauuuaaguuacuuaaauuacacuauucaucacaugaaaugcaaacauucauuauggaaauaacauuuguuugacuugaaaaugugaugauuacuaaauauaaggaacucauugaaacuggaauaaaugcacaagccaucacacaaaacauuccauuuugaaggaaucccagaggggcauuaucugucagcgcugguagugugcaccuguucuucggaaaacaccuuggaagguaguuggugccauguuccugaugggcacagggaggcuggcuucuuacuccaggcugcucagggaagauagucugguaucauaaacauccagacaagaaaugcaugauuucacaacgaugcaccuuuugacaaacaaugagcacacuacugacauccgaggaugcauuacaagugagacuuucagaaauaggaggaugaaaugcagucugaaaauggauauugcuuccuguuuuuccuuagucuucauugucaaauaauugggagaugucaagagaugaggguuuaggauaguuuuucaacuguuuucuguuuccuugguucacucagcuccugcuacuucacgcagacuguguuauuaguccuugagggcauauugauauaauuuaaaacaauuuaaaauaugaacuguugcugauuuuguucaacaggaacagcacuaccauuguaagguuagcaagauacccaauauaauaaaucuccauaggggaaguuuaagaaaauuauguuacggcaguugaguucagcucucuuuucagcuggagccuuaagucuuggagcguucuagguucuacaucuaaaugugcuuaacaguacacaggcuucuugacaaaugcuguucuugggaagaguacaauccuucugugagucuguguuauuuuuaccugugaguuggcauuccaggaaagaguagcauguacucauuaagaaaauucaucuuaaaauuuauucagcuuuuugucuucugacaaccuuguauuuuaggcccuauugccaaguuauuucccgucuuucuguccugggacuaaaguuucuuuuuuucuuuucuuuuucuuuuucuuuuucuuuuuuuuuuugaaacagagucuugcucugucaccaggcuggagugcaguggugugaucuugacucacugcaaccuccaccuuccugguucaagcaauuccccugccucagccucccaaguagcuggggcuacaggcccacgccaccaugcuuggcuaauuuuuuuuuuguauuuuuaguagagacgggguuucaccauguuggccagacugaucucaaacuccugaccccaggcaguccgcccaccucggccucccaaagugcaaaauuucauuuuuuauaguuuaauuucccaccauaacuuugacauuuuucuuuggaaauaaacuacuuuuuuaaaaauuucaaaauauuucuauaaguuguagguugaacaccccuaauucaaaaacgaaaaaugcccccaaaucuuaaacucuuugagugccaacaugacaccauguggaaaauucuaugcauaagcacuuaauacaaacuuguuuuuaaugcacaagauuauuuaaaauauuguguaaaauuaccuucaagcuauguguauaagguguauaugaaacauaacguuuuggauaagggauauucaaccuguauuguuauucuuauuauuuuuauuguuuuauuuuuugaaauggggucucccucucgcccaggcuggagugcaguggcgugaucacagcccacuauagccuugagcucuuggacucaaaugaucuucccaccucagucuccugaguacuaggacuacaggcauaugccaucauggcuggauaauuuuuaaaaaauuuuuuguagaguugggggucuugcuguguugcccaggccggucucgaacuccugggauuacagcaugagccaccaggccggccuauuuugucauuaugccacuuucuuagacaguguucuuugguugccauuuugaacuauuagaacugccuuguuaaaccauuuagcuuuugcccuuuucuuccccagaucccuaauacuuuucugcccaauccuuucucucuauucagaguguuuccuguuuguccuacauucucuuucuguccuccuucuuuccugcucuucccucuuuuuuuuuuugagacggagucuugcucugucacccaggcuggcauguaguggugucaucucggcucacugcaaccuccaccucccagguucaggcgauucuccugccuuagucucccaaguagcugggacuacaggcauacaccaccauguuuggcuaauuuauauauauauauauauauauauauauauauauauauauauauauauauuuuagcagagacggguuuucaccauguuagagaggcuggucuugaacuccugacuucaagugaucugcccgccucagccucccaaagugcuaggauuacaggugugagcccugcaccuggccucuucccucucuuuuuuuuagggcuuugaggcauccuuuucaacagcuccuuaaccuuaaaauuaagccaucaaucccauucuaaguaucucccucuuaaacuucugcaauuuguuuaaucugaaauaaacaccugaaaauagaaaauugaauaucuauauuuuguaaauaauccugauugaccuuuauuuuuauugucaacucucuuuuccuccacuccuuuuuuuuaaaaaaaaaaaauuguugaauacauuuaagugauaaaccuguaggacaagaguugauuuaacuauaaaacauuguuggcacuuugcaacaauaacaaucaugucaguaugccugagagaguugcucauaauauuggagacacucguaggcuucuguuuucugagaggguaaaugucaaccagaugggaauuacuggaacugagaaaucauuuucuuuuugucuuuaaaaauuucucuucuauaucuugaauuucaaguaaucacagaaaauuuccuuugcuucagauaccauuuacuaauuuugcacaguauaccauuuuccaacuuauuuucccacuuucaguaaacuuucuguucucuauccagacauuggaaaugcaugaacuauuuuacagucaccauucaguacagccuagagggcagaaaaauaaaaguucaaccacucaccuaaaaagcacuauacauuuuauuguauuuuauuauuauuauuauuauuauuuuugagauggaguuucgcucuuguugcccuggcuggagugcagcggcgccaucucggcucacugcaaccuccgccuccuggguucaagcgauucucccugccucagccucccaaguagcugggauuacaggugcccaccaccacaccuggcuaauuuuuguauuuuuaguagaggugggguuucaccauguuggccaggcuggucucgagcuccugaccucaagugaucugccuaccucggccucccaaagugcugggauuagaggcaugagccaccgugccuggagugcuauacauuuuaaauuauaguuguuaaccacuuucuguggaguuuauugaaagcugccugacccuuaucuuugcuggccauguagaguccuugugucucgaguuggcuagcauccuugcaucccagccauuccuuaggcuugacagcugcauauuuucccagaaacaguugugauugguguguauaaugaauagaauaaccuguucuuuccaaauauacaucccuguuuugccccuuaguacuugauuugacuaauuguuucaagcugaaauauagacuucaauuaaaaaauuggaagccaggugugguggcuguugcguguaaccccagcacuuuaggagacugaggugggaggauccauugagaccagccugggcaacauagugagacccuguugcuacagaaaauuaaaaaauauauauuauccaggugugguggugugucccuguagucccagcuacucagaaggcugaggugagagaauggcuucagcccagaagguugaggcugcagcgagcuauggucgugucacugcacuccagccuggguaacagugcagacguuaggaucuucccaagaauguggccagccuacauccugaccuuggucauguggcacguuauuaaucauggccauuuaauguguaacagguugcauucaagagccuagcuuguguugguuugggguucuuuuaaauuuguuuucuguugacaauucuauuuucuaguaaauuuuaaauaaaaauguuuuuucauuaaggcugauuccaaagguacuuaaguuccuuucuagccagccauucuuagcuggguccugugaaagcauuaugcccuauagaaaagaaaauugagugacuauuuucucaguucucccaaacaugguacuauucuagaugcauugaagagaagucaauucauuacauacagugaugcuuuaagggcaguuguucucagaguuugauucagggaugucauagacuccaauacuguuucaguggguccccuaggucaaaaccauuuuuaaagaaaugccacaacauuauuuucacuuuucauucauagucucucacaauuauaaaauagagauuuccagagacuaugcuauguaugaugcugcaauugcucugaugaccaaggagaugugugguuguauacacgugucuuuuaaauuuuugucuuaauuucugauuuuuaauuugauuucuaagcaaauauugaaagauauuacucacauaaucaaaacuucuuugaaguuucuccuaacuuuuaagagaaggaguccugagaccaaacaguuugggaacugcugucuuaaggcuguaagacuuaauucucugagagaaccccuccugggaauggcugcacacaagggcaguacaguaaaccagucaguugcucaauagacauuuuaaaaauugaauuaaauugagcuccuagaauauaacuuuugagaccuuauuugagauuuucucccaaggcaauguuugagcauugagagccuuguaacuugggccagguuucugugagauagacaguuggcaauucucaauaucaagucaaugauuucagaagucauuuucaaggaauacguccuuuaacugguagauuaauuauguagccuguuggcauuauguggaucagugccguccaagagaaagagggcacauauauuauuuacaauuuuuaaauaaucauauuaaaaaaguaaaaaguggugaaauuaguuuuaauaucuuuuguuuagccuaauauaucuaaaauauuauaauuuccacauguaaucaauauaaaaauguaucagggagauaguuuaauucuuuuuuauauuacuaucuuugaaaucugguauauauuuuacauuuauagcgcaucagucuggauaguuacacguggcuggugccuacuguauuacacuguacagaucuagaucauaaaauaguuguagagcugagccgagaauguucuagaguagauaagcuuugucauaaaaauagagaauaaaaauuuugcuacagaaguuaguauaaaaacauaaccccauugaaaaaagcuuacaaugacaaaauguuugauaucugccuaaauucuaaagacauuucuaaaagaaauagagcucuuuccuuaaaacaaauuuuuuaaaaaaauaagcuuuucuucaaacuguaauguuuucucuuuccuucuaaaaagcaugcagucugcucacuauauucuuugaaauuacuguauguucaucugcauaccaguguaaggagauccucuuucucgucuuggaagaauuugagcccuugugaucuuugcauuucccuccuacguaguucuuucuugaacuguccauuuguccuggcauaucccugaauccguacuaucugcuauagggcauuuauuucugauggggaagggugguuuguuuugaucuuaaugcugaacugucccuuaguucauugucuuuuacucuguugccguaucuugcuuacaaauauggugucagaauaugcaagugaauuuauugccuguugugaagaaaccacuauuuuuuucagcuucauucacuaugaacauuauugugcuuacaaaagugaguugaguuaaaaagaacuguguuuuuuagaagugagaauuaaaagggagaaauaguaauuuuuccucucauagaaugaauaauaaagaacuaugacuuuaaauuuggcaugaucuaaauuuaauuuuuuuccuaccacaugccaauugaaacagaagaauuuguugaaugggaaugucuugaguagggaaauuaaggacucucacaaucuguuaucucuuuaguagcauacuugauacagugucauguuuaauuaauauuagaaugucaauuuacaaaaucaugcucuuuggaagauaaaagaauucuguguagaacaggcaaacuuaggaaauauauggucucuugguaacauguuggaaguuuucugcuuuguuauaauuuucauauguaaguacaauuaggagauuuauagauuuucaaccccaauauaauaacauucuuugagaguuuaucuuuucuuuaccuacugauuuaccuuuguuguggacacauucaguuuuucaagcaacugguguguacuuuacaccaaaaccuuuauuauauagucuucaguaaucuguagcugugaaacucauacucauuuaucuguuuagauauucucaaaacaaucauaccugugugccagccaccugcugucugacuuggcaguuucucuguuccaacuuuauuuuucugcuuuuuagaaaacucccacuuuccaguuugcagcuaagguaggagcugaguuccuuucccuguuaaguggucuuaucaggcaguuaugccauugccaagcaacaguaaguucucuccucucagguguuagcuaguagguaggguuggcaaggggagccuggccugcugugaagaaguagaccagugucucucugccacagcccucagggucgggucuugcuguggguuccauccuauggcucacugugacuuuccugaauggaaugcguuuauuuuuuuuccagcucuguucuuuccauguucuucccacaucagcuggcggcagccaguugguucugaaugcugcccacaaauuguuagcuauuuugcuucuuggucccucaauuugucccuugaauaaggaauugauguguuucagauccaggauuauguugcuuagugaagcaaaucuaauccuugccaaggaaugccuaaaguugaaggcuugauuccagaagaaaauaaaauaacaacagcacuaccuguaauuaacauauauugccuguuuacugugccaggcauuauauuaaucagguugcauguauuagcuuuguuaauccccaaaaucacuuuaaaguagguuccauuguugcccacauuuuacagauagggagccauuggaaaauuaaguaaccuguucuagguuauauauuaagggauaguuccaagauuuugaaucuaaguagcuugucuucagaguccuugcuuucaguacuauauucaacugcuaaauaaagcuucacuuugguuuuuuuguuuuguuuuguuuuuuuguuuuggagaaagugucucauucuguugcacagauugcaaugcaguggcgugaucacggcucacuucacccuugcuaggcucaugcaauccuucugucucagcuuccugaguaacugggacuacaggcacacacuaccacaccuggcuaauuuuuuuauuuuuuguagagaugaggucucacuuuguugcccaggcuggucuugaacuccucgccucaagccauccgccugccuuuaacucccaaagugcuggaauuacaggcgugaaccaccgugccuggcccaaagcuucacuuuucaaugucuucuggaaucugaacucucacugaagaguagacaggaguuugauguuuuaaucuauuaaaacuucuuuguacgugccuucuaagaacagauuauauucaaugcaauuuuuccugaaaagaugaaguacauuuguuuguaaaauucauguauguauguauuuauuuauuauaguacauauuuaugggguacauuugauauuuugcugcauggauacaacauguaaugaucaaaucaggguaauuaggauauccauuaccccaaacauuuaucaugucuuucuguuggugacauuucaaaucuccuucagccauuuugaaauauguaauaaauuauuguuaauuauagccaacaaaaggcauuauugcuaguacagauauuucuugacuuaugauggguuacgucccaauaaacccauuauaaguugaaaauaugguaagucagaaaugcauuuaauucacucuauuguuaucuacccacgugauuguguggcugacugggagccacacaaucucuguuuaccauuaugaagauccuauugcuucagaaugcaaaugaaauuuagagugagugccuugugaaucagggaggccccacuauaugacucccugugaucucuuggaggugaaagaaugcacaaauuucauaaguuaaccugaaggucacccgcuuuuccccaguuacauuguacaugccaucaauuaguagggggugggcagagguggaagauuucaggcacaggccuuagacaguugaugcccucuguuauuaagguaaauaaauccuagcaguucuucccaccuuuugcacaucauggcaugcacagaaaguugagauuggaggugauccauuauugcuuguaacccauuuccaacacacuuguuuggaaguucuuuuuuuuucuuuugagacagggucucauucuguugcuggcacgaucauagcucacugcaacuucagcucccgggaucaaacuguccuuccaccucagccuccugaguagcugggacuacagacacaugcuaccaugcucggcuaauuuuuaaaaaguuuuuuaguagagaugggguuucaccauauugcccaugcuggucuugaacuccuggacucaaucagucugcccuccuuggccuccgaaagugcugggauuacagcuguuuggcagcucugcuauggggauauaucugcaaguuucuaagcuuguuauauuuaugaaagcauucuguacauuacaaggugccauucacauguaagauuuuauuaauaaugacuauuaagaccaagcuauuuguucuaggaagagacauuguguaccaugauuuuuuuuguuguuguuuugggagcuguccugagagaagcaggagcagaugcuagaccaguuguggaguuaaggucuuguaugugaucuggugcaguaaugaggagaaguagaaaugcagguggucaaggguuauauuauccaagacuucuuacaggaaaccaagcagcuggugagauccucauuaaauucucuaccuucuucucugccuaucccaguucucucuguagugaaauucugcuuucuuugucaagucuuucccagacuuuuucuaccucuucuccuguaggugaaggucauucaccauccucugucuguuguuauaccugguacauagcuccauugcuuguacuuccaaugcugcauuguuuucaguuccacacaucuuuuuuccuuuuuagacugugaucuccuugaaguuuaggcugugucugauuaauccuuguagcuccagccacacccagcuccuuucaucacacucccucguuaggcauggcuugaaugcucuuugaguacagcugaaauuuaucucccugugccuuucucccguggguccucauuuuaacaccugaaacagcuucagauaaaguuacuuuuaugccagccauuuauacaucugaauaaucugccacguauggcuccaaacagucuuuauuucucugagcuaaacauuuuuacuuuuguaauuuuguuuuccugauuuuuuccucaguaaguacuguauauguucccuuuaccucucuggugcauagaaucuuagaauguuaagauuuggagaggacuagaguuugacuagucuagguucuucaucuaaccaguauugcuuccauacugauuacauaauugaaacugagauauagacauauuuuggagcaacacaaauauuuuaaguauuucacugaggaaguuuagauuuaguaaauuuuuaaaaguccuucaucguucauucuucauuaaaauguauuugcugaugaguaucuuauuaaaagggggcacauuggaaagauauguuuuaugaugcagugcauguaugcuaaagaaagaucuucagauucuuauaacauucuuauuaagaauuugauucuaaagccaagcuaccuaggcuucaauccugcaccugccacauacuagguguaaauuacuuaaucuuggguuaauuacuuaaucucugugugccucaguuucuguauuucuaaagcaagguuaaugauaagguggguguuaggagguuuaaaugaguuaguacuuccaaaccacuaagaguuaugccuggcccauaguaaacauuucguauaugguagaugcugcuacugcugcugccaccaccaucacugcuacuauuauuauuauuauugaguucuacaagcaucuggugagauguguaaagccccugugaaaguucucauagaaccuuaguaagacaccauguauuuaugauacaagcuucuugccuuuuuaaaaauuuuuuauuuuauuuaaagcuucuugucuuaaugagagacccuguauaccacucugcacugaaacaugauuugacccagaccguaacgacaucuauggaguaauaaaguauuuuuucauaggauuuuaccguauaagcaauugaagaaauggcagaagacccauuagcuuuuggagucuguuccuuugagaccaacuugcuaggaauccauuuccuaucuuuuuaaaaagaguaaauuaauuuuccucauugacauucuguaaacagaauacuggcagcuuauauuuuauggaacguaauguuuuaaagugaaccuaauuuuucuuaguaaacugcuuuuaauaaugcaucagaguaauuuuuuucccucuguugucagguugcuaucaagaucauagauaagacccagcuggaugaagaaaacuugaagaagauuuuccgggaaguucaaauuaugaagaugcuuugccacccccauaucaucaggcucuaccagguaggaucauuaguguauagcagauagcugcaaagaacccagaauauuguauguauggcucccuuugaagaaaugugggugggugaacaucugugacuuuuuuuguuucuauguuaauccugcuaucuuuccuacccuucuguuuacgcgcucagcacuuaguauccucaaguuuccccuggccauuuacuaguacguuuuccuuacccagguaggucuuuuuaauuuguucuuuaaaauuugaugccauucuuagcaacaacuacacaaaauguuaauucagaagaugaugagaauuuauuuuauuuaguucagaguucuaacacaggaugggaaacucaaaaagaagagaauuuagagaggugaaaaguuagagaugaauauaacauuuuuuuaauagcauuauuugaauacuaguuucugugaucauguuauaaauuguuauggcaaaggacugcuucuuggaucaaucaaaaccuaccucuuuucuauucuaauaggauuguagacuuaguuuuccaagguaguaauuauuuugauaaucaagagaccagaucaagugaccagaucucuccaauaggagagauuucuauuuuaguuuuuuuuuuuuuuggucuucccaagaaacaugcauauuucaugccaucaucaaaaugauucccuagcauaacuacaaaagcaguaaaucugauggcuggaauuucaagcgggauaggaggagaggaccuugccuuagcaggcuggugaaagagauauuuugggagagguggggcuucgggaugcuucucaaauugcaauguguuggcagccgagaacuuugccucugcauaggcccaacucuacuugcugcuuucugccagaacagccaucucuuaguucugaaggacguggccacccacuugguuauuuugcugcuguuagucugcaguaaaugguuacuggcccagacauaggaccauguguaaaaguggagaaaguacacccaaggcucuaugggcaagcuuucguagccucuuaguuuuauggaaaagaaaacauguugugauauuaacaugugugguuaaaacuacagcguuagagcucuucccuggcaucagcugcucacauaaugaaauuaggucaacaggagcagaccuguugaaauuuaucagccuaaauuauguugaacaacgccuaccuucugccccacaagcaaacuuaugaaagcuuccuggugcugccugaagaccuauaucugugagcucacaggugucuaaccucagcuuccuuccuauccugaugggcugaauaaauuucuugaccuuaccuuuuaaaauaaaucaucuuuaaauaauuguggggcuuaggcugaccuuucucaagagguugacuuauagcuauuacccuuguaacugaauucugcaaguuugccugucuuacccaagauuagccuaugaggauuuccacagguccagugcuagcuuugagcagugccuucuuucaagcuuuaauuuugcuuucuggcagcuggguuuuuuaaauuuuauuuauuuauuuauuuauuuauuuuugagacgaagucucacucuguugcccgggcuggagugcaguggcaugaucucugcucacugcagccugcgccuccuggguucaagugauucuacugccucagccuuccaaguagcugggaucacaggcaugugccaccacgcccagcuaauuuuuguauuuuuaguagaaacgggguuucacuguguuggccaggcuggucucgaacuccuaaucucaagugauccacccaccucggccucccaaagugcugggauuacaggcgugagccacugcgccuggccggaacugaauuuuuaauuguauuuaguuuuaauuaauuuaaguguaaaacuaaaaauaauuuuaaaaagaauuguugaaaugauaguauuuuggauauauugggguaaauaaaaaguaguauuagaauuaucuucaccuuuuccuuuuuccuuuuuaaauguggcuacuagaaaaguuaaaauaauauaugcaguucauauuauauuucuauuggacagcacuguuguagaaagauauacaauaagcagagaacaguguuccucuggggauugagauggaggagauugggaagaggaaagccuuuggucuuuuguuuuauaaugaguguauguaaucauuauuacuuuuaaaaauguuugauggaaaauguaaaaaggaagaaaggacugacaacauacuacaaugaauuuuaaaaaggagcaacaaagggaccaagacaaaacacaaaucacuuacguuacuuuaaaagguugaguauuuuaaauuacuguucucuuuuuuucaaauaaaugggcaguggaaaggaaaguugucauuucuauaaaaaaaagaaagacauaugugauuucuguggcguucuuaugugacucccauuauuuuccccaaaggcuucuuuuugcuuuaguuuuuuuuuuuuugauuugauagggcauuuuugugcuucagaugauugauguugaaucugaaguuuaaguuuugguucuugacaacuucuuugccucucaguuuuauggagcuuaagagauugcagagaccucauggaacaucaaaaagccuaucucucucaagcaauaaauguuuccuacuuuuaagaacuuggaggaauaucuaauuuucccuuucuucuuaauaacauuuauauuuguuuccccaaaaauguuuuaaauuuucuuuaaucuauagugguuauuaauauuucaaaugagaaaagaggagucauuaguuuaucuuccuguaucagccugucauuugugucacugucugucacuuuccugccuuugcaccagguuauggagacagaacggaugauuuaucuggugacagaauaugcuaguggaggggaaauauuugguaaguacauuuauugcauucuuuaaacagcuauugagcacacuauggcaaaccuaaaauagcuguucagugccuuugucacuugagcagcagucacuugaugcuguucuucaauccugccauuuucuaucaacaaaggcauuuuaauuuguuuugauuaaucuaguaaaaucccuuuaacacauuuguuuccuuagcaaagguguuuuguuuauuucagucaggcgcugacaguugagauuaaagaucuccaaaaacaagcauccuuucugaacgugggacuuagggucuuuccuguuugcagguuuuaauugagguuaccaagugcgacagaacucacacaagugugugggccucuguugugucagaaagagccacuuagagcacauaaucucacccgagugcguuccuuaaacuuuguuuaaauauaacauguaacuauauuauuuaccauguguucacaguuccccucaguaauucuuguaauuuuggggguucugccuucaguagcuauauuuuccucucacacuuagcuuuagcacaaugucagaaauaagcaagagacuuuguuacugacaaaucugauuuuuaagaugcuaaaaacugacaaaacgauuuuuuuucuaacagugauaaauggagccaaguagaguuaaaggguaaacuuccaaaucuaaauugaugugucuuuuauuuuuucuuuuggcaacuaacuacagagaaaaguuucuuuauauacuuuauuugucuaauuuccucauuuuaaaaaaaauuuaucaauaugaacacuugcuaguuuaaaauuuuuuaauuuuuauuuuaaacauuugcuccuuccugcacgauaaaauguauuuaaaagcauagaaucacuuuuaaaaugaaucuucuuauuaaugacuagucaguuguggcugcauggauguguguguguguguguuuguguuuuuaaaguuucccuagcgaucuaguguuuuuuugugugucaaaguaucuuuaggguaagugcuaguccuuuuuaaaagagguaucauuauuucuuaauuuuauauuuaauuggcuuuguauaugugauuaguuaaugucaaagcuaauggugauagaaauuuauacucaauauaguaugggaggggauacuuuauuuuaaagaaaugaaagcauuacaagauuugaaggauagcauuguuugucaagaagguauaguaggccuucacuauguaugauaauuauaugccaaucaugugccuuggagaugcugacucaauuaagacacugguuuuccuuuccguggagaaaucugguggaaaacagacagggaaaucaacauauuacuuugaagaugagaauggaaacuguaaaacucuguauaguagagaacaguagugcagauggcaguuugguuaacucuuggagaucagggaaaucuuccuggagggcaugguuauauggaaauuuaugaaccagaaaaugaaagcacaagagagaauauuuggagagagagaaauagcagucauguuauugggagacuauacuauggucugacauuccaggcacauguuaugauaaaccugccuuaauuaagaucacaaauguauacaaaggcaaauagaaaacuuucauuaucuagauaagguuuuuucuuuggacaagguauugcucugcugcccuggcuggaaugcaguggugcaauccuagcucacugcagccucgaacuccugggcucaagugauccuccugccucagccaucugaguagcugauacuauagcugugcacuagcauaccuggcuaauuuuuaaauuuuuaguagagacgggggucucacuauauuguucaggcuggaagauaccuuuuuacaaguuuuauucuauaaaaagucaaacaucucccaaauccuugagcugccuguuagguauuuuauuucauagaacgacauuuauugguggggaaacaaugguaauuuggggagaaaaaagaucaugucaucuuaauguuuguaauaaaaaaagacccaaacacagggcacaucaaucuaccuuacucuuuaagaaagcagauuuuauuuauuuauuuauuuauuuauuuauuuauuuauuuauuuauucuuuuuugagcuagggucuuggcucuguugaccaggugaagugcaguaacgggaucacagcucagugcacccccagcuuccugggcucaaguaauccuccugccuuagcuuccugaguagcugggacuguagguauacaccaccaugccaggcuaauuuuuaaauuuuuauagcgauuaggucucauuauguugcccaggcugguugugaacuccugggcuguagcaauccuccugccuuggccucccaaaguguugggauuauaggcaugagcuacugcacccagcaggaagcaguauuagagagauccguuucuugguccuggacuucaugugaauguaccucaagggaugaacaaacagaauaccacuucugauaauguuauuuuaaaaacaaaauauuuuagguuggugaaaaaguaauuguggcuuuugucauugaaaguaauggcaaaaaccgcaauuacuuuugcaccaaccuauaauuauauauuguaacacauauuauguaauauauaacaauagaauuugaaauguuauuauugauacuauuaaguaauauuauuauaaaagauccagauguggaagaaaauaguguauuaccuaaagaaauuauugagacugcacagggauagaacugucucaugagcucugauuuuuaaaaaugucuguguaaaaaagaugaaaggggcuuagucaagaaaaccugggcuuuggauguauuuagaccuagguuugaaucagaucucugucaccuauuugcccuuuuacuuagagcaaauuacuagaugauucuggugcacagguuccaggucuguauaagguaagaucuagaauauuuguauuauaguugugaagauuaaaugagaucgcauauauagagcucuagcacagugcuuccuuacgccuucaugugagagagagaucaacuucugccgucaaggugugaggagcucugcugaccugccuugcuugcugaaacaagugaaaacuauuaaagaaaacaaaacccagucauuuaaagucucuggaaaucguccuaagaguaagcagaaaaugaaggaacauuauucaagaacaucugugcaaauucgguaagaaacaaagucuggucagcaagguggaaauucccguccaggcuacugcagccaagaacgcagggcuuccuucugucaaaagacaaaauugcaaguuuaguuugaugaucccaguuggcuuuauuugcgauucuagaaucggacaacauuucauuucauagaauaaguguuccaguaaguugagcagaagaguuuggcuuauggacagaagggcuuaagaagucugaacaguguauugguuacuuuuaaacagaacaauagaaaauuaaccaguuaacaucagguuacuucgggcuaccuuuuuuaguaaggauuaaagcagagggaacuucaucauugugccaguuaaagauuuuagacugggcuguuugggaaauuggcuguuaucucuuucuccugauuucucaggucagauaacaaccuaguuuucgcuuuggaacuuuagcaugagugacuccauuuugauauuuaguuuggucuguuggugccuagugcagaaguuuauucgaaaacaauggucuccuguaauuuuuauuugucacuucuccucaauucucuccagcaucugaauagcagcuuucuucccaggaggauuuggacaucagcaauucucauucugccccgagcugccuauugcugaguccuggagaagugcaguuaagagaugggggccccuucuucuacucagcccccacuuguggaacuugaucagguaugccgagaauacuaggacccagaucacucuugccuuggguauuaagacagugguuucacugucuuuugcugcuaggagaggcaagcugagaggaccccaggcugcuguccucccccgcucuccauccaccaaacucucaguuccuagagugggagcgucacucagagaaguuugcuguuguccccaaccccagcuccagagcccuaacucugagauuuuuaccuguggagaaaaacaaaccauaaaacagcuccuaauuucuucccaaaggaacugacuucauuugcaacagggagugaagaaguucaaaccugauuguacucucaagaacaguagagggaaaagaaaaaagaaaaagaacaguggagguugugguaaaggacauuugagaagagauucaugaaacaggccaaaugguagguuugcuaguucgcagggggagaaccaaugaauuaauuuagaaagagcuucucugggauuagaaugaaaauaaaucacuggcugggugcacaccuguaauucuagcuauucaggcaggaggauggcucgagccuaggaguuggaggucagcauaggcaacauagggagacccugucuuaaauaaaaacaaaaauaaaacaaaaaaacacugauggcaaaaauuauuucuucaaaggaaccagaauuugauuguauuguuuguagaccaauuugugccccagggcauuauucaaaacaaaagggcaaucagccagcaacuaguggaguuuaacggcugaguauggucaguaaaugagaggaagaaaguccuagcaaaaacacugugaucccaagguaacuaacuguaggcauaccgaagcugccuguuccagaggaaucacauuagaggcugaacacuguaaauauggagaaauaaacuucacuagaagaaucuagcuuuuagcugggcaugguggcaugcgccuguagucauagcuccuuagguuauugauacgagaucuuucuaacugugggcauuuuacagcuauaaauuucucucuaagcaugcuuuggcugcauaucaugaguuuuaguaugccguauuuucauuuucauucauuugaaaguauuuucugaauucacuuuugaugucuuguuucauuauuuauuuauuaguguguuguuuaauuuucacauauuugugaauuucccgaauguuuccuacucuugauuuccaauuucauuccauuauaguugguuguuuuucuauccucuauuucauaauuucugcuauaauauuuguuauuuccuucuuucugcuugcuucaguuuuaguuuguucuuccucuucuagugucuugaagccaagcagaaagaaggaaauaaagauuauagcagaaauuaugaaauagagaauagaaaaacaauagaggauaucagugaaaccaaaagauaguucuuugaaaaaaucgacaacauugacagaucuuuagcuagauugacgagagagagaagagaaaaagagaagacugaaaugacuagaaucagaagugaaagaaaggaacauuacuacagucccuuaagaaacaaaaaugggcugggcauggugacucacgccuauaaucccagcacuuugguaugcugaggugggaggauugcuuuagcccaggaguucaguaccagcauggacaacauagugagaccucauuucuacuaaacauaaaaaauuagccggaugugguagcaugagccuguggucccagcuacuuaggaggcugaggcaggaggaucacuugagcccaggaugucaaggcugcagugagccaugauugugccaaugcauuucagccugggcaacagagcaagacccugucuuaaaaaaaaauaaaaaugauuauaaaggaauauuaugaacaacuauacaucaacaaaucagcugggcuugguggcucaugccuauaauccuagcacuuuggggggcugaggugaguggauugcuugaccucaggaguucaagaccagccugggcaacauggugaaacaccaucucuacaaaaaaaaauagaaaaauuagccaugcaugguggugcacaccuguagucccagcuacucgagaggcugaagugggaggaucaccugagccuaggagguggagguugcagugagcuaugauugcaccacugcacuccagucugggcaacagagugagacccugucucaaaaaaaaaaaaaaagucagcuuagaugaaauggacaaauuccuagaaagauaccaacuguugaaacaacugacuuaagaagaaauagaggccaggcacgguggcucaugccuguaaucccagcacuuugggaggcugaggugggcagaucacgaggucaggagaugagaccauccuggcuaacacggugaaaccccgucucuacuaaaaauacaaaaaauuagcugggcaagguggugggcaccuguagucccagcuacuugggaggcugaggcaggagaauggcgugaaccugggaggcggaacuugcagugagccgagaucgugccacugcacuccagccuggacaaaagagcaagacucugucucaaaaaaaaaaaaaauacauacauacauacauacauacauacauacauacauauauauauauauauuucccuagcuaaaguaaaaaaugguguucugguugcaaauugauagucuuuacuucauuugaccucuuuguagcaucugaauucuugacuguuuccuucuaaagcucuuaguuuugacuuccacaaauguucaacuucugauucuucuauuguucggacuguuccuucuuaguaucuuuugcugggccuccuuucucugacugcuagaacauguugacauguuguagcauauucucugacuuuauauauauauauaauauauaaauaauaauuauauauaaaauauauaaauaauuauauauuguauauaaauaauaauuuguauauaauauauuauauauaaauaauaauuuauauauaauauauuauauauaaauaauaauuuauauauuauauauauauuuuuuugagacgaagucucacucuguggccaugcuggagugcaguggcgcaaucucggcucacugcaagcuccacgucccagguucagaccauucugccucagucucccaaguagcugggacuacaggcacucgccacuaugcccggcuaauuuuuuguauuuuuaguagagauggguuuucaccauguuagccaggauggucuugaucuccugaccuugugaucugcccgccucagccucccaaagugcugggauuacaggcgugagccaacgcuccuggccuggcuagggaaauauuaauaaaauggcagagguggagacagauguuaaagaaguggaggcauugggugcuauuuugagaagcauugcucugaaggaaagaagggagaagacaguaguuuguacaggaagcaagguuguugggagagaguucuccacggauaucucacauuucuucauguuucaugaguaaggcacugacugccuuuguucuagacuguuuucucaaggauguuuauauagugagcacccuugaaagacagagauaguaucucccuccacagcucaaagaucuguuuauugcccagugugaaagauucccuaagcuccaagcucaggguuccucuccuauaauggacccgacuguguguguaggcgucaucugguccccuuugcagugcccugugaaaauuagggcuuggggaacugaagcaaauauguugauguucaugcugcuugcugugccguaagugacaaagucuuuugucucugacagagggguuuccuaucuucugccaucacccauguaauuguggcagguugaguuauuagcuugcagaaauggugagaucucagacccucuugauacuugacaggaaauaaggagggguuuguuuuauuuugauucguuuaaauaugagacuugauuacagguugagguugaagaugcaguaguggggaagaugaguuugaaaauaauugauauggaaaacaaucucuaaagcaagaucaaugaggaacugagggaugagcauaauugcaagaaauuagccuugcacaugaagaaggauagaagauaaaggaugcauguggguguaggcaauuuuuuagguagaagaaugugaaaaagauguuucaugcuuuucauauaauuuucuauugagaguagcagauuauguuaucagaugaauuaagggugagaggguagagaccuggaucagcauggagaaagugaaauuagcugcagggaggaaugagagagagggcaauuaagaauagcuaaauaaguugauuaaaggccuuagagauaggaaacaguuaacuuguuauuccauuauacagaauugagugauuuuuuuccccuaccaccaaugcucaauuaccuguguguaaauugaauaagacagacaauuggacugauccuguuuagaguuuacaggacaugugcaaaugaagaggcaacaggugacaaggguuuugaggccacuagcaauaauguaauuaaagugugggcuuuugggcuuaggcugaaguggguugggaaggcaagugagaccaggaugacugaucuuaaauaagaauuuuuaaagcuggcugggcaugguggaucauaccucuaaucccagcacuuugggaggcccaggcaggcagaucacuggagcccaggaguuugaaaccagccugggcaacauggagaaauucucuguuauuuaaaaaaaaaaaaaaaaaaaaaaaagaauucaugaagcuacaggucuagaugaaguugaaaagcaaguguguuaguguguugggcauaugaagguuggagagaugaaagucuaaaacuacacugcccaacacgacagccacuguccacauguugcuguugugcucacgccuguaaucccagcacuuugggaggcugaggcgggcggaucacgaggucaggagauugagaacauccuggcuaacauggugaaacccugucucuacuaaaaauacaaaaaaugagccaggugugguggcggacgccuguagucccagcuacucaggaggcugaggcaggagaauguugugaacccgggaggcggagcuugcagugagucgagauccagccacugcacuccagccuacgggacagagcgagacuccgucucaaaaaaaaaaaagaaaaaagaaauguagcuagugccccugaggaacugaguuuugaauuuaauuuacauuuaaauuuaaaaacugagguauuaugaaaaguuuuaggccagcugugagaguuagccaacuacagacuaagagagcauagucuccaagaucaccccucacucugcugucaccuacaaguucaggaaauucccaaaaccgguucaguuugauaaauagcuagaaggauucacaaaauucacugaaagcuaauauacucccgguuugguuuaauacagguaaaggauacagauuaaaaucagccagggaaggaagugcagaguccaggagaaguacgaaaugcagaacuuuuguuguccuuuccauguggauacaagauauguuacacuccugguauugauguguuacauuguguacagagcaguacccaucagggaagcucagcccagccucuguguucaguguuuuuauuuuacauaagccugauugauugauugauugauugcucacaugauugaucugugugucucggucaacugaugcucgugacccaaagcccacacgucaagucacgcuguugugcagccaacaauguauauccagccucuacccugagacuauauggguguggcgaaucccagccuaaaucauguuauuagacucucuggcaugacccaaggcucccagacagagacacuccgagcagacauaacauuccaagaacccagagacugcuucccagaagccaagggaaggccaggccuucucuuuggguaaggccaaguucuucacucugcagagucuaaaauauuuuucuauuaaacgcaacucuuauuuugauaaaacuacauuacaccuuggcuauagacaacuuaguauuuuaguugugauacgcuuauaaaguauaaaauacacaguggauuuugaagacuuacuaugaaaaaagaagguacccuaucucauugcuauuauuuuuauugauuacauucugaaaugaucuuuugauguauuugguuaaaguaaguuacugauuuucaaaaugagugcuuuuuuuuuuuacuuuuaaaugugauuacaagaaaaucugaaauuauauaaauggcacacauuguauuuuauuugauagugcuaauuuagaagguuaagauaagagagggggaaguuuagaauuucagaguuaaaauaaugucaagcaaagacaaguucaagauguggccauaggaauaguugcuauacauugguagaguucuaggucaccggagagaaagaaggcuaaaggaaccaugaagcaaacugucaaauaaguuauccucauugauguucacauucccuaggugauggcagaauuugaguggagggcgcaauagacuacaaacuagguuucggugagugucuuugaugaaugugaaggcaagagaggcagaaagggaguauaccagcugcccaaacauauggcguaguauuguuaguggagaccuugaagagguuacauuaauuccuaaucccugguggaauauugucccuuuuuaccucaagaggccuguaaaggaauugcuagucuuagaggaguugguuggaaaagugauuaucaaugggagguguuggccccgauguaaaagcccugcugcccuucuuugcccucuuugucccuccuuaacuuuugugacccaucucaaauguuauucccccugugaacucugcucugauuuugccaaauagcuaauuaccuuuuuuucuucacuuugaacauaccucuccuauagcacuuuuugaaguaauuuuuuuuuucauuucuaaguuugucuuuuacugguaauuuagacucugguccauuucuuuuuccuuugacuauuuuccaaggggcuugauugaauccaugaauguggugcccacagauagagagggaagacuauauaugcugaauucaaucacuuaucaccaccuccauaacuaccaaucuggucuaagccaccaucaugucuugcuaagaucacugcaguagccuuuaaauagucucucugaaucugcccugacuucccccccgauuauagcuagaaggauucuuuuaaaauucaagugggaccuuaccacugagcuacuucuguuggcuuucccaucuauuuggaauaaauuuauaauuccuacuauagccuauaagauuauauaauuuggucuccugcugucucucaccacagcuccuagcacucuccuccucacaucggcaucuuucuuuuucauuaaacccuucgcugugcucccgcuuuaagaccauauauuccauuucuucuuccugaauuacucuuuuccuacauauccacauggcugucucuccuguuucuugccagucucuuaucaaauguuaucucauuagagagguguuugcucaccaugcugucuaaaaucucauucuuccuacuggcccauugcucuguagucucugucuugcuuuacuuuucuuuuugguuuuuaucaugaacugacauauauuuauuuguuuuuuuacugucuugagucaauaaaauuuacgugccauuaaagacuuugucauuuuuguuuccuaccaaaucuucaauacucaaaauagugccuacagggaaugcauguuccauaaauauuuauugauaaguugaauaaaauacuaagugaaugaaagaacaucacuggauugcugauuauggcguuuaaguuuuauucaucugugucuuccuuguuuaauguagugucuaacauauaguaggcacucaguaaauguauuucauugugucauaaugaaauauaacuaagucaagcauggaauuugcauguuauuuaauaacaucuuaguuaaaugaguuuuugacauggggaaagcaccuuuuuuggguaacuguauagagaaagacauauugaagauuaugaauucuaagcaguguaauaaauagacuucaguaauugguuauuucaugaauauuuacuacucauucaauugacuuauccaguuuauuuuugcauacuauucagccuuauauuaugaaggagcagugaugacaguguggguuuauuuaauguuacaaacagaauugagaaacugguuaguuuuguaaaccacuaaauuuauaauuuaaaacuuccacacucugauaucuuuagauauauauccccaaacuuccuauuugagaccaugaagucauaaauccagcacuuuaucaagcaaaauuuccugaauaccaggcagaacucaugggcauuuaaaacaaauuacuaauuuaagaggagucuguugaaauguguaugauuuauuaugaacauucucagugucuuaaaaauaauauuucuuaauggugccaacauguauggaacccugaacuucucacaaagccauucauuuaugccauaggucacucaaaaacuauuaggacagaggaucagaaagacuaacuugcauaaccauuguguacaagauacuguguuaaguguuucacauagguuauuuuaucuugugacugccuggaaguucaagaauacaacacauuuguuugaacacuacuauguacugguuuguuguggcuuuuuuuuuuuuuuuacauguuuuuauuuaauccgcagcauccuuuaugucuucacaacuaaacuaccauuuucccacuaguuuauuuacuccuuugauuauuaaaaaagguauuuucggccaggcgcgguggcucacgccuguaaucccagcacuuugggaggcugaggcgggcggaucacgaggucaggagauugagaccauccuggcuaacauggugaaagcccgucucuaccgaaaauacaaaaaauuagccgagcaugguggugggcaccuguggucccaacuacuugggaggcugaggcaggaaaauggccugaacccaggaggcggagcuugcagugagccgagauugcgccacugcacuccagccugggggacagagcgaggcuccgucucaaaaaaaucaaaacaaaacaaacaaacaaacaaacaaaaacuuagcuauuuucuaagggucuccuaacaagcaaguaaccaugcuacugaacuuuagucacucugaaucaaaauaauugacuuguauuuauuucccuaauuaauuucccauuuauuauuauucauuuuuuguucuguuuucuuaauaucagauaugacuaacauuuauuuuauuuauuuauccuuuuuuuuuuuuaaugcccccaccaggagugugcaaguggagagaugcauggaugaaggaggggagcuggcgggggugggucugugaccagcauuuauauuguaacuggccaagauguaugaggaagccaccugugcuuugaccucacuuuacacuaaaacauucauuuauagucugaucauccagucauuucuaccaugacauaaaaauaagagccccagagaacaaaucaaauuauuuuugcuguauugaguauauauaaaucccaaagggccaggcaugguggcucacuucuguaaucccagcacuuugggaggcugagaugggcagaucacuugagaucaggaguucaagaccagccuggccaacauguugaaaccccgucuuuacuaaaaaauacaaaaauuagcugggcguggugacacacgccuauagucccaccuacucgggaggcugagguacaagaaucacuugaauaugggaggcagagguugcagugagccaagaucgcaccacugcacuccagccugggugacagagugagacucugucucaaaaaaaaaaaaaaaacaaaaaaaccuuaaaggaauauuuuugccuggcuccuacauuaacauuuacuuucucugaaaaucauaacccuguguuuguuauuauccagugucuacaaacagcccagcuucuauaguuagguaaaguaaauucaauaucaguuguucuuucauaaucaaaacagaagucuacaaugccauucuuacauacaacagcauugacaguaauuccuuacuaucauguaauagccagggcauguuuagcuuucugcagauguuucaaaacaucuucuuauaguuuguacaaauuacgaugcaagaaauccauacauccauugaguugaaaaaugucuaaauuuuuuauaaucuaaauuuuuaaauaaucugugacaaccucaucucuucccuacaaacauuuacuuuuuuucuaugcuaucuauuuauguaagaaacuggauugucuuaaaaaauguccuacauuuggaauuuggcugaucauauauuuauugugucauucaacauguuccuguaguucaguguuucuuggaaaguggaaguuauauuuaggaauuugcuuaguucaguuuuuggaggggaagcaggagugcuccauaguuuuuuauugcaucacuucaagaguuguauaauaucugauuuucccacuuuuagugauacuuagaauaaucuucagguauaguuauuguucaccaaauugauccuuuauaaaguuucccaucagucuuuuacguaauguuuuaucuacuccugucauuuaguugccuagcuauuucauuagaaguugcaaggccgggcuugguggcucacaccuguaaucccagcacuuugggaggccgaggcagguggaucacgaggucaggauuuucagaccagccugaccaacauggugaaaccuugucuuuauugaaaauacaaaaauuaaccagccauggugaugcacaccuguagucccagcuacuugggaggcugaggcaggagaauugcuugaacccaggaggcggagguugcagugagcugaguccgcgccauugcacuacagccugggugacagagugagacuugucuuaaaaacaaaacaaaacaaaaaagaaguugcaaaauggugauuauuugaauucucucauucauucaacauuuaugaguuauucuucuucuguaaagaacuuugccuuauaaacuacuuagaaauuauaguaaugacaagauaaaugcuugauucuuucuuuuccuuauguaucaguuuuuagaauaaugaauugguucucugcaaucuccaguggagacuaaggaaguugguuuucuauuuuguaacauaauuaugcaauuauggauuuuaguauauuuuaugugcuucaguccauuaagucauucuucuuuugaaacugaaauuauuccacuuagccagugggagccuggagccucuucaggcugacuccuguguccuuuugaugugagcucaauagucuuugauauuuuuguugcuuuuaggcaagauguccuaugcuuaucuugaacauuuccuguaccagacauggaaucaaacauuucuccuaggaauucugguuuggucuccucuccucuccucuccucuccucuccucuccucuccuccccuccccucuccucuccucuccuccccucuccucuccuccccuccccuccccuccccuccccuccccuccccuccccuccccuuccgucccguccccuucuuuucauuuuccuuuucuuuuucucuccuucucuucuccucuccucuccucuccucuccuccccuccccuccccucccgucccguccccuucuuuucauuuuccuuuucuuuuucucuccuucuccucuccucuccucuccuccccuccccuccccuccccuccccuccccucccguccccuucuuuuccuuuuccuuuucuuuuucucuccuucucuucuccucuccucuccucuccucuccucuccucuccucuccucucuucuccccucuucucccuuccccuccccuccccuccccuccccuccccuccccucuagauagagucucacucuguugcccaggcgggagugcaguggugugaacucagcucacugcagccuccgccucccagguucaagugauucuccugccucagccucccgaguagcugggacuacaggcacacgccaccaugcccagcuaauuuuuguauuuuuaguugagacgggguuucaccauguuggccaagcuggucuugaacuccuggccucaagugauccacuugucucagccucccagagcacugggauuacaggcgugagccaccgugcccagccaacucugguuucuuuaaauggaaaauagcauuuaaagaccagaauuugggccucagggaugcucguuagugcuacuggguuauuauugcuuagaggaggggacagagcuaugaaauauauauuuuuaauggagaggaaaaugaaacaaguuuauacuaacacuccaauuaaaauguaagauuucagcauuuuuacuucuuaaauauuauaucuuuaguucucuuuucccuuauguugaaaauugugguuccagaugacguuaacauagucacuuuuuugauaugagugaggggagagacugauugauugaaaacaauaccaguaguauuacaaauaauaaggagacuugugguucuuuuuguucuuaggauauaucccaugaagaauugucuuagucuauuugggcugcucuagcagaauacuuuuaacuuuauguauaguuagguauuauguaccguaaucuacugauuuuuuacagguugcuuucaauuuuuagaaauguucuucuauuugauucaauucugaauuguuucaguuauguaagacauuacuuguuuccaaaguuaaagcuacaaaacaaggugcauucauaugucuggcuuccacaccuuuuccguaaguaaccauuuauuuaacauuauuccuuuuggcaaaucuaaauaaauauaugcauauacauacacaugcauauuuguauuuucccuuccuuccuacacaaacagaaacacacucuacauauuuuucuacgucuugcagugcuucauggauauaaacccauccauggaccaaaaauccaugggcuaggagggaagacacacaagauaagaaauuacuguaauauaauuguuugcugaugucauagaggcagauagauuaaaugucauuagacacaaauuauggagcaguuuuucuagggcgggugaguagguuaggguuagcuucagagaaaugaccuuuaagcuggacuuuaaaggauaaccuugaauuccaaaguucagcuggggauggggaugagaauaggagacaggcauuccagcaagaaguaaaacccugagcaaaguguacagcauguuggugaaacagcaaguacacaugcaggugaacuauguuuaugaauuagaacuauauauuguaggcugugagauuuuguugaaaaguucuaaguuaaaugaaugacacgaccaaagaaauguguuagaauaacugguaacaauguaaaggaugaugggcagaaagggaaaccugaaggauagagaagaggaggcauacucuuuaaauguaagucgaaaauuuagcguauuuuguaaguaauuggauguuaagagugaggaagaaagaggaguugaagaugauuccaaaguuucuuucauggacaucuagaugaugguaauagggauucaggaggagaacuagguuacagcaggaagauaaagagaacguuaguucaggccaggugcuguggcucacgccuguaaucccagaacuuugggaggcugagguaggugcauuacuugagguaaagaguuugagaccagccugaccaacauggugaaacuccgucucuauuaaaaauacaaaaauuagcugggcaugguggcaccuguugucccagugacuugggaggcugagauaggagaaucacuugaaccugggaggcagagguugugaugagccgagaucacaccaccccgcuucagccuggaugacaaagugagucucugucucaaaaaugcaaacaaacaaagagaacgcuaguucaguuugguccauguuaaauuuagauaucuuucaaauuuuuuuaaauuauaaaaauaaagaugggaucucacuauguugcccaggcugaucuugaacuccuggacucaagugauccucccuucuuggccucccagugugcugggaucacaggugugagccaccacaccuggccuaaauuuagauauauuuaugauaccuagaugaaguuuuucaguagacauuugaaaacaggaguuuggagcucaggagguuagaugacuagaaacagugaauuuggaagccauuagccuuauguauuggcauuaguuaccaucucaugcuacauaaaauucccuggagacauguacuugagcuguucccuuuggaagacuaguuagagcuaggauugcaacauuuugauagucaauauuuuaacaaaucgaaagguaccucuguugacuuggagcaugcagguuauacuaggaucugauuagaaccucuguuacaggauuagcaaaccaaguauugcuaauaccuugguguagcaugagaaacauugguacuauaugagaaaacuugaauaacauuuuugaaaggccuuuuguaauauaugagauucuauuucaaagccuaccuggguuuaugcuuagucuagaaauacuuuuuaagaagccauaagaaaacaaauccuuccuuauacauuacugugaauggacuugauaugaaaaggauggcauguuuuuuaugaagacaacuuaaaaaguguguaguuuacaaaccuuguuuaauagcaaaaugaagaguaaaaaaaguguuuuuguaaaagcuuauagucucuucucucauugguauuccuugaguuaauuuauaauaauaaauuaauaaguauuaauaaucaauauaauuaauaauaauuuaucauuauuaauaauaguuuaaagauagggucuugcccuguugcccaggcuggagugcaguggcaugcucauagcucacugcagccucgaacuccuggguucaagugauccuccugccucagccucucaacagauuaccaggugcauaccaccaugccuggcugauuuuguuuguuuguuuucugagacugggucucacucugucgcccaggcuggagugcaguggcacgaucucggcuuacugcaaacucugcuuuccagguucaagcgauucuccugccucagccucccgaauagcugggacuauaggcaugcgccaccacacccggcuaauuuuuuuuuuguauuuugaguagaaaugagguuucaccauguuggccaggcuggucuugaacuccugaccucagguaauccaccuaccucugccucccaaagugcugggauuauagaggugagccaccgcgcccggccuaugccuggcugauuuuuaaauuuuuuguagcaauggggucuugcuuugcuguucaggcuggucuuuaagugcggggauuauaggugugaaccaccaugccuggccuaaucuauaauuauuaaguauccaucauaggcagaguacuauuuuauguguaauaaggaggcauagaaaaaaauaguucuaguuccacauuuucaaaacuaaagcauauccugugauaauguguuucacgaagaaauuguguugucucaaaacucucagggaaaaaguuuaguuuauuuggaagagacagaagaaaauuuaguauacuuuuugcuuguaugccaaguacagacuuggauauaugaagacaggucauauauguuagugugccuuuuuagauuaguugggaagacucuugaauucauugaggugagcaauagcauuuagcauucauuuugcuaauaaaaucuaagguucaggaaauaguuuuaauaaacagggauaggaauguauucaaucaucuuuuguucuuuuaauaaauacuuauuaagugcuuaauaugcgucagauaccguucauuguacuagacacaguauugaacaaaauggcaagaaugccugcccucauggagcuuguuuucuaguggagaagacagauaguacaccaacuaaguaggguagaaugugucauuuguuagaaaaugauaaagugcguaggggaagugaauaugaaauugaaauaucaggagguaagcugacaauagagauaggaaagaccucucugagaagguuauacuuuuguaaaagaucaugcagcuauuuggggaggagcauuccaaguagaaagaauagaaagaacaaaggcccuguggcaggaguauuucugcuguguuugagaaauagcaagguggcauaugugauuauaguagaacaaaagagccagugaaagaagguaaggucaaaggucaugagcugggaacccauccggagguuuugacagaaaaaaaugaugugaucuuauuuaagauuuaagagaauuacccugcuacauagaaaugcagacuuaauuguuugaguguaggaguuugaggcuacaaugagccaugauugggccacugcacuccaacaugggcaacacagcaagaccuugucucuugagagagagagagagagagaggaaggaagaaaagagaaaaugcaaacuuauauucauauaaaauucuauacacaauuguuuaauuguugauagcagcuuucuuuguaauagcuaagaacuggaaacaaccaaaauguccuucaguaggugaauggauaaggaaacucuuguacaucuauuccaugcuguacuacucagcaguaaaaaggagcaaauggggccaggugcaguggcucacgccuguaaucccagcacuuuggggggcugaggcggguggagcacgaggucaggaguuugagaccagccuggccaauauggugaaacccugucucuacuaaaaaugcaaaaauuagccgggugugguggcgcacgccuguagucccagcuacuugggaggcugaggcaggagaaucacuugaacccaggagguggagguugcagugagccaagauugcaccacugcacuccauccugggugacagugagacucugccucaaaaaagaaaaaaaaaaaaaaaaggagcaagguuaauagacacaucaacuuggauggaucuuaaggacauuauggugacuaaaaauaucaggccagucauggugguuuaugccuguaaucccaacacuuuggaaggccuaggcaggaauaucacuugagcccaugaguuugagaccagcuuggucaacuuggugaaacccuaccucuaaauaauuagcuaggcaugguggcagaugcuuguaguccuagcugcuugggaggcugaggugggaggaggucaaggcugcagugagccgugaucuugccacugcaguccagcuugaaugacucuuucucaaaaaacaaacaaacaaaaacaagaaaauaaaaaagccaaucucaaaaggucgccgacuguaugauucuguuuauauaguguucuuaaaaugaugaaauuacauaaaugggaaacagauuagugguuucuaggaguuagggaugguggggcauagaggaacaagcaugacuguguagggguagugcaacggagaucuuugugguggugaaauauuuuuguaucuuuuuuugauacaaaaaauugaacaggggaaaggcaagauccguuuacacaugcaggcauauaugugagaguacucaguaaugacugaguccgaauaguuguaauugcuauuguaguaauugcaguuguuguuccacaaaucuacacaugugauaaagugacauagaacuauacauacgcauuguacccaugucaaauucuggguuuugauaucguucuauaauuauauaagauuuaaccauuggcggaaacugggcgaaggguacacgggaccucucugcacugucuuugcaacuuccugugaaucuauaauuaucucaaaauaaaaaguuuuuaaaaaaagauuacuaccuuggcugcucuuuugaggaguaauccuaggagguuauugcagaaaucuaggagugagguaguugcuguuaaaugaggcugguggcacuagaguggagugaaggcaggggugagaaauaguuggauucugaauaugauuugaacguagaguuaauagaauuugcugauggauaggaugcagggugugagagaaagagaagaaugaaagaugccauaaaaguuuuuggccuggucaauggaggagcaaagaaaagagauaguaacaagaagcagcaacaagucaagaagcccgguaagagguaguuggauucuuggcaagaaagacaaaaugacaaacccucuuccucuagucaguggcagccacgccugggaguuagaggacaauaggauauuaaagugacugcacucuuauuaaccugcuuagggggagcugaguuaucuuggccucgcccugcuuuuuuggaaagaagcguuuguuugauaaacaggaagucguuuccauggguguaggaagaagaaaugauagaacugaguggcaaagcaaagaacuacuagcugugguuaguuuggaauuggcagaaguuuuuucagguagucaccuaagaugaagaugagcacacauacugccuuuucccuuuucuaggcuggguucauucuucacugaaaugugguauuucugccuauugcuuguccugcugucaggguauguucauuuucagcuaguguuuugcaucaacuaugaguuguagacuuagcagacaaauggagacacugucuguuuagaguggaaaagugacuuauuuuaagaaauguuggcuccgcaccacuaucccauuaguggcauaccucugacacuccauugaagcuggccuagggaagguaagacuggcuucuguguauuuuugcucuuugaaaggucagaaccuaaauguaccacaagauauuuucuuccugaguaagauugggacaaaauuacaaacagugaauucugaagcaaacuuacgugcuggugcucuaauacuuuagaaaauucaaaaucgauuuccuguacuucuaacaauauuacucuucgucggguauguaaaucucuuagugucacuuacuucuuuucauuuugcaaggaagggcagaccaaaaagauuaaagaagaccaaugccaagucauggucaugggaaagugagaaagagaauuuaaaaguacuuuuuacuuuuuuuuacuuuguuuuacuuuuuacuuuugaaaagcacuugaaacaggagaaccauuuuuuuuccuuuuaaccgagagucaccucaucccugucuggguacauguuuggagugaaauuguggucaaagaaaacuuuaaauuugucccagaccuauaauggcaacuaaauagauaaguaguugauugauggugaaaaaagcuuagugugauggacuugacuuuaugcagcaggugucuacuugagguuuguuuagauugguggggguggggagggggcaggacucuagcuaggggcauggcugcaguguggaugauugggaugaggauauggguaguauuugugucucaguauuuaggagagguaguucacugaauugccuggaagaagcagaacaacucuggaguuccuugcaauuggaguuuauccugacaagguucaacguacauuuuacuuugcguauugaguggauucaggagccauuugguuucauuugccuucugaaaguacugcaguauuuguaaaaaugcugugacuauguguuaaguccaggcuggucuacagcucuggauuucuucacugaaaguuaaauaucacauuugaacuugaagaauguuugcugccugccucuagagcauauacgaauauaaagcagcuauuugucagcaggcagcugaaaggcgauuuucagcagggagugaaaaccacugcaggcugcuggcuuccuggcacacccacuagaccucguagguuuacagugaaagcaaaccaaugggaguagggguuggggggauaagaugggcaaaaaucagggcagaggcugaggucugaaugcgauugagccacuggaaggagcuugcaugugaagagcacagugcucccaaagagaagaaaacuugaacccuaaacacaauggcuaggagcaaauaucuaaugugaacacuuuaaaaaaaaaaagugauuuguuccguaaguguauuuagaguccaggggaaaaaaaaaagugauuuguuuaucuucuuuguaucuauaacuauagggguacugaagguaacuuuggggaaaguauuauaguuuaagcuguacuacccagugcgcuguuacagcuaccuuuuaaccagaaccauuaacagugacaaucgauguguagaaaaucaccuuuaagcucugcagaauccugaaggacuuugugcucuauugacuagauguuuaaguauucccuauauaguauucaguggaccuuuucaaaaaugucuuuugcaacaucuuugaaagugaaaguuuuaacguaugauacucuuaaucagaguacacguuuauucccaaauauucuguucuuucuuuggguauagcaugcaacagaguuuacuuguauuuagaagaucaagagguggggguauuggcaggauaaaugauuuguccagggacaacugaugugucacuguagagauaaaacagaacuaggcugcauuccagcagcuucuggcccguauaacaguuuugagaacuuuccaaucacuuuaggaaaacaagguacuuagaaauuuauaaagacuuucuuaauaaaagaaaucacuuauuuuggaaauugugaaauuaaucauucugcagcauuuaagaagcacuuugauguguucugguaauuaguauuuacugccagacaaaugucucuugggcauuuuaauuaauggguagcuuggccaaaugagcuucugaugguaaaccuucauaaggguuuauuuuuauguuucucaagaauagcugucucuucaaagcucuuuaauuagacaagguuuagcaacuaaaacauauuauuagaauaauuaggccuuggguuaagagaaauagggggucagaggagcagguacuguuagaaaauggccucuuaaaacauagcauucuaccucugauggauggccaguucuuucacagcuucuguuaaguuacucucccuaguuuggacuucguguuguuuaaaguucauagcagaccucaccggaagccuaaacacacccgagugggagcuuacuuauccccaccucugaccucccagggaaagcuugauucuaguccuuuuaacugcuaaguggaagacuucuuauuuucuccuuuuucuucuauuaaaucgauaaucuuggcuauaacaaugacuuguauuuuugagggagaugcuucaaaagccuuguguguggcgaacaaaaauuacaauaauuccuuugaggaucuuucuuaaugauuuauauuaucuacauauaagauauguucuuaaagugacuacaguauuugcauuccagaauguuauauuucuuguggucagaaugcaguuugaauuauuuugcaaucugcucuguagaugggcuggcaucuaacuccccuucuucaaccuucuccccuaccauuucuugccacaagcgcucagucuuggcaguuauugcuaguaaauaugugcuacccugaacuuccucuuuguggugaaggaaagauacaccugacugguccugugagggagugagaugucaccaaaacaauuguguauucuaccaaaacuguugauaaaucacaauauauuuaucuauauucccucauuuuucacuuuccuacugucucaggaugcuuaggauggcaaauauguccuuuucccagcuagaucaguugauuaaaggacagugcucaugagacuauuagacauuucuaacagaacaacuguaucauagcugacauuucuaaucccacuagcugucaugaccuauauguguuguugguuugauaaagaacugagucaaagauauguauguuguugguuugguauaaaccuacugcuauuauuagaaaguucuuaaagaaccugcuaauccaucaaaucauuuuugaauauugaggauagccugcuuuauaguauuaugauuuuaucacauguaaauucuuuugauauaccuuaguuaacaacauggccaaugaaaugauuuuauuugaguugguagaaacuucacuugguuuuugauugauguuaucuguaaaaauuaucauuuuguaagaaccauuuggugagccccauaaaugcagauauaaagauguagguauaucgcuaugcacuccagagaacaguuaccgaguaaguguguuuuuaugucaaaucgaagaacuuugagaaagcagaaagauaguaaccuaaacagagugcucugucgaggaguuuucucccccuagcagugacgaauuucuguccacccuuuccuuaaaugauuuaauauuggggccuugcuuuuuuaccuccucuuuaacacaggaaauauuucugauacuuaucuucauguguguguuugcucaugucugugcagucuucugcagugaggauaugaaaagaaagguagugaguucuaugacccuugaaaaacaccagaacucucuuuuccuaaugaaaguacaaguguguucuuaugcauacuuuuguauaacaggauuuauacuuaaaauaguuuggauacuuauuacuaaugaauuuugauagaugcaaaccaggacuaucaauguguuguucucucauugcucauuuugccucuuuaacucacucgagagggccccuuguagcccuccuuaagucuaccuuuugaaauuacacaaguguccaaaaugaaaacugacuguauucuucuucaacacagaccaccugguggcccaugguagaauggcagaaaaggaggcacgucggaaguucaaacagaucgucacagcugucuauuuuugucacugucggaacauuguucaucgugauuuaaaagcugaaaauuuacuucuggaugccaaucugaauaucaaaauagcaggugagaacuguacugaggaugucagauagggacaaaggagcuuuuccuugggguucuauaagcaagggauuaucuguuuccaucucuucagaaagaacuauugugaaaguaaggacaauuuaagaugaaaaaaaaaauagccugaaaauugauaaacuuuaaaaguacuuccccuccccugcccuuuuuuuuuuuuuuucgagacugagucucauugucgcccaggcuggagugcaguggugcagucuugacucacugcagccuccaucucccagguucaagcgauucuccugccucagccucccaaguagcuaggauuacaggugcgcaucaccacgccuggcuaauuuuuauacuuuuaguagaguugggguuuugccauguugggcaggcuggucuugaacuccugaccucaagugaucugccugccuuggucucccaaagugcugggauuacaggcgugagccaccacacccggccuguuuauuuuuaauguaguaucagcuggaacuaggcuggggagaaagaagggaaaggugauauuuaaaauacuauuacuuugguuaacggguccuuuuuuacauaagaaauaaaauauguaauaaaguggaaaggaaaacuacuaaaauuguauacccucucaccuucacuugagaagguugauuuaugucacugcugacacagagcauacuuauucuaaaggcuguaauuguaugauaauuuaggaaaaauagaucuuagaguggcuuauaggcaguccagcuuuuugucuucucaaauuuuacuagucugcuuaucugacagugccuugagagcacuuuucacugccuugaucuguucaugcuuaauuuuaguaaacuaucagcauuuugccuaaugaauacagacucaccauuuacuaauaaaauuaagugacugcaaucuauagagaaacuguaaauaugaaaauaagccauuuauguuugccgacacuuuccgguauagcaucguguauccccggucucccagauaaaaggaaggacaucucauauagaaaacuaaaauauagcuagaauguaauugucuagaaaaggcaagguauaaagcaguucuaaggauuuucuuccuuaguagaggugggauuugagaguuuggauuuuuaucauaggucaaaguuaccuaaggguaccuuugcagggucacaauucuucugagaguugcuuuuguguagauaagccuguucacuuuuacauccuggagcaucaccuagcuuuuuauauaucugaaacugacagcuacacuuuuguuuagaacuuucauaucauuuauaaguucuuucacuccugcacuagcuuauuacagaguacacaggaauuaaaggcuuucuuuaucuuauauaaaaucauguuuuuccuuugcucucaugucgguuuuauuuucuccaaagcucuauagauacugguaguucccacaaagguguguggcauggaaaagccuggcaauuucaaaccuucuuuuguaauuauuuguuguagcuucaauuaaauuaauacuaauaauaccuacuaaacuucacaacccuuaaaacuguaauaaaagauugauuagugucuuauuauuacuauaacaaauuaccacaaacuuaaugacuuggaaaaacacagauuuguuagccuguaguucuggaggucagaaguccaagcugggucucacagggugaaaguuaaaacagcagcaagggcuguuccuccuggaggcucugaaggaaaaauguguccuugccuuuuuuagcuucuaaaggucaccugcauucuuuagcucagccccuuccuuccuucacuccaaccuguggcuuccauugucacaucuccuacuccuaauuccgacccuccugcuucccucuugcaaggaccuuugucauuacauugggcugucucagauaauccaggaucaucucucucccacccccaccuuuuuuuguuuuuguuuucgagacagggccucauucuguugcccaggcaggagggcaguggcgugaucucagcucacugcaaccucaacuuccugaguaucuggaacuacaggugcgcgcuucuaugcccagcuaacuuuuguauuuuuaguagagaugggguuuuaccauguuggccgugcuggucucgaacuccuggucuccagcgauccacccaccuuggccucccaaagugcugggagccaccgugucuguccucaucuccccauuuuaagaucuuuaaucauguuaauacaaguccuuuuuaccauguaugguaacacauucacaaguaugggggauugggauauagauguauuugggggccauuauucaacaugccacagaugucacuguaaggcucuuuggauuauagauuaggguagugaauuaaaagaaggcccucuggacacgcaccacccacucugcacugaccagcccaccuggauagcagaggacacccccagcccccaccaagcauugaagacauaguuuauuuccucauauccuuucuccuuggguguaguugggguggggaaggagggaagacuggggucaucuccauuccuugggcucugugcccgaguccauggugcaccacugugcugcgagcuguggggccugcugcagugggaguguguggaacaccuugaccaaaggggagcuuugucuuguguguuuugaaaaaggcuuaaugaagagaauguuguucauucuuaguaguauaguuugcaauucuuaaugacaaauaguaaguuucaguagaaaacaaaacaaaacaaaaagaaggccuucuuuauauucucuaguuuuauuuuccguccgcugacccaagauuaaaaauuuucuuaaugcucccuugguucuugauuuugaauuuaggaugauuuugauuuaguuaaagaaauuucuuuuuuuucuuuuuuuuuuuuugagauggagucucacacuguugcccaggcuggagugcaguggcaugaucuccgcucacugcaaccucugccucccccagguucaagcgauucuccuaccucagccucccguguagcugggauuacaggcaugcgccaccacguucugcuaauuuuuuguauuuuuagcagagacgaguuuuacuaugcuggccaggcuagucuugaacuccugaccucaggaguucaagauccugauccacccgccucagccucccaaagugcugggauuauaggcgugagccaccacgcccggcuguuaaggaaauuuuauauccuuuaguuuuuacauugagaaacucagaguaaaaacagagauuauugauaauugaaguuggaaacucuacugaaauauuugguaaggagauuuuuaaagacuuuucuguuguuguuguuguuaauaguuaaaacaaauucaaggagucacaaugagagugucuaccugcugauauauaauuacagacuccggggugcuggcagccagccuugggcucucucuguguuaacacauauacuuuggcaagauuuuuaaguucauuaacccaaagcguacauuuuuauuauuuguuuuaagagcaaaacagaaaaauaaaugagcaccucuaguuuugcggccugcuacaauaccuaacauuagcuuugcucaugcagucuuucucuuauaugccaucguuacucaguuucucagucauugccugaaccuccuuucuugcacauaaauuaaauagaauuaucauucucaccucccaguucuuuuuugaacuuaauggacuagugggagaaaugcuucuaguugaagccaacuagaacaugacuaauuuuggagagguagguuggauguuuuugacaggauaaggucagauagguaacgaaaucaacuuuaauucuaaaagccaaaaguaacuuucagauuccugaucuuuucaauggccucccuuuugguaaaguaucuuaaaugucaguaagaagaaacuacuauauaugaaagaaacaugcaagagagaaaaaggguuuuuugguuuuauuuuaagaaguuagucuuggcugggcgcaguggcucaugccuguaaucccagcacuuugggaggccaagguggguggaucaccugaggucaggaguuugagaccagccuggccaacguggugaaaaccggucucuacaaaaguucacaaauuagcugggcaugauggcgggugccuguaaucccagcuacucacgaggcugaggcagaagaaucacuugaacccaggaggcagagguugcagugagcugagaucacgccauugcacuccaaccugggugagagagcgagacuccaucucaaaaaaaaaaaaaaaaaaaaaaaaaaagagaaaagaaaaggagaaauuagucguaagcagcucaucuuuaaaauaaucguauauguuauaguaccaaaauaacuuggaacuaauaaaacucagauuaggaaguauaaaagauucauguuuucuguaugccauuguuuaagugauuuuaaugaaaauaaucaugcauccaguuucguguagaagaugaauaaauuggucuguggauauuuguguuuacauuaauuuauuuuuacauuuuguauuaauguggugauuuacauuugauacuguuuguuuguuuuguagagacagaaucucacuauguugccuaggcuggucucaaacuccuggccucaagcgauucuccugccuuggccucauaaagugcugggauuauaggugugagccaccaugcccgccccuucccccuucuuuuuuaagaaacuggguuaccuucuguugaccaggcugcaguggcauaaucauggcucacugcaaccucagccuccugggcucaagugauccuccugccucagccucccaaguagcugggacuacaggcauguuccaccacaccucgcuaauuuuaaacauuuuuugucacuauguuccucagccuggucucaaacucuuggccucaaccaguccucccuccuuaaccucccaaaguguuagaauuaugggcaugagccaccgugccuggccuacauuugauauuugauacuguaaaaagcuagcuaucacaacuguccauacuaguucucuucgagagaauaaguguucccuggauagauagauauuaguuauagauauuauaaguuauaauuauaguauaaguuauaucuucagucauaaauacuauaagauucagcugagcaagguggcaugcaucuguagucccagcuaguugagaucaaggcuaaggcaggagucuuacuuggacuuaggaguuugagucuagccucauagugauaccuugucuacugaaaaaaaaaaaagauugaaccauuguuccacuguuuaugauuuuuuuugugcuuaauucuuauuuaugaauuuuuguucuaguucuguuucuagagagaauaaagcccaggugaauaacuuuguuuucuuucugguuuuagaauuauuaguaacaaauccguguucuuaauggcaguagcaaaccugucuucuguagaauuuuuaaagagauguuucugucauuaguaauacagaagaagccuugaucauuuucagaauaaagaauuuuacgacagggagagguggcucaugcccguaaucucagcacuuugugaagccgaagugggaagaucacuugaggccaggauuuugagaccuggggcaacauagugagauuccaucucuuuuuuauuaagaagaaaaaagaaaaaaaaagaauuuuauuucuaaaggcaguuaccaagucuagaacuaagaauuuguggagguaaucuagaaucuuacuuguuaacgaagccuccuugcauaauggcacagaagagaaaaaagaagcgugaaacgugacuccagcccuaaagaacugaggcuauaugggcagcaaacauuagaucuuugaaaaguugguaacaccaaaauuaugcuuugcauauauauaauguacuucacaaagcauuuuuacauguaucaccuaauuuuauuggcaugcaaauauaucuuauuaaaaaaguaaaaucucuucaucuucuggcacuuuuaacucuccaaaacuucugaauuucuuguaaagagcacccaggcaagguauagagaaccccaaugcugggaaaagaguaggauucuuggccuccgacuuuuaacuuuucuugccugagauguguaaggauccacagaagagcaguugaaggacugacgaggcacaacacagcucacucagcauggagccggcaucgcuggaugauaguauccuuaacagcuaccaaauuauaguuggauacaauagaagagauguuacaaggcaugucaugacucauuaucacauuaauuguacagucuaauuagcauaggaguucagaggaugauagaaguacuguaguuuguaagauuccacaagauugucaguuccacaaggacuguaaccauguccuguuuauugucacacucccacuggcucauacaugccuguucuguagcaggugcuccccagcuuugucgaacugaaguucaggcgguacugauaaaggacauaaauauuguauugaggacauggcauuugaggugcguccagugucaugugauuggaugaucagguguagaggagagaauuccagcaaguguuaauaaggcaccugucaguugcagacacugauacaggcacggggguacagcagucaguaagauaaccccuuggaacuuauauucuaauggggauaaauagacaguaaacacaaauaagcucucauagggcugugacaaagauaaacucgaguaacauggcagaaugauuugugcgagagguacugcuuuuagccaggaucuucaaaacauuccacgcagaaagaagaacaaugcaaaggccugagagagauaaauucaacauagaagaaagggguagaagaaaguccagcauggcuggagauaaugaauaaaauggggauuggaagaaguuggggugagagagauggcaaaggccaguugcacgugguuaggaugugggauuucauuuagguuccagugggcacugaguuggagcagcgugggcagcaguagaaugcacaaggucuauuugaaaaaaaaaaaaaaagggugagcagcucaguggaagggaaggcuaaaggagaggagucuccccgagaaggcaggagcaguagauguuuauauuagauugaaaucauuugaauauaagauauaaggcuuaauuaauccaauucaguauggagacggcaaaaagcuggaagcugagggaagggaagggccuccugguaauaggaaggccaguuaaaggcugugaaugguaaaaucccgcaugagggugaugguggcaguaaacaugcaaaggaagaaaacggcaacaaauucaagagagaaagcaagcgagaauuucuaggaccagauaaccaaucauaugucuugaccaggaagagggaauuuugaaagauauguuuagaaauaaagaaaugaaauuuucuuacugauggauuauauuaagcuaucaaaaaaaugguguuuugaaaaugguuaauguauugcuauucgaaaguaauuuuaauguccuuguccccaaagauuaaguagcaaggugucuauauuuaaaauagauugccugagaaaaaacugaaauguagcuggcuuacucccugaagaaaaguucuuucaaaugcuuagacguuauaagaauguucugaaaauuguggaaacauuuuuuuuaaaccuaaggaaguuggaaacuuuugucuuuaaaugucgacucccagaauggucuccaugagauaguuuccacucucguguuauuguuuuaguuggcaaucaguagacagcaaagaucagaaaugcaacuauagaaaggccaauauccuggaaagaauuuucagagcauggauuuaagguaccauggaaaauuuugaccuuaaugcagugagagcuagaccauuuuauuauuuuuuagggagaaauuaaaacauuuccuaacucaauugaccuuucacccuuaguaugaauauacugagauaccaucauauagaaaagaaagguuggaaaccuuggauuuuugaguacccuuccacaguguguugacugacagugccucugacuggucacaggaaguaguuaugcaauacucauuauaucaaucuaaauuguauuucaugauucuaaugcccucuuuuuaggcuaucauucauugcaccucccagguugacauguccagugaauugagaccagagaggccuuuguguuuguccugaauucauaauagagucuaggaauuuuaauagcuagaccuguguucuugcccugaaauggcauaugaccauuaccaagaagcggcucuaaauaaccuuccugcacguugacccuugggaaaagaaaauuugaaauauuaucucucuugaauccuauuccugagacuagaacuuuacaaauuuguauucuacuuaaugucauaucuauauuuuuuaauauuaagauuauuaacuuaguuuaacacagaaaaaacguugauguuccaggaaggugcacccuauuuagccuacgguuucucguauaucuuggaacacugaaguguaacaccugaggcuguguaaacagaggccagccugagaagcugagaaucaagaauuugaugcucaaccauagauuccucuuacucacacuucuaguuugugcagagugacuucucuauuacuuuuccucagccucaaggauuuucaugccauuaucuauuaauugcacgucacuuauuuuggggauaauuagaaaaagggggaaugagagguugggaauagaaaaagggagagaagcaaagggcagaaaagaaauggaagcuuuugcuuugaggucuuguggggguggggguggaaaaaaaaguguaggagaagccugagcccaaaagcuugccuccucccucuacagggaaagggaguugagcggaguguaagaggguggauggcaugcgcuucugaccuaccaaagcaucuggaaauuucagacugcucuuugucucugagacuguguugggcacagcauugaauaaaguguggaucaauaaguaugugaagugcuggauauguuaauucacuggauuuaaucauuccucaguguauacauguaucauaacauguacgauguacccuguaaauauauacaacuauuguaauuugcccauuaaaauaaaacaaaauauaaauaaaacaugagcagugaugauuaaaagccaaaguuucaucuuaaucuguauaauaucuagaacaaagaaaaauaauuuuaucggcauuuuauugaagcugcagaaaaugacagcuuugaaaaaucucaagcaacguaugguuuaaggaaauuagguguacacuuaagcuauaguuuguuuguuucucccuuuccuuuccuuuccuuuccuuuccuuuccuuuccuuuccuuccuucuucuuccuucuuuccuuccucucuuguccucuccuuuucuuucuuucguucuuucucucucgcucucuuuccucucucucucucucucuuucccuuccuccuuuccuuccuugccucccucccucccuuccugucgcucagacuggagugcaguggugcagucauagcucacuguaaccuugaacucaugggcucaggggauccucccaccucagccucccaaguagcugggacuacagguguuuugccaccaugccuggcgaauuuuuaaauuuuuuguggagaugggacucguuuugcugcucaggcugguccugaacuuuugagcucaagagaucuucucaccccaccuaccuaacuguugggauuacaagcaugagcuacugugcccagccucuuaccuguaguuucuaguuuaagaaguuuuagaagaacauugauauucuauccauuuagaguaguguuuuacuuuuauuaguggcuauagaaacuauaagaacuauagaaaaguuauagaaacuuacaguucuuauaggaacucuaagaacguuuauauaagucugcccaaggucauguguccucaugaggaucguaagcuccucaaaugcaaguugauguugggaagggacuaacgaaucacccagagugcuccuucacucugauucugagggagucuuuauuguguugugugaagcguguuggaagccagguguggucgcacgcaccuguagucccagcuacucaagaggcugagaugggagggucgcuugagccgcagagguugaagcugcaguaagcuaugauuacaccauugcucucuagccuaggcgacagagcgagacccugucucuuaaaaaaaacaauaaaauuuuuuacuuuuuguagagaugaggucucgcucugucgccuaguuuggucuugaacuccugagcucaagugaucuuccugccucagccucccaaagugcuaggauuauaggcaugagacacugugccugaccuaaaaaaaaaauuuuuuuuuuuuuuuggcucacaccuguaauccuagcacuuugggaggccgaggcgggcggaucacgaggucaggagaucgagaccauccuggcuaacacggugaaaccccgucucuacuaaaaauacaaaaaauuagccgggcgugguggcaggcaccuguagucccagcuacucaggaggcugaggcaggagaauggcgugaacccgggaggcaaagcuugcagugagcugagauugcgccacugcacuccagccugggcgacagagcaagacucugucucaaaaaaaaaaaaaaaauuugaugugauauuauagaaauuuaaaauuaaagcaaugucaaaaagagugaggcugacuuuuuaggcaagccuuugcaagguggcagaauauuaguaaagguccccauuauaucagaaucugguugucauuuaugaguucugaaauauaccuuaucaguucucuuaaaaucauaagagagugaguauaauauuuguaucaguuuucuuagcaucaaaaaguacaguuugcuagugguaggcauggguauuucaucuagucuuuuuaaaauauccugauuugaguggucuuuggcucgucuuugcggagguuauacacagaccauccuuaauuuaccaucucaaguaguauacaggaucuuuucccagccagugacuucugaauccucagagauuuucaguguuccaagagauucaugucauacaaagugauaaugacuuuucuauuuuuuagaaguuaauaaaugaaauaauuacuuaggucuuuccgcccuucuuaaauggaauaguuugagagccucugaguauaaaucgagucuaccugcuggcagggcgcuaaugagcaugcuuaugacuuggucauuccauuuauuguucaaguaguugguuaucauaauagcuuugaccaggguacaguuuuucauuguauuuuauuaaguuuacaucuauuauggaucacuggauuauauaaagcauaaagaacacuaauguugaaauucaaauugaugaggauaaaaaugauaauucuguaaugccucaagacaaccuucaccaaauucaugauuugucuuuguuuggccaugguucuuacacagcacaucaaauuguuucuagggccucaagaaacaaaguuuaaaaauguuacauuacauacauacacacaaaauauguauauaccacauguauauacauuuuuuacacacauauccguaucuauaucuaucuaucuauauuauauccaguuugauuuauugggaauaaagacuaucuacauucauaguauauuauuugcaaagaagugcuaauaaguaaugacccaauauuuguuaauccauuucauuauuuaaaagcaaggcaugaaaauaauucauuuaaucaagucugguuuuuagguucaaacauguaaguguuccaaauccuaggucaugaaaaguauucaucuguuuuguguauuauaaucucaguauauuuguggcuuccaaagccaggugccgugguucaugcuuguaaucccagcacuuugggaggccaaggcgggaggaucccugcauaccagccugggcaacauaauaagaccccaucucuaucccaccgccugcccccccgccccaucaaaaagaaaaaauacacauacacacacacacacacacacacacacacacacacacauauauggcuuccuacuaaacaugauauaucaauuuuaaauaaauacuuuuucuugaauaauugaaauaaauagugugggucacuuguaugaugggauaauaugaauuugucuuaaaauucauagugaacuuuuaaauuaauuuuuaauguacuaauguaaaauaaaaugucuuuuagcuaaagucucuucuguaucauaaaucauagaaaaaugacaaaauuauuuuuaaaauuucuuucccgggagguuuuuaagauaauacauuccuuugaaaggaguuugugagucagaaaagcuggaaaauaaaaagguaacuguacugauuucuuuacauucuaauccaaguauaccaugguuuucuugaucagauugagugagucucugaacuguugauagaaccuucuucaggaaagccccauuucucuagaauauaccaauugccccucuggaacuuuuccuuaaaacucauccagugguuauaauuauauaguuacaugugugcuuguuucauguguaucucccccacuggacuaaucugcuacaugagggcagggaccaugucugucuuguucaccuuguacugagaauacauuugugguccaucaaaaaauugaggaggcaggccgggcgugguggcucaugcuuguaaucccagcacuuugggaccugggcggauuaccugaggucaggaguucgagaccagccuggccaacauggugaaaccuugucucuacuaaaaauacaaaaaucagccagcugugguggcacaugccuguagucccagcuacuugggaggcugaaacaggagaauugcuugaacccaggagguggaggcugcagugacccaaaaugguggcauugcacucuagccugggcgacagagugagacuccaucucaaaaaaaaaaaaaaaaaaaauugagaaggggaguacuuuauucccauuaucauauuuucacaucaccuuucaguuggguuacuuuucagaugucugcucucauuugaaguuuuuuuuuguuuguuuguuuccuauuagcuuuaaucuaagauaguauuuuguuaccuacucuuaauuucuagguaacaccuuagagcuucuuaagugacaauccuaucuucuuuucucuaaaaguaggcuucugcuuaucagaccauaugucuuaguuuuuaauuuggaaaaagguuuuuguuuuguuuuuuuguuugugguuuuuuguuuauuuguuuguuuuuuugagacacagucucacugugucacccaggcuggagugcaguggcccgaucucugcccacugcaaccucugccuccuggguucaagugauucaagagaauuuaaggggacacugauucauccuguucuauaaaaggcacacuaaaauuuuguauaccaugcucaccuaucauuauuagaaacuuaccugauuaaaugauuaggcuuuuauuguucuuguugauauucuuuacaaucaugacuaugauauacucauuaauguuuuuaagaauuccgaugaguacuguuugcauguguuguagaaagugucucauuauaauccuuuccuuuauacaucuagucaguacugaguuugaugcaaagauccuauauugaggagguguuuggggauuuauaugagaaggguuggauguugcuaucuaaaauaaauagaguggagaagacugguuuauuacuucauuuaaaauagcugaguucagcuauuguaccugcuaagguguuuugggauaaaaauacauaagucacucauuggaaaugccaauauaaugcugauccaaaucuccccccaaauaagaugauuacuugauuuuuuuuuuuuccuugaaggaauuuucucuuguguauauaugcuaaggcugugagucaggaguuuuuggcauuacuucucuauuagcuccuagugaggaaguucagccagggguugaagugauuacuaaauccugaggacuucccaauaucuguuuuuaagagugaacuaauauugugacuucugagaacuuugaaacucauccuuugucacuaccacaauucugagauccacacacuugacuuuuguuuuguucaauuucaaauaaagcccuuaggucauaugguuuggccagugacauuauauaggaaaagcagauuuaauuccuuauuagcgucauguuccauuuuaauagucaggagaacauucuaaauccuauuuauauacuguucuuacaccagucuugaucuuugguucuuugcaucauuucuagcagcaacauuucuaauuauuagaaauuucuaauaauuggaaauuaaucaaggaccuaauuauuucugucuucaucuuugggucucuaauugcaaaugcaguauugggauugugaauccucagaagcuuuuagcuuugaaaacaugaaggaucuugucacagugauuuuuggugagguuguucauuuaggguaaguaaauaucuucccacuucacuuuuuccccucugcucccugcuuccaagcuguuuacuuauacagcaaggaagugaagcacaaguuacccuuggaaagcaggguuguccgucgcucaaagcuguacuguauugccuuagagacacugagaacacuaguacuggcuggaaaguugugccuaaucuguuuacaucugcuuuggauuguucuuugguuagccaaaaaagaagucaaguucauugcucuaaagugguagaccaaauaagaaaauugccuguugcaguugcccugauuuauaaauuaaugccgcccguuuugcucuuuucccuuaccacauagacauauccaguugaugauauacuuauuuuuagggauaucaguuaucacuaccuuauauauccccaggcuccugaucucaccuccaacaaagaauuccaagucucaaaauugauaguaagcucugguauuuaagccuuccuagaagacagucauaugguucaaauuaaagucuccugcucuguauuaagagaaagggauuuaaguugccauuucagccugcggacaaaugcuaaccaacuaggguguuggggguuggaaagcaacuuaacaaauuauauugagagccacuugcgaguggagaaauaaaugaccauggccacaugaagagaccaacuucgcuccacucauauggcuucuguuguguaggugugcguauccaucuuaaccagcuucuucuguuucucccuguucuuccguaacucuuuagaauauucaucauuuuaauguugacucuguaggucauacaucuuucccauugccaguaaauaagcaguaagggauaucaaguauuuuaucggcaucaguaccugagaauuacauaaaacuaacugcucaguguuuuuguucuuauuguucaagaugaugucuuaaagucuuuauacuuaaaauaaaaauuuuaguuauagaauaauguaagcauacuauagaaaauuuaaacagcaacaaaaccguuuuaaauauucaagcugcaaucccaccucugaaaccauuguuaacauuuugaaugcauuuucuuuugucuuuuuacuaugcauguuuuucauacuuauaaucaguguauuuacaauuuuauauuucccauguugcuccauauagucaucauuuuuuuuuuuugagacagagucuggcucugucuugcccaggcuggaguucagugccaccaucucgggucacugcagccuccgccucccggguucaagcaguucuccugucucagccucccaaguagcugggacuacaggcaugugccaccacacccagcuaauuuuguauuuuuaguagagaugguguuucaccguguugaccaggcuggucucgaacuccugaccucaggugauccaccugccucggccucccaaagugcugggauuacaggcaugagccacugcaccuggccucaucauuuuuaaugagugcacaucaaguagauguaccauaauuuaccugaucuaccccauauuguuuuuguuuuguuuuguuuuguuuuaaaagacaggguuucgcucugucacccagguuggagugcaguggcaugaucaugguucacugcaccuugaacuccugggcuccagggauccucuggccucagccucccaaguagcuggaacuacaggugugcgccgcuucaccaggcaccauauuguuuuaugaucucaccaauucuugguauuagcacaauccucacuuuuucuuuggcauuuauuacugcauucuaaaacuucaaaguguguuuacuuaaccuuuugaacguacagggaauccuuucuuugccuuaaguuucuguguuuuuuuuguuguuguuguucuuguuuuucacuuacauugaaguugucauucuucuggauuuuuuuuccuuuauauuucaccagcauuuggccugcuagcacucuucaucuugagccaugugaacuaaacuucagcuuaugguagucuaguuuacuuuaugucuucuggaauccagcuagugguaaugaucccaggccuugucccuuucucuuucccaggcugacuugagcuggagcaguacagcacuccgguguuccuuagagcgauaugagcucuggaauggugaaagaagauuguuaccaaauacaaagugccugugguuuuggggagaugaugaggcucuguguguuuacuggcugcuuaccuuugggauuugaauaacuuaaagauuauaaucagaaaaaaaauagauucuuaaaaaaaaauggggagaguuaagauuaucugaaagauuacuaaaacuaugucaacuuucaguuauacagguuuuuaaaaauauuaucuagguuuuuuuuucuucuuuucuggcuauguuuuuucauuugauaguuuacauauugaaggaaaagaaggaaaaccuaauuuuuuuuaguguucuucguuaacagcucuuguuagaacuaaggaagcaagugauauuauagacaaaaaugaauuuuuaaauuauauguaguguauacuagcuuugucucuuacuaauauggguuacugagaaauaguuauuagugugggaguaauacuaauauuuucaaucaugugacuaauaagcauaucacucacaccuaauugccauuuuagcauuaaugauuauaccuaucacuaaaauauuuacucuuccuuuaaaauuauauuuaaugauaacuggaaacuucaucauuguauauauucuuccuagauuacaguuuuucuucauauaugaaaauugcuauuuucaacaaaaacuuuaguugagaucucugucuuaccaaguaguucccaguuccuacacucugaguucugauacauucauuuccuauuucaaacuguaucgcucuuuucuucccuuucucccacccucucuguucuuaguuagucagugaguuguuuuaagauauuuauugagugcuuucucuuccugucagcacugugcuaggcccuaggaaaucaguggugagaaaaaccucugcccucaaaagcccuaaugauuguggagcuuagaucccagagcagugguuccaaguggcgagaaauagcaguggaggaggaaaaggagcuauucuugucucuuuugucuuucauuuauuaugaaauauuauguuuauacauaaauuuucuuuaagcaucuguguauacuuuagugaaucacuagaagcaaauaccuguguaguaauuggcacucaggucaaaaaacuagaaaauuucaucagccaggcuguacaccucaucacaaccauauccuucccccaagagaaaaaaaauuuuuuuuguacuuuuguguuaaucacuuaugugcucuacuuuauagguguuuuuuuuuuucuuuuaguaguuuugccacugauguaaugcauuacuuaggaguuuugcuccaagggaugccauuuauacugaauauaauguguaguggguccauccuuaaacaauauaguuuugcuuguuuugaaugauacaugaauagaaucauauugauuauauuauuuuuugucuguuucauccaacagucugugagauuuauccauguuguuuguauagcugcgauuuauucauuuuuauuucuauauaguauuccaugauaugaauauaccacaaguuauuuuuccauuguaccuauuaauagcuauuuuaaaagcagaagccccuauugcuuucaguuuggggcacuuacuaacagcugcaacgaacauuccuaaacauuuauccugguauacucuuaaacauuaguguguauucuuaaacauuuaagaguguaaacugagaagugaaauugcugggucauaugguguguguuuuuagguuuuauuugguaaugcugaacuguuuccaguaggugugagaguuccacuugcuccauguccucuccagugcuuguuauuaucuacucuuaaauuuuugcccaucuggcaacuguguaaugauuaucuuguugugguuuuaauuuuuacuguuucucuuuaauaaugagauugagcuucuuuuugugucucuuggccuuuuuuugucaauugucaauagucuuuugcucauuuuucuacuggauucucuauuggucuuauugauuuauaggaguuuguuucuuuuugauagucuggauacaaguccuuuguuuuuuuuguuuguuuguuuuuuguuuuuugaugauugauugguugguugguuguugagauagggucucacuccaucacccaggcugcagugcaguggcgugaucacagcccacagcagucucggcuuccuaggcucaggcaauccucuugccucagccucucgaguagcugggaccacaggcauacaccaccaugccuggcuaauuuauauuuaguuuuugugaagacgaggucucccuguauuugcccaggcuggucuuaaacuacugagcucaagcaauccuccugucuuggccucccagaaugcugggauuacaggaguaagccaccacguccagccgaguccuuuauuuuauaaguuacaaauauccucccucacuuugugguuucucacuuucuguuuaacguguguauaaauuuuggcauaauucuaauguaacgaaguuuaccacuuuucccuuuaugauuagcacuuuuuguuucuuguuugagaaauucuuccauccccugaggccguaaagauaccugcuuuuuuuuuuuuuuuuuaaauaaaaacgugauaguuuuaccuuucacauuagggcuauaauccaccuggaauuaauuuggggauagagugugaggauggcagccucuguaauuuuuuuccauaugaauaacgaguuguuccugugccacuuuuugagaaauuuauccuuuucccauugauauacagugucuaccauucuuuucuaugcauguuuuuaaaagaaacuugacgcaguauuccugaagcauuaugugucuuugggaauuaacauaagcagagcaaaggguggcagucaauaauaaaaugaaaaacaguaaacuguaauaacuaaggaauuugcaaguuuuuuguuuuuuugagacaguguuuugcucuugucacccaggcuagagugcagggugcaauuucgacucuggugcaacccuccgccuccuggguucaagcaauucuccugccucagccucccgaguagcugggauuucaggcaccugccaccacaccuggcuaauuuuuuauuuuuaguagagacgggguuuugccguguuggccaggcuggucuuaaacuccugaccucaagugauccgccagccuuggccucccaaaguucugggauuacaggugugagccacugugccuggcaaauuuuuaaauuucaauaaaaauaauuaugggauguacgugaacuuaaauauaaacacauacaugaugcugaaagcacaauguggggcuggauuuugagggcacugagaacuggcguuauaggcugcaucugauucauacuaauuuuucuuuaaccuuuauacuugggaauguuacuuuugaaccucacgucucaggcauaaaacaaaaauaaugcucaucucaaugagguaauaaauacaaggugcuguagcgcagcacucaacagaagguccuuugaaaaacaacuguuuaauacugcaaagugcagcacaaauaggaaaacuguugcacuggagagaugagucaaggacaguccaguuccaagucuuucugggauacauggcucccuccagggcucuugccacucaccugcauggccacgacguucguuucuaaguacucugaauauauuuguauauaacuuaggauuaguaucuguugguugucaucaaucuugguaagaaaugccuaauuuuauucacagcuugacauuguagauaacucugaauggaucuggauuauauuuguaguccauuucugugauguagccugucuuuacaacaaauaaacaaaaauucugaggggaaaaugauaccauuucucaucgagaauaauuaugucaucauuuguuuucccucagaucaaaguuacauaacacuuggaugagauuacauggaugcuguaagccaccuuuuucugcuuuucugcucucucggcuuccuuguuacauuuuccugacuuucuuccuuuagccgcgcuuucucucuccuuuuugcugcauccucuuucuguucucgcaccuagggaauaggaaguaccucuggguguuuucgaagccuuaauucucauccuucccuuuucucuacuuuuucuuucaaaaauauuuuauccuuuuacuacuauaauucaguuucucagaauaucuucacuuaaauuucugaucaccuucucaaacucaggacauaaagaaaaaguaauuuuuuuucuucccaaaccaacuucugcuuuccuuaagucugucaucugcucagggccauauucucuacuucuccuucuuuuucaucccauauauucuguuuguuaucaaguacuguccgcuccuuucagaacaucuuuugaauuguuuuuuucauuuucaauaucucaucugaucacagccuucaauauucaccucacaccuaaccuaaucuugcuuucuaguuuauuuuaccacuucaccugccugcucagaaguccuagcaacuccuuauugccuguaaguguggcucucaaaccucuucagaaagaacuguguuuuacugguaccuuuauauucacaccaaaagcauaagugacaaaaggaaauacagauaaguuggaccucaucaacauuuaaaacuuuugugcaucaaaggacaucaucaagauaaugaaaguccacagaaugggagaaaauauuugcaaaucauauaucuaauaagagauuuguauccagaauguauaaagaacacucacaacucaauaauaaaaagauaaccaauuuuaaacugcacaaaagauuugaauagacauuucuccaaagcagauauacaaauggcugaaaagcacaugaaaagaugcucaauauuauuagccaucagggaaauauaaaugaaaaccacuguaagauaucauuucacauccacugggacagcugaauugacaauaauaaguaauaauaauaaagacaauaaguguuggcaaagauguggagaaauuggaauccuuguacguugcugguagggauguauaaugguacggccacuuuggauagcaguuuggauacuuccuaaaaaguuaagcagaguuaccauaugacccagcaguuccacucccagguauauauccaagagaaaugaaaccauauggccacacagaaacucacauaaauguucauagcagcauuauuuuuagucgcugcaaaguggaaacaaccugaauguucaacagaugaugaauggauaaauaaaauguggaauguccauaccauggauguuauucagcaguaaaauagacucaagugcugacauaggcaacaacauggaugaaccuccaaaauauuaugcucagugaaagaagccagacacuaaagcuuauauauuguaugauuccauuuaugugaaauguccaaaauugacaagucucauagagacagaaaguagaaagccuagggcugggccauuggugaaagacuugaaggguguuggggaguaacuccuaauuagcacaggguuucuuuuuggggugaugaaaauguucuaaaauuucuucuuugguuuuuucacugccuuuuccuuacaaggugaaaaauguucuaaaacugauuguggucaucgucgcacaacucugugaaugcgcuaaaagccgcugggcauuacacuuucaaugcgugaauuguaugggauauggaauacaagaaauauguuauggccaggugcagcggcucaugccuguaaucccagcgcuucggaaggccgaggugggaggaucaugugagcucaggaguucgagaccagccugggcaacacagcaagacccugucucuauuuuauucuauguuuuaaaauuuaaaaauuaaaaagaaaaaagaauaacauuuuauaagaaaauauuuuaugagagacuuauaaaagagacauuaagaauaugaaguaauauauuucguauuccuuaucucaauaaugcuguagggaaaaaacaauugaaauaaaagcaguaaaugaguggagcauggagagugugucaugagccaaagguuauaauaaauucauaaucaaguuuuuuuguaucugaagucuaauaaaauuuuuaaauguggaggaaaaaaaaaggaaagaaaaaauaguaaugguucacaggaugaaguccaaggucuucauucugucauuugaagcuguauuuuaucuggcaugaugcugcugugcacucuuuauuucuugccauaugccccuacaaacccuuuauuguacccagggcagugucuugcuugucacuugaacuuagcgaguuaauucuaaguguucugcccuugcucgugcucccuccugacugccauucagagcacccuuuccaccuuccuucauugccucuccagauccuggccauucaaccaaguucugcuuccuuugagccuuucccuagaacuauguuuuaugccuuugguuuguuagaagaucuaacacauugcuauucccauuggaagaguuccauaaauacauguuacauaaagagugaaggaaauggaggaacuuacuuagagacuuauaaaagagacauuaagaauaggaagcuuuaguaaauaaugaaagauauugugaauuagaguagcuccagagccaaaauaagaugaaaaagccuauuaaauagaaaugguuuucuagguucaaguucagaucaaacuuaagcucuaaagcuuuucuuggcuuggugcaguggcuguugcuuguaaucccagcacuuacgaaggccuagucaggaggaucgcuugagccuaggaguuugagaccagccuggacaacauagcaagacccccaucacuacaaaaaaauuuuuuuuaaauagcuaggcauggugguguuugccugaagucccagcuacuuaggaggcugaggcaggaagauggcuugagcccaggagguaaaggcuucagugaacuaugauugugccacugcacucccaucugggaaacagagcaagacuccaucuccaaaaaaaaaguuuuucuuuaccuuuuucuuuggcauuucugacuuaagccagugagaauucuuccucauucuuuuuuacucauugcuugaauuuguguuaugagaauuuuuuuccuccaacuuggaugaucuuucaauuuuuuccaguugucuauacauguagauaacugaaaacagcaaagcucuuagugauucuguuccaugucuaucuguuccccaccuccauuuccuaccacacaccccagcauuccccuaguacaucacuaaacuaucaacagaaccuaaaauagacuaguuuguuuuaacuguauuuuucuuuccaguccucuuaaaaugugcagcaaaauguccccaaaggcaagcagcuaagagaaugaagaggagguauucucccaucacaguuacucagucccagaaguauugauuggaaggcacugaauuuucaaaaugacuuccagauuuaguacaugguaauaauuugaggcuuucccacacggauaauuuaaauguucagaaaauaaguuauguuauagcugaaugggcagcaaauuagacagaauuuuaacuuacaagaugcauagcaauagugaagauuaaugugaaauacuaguaaagagccacugguagggaagagaagacagcgauaugcuuucaaugaaaccgucaauuuauaauaauauguauauugaaaagggagaguggaucagauccuguuagguuugguacguuaaagaaagaauuaggauaccgcaggcucaguaauuaaaggaaucugcccauaauugggggguaaaaggugucuuguaggcagggaauagcaagauuuugcuugaauguacaccuuagaguugggaguaacaauacuuggaaugauuauagaagaccucucgacagguuucugagacuagaggauuuuguuuggugcauaauaggagaugagagcaagccaguaguauuugguuguuguugaaucuuacagaaaucuugcauuugguuauugggucuagcuguugaagccagcuguuuggauguaacauaguggaagcaggugcuucugcagauguggcucucucuaguugucuggcuguaauauaucauucauucucauacacucauuucucauauaaaauccuuauaacuauuagcagucuaagccugcagacauugcugaagcugguucccuuugauauuguuuucuuuguaacaguuuccuguuugguagauaaaauaacaagcucacacuauuagguuugugccuucaccucccuggcaaaguaacaugcuagaaagguuacuaaacauuagugguucaaaaugagaagucuguacauuuuaucugcuuauaggcgaauuuaaacucaacugguuuaaauucauugcuuagccuguugcaugcuccauugaaaacacaaacaaaaaacuccaugauucuucuagccaugauucuucuagaguuuguuauccagucauuccagugccagaauccaucaggcagaacagaaucauucgcauuucuccucugcacuggagagaagaggaaggcugaucauggaaaaggaccuggugaagguuuuuugcaaaucuaaggaucuuuuuucugucuuuuauuuuugcaaaccuaaggaucuuccuucuggauaauucccagagacgucaacuuugcugaaucucaguuguugggauuuuuagcaaccuguucccacucuccuaagaaaaaaaucuuaauagugaccagugugugcagacuuuaauuuguaagugaaaguuacgguguuucaaaaguugcagguuaguugguagagcauuaaaugcaguuuuguucauagucaacauuaagugcccacuguguuaaacacuguuagauacugugaaagagagaagaauaagguaaggaacuagagagagaggguagaucuuuacaagagaggauguuuuucaggagcuagaagaauacauuauuuauguauucaaauaauaaagggaaagaaaguacagacagaguagauaggggacauuucuuguaggggauccaggaggacuucacagaagaaguauuauuuauuuccauuaaugaaugagaguauucaucuucucauagaagaagcuauaaugauucuauuugugguccugacugccacaccccuuaugaucauuaaguuaauuuuagaaccuugggagggacagcuaggaggcagaggcucucguugcuggccagcugccauugucaguuugagaagucuccaguagucaggaggugacaagaggauuggcccaguuauuuuauugcaguuuaauuucgugacccuuucuugagucucugcuauguauuagaaccacuguguagagacuaggauaaauaaaacgguaucuccuccauuuacuaauuaauggaggguauaaacacacaauacaauuaaguauaauauaaggcagaggcugggcgcaguggcuuacgccuguaaucccagcacuuugggaggccgaggugggcugaucaccugaugucgggaguucgagaccagccugaccaacauggagaaaccccgucucuacuaaaaauacaaaaauuagccaggcauggugaugcaugccuguaaucccagcuaccugggaggcugaggcaggagaaucucuugaaccugggagguggagguugcggugagccaagaucgcaccacugcacuccagccuaggcaacaagagugaaacucugucucaaaaaaaaaaaaaaaauaaauaauauauauguauauguauaugacagaacaguaaugggauguagaggcguaaacaaaaggcuguggaagcacggaggaggaagccauugacaugguguuuucugguggaaaucaguuaagccuucauacaggaaguaauauuugacugggccuugaaaaugagugauacuuuaaagauggaaaagaaaggaaaaggcaugguacagagaggaaauagcauguggaaggcauguaaacacaggaugugaauagucuagugaugcuagcauggccagggauaaauuggaaacauaggauggagcuggguugugaagggccuuaaaugacaaugcugagaugaagacucuucuguaaguagaagggaggcagcccauguuuuuugagcgaggagguaacaggaucugguuuguguaacuuugugcuaugaauggauagcuuaggggaaaaugaaauaggaaguaagcaauagcaucagucaagcuagggaugauaagaguaugaacugcagugguagaaauggaaauagaaaagaggagguggagucaagacacauggaguugaagcaguaagaguuuuauuaccagguugaaaugggaaacgagggagaaaggacuugaagaugacuccaguguuucuaguaacacagguggugaugucacuaaugaggguaaaagcacugaaagcgcagguaugacuuuggaaaaugguggguuugagguguuucuucccaagcaaguauuggggauucaugccaagaacuuaagagugguaccagggccagacauauaaauuugggguauuuauaucaaaugcugguagaaguagcgagauuaaaagaguuagcccugagaaaacauagagcaaggagaggcaguuaaaaucagcagagccugcugaaaaacaccuucuguagaagguagaaagaaggaaagcaaauagcaaaaggagaguugucaacaagaguaaaacuggaaaagagagggacggguuucagagaguaggugggugcuuaacauuuucagaugcugugauuucagggagcauggugucccuggggcaugagggauuucuagccugucacauggguacacauacauaaauaaaagcauuucuacaccagagacucaauccuuuggccagccauccuugcucauugucuuaguguagcuccugaagacucaucccugcuaccucccaucugcugcgucuuguagcaguaggagagggagagaagaagggaggaaaauugaagcacaaggagaguuaaaauuaaaauguaagcauucuugcuucaguuuguaaauaaguugcauauucuuccuuuugaauaaacuacuuaauuauaauaaugucacuuugucuaauuuuuaaauggucauagauguguuugucauaagaaguaaauauaacauaaaaauucuggguccaagccaaaagaacaaagcuggaggcaucacacuaccugacuucgaacuauacuacaaggcuacaguaaccaaaacagcaugguacugguaccaaaacagagauauagaucaauggaacagaacagagcccucagaaauaacgcugcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuacacaaaaaucaauucacgauggauuaaagaccuaaaccuuagaccuaaaaccauaaaaacccuagaagaaaaccuaggcauuaccauucaggacauaggcaugggcaaggacuucaugucuaaaacaccaaaagcaauggcaacaaaagccaaaauugacaagugggaucuaauuaaacuaaagagcuucugcacagcaaaagaaacuaccaugagagugaacaggcaaccuacaaaaugggagaaaauuuucgcaaccuacucaucugacaaagggcuaauauccagaaucuacaaugaacucaaacaaauuuacaagaaaaaaacaacaccaucaaaaagugggcaaaggacaugaacagacacuucucaaaagaagacauuuaugcagccaaaaaacacaugaaaaaaugcucaccaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguuccaccauuguggaagucaguguggugauuccucagggaucuagaacuagaaauaccauuugacccagccaucccauuacuggguauauacccaaaggacuauaaaucauguugcuauaaagacacaugcacacguauguuuauugcggcacuauucacaauagcaaagacuuggaaccaacccaaauguccaacaaugauagacuggauuaagaaaaugugucacauauacaccauggaauacuaugcagccauagaaaaugaugaguucauguccuuuguagggacauggaugaaauuggaaaucaucauucucaguaaacuaucgcaagaacaaaaaaccaaacaucgcauguucucacucauaggugggaauugaacaaugagaacacauggacacaggaaggggaacaucacacucuggggacuguugugggguggggggacgggggagggauagcauugggagauauaccuaaugcuagaugacgaguuagugggugcagcgcaccagcauggcacauguauacauauguaacuaaccugcacauugugcacauguacccuaaaacuuaaaguauaauaaaaaaaaaaauucuggguccagcugaguaggcuuacauguguuuccugauucuaauguggucuuaacaucauccaguuucauuugcauucuuuuuuuuuuuuggagacggagucuugcucugucgcccaggcuggagugcaguggcgccaucuuggcucccuguaaucucugccucccagguucaagcaauuccccugccucagccucccgaguaccugggacuacaggcgcacgccaccacgcccggcuaauuuuuuguauguugguggagaggagguuucaacauguuggucagaaugaucuccugaccucgugauccgcccaccucggccucacaaagugaugggauuacaggcaugagccacugcccccaggcccauuugcauucuuaaaggaacaaguaccacucgcuuuauucugccuagguuuaugaagggagcaguacuauuuuugcugacauaaacugaucauguuuauauuucagcucaucuauaucucuguuucacuauuauuguuuuaagugucuggcuaugugguuucuaaauguucucuuuuugcauuuaauauucagacaaugauuuggaaucuuuagugacuagagacuaguguuugcucaguuauaauaaaagguuacaauaauacgaauuauguccauuugccuuucuagauuuugguuucaguaaccucuucacuccugggcagcugcugaagaccugguguggcagcccucccuaugcugcaccugaacucuuugaaggaaaagaauaugaugggcccaaaguggacaucuggguaaguaacugccuucucuuauaccccacagcauuagcuacccuugguugaugacagcuauucgcauccugaaggauacauaaugaugcaacaugaauugagauccuggucaccuguucuuucaagucccaauuccugugcaaagccuuuuuuuuuuuuuuuuuuugaaacagagucucacucugucgcccaggcuggagagcagcaggaugaucuuggcacacugcaaccuccaccucccagguucaagugauucuccugccucagccucacaaguaguugggauuacaggcacaagccaccacacuuggcuaauuuuuuguauuuuuaauagagacaggguuucaccauguuggccaggcuggucucaaacuccugaccucaggugauccucccgccuuggccucccaaaaugcugggauuauaggcaugagccacugcacccggccuacucgugcaaaaucuuuccuccaauacuuaccuuguggacugagccacauauuucaaauuuccccuuugcauuugcaaaagaagcccaagggccagcuuggaugggggccguugccaagaagagagauuauuucuacuguggccacuuaccuuauccccagagaaugaguacugagaaaaauucaggauguuacccuaaauuaaugccuagaagcaaagaagauuguuaacuguucuaagauggaagaaaaaguuuguuccauaaucguaugcaugacucaccaucaucugcauacacacacuacaguagucuuuuuuguuuccccugaugugauuaauuguacauccucucuguuugggaugcagagccuuggaguuguccucuacgugcuugugugcggugcccugccauuugauggaagcacacugcagaaucugcgggcccgcgugcugaguggaaaguuccgcaucccauuuuuuauguccacagguaagggagucgcuagcacacagcuaugaauggguucaugaaaguuagacccacucaguuaucccaggaauuuagugauggaguauaaauggcccacuuacaaccuuuuuuaacuccagcuugcugaccugaugccuccaggaggcaagguucuguagaaacaguauauagguuuuggcaucagagagcccuacuuggguuugaaucugggcccuaagucugucucagcuuuaguguccucaucuauaaauuggcugagaguuuugugagggcugcuauuacuguaaggauuaaaugagauaauguaugugaagacucaguaggcccauggcauagcaguaaugcaauaaaugcuuuuguuucacuucugucuuccuacccuuuuucaggauauuuccacuuauuggguucucauugcaaugugguuuuaaaugccaaggauaaaguaggcuuugcaucuuagucuugcuacugcuucauuuccuauuucugugcucuuuguccuccagaaucaaauuuaaaaaauuuuauuuaacgagugggcaguaagguaggcaggucuuggaaaaauuuaacaccgaaaauagauacaagauacucagaauuaacaguauuuuaucaccauuuauuugcacauaagaagggaacauuuuagagaacgcaaaaagucauauaguuuugcuuaaucaucuguuuucauuuuaaggaagaacauguguccacuggguugacaacaagguagaagcccaugguaauugcauuuuagaacaaagaggugaaccuuggaguagauuuaacuuggcuccuuugaacugauaacgucauaguguagaagauagugcuaaaugcugugggacaaauaaaauagagaaggaguuaggauagugguugguaaguuacaugaaaaccccuucauggagaaagggaccuuucagcaaagccugaaagaaggugagggugaaugcugugcaguccggggaagagcacccccuggcuguugaggggucagcgcagaggccgcggggauggagcauggcugcaugugaaggaacgggaaggaggccugcgugccuggaaggaaggagcggugagagaugaggaagagagaugaggucagagagguaagagggagcuuaauuuuagggccuaguuaauguaaagacuuuagauuuuacugugacugaaguauacaggauuggaggguuuugacaggagugauguaaucugaguuuuauuuuuuccaaauuuuaugaugaaaaauuucaaacauacaaaaaaauugaaaaauuuugcagugacuuuuguuuaaaaaagaucacuuuggcugcuauguugccgguaggcuaaaagguacaaaggcugaaggagggacaccaguuaggaggagacuuuuacaauaguccagauaagagauguugguggcugguucccagucuggggugucgagauggagaugguaagaagugaucagauucaagagaugcuaccuaccauguguggcaggcacuguucaaagcacuucacaaacauuaacucacuucauuauuuuaacaacccuaugagauacacaagauuauugucuccauuuuacuggugauaaaacugaagccaggagagauuaggcaauuuucccaagauaacacugcuaccaaguggcugaaguagaauuugaacccagguauuuuggcuccaauaacauuuaguguuggauuugauaugaaagaaagacuccagaguuucuauccugagcaaauggaaggaugguuuuacugccaacugagauggggaugacuggggaagaauacuuacauuuuggagagauguuuuagacaugucauguuugaggugcacauuagacaucagaguuaagauaugaauuggcagucgcauuuaggagagaauucuggguuggggauguauguuuggaauccccaguguauagauaauaguuaaagccaugaggugagcucacuuuuuaggcagugguuacagagaagagaagagguccaugaauuaaacucuggaacauaccgcuauuuagagaacaagcaggugaagagguaucauaagaguugcuggugagguaagccagagggccugcuguccuaggagacaagugaagagacuguucccaggaggagggaggagggagugaggagcuguggggagugaaugcugcugccaagucagguaagaggacugagaacugaauguugcauuuagaaauguggagaucguuaaugauuuuguuucuuuuuuauccccccacacccucaccuuccuagaucauuaaugauucugaaguacacuuuuggcagaggaacaggagcaaaagcuuaaucaugugguugcaacaaaaaaggaauagaaggaaaauagacgacacgcucuuuccaguuuacuauaaaaggaagcagagaagugguccaguauugcucuggccagggucaccagugaucucguuauugaucaacugcauauccuuagucuuuuucuuaaucacugcccagcagugauuaacacuucacccuugcccucccucccucucuccuuuccucccuuccucccuaacucccuuuuuugggacugggucuugcucuguugcucagguuggaaugcaguggugugaucguggcucacugcagcuggaccucccaggcucaagugauccucccuuagccucccaaauagcuggagcugcaggcacacaccacuaugccugacuaauuuuuuuuuuugguagagaugggguuuugccauguuguccaggcugaucucaaacucuugaguucaggcgaucugccugccuuggccucccaaagugcugggacuauuggugugagcuacugugcccugucucuuuagaguuauauguuagagcagcuuuagauucacagcaguauugaguggaagguacacaguuugcauguacccucugugcuguccugccucccuccccugcugaccccugucauaaucaaugugccccaccagagugguauguuuguuacaaucaaugaacaugcauugacacauuaucacccaaaguccauagcuuacauuuggguuuucucucaguguuacacauucuguggguuuugguaaauguauagugacauguauucaccacuauaauacauauaaaauuguuucacugcccccaaauccucugugcucugccuguuuauccauuucucccuaacccccugcaacuacugauccuuucacugucuccacaaguuuuuccuuuuccagaaugucauauggguagaaacauacaggaugcagccuuuucagauugguguuuuucaaauaguaauaugcaauaagguuccuccaugucucuucauggcuugagagcccguuucuuuuuagcacugaauaauauuuccuugccuggauguaccacccuuuauccuuucaccuacggaugacuugguugcuuccaaauuuugacaauuaugaauaaagcuacuguaacaucuuugugcagguuuuuguguggacauaaauuuuuaauucauuugguuaaacacuaaggagcacaauuccuggaucauaugguaagagcauggauaguuuuguaggaaacugccaaacugucuuccaaaguggcuaugcuauuuugcauuccugccagcaaugagugagagcuucugcugcgccacauccuugucagcauuugguggugucagcauuuuggauuuuggccacucuaauagguauauagugauauuucauuguuguuuuaauuuuuaauucucuaaugauguaugaggaugagcaucuuuucuuaugcuuauuugccaucuauauaucuuuguugaggugucucuucaggucuauuggucguuuuuaacuucagguuguuuuauuuucuuauuguugagucacucauuacauuuuaaaacacuuuuucucauugcuucugagacgccauauucuccaguuuuccuccuguccucuggaagcaccuucuccaucuucucuaccagacuuauuuuucucugcucauccuuuagaucuuuucaucuuuacaacaucuuucuggagccauguuauuuacugcuguagcuucacugaucacuguggugaucaguccucaguuaacuuuuugucccagaccucucgaucuagggcgacauauccaaguauuugcuaaccauuaucuucacuuucauguauugaagucagaucaauggagacauauucagaaaugaacuugacuucccccucccuagauuugcucuauucuguauuugcugccuuagugaauagcaucaccaucugaccaaggccagcacaagccuugauguuuccucucucaccagugccacagcugaucaguuaccaaauccugucaauucaacccuccauucauguaggcacuucuaagaccauacuaucaucuucccuugccucaauuaaacaauagccaauuauauggauuccuggcuccagucuugucccccucuaaucuauugucaacuuugcuacaugacuaaucuuuccagaacacaaacauauaaauaaauaaaacauaccacacacacacauacacguacauuuucucucucuuucucucucucuuacuuaaacacacaaaucugauuauaucauuuucuagccugaaacuuuucagugguuuaccauugccucuaagguaaaguuuacuccauaagguggcaaagcauuggcuuacaaacauuuuuggcuaugauaagaaaaaaguacauuuuauacugugacccagaacacgcauauauagauacaaaugaacaaaagcuuuguuugcuugauuuagagauggggucuugcuauuuuguccagacugaacucgaacuccuggguucaagugacccuccugccucagucucccaaguagcugagacuagaggcguauaccaccaugacugaaaacaaaagacuuuuuuuugagacggagucucgcucugucacccaggcuggagugcagugaugugaucauagcuuccugcaaucuccaguuccugggcucaggcaguccucccaccucagccucccaaguagcugggacuacaggcaagcaccaagcaccaucaugcccgucuaauuuuuaaacauuuuuuuauagagauggacucucucucuguugaccaagcuggucuugaauuccuaaccuuaagcgauccucccuccuugaccuccaugagccacugcgcccagccagcaaacaauuuuuuuaaaaaagcaaaacuuaccuuacuauguacagugcauuucaauauauuuuauucuauuccauuuuaaaaaaugcugauuucgacuuacuaaauugaucuccuaucugcuauuucagaaacaaugacauagaaauaccuuuauaaccugacuccugccuagcucuucagccccagcucccacucucccaccagucacccuaauuuucuucucguucccugaacaaguucuguuuucuggagcauuucccacugccgagaauacaucuucccuaucccaccccacuccacccacuccuguauucuagaauucagaauaaaaaaaauuagauuggauagaaauaagaaucuagauaauuucuauucacucuucaugucucuaaacuuucucuuaucguggugcuuaccaagcuuuauauuguaacuacuucuuucauuguaugucuuccacaccagacugaacuuagugaaaguacagacgaaacaugucuuuuucacaacugucaauaaccuaccacaggaucugguguguaguaggacuuaguaaauaugaaaucugaaucagaaccaccccauccccaguggcauuuguuuacauucagaauaaaauucaaggagucauuauuacuauggccuacaaggcacagcugucauugccccuucuuuggucucauuuccuguuacuguucaccuccgguucugagcuccagucacagggccuuccuugcuguuucucagacuugccaaacacauacauuccccucagagaggagucauagguccccucagagaggccuguccuggcuacccccaucauucucuuucuguaauucugcuuuuucuucauagcacuuacuuuauugucuccucaccuccuaucaccacuugaccauaauaagcauuugguuuuuguuuacuguuauguucccagggcuuuggacggugccugaguucuaguaggcacucaguaaauauuuguugaaugaauuaaugcauaggguuguucgaacacugacuccaaaagccccucuggagaguagucuuauccaaaucauaauaucaguaguaauaucaaauaauuacauuuguuuagggcuuuugaguuuauaaaauaauuucuuuuuuaauagguuuauuuuuugagacaggaucucugucgcccaggcuggagugcaguggcgugaucuuggcucacugcagccuccgccuccugggcccaagccauccucccaccucagccuccugaguagcuuggucuacaggcgcacgccaccacgcccaccuaauuuuuguauuuuuuuguagagaugggaucuuauuauguugcccaggcuggucuugaacuccuggacucaagcaguccgcccaccacggccucccaaaguuuugggauuacaggugugagccacugcacccagccaauauauuuuuuaaaaauauuucaauuuuucaguuuuuauauuuuuggcgacagggucuugcucugucaccuaagcuagagccuagugguaugaccauagcucacuguagccucaaacuccuggguucaaacaacccuccuaccucaggcuccaaaguagcuaggacuauaggccugugccaccauuccaagcuaauuuuuuaaaagauuuuuuguagagaugagucucacuacauugcccagucuggucuugaacucuuggccucaagcaauccucccaccuuggccucccagagugcugggauuaugggcagaagccagcauacgcaaccuaaauuauuuucuuuuacuuaaucuaauuugagcuacauaacuauauuuuagaauagguaauagcacauauuuuaucaucuugcugaugaaguuuuggaagcugaaguuuagagaaaugaguuaacuugccaaagccacacagguaauaaguaacuaggucaguauucaaauuuaguguuuguuuuacuacaccauacuguugcaaaaagagcaagauaaaccacuuccuuuacuuuuccaauguccacaguguuuccugugagcaacuuggaucuuuucuauccuccacccccaucaccucacaccauggcaagagauucuuacugaacccuucccggagccggcuucagauaggggguccuagaaaacagcuaagcaugcugucagccacacugucuauuagugcuuagaaauaaacuaacagucuaacugcuuagaacuauuauuuguaauaugauguuaguuaaccugaaagcuucaagacucagagaaagccaacaggauuauccuaaacguagucgcucuuuaaucccaguuaaauaauucccuaaguagcaauacaaguuuuuguaugauuaguacagagaaugagaaacaaccaggguaggaagucaguagauacuugcuauauuaccaauaugaucucucuggcccuugguaauauacaugugcuuggcauugcugaaugucauaggccuaaaucccaaggcccauuagagaauacuucaaaaggauaaggcauagcagaaaaugaauucaucgguuauuuaggcuuuucuuagcuuagacaaccuucaaguaccagaaagugucaggugaaggaaguuuagagucugucccagaguccuuuuucugcuuacgccucguguuucugggcacaguuguaucucaguagaccuggagcauagucuucugauggaggcgagugcuggcugcuuuucagccugugaggccagcugcuauugcuguauuacgggagauagcgugauugagagaauuccuuaugcacaagauccuuccuuuucucagcuguugucauaggcuugagcugaguuuaucuguuuuucuuccugaagggucuagaaacuccagcagagcugguauaguguucuaaaugaucacuuggaagaccagagggcaaagccucuaccauguagcugcuucuagccaaguugaauuccagaguagcuacauacagcugugugggaggccaugcucugcaaauggauauaguuagcucaagaauucuaagcugcucucuauugucaguaauguguggaaugaaguauccucacaauucauguauauuucuaugccugguguuguuuguuugacacaaguuuccuuucauaggcauccugagauguacuaaagacauauauuuucaaguuggaaugacaguggcauacauuuaaaagaggauuuauuugaggcuagguugauuguauaccaccuaguuuuuauaauuauguaugugucuuccuccucuccccacuagaauguaagccucuugauuaucagagcuguguuuuacacucaauaccuuccauaaaaccugacagccccugguaagacauaagcauucaguaaguguuuuugaaugaaaaacugagucaucacuacuuaacuauggaaucuuauaucagacucuuguuuuuuuuuuuuuuugggagacagauuuugccgcccaggcuggagugcaguggugcgaccucagcucacggcaacuuccgccuccuggguucaagugauucucuugccucagccuccuggguggcugggacuacaggugcgugccaccacacccagcuaauuuuuguauuuuuaguggagacggggucucgucauguuggccaggcuggucuugaacuccuggccucaagugaucugcccgccucggcuucccaaagugcugggauuacagacgugagccaccgugcccugccagacucuuguauuauauuauuaacaugaucuaaauuauuuauucaucaaaccacuugguuuuauauacuuuuuuuuuuuuuuuuuuuuuaguguagagacaagauuuucaucauguugcccaggcuggucuugaacuccuagguucaagcaauccgccuggcucugccucccaaaaugcugggaucauaggcgugagccaucacgcccagccaugguuuuauguaguuuuguuauaugaguuauugugaaggugaccaagucaaaugacuuuuagguguaaaaggguguuuugaucuacuguagaguuugcuuccuauuccuuaaguaaaauaaguuugauccaggccaguguuuuuggauuaaacuucucagagcaucccaaagagcaguuugauaaaacccugagucuaaauuauagaaggauuaaaaguugaaacuugcuguuuucuugagcuguuguggaaggugaaaccuggccuggcuucauguguuggcaaauauuuccucugaucugcccuuccaccgauggaugcaaauaacuuaaauuuuuugagcaccagauucauucaauauauuuuuuuaacaacauacuuaaagccuaguuuacccuauuccccuguuguaccaccugcuagcagacauacuaagaucguuuauuuaacugaaggaaaauuaauuuacagugaaaaaacugcagcguuagugaaggcauagagaucucuuguggacaauauuuuugagucuuuauugauuagacuucauugugacuuaauuaauuguaauacugcaugagcauuuuauuacugggaacgcaaaacccaggcuuacauaaugcuucugauggagaauguaaccugcagcuacugccaaaaagcuucuacuuagaggcaaacaacucugcccugauaggcuuacucaucaagaaccacacagcaucuugcuuggcuaaaagcacuuuguuuagaaccaauggggcaagggauuaaauuggcucacccaccaagucuccauauaccgaggggcucagaguccucaaagcaguuuucucauaccuuuugagacacacugcaccgccagagagaaaaaucuauguagugcuuucaugucagugaauguagaaaucacagcugaugucagaaaagagguuaagaacuacuucagagugaaacaggccagccguguucauucccaugaccuaacauaacuaaaaaccaguagauaaauagugguacugcccuauuuauuauuagccuuuucaaaccagcugucuccuggcuuauggcaacccuaaauagaaaaauaaaagaaggacauuccaaguggaaggacuucagagauauggauaauagucaacauuuauugaccacuuucuauguaccaggcacuguugcauuaccuuauuuaauguucagaacaacugucugagguaagcuguuuuaugagguaaacuguaugagagguuauuugauaaauaagaaaacugaggcaugauaagguuaaguaacaugcccaagaugcacaucuaguaaguggcaaagcugagauuugaacccaggcagucuggcuucagagaccaucuaaccauauguguuuguauuuucauucucaauaaauacauaguaaguuaguccaagaaucaagagagucauagaauggauauauuugucugcaucgggauuacuuacugaaaaacgaguagcaggaacucuguauuggaccuggaggcagaauuuucuuaaacuguaaugacugauacuaggagucaaaagauacuagaauguaaaccacaagauggacagccuccuguaaaacaguauagcaagccaggaucuuuucaggguugggcuagagcuaaaucuuggcaucccuacccuuuaggccaggauuuccugauuucugaauuuuaauucuggcagcaucaugcccaccuagaaaaacugaucgaaaguaaggaaguucaagaaauaggugucauuuuucuaauaaauggauauacaugggucaaaaccuuuucuuuguggucugucucggguugauaaacuugguaaaacugaagagaaaagccucucagugcauguuuauugauuccuaaagaaacuuuucuuaugggcuccaucucuuugcgaaaguguuccaggccaucucccuauggccucuauguucagucacugaaagugucucacagaauuuagagauauaaagaacuuuauuucuauuccaggauauucugauuacaauaauuugcagaaaccacuaggguuggaauuuauaguuaaauggauaauucuccaccuucuuuucugauaucuuacuguuggaauaucauuuuugaaauuuuacugaagugugggacuuccauuuuucuucccccgagcaacugaaaauaaauguuucaaaacaugacaguuuuuucuuagugccauugugucaagagaagcuaaucucaaugcuuauuuuuuaugagucggaucuuacugcagucagugcugucauagguuaaguuccaagguuguguauuuucuuuguuuguguaaaacuguggcauugacuacauccuugucaggcuugguggcaugcaccuguaaucccaacaacucaggaggcugagaugggaagauuguuugaggccgggagaucaagguggccagccugggcaacauagcaagacccugucucuaaaaaauaaaaauaaaaaaaauagccagaugucacuuugggaggccgagaugggcagaucacgaggucaggagaucaagaccauccuggcuaacacggugaaaccccaccucuacuaaaaauacaaaaaauuagcugggcgugguggcaugcaccuguagucccagcaacucaggaggcauauuaucguuuaugaggcaggauaaucauuugaacccgggaggcgagguugcagugagccgagaucgcacugcuacacuccagccugggcgacagagcgagacuccaucaaaaaaaaaaaaaaaaagccagaugugguggugugugccuguagucucagcuacuggagaagcugaggcaggaggaucacuugagcccagggguucgaggcuacagugagcuaugauugcacccagccuggccaacagaaugagacuccauuucaaaauaaaaauaaauaacuaguccuuuaacuugguauuuagaaauguuuauuucuauuauagcaguaauaugucaaaauuuaauguauagaauaaaagcauuccaauccuuauaacaccauuguucuagcaguacccaaaauaacaaaauuucagugcaacaacaaaaucccuguauuuuguauuauuauaguuaacauuuauacaaucucugaauguaucuauagguuagcacauuuacuguauguuauuuauauauacaaaugucauuuuuuuuuuuuaagacagagucucacucugucacccaggcuggaaugcaguggcacaaucucggcucacugcaaccucugccucccggguucaagugauucuccugccucagccuccugaguagcuggaauuacaggcacacgccaccaugccuggcuaauuuuuguauuuuuaguagagacuguguuucaccauguuggccaggcuggucuugaacuccuggccucaagugaucugccugucucgggcucccagagugcugggauuauaggcgugagccaccaugccgggcccaaaugucuuauuuugaggaccauuugucuauuuguuuacauuuuuaaauagugacuauguuaaauaaauagguuugaucuuagcuggcaguugacauugacaguguuucuugagcguauuaauaaaacaucauuuuuagggcuuaguccacaagcagagugaagauuccuaacucuggcuggcuucuuagcaaaagaagguaucuuggcagaaaacaccccugguuucuuauugauuuacuuuuuaauuauuucugcagggaucauagcacugcaagauagucacacuguucuguccauguuauaacaagaucaggacauuauaacagacuuuauuuucuuuucaugaggaaaaacagcauguuuugugugcaguuugucuuuuaggaaaaggcaggcagcauuaaagaggugcucugagacaaacauuuuuuaaauccagaacaucuaaaauacagggauagacucuuaucaaagccauguggcuccauccugagauugcuguugcaggccauccauuggucuuguucuguuugcuauaauagcaucacuucucccccagggcugguacccgagcuggacaaagugaguggauaacagcaucaagcaguguauugcauagcauccuuguucugaaaacuuuaagacuuuaaugucauuuaacuuuuaaaagguuuuugucaaguaauucauuuuccauagaaacauguuucagagauuuaaucgccaauuuauuuuuguuuccuuuuuagauuuugaaauuuagaaaaaauagaacccucuuugaagugagaauugugccagaagcaauucauuacuaagaaguaaacauuuuuaagaaguuuguuuaaauuauugaaaauauagaacucuugggcugggugcuuuagaauuaccuuugaacacaccuaccauugacuggaccaaguacauaagaaacuagaucauccccuucuucugagcaccuguaagcagcaugcacuuucuugccugcaagaaagccuuucugugccuucugguacacagaugucuucuguuuccaccagcucaaagcagcuuuauguggucagaaagaauccaugacucaguuucuucuaugccauugcucaccacagagcuggaaaggauuguuuugccauguucuguucuuuggugucacaugcaggguuucagggacaaauggcuuucccuccuucauaggaucagccugaagagucugaugaucugguuccuuaaauuuuuaccuaucuccucuuaucuuugauccuugauucgggaagccuucuguuucaagccuuccaucauagucuucaucaccuugcaacaacuagaguauauaaauaaguuugcucuaccacaguguauuuaauccucaccagcaaaauuaugaauaagacaacgcuccccauuuaguguucucaugucccugccucauuaauccauccaacuugccgucuccccuuaaagcuaguucuuggucuuugcaccaucuauuugccuggcccauuuuguacuaaccuagcuugugggugauucugucaugauggaaccugugaagaugacauggcaucugaucugccagaggagagaauuguuuugguuuguuuucauaacccagaauaccaauaauguguuuauuuuagguaccauguagguuaagagcucccuggaguaagacugaccagaauuuguauucugcuuuggccucuuauuaucugaucaaguuucucaacuucucugauuuuaaauucucuuugucuauaaaauugagauaauaguauuggguugguuugugaaguagaugcuuaaauuaacuuaaaggguuuagcacuuugccuaucauguaaauggucaauaaauguuaguaaugauuaaauaauauuguugaaugaauugcucuauuagucuuucauucucuucuucccuauuuuuuuuacucuuuucuauguaucuuucucucauuuuugcucucuugguaugccaaagggacauuacuauuuucagucaaauccacacggcuuauggagaagacuuaucucccaagaauuguuuugguuuguuguaaccacuuagagaaauuuguuuuauuaucaaggacaaaaaaaaagaaaaaaaauguugcuuucacagauacggacucacacuggcuaugucaacuuaauucucauuuuaggacccugcccauacagcagcucucuccccacaaagucauccaaaugccuggcagcgcagcagggcaaggccugugcugaacauccucuaguuaacguucuguuggcagaucagguuuccugggcccacagugacucucacugcggagaccgcuuggcgucuugcauggagcagaugaaagcagcucugaagggaagcugcuucucuggcacacacaagcagaggagcauauucuugcauugcccaaagugguucaguuucauuuagcaucagaggcccugccuuuugggugggagcaaauaauggggcccuuuuauuuuuuauuuauuuauuuauuuuauuuauuuauuuuuuuagagacggagucucgcucugucgcccaggcuggagugcaguggugcgaucucggcucacugcaagcuccgccucccagguucacgccauucuccuaccucagccucccggguagcugggauuacagguguguaccaccacacccagcuaauuuuuguauuuuuaguagaaacaggguuuuaccauguuggccaggcuggucucgaacuccuagccucaagcaaucugcccaccucagcuucccaaagugcugggauuacagacgugagccaccaugccuggccaacagggaccuuuuagacaauaaaauagaguaguucuugguaucuggaaaaguugauguuuuguuuaaugugagggcuccaucuuuccaugcuuguaaauugaauguccugugggugauuguguucuuagguuugagagcaucuauuccccucguuuucacccuguuuccauguuuuauguagaauggugucuucaaaucucaucugaauuuaauuucaugaacuacaugacacuuaggaaauaugaauugaugaugauacucuagcuuucugcauuuugucauauuuuccaucugcaccacauaugaaaaauguuaaauuucuguuccuuggcacguucgauauuauguaggauagucaagauuaaaaagcucuugcccuugacacuguaaccaagaauuguuuugguucuuaaucuggggccuguagacaccagggucugggggaucuaugcaggcuucauaggacaucguugaguagucuaaaguuacaugcaaggucuuguguauaaauucuugugcagauuuuuuuuuuuuuuuggagaauuuucaaggcaucugaggccaaauaaugguuaaggaugacugaauagagguuucaagauccugaaauugaacuagauauaucuucuaauuaggaauuauuaugguacuguuuuugguuugguuguguguguggugguguuguuguuauuguuguuugcuuuuaaggaaauugccuuggaaaaaaucuguuuuaaagcaagccuguaacugaacaccauucagcuuuggucaucuuaugcacuaaauuguguguggagaccaaaggaaaacaggagagugccaucuagaggccuuaacaacaguuugguccuagccuucucccuacacaggagucuuuaacaacuuccuaaauuaagaacacuuuuguccucuuaaguaacugcaaacgauaaacauaugugucaaugacauuuauaaucuauacaggugcugcuacaguuguggcucuagccuuacuacucuggaaauguaauuuuaauaaagcguacuguuguagauggcauuuacuuuauucuauaggaauguagaagucuuugagauguacacugcauuugaauauaguuuuaauuguaaagcaacaacaaauugaugccugauguaagaaaucauuuugauauaggaacuuuguuguauuaucuuuugaaguuagaguaaauuaaaauaagaguaauuuaucuuaguuacuuguaguauucuuuucacaacaguaauauagaaugguguuugccaaaugguauagaaauugaagaguugaauucacccuagaaaaguagaucaauuuauauccauguggagauguauaauaggguagucaagagcacagcuuagaagucccaacuuuaccauuucuuugccauguugaauauguuaacuuucaaaaucuuguuucuucuucauuuauaaguggagcuaauuauagucucuaaguuaagguuguugugaagguuaaauguaauaaaguugguaagcacagugcuugguauaucaaaaguaguuuuuuguaauaaugucuuacuguuguuguuauuuucacuggccaguuuuguuuucaggacgguugugauuaaauagaagcagaaaauuuaaaaaccuauagaaaauuuuauuuuaaaaaaauuuucacaauuacaaucucauuugauuaaauacucaacaaauauuuauuuacauauucaguagauauuuaugcagcuccuaagugucuagauauaauaaccauuuuagguacuggagaguugauacuggguacaacagaaagaaagacaugggccuugcauugcaguggaggagucagacaauaaguaaauacauaaacaagaugguuucccaaagaaaucauuugcgugaagacaaugaaugugauguaauagagagugacuggaggcccaucuuagaguagaugguuaaagaagagcuuucugaggaagugacguuuaaacucuuaccugaaugacaaggagccaaucauaugaagaucugaggaauggccauuuccacuaaaggaaaaaacaaacaaaaaaacacauguaaaggccauuggaugagaguguguuaaacaugugcaaaaacuagaaaugugcauaguggcaggaaaccaggucagagagggaaguagggggccaagcgcgguggcucacgccuguaaucccagcacuuugggaggcugaggcaggcggaucacuugaggucaguuguucgagaccagccuggccaacauggugaaaccucgccucuauuaaagaugcaaaaauuagcugggcgugguggcacaggccuguaaucccagcugcuggagaagcugaggcaggagaaucacgugaacccaggaggcggagguugcagugagccgagaucgcacacugcacuccacagccugggugacagagcgagacucuauguaaaaaaaaaaaaaaaagggagagagagaaguaggagccuuggaggcccaggacuuuagauuucauucugaggguuaugggaagagauuggagaguuacaggcaaaguggugauaugcccaaauuuaugcuuuggaaaaauuccuuuugccucucuauagaaaacagauuguaauggagaaagaauggaagcagaaagaccggguaggagacuuuugcagcguguaagucagaaaugguggcuuggauaaagauguugaauuaaugguucagugcugaauuaguguugggggauuuggaucccccaacaacucugcaccacaggggcaggguagcauugugguuaagagaaccaggugaagagucaggcuaucugguuugacuuaauagccaugugaccuugacaaguuucuuuaccucccugugccugguuuuugcuauuccuaaaaugggaacaaugauaguacauuccuccuaggauugcuguguagauuaaaugaggaaauaauaauuguaaaaugcucagaagaugcaucaauagugcuguuuugguaucaucaucacugccuucaucacaacuauuacucucaucacccucaguagccacauuuuauagaugagaaaacuuagagggugguuuugaaaucagaauauacguuucuugauuuugaauccauuguucuuucugcaauguaaucuguaauacgagcucccagagaaaaauuucuauagaucugaauaucuguagcucacagcccaguuuuaaauaccuaugacuauuuaaauaacauugagaagaaaaugauaaauaaggcuagcugaaucccagggcauaggagagaaguagccuguggcucucuccccacacaccuugugccaucagaaauucaaguucccugaguuuugaagaaggguauugcacaccuaagccaaaagcauuaguaugcgcguggugguacauuuaggaggauagaacugaauauuuugagaaccuuguaagauacugaaucucuuuagaggccauucuacucuucauuacuuguguuaaauagggccauauacauaauauaaauaaaugaaauccauggauuauccccagaccuuuucuggucagccuuuuggugaaggcaacaaccagacuaccacacuugaguuucuuuuucuccaccucucucugccuuugcuuagccccuucugguggcauaagcaacagaauagguaaggaucaaagagcaagagagacaaaauuagaagcagggaguuggauagccucccugcuggcuuugccccugguuccucuacuccccuggugccuccccucaccagagacugaaggcaggcuguuuguccauugcagaaugugagcauuugauccgccauauguugguguuagaucccaauaagcgccucuccauggagcagaucugcaagcacaaguggaugaagcuaggggacgccgaucccaacuuugacagggugagcugggaaccgcugcugcaggggacuccucugaaagcugcugcagccuccuuugcaugugauuguaaucaggccauaaccugaaaggcggacacugggaacaaacuauuauguaacacuaaagcagcacgugaagcaagcaagaaggaauguaaaaccaguuaaacugcuggagaauagugaucaugguucccuaccauguguccccaaauuaucgucuguuuuuggcuuuugagauagcacagccugcaguucugcagcuuaccuaccauggggaugucgccuuccucuugucuuagugugcucaauucaguggcuucuguagcaugcuuuuauuuaaaccacuauggccaugccagguaugccagggagcucaggaaacagugaguuguugucuguuuacagcugaucacucagggcucucuuccuuagacuuugucugaggccaaaaauaucccaagccagagggcauggaacagguuggucauuauauaugcugugccacauuugaugugguuaauugggggguugacagcuuccuccuuuuuauguuacaguuaauagcugaaugccaacaacuaaaggaagaaagacagguggacccccugaaugaggauguccucuuggccauggaggacaugggacuggacaaagaacagacacugcagguaucuccgaaggaguggagaacaaagugggauguagcaguuccucuaaccugcuuuuuccauuuuucgccuucucgggaacuugggccuuuuuuuuccuccuguuuuucuuccucugccccuuccugggccuuggaaagaaggaaagaaggugcuuuggcuaauguuauuacugaaaggguucuggucaucaacaugccauuucaccaggguuuuguacucuuuucccuucucucuugguagucauuaagaucagaugccuaugaucacuauagugcaaucuacagccugcugugugaucgacauaagagacauaaaacccugcgucucggagcacuuccuagcaugccccgagcccuggccuuucaagcaccagucaauauccaggugggcaauaacuccagugaccuaguucaggacaaguaacaccagggggguaaagguuagcuguugcucacuaacccuaagucgagaguuucuugcucuuccuuaccucugucuccucccauuugucaucucuuccuuugucagaggccaaucaaagaucugaaccuuuuuugauggagaggagggaugagcaacaauaguugugccuuuuguuuuuuugaagaaauagcaaaucaugaggcgaugcuauccucuucacaggaugcuuccuuguugugacuucuaagggccgaugaaccaaaaacuuuaguaaucagggaaacauagacuuuagcaaucaagacuacuuggaaagacucauuauuucucucuaguguuaaagguaugcguguauauguauguacugcuuuccaggcggagcaggcagguacugcuaugaacaucagcguuccccaggugcagcugaucaacccagagaaccaaauuguggaggcaaguagcaaccugugggagcugucagcugaaaccacuuucuuugccauauccuugcuucccuuccuucugauuucuaacucgaugguguuucccuccaccucagccggaugggacacugaauuuggacagugaugagggugaagagccuuccccugaagcauuggugcgcuauuugucaaugaggaggcacacaguggguguggcugacccacggugaguauccggccaacagcccucacuaacacuggggcaaagaauugucaccugacuuucagugucuaccauggcacauuuccuacuacauuguauccccagaggagaucuaauccaguggccaaguggacaaaugauaugauguaacuuauguauguagacaauuaaaauuuaaaugaauaaggauccaaaauccaauaacaacaguuucccaaaguguuuucccaaaauagucuuucaugauguucccugcugccugcacacuggaaaaaauggacugaaggccagcucgccccauuuuuguuccacgguugaagacucucaacauuaaaauagccuuaccucuuuucuggauuuuuucuuugcugaguaggaagagaagguugugggaagaauucuccugagaggucaaaucagggcaaagcugguuuucuuauaaauaucucuuuucuuccagugaauuuccaaaaaagacucccaugccugcugaugugcuugcuuuaugucucuuguucucagccuaugaucaaauaggcaauaggggaacauucuggcuccacagacugagauagcuuuaaagggguggagcccugagucgcucuguuaguggaaagaugucuuacuuuaaaguaugcuguaaaaccuaucauuguagcaagauagcccuguacaucuaguacuuaucuguccuaucagcacugacaagaguaauugcauucuuucccuggugaaucaguugcuacuucaggcagccauuaucuuaguggauggcccauguucuccagaaacuugguguucaccuccaggauuugaaaaccugaacuggacuggugccacuauuuccucuuggcucagagcuguugguuuuacaugaauggccaauaaagaauagcaauccuucgucccaaauaguaaaggagcagagaguuaaauuccacacuuuaggcuuuugcuuugcuuuaggaucuuaaagagaaacauaaauucaggaagaaaauaaaauaaguuguacugaacauagcaaugccaucaguuuugggauauaagcacuuuugaguaagaauguuaacuaaacuucucugucauucuguuuuguaucagcacggaaguuauggaagaucugcagaagcuccuaccuggcuuuccuggagucaacccccaggcuccauuccugcagguggccccuaaugugaacuucaugcacaaccuguugccuaugcaaaacuugcaaccaaccgggcaacuugaguacaagguaccuagacauggaagagggcuggcuccagaagaaacaaacuugagcuuccuuugagaggcuaugaggcaccuucccuaggacuuaaggguuuacuuauagagaaagaugauuuaucuugcaaaguagcucgggugagcgggaagcguccucuagucucugucaugacccauggcucccuuaauuuccauagaugaguggcuugccccuuucuccccgccuuccccucaucucaugguccguccuccccacucuguuccuggcaggagcagucucuccuacagccgcccacgcuacagcuguugaauggaaugggcccccuuggccggagggcaucagauggaggagccaacauccaacugcaugcccagcagcugcugaagcgcccacggggacccucuccgcuugucaccaugacaccagugaguagcagcacagagcccaauucacugucucagaggcuuuugauaaaaagguugugagccugggguugggaacccagggccaaccuacaugucugaauuuccuuuuucuccaaacuuaggaugcuccagcccauuuucuucaggccaguagaguuuuccacacuuuauuuuuggcgaacuuacuuacuuagccaaguuauuucuacauugaacuccacuccuggagagcuuuuuccucaaugggcgcucacagguacccugguuaaguccagcugcacuccugccagcuuggggcagguagcagccuaacucagagccuucucccaggcaaccuuucccugccagaaggccaaagugcccuuaaauuaauugguuucuagacuggcuuccaaaauugccuuuucacuaaugcuuucuccauugauaaacacaccucacauguuuggcauaaccuggaucacuugaugauuugcucccacagcuuuagccgagucaguuaucuuagucacauguccuucauaugauagucacauucagagauuuuuuuucucccuuggguucuguuuauuuuccugucauaggucauucauucauucauuuauucauucaaucucauaguaccauaagauuggguaguaaauauauccaucacccuuggagauguuguaagggcagugcugcuuugaggacccuuuucccuccuuuaauccaucauggguuaaucccuuguaaaauauaguaaaagugaaacauuagaacagugaaaauuuaaacacauauaaaauacaaggcauuuuuuauugaguucaacagacaaaauuacucuguuaaauugcuaaaagugucucuuuauuuauuuuuuuaaauugcuaaaaguuucugaaagccuuuuguugauuucuguacuuaccuuaucaugaauugguaacaaaacaguuugugggcauggguccaugggccacacuuucaguaaugaaagaauuauauaucauagcccuugccaucacugacaagaucaacauaugugaaguauuugacuaauaguacaagaucauaugugauuaaguaccacaguaauaacauggaaaauuagguggcagaggcauucagagaugggcaagacagguuuggaaggaucauggucagcuuuaugggacguggggugacuuacugugucuacuguaacuguuuuugccaaggucgcuaacaaguucuuguugauaaauucaguggacauuuuuaaccuuuuaucuuuuuggacgucccaacuguauuaaucacuguugacuucuuuuuuccuugaaauauuuucuguucuuggugucuguggcaccacauucccuguguuuucccccaccucuccuuuucacauuuccuuucugcuuguuccuugagguuggcaaaacccagaguuuuauccuaggcccuauucccauguccuuugauguacucucucuggaugaguuuguccacuccuguaauuucaguuacucucugauucuccagcccagaaugcuccucugaguucuacacauacguguacaugacugccuaugggauagauuuaguugguuauuccacaaguauucacaacuuuaauucagcaugucccaaaugaacuuaccaugacucuguaaaaccugcuccuccucuugggugacagugaauggcacugucauucuccggguuacacaagcuagggaugugaauuuuaucuuuaacucuugucuuucuuauuugccauaucaagucaguuguccagugccugugaaugaaacauccucuccacuuuccuuuccuuaacucaggucacugucauccauuguguagaugaacaccacggcauccuaacugacuucuuugcuuccagucauguccccugaucccugccaccagcccuuuucacacugcagcuagaguaagcuggcuuuugcaaauauaaaucuuuauaacaucaugccccugcuuaaaauccuuuagugauucaccacuguucuuccucaaacuucuuaguguguuauucaagaccauuugucacuggccacagcguuccucuccugccucaucuacagccacuuccugccucacccuguucacuccacccuuguagaacugugggaagggauccaggaacccugggagcuuuccgacaaaauuauuccaggaguguuuuguuuuguuuuguuuuguaauuagccauuuuguaaaauacucuuuuauaauaauugaagugugauuuuuguucuagugacuggggcauggugaugaugugggcacccaggcuauggguagcuagcaaggaugcagaugggaaagucacagugauacaagcauuguggugguucucauuucacucacauguuuuggcgaguaacaacuauuuuaaagcagugaauugauacuacacaauuguaucuuauguaccaaaauguaauuucaguaauucacuaugcuuuccuggaguuaagacauuuaaacuccggaaaucacauuaauaugaaacaacaggucaaguccuagacauuucagguaaacaaucuucuacuguauuuucggguccucaaacaccuacaggccuucucuuuucuucugccuggaaaccuguaacuccugucccucuuugccugaccagcuccugugcauccuucagguuccugcuaggugcuaccuccuccaggaugccuuccuuaauucccaaacacccccauuagaagacuugaucaugcuauuuuguaauuguuuacuugucucuauccucuacuagacuguaaaaugagggcaaggucuaugucuguaaauucacauuuuauccuguaacaguaagcauuuggcuauuuguuagauuaauaaaugaaugaaugaagauaaauaagaggaagaaauucuaauuaguauuaccuaagcaagguaaaaauggaaaaauagguauaugaaaauccuguauaacccaggagucuagaaaaguucuguaaauaagaaaguuaacagaaaguccugccccaagcccaguuacuagaguaagaggcaugacagaauaagcugccaccuugagcuuuuccuuccugucucucuucaggcagugccagcaguuaccccuguggacgaggagagcucagacggggagccagaccaggaagcugugcagagguaaugugacaucuggcagugcuugcagaagccccugggcaggcuccccugcaaccagcgaaaggucaccucugcccaaggaggugguagagugcagcuucaacauuuguguggucucuuugcucaagccagauggcauguuccaccccacauggaaguaacagaagacuacccagaaaaugucauuucuguaagcaccauuggaaguccccuaagugacagcaauaaccauaagaacuuuuucuuuccucccuccuucuuccuuguccccugccuucauauugcaacucugauaguauucacaaggcacaaagccugcucguaccugccaagaacuguuuacugaaaaggaauuggagaugugggaugacagugauccuagcuagucuggccauggaccucuggcauggacuuuuccuuuccaggagaaugaauaccucuuguacuguuugcugugugcuucuuccacccccuuguaccaacaaagagauauugaaaaagagaauaugggauucgggccagggacagaugcaaauauccauuguuuacagaaccuuguugagagaugccuaacucacagagaacggcagugaccaucaggcaugcuguacuguucauuuggccucaguuccguuagcccugguccuuagcuccaugcaugcccccuugugggaguugauuuucuuauuauccggggaggggguuucaccagaauccagcauguauuuucccagaaauacagguguucuucaagauuauauguuuuuuccuuugagggaaguugaaauaaaaugguuuucaugggcuuuuggggaacuuugggugucuuuauccaaugguuauuaaaacauuaauggcuuacucuuuggcaaguucacauaacacugauuacucuacagucuguuaacugauuuuagcugaaaggggcaagauaguuaagaaugaaaugagaccauuuuuuaagaaccugccaguugcuggcuaggacucucauccuauccccaguagcucugugugagagcugcuauucagaaagcagcugguccuauguggaaagaaaaccauggcaaacagggguguuggcaggugggccagcuccuucuacagcuuggccaauagaaggaaaauucugguaacuuuuuuuuuuccuugaugcuguuguuucuauaguuugcugauaagaggguauauaagguuacaaaugggcccuacugggucaugaagaaaugagaaaucaggaaauuuacugccuuucuaccuuaaaagagacagcaauauuuuaucuucuuugucuuagacuuuccuuccuccaggucuaccuucuuucuucuuuagaccaacauuucaaggguauaaugcccaucaguuuugauguaauaaaaaagguguagugccucuuuuauucaugccuccagaagagcagcagcgguggaggaagucauccaccagacaaagagggacaauaucuuauugaugguauuaacuaagugcugggucugaaagaucuuccgaauaaaagccaucaguuugggaacucuucgucuugugagacucuucuguuuuuauuuuuugccuugcuuuuucccucccuaacuaaacauuucaugugguuuuauuucuucauccuccacagaauguugguuccccaaggacaacaucaguuuuucuucucugaugauugaguuauagucaccaagcgagagggaaagggugguuuuggaauucauuuauccucaaauggaaggaucaguuuucugugaccuguagugaagaaagucucaaaccuggggccugugagaucgagagacaugcacagaguccuucugaauaucuccccagguucaucucuaggaauaguccuuagggcucauuuccucugacuuguauuuuggaaauuuggagggaaaagaugaauaaauuaacauggagaaaauaaauucuucuaccgaguagaaugaagcaaggaaaagugaucucaucuuugugagcuagaucuacuuucucucuucucuucaauggcuauucuuagguucaaaauucagccacuucauugucaagccaacuucuguuggccaguuagacgugucucacuuccauccaggcagggaucuguuugccaucaagccuucgugagcucuggcacuauuucauugagugcuuuggauuaacuucuaaugcuucuuguggaggaauauuccugucugucuuuuuuacuaugaaaugugcuccugcuuguugcagguacuuggcaaauagguccaaaagacauacacuggccaugaccaacccuacagcugagaucccaccggaccuacaacggcagcuaggacagcagccuuuccguucccgggucuggccuccucaccugguaccugaucagcaucggugaguagccacaugagcugugcgagcuccuugaggcucaucggacaggcacccuucugauuagucucacagcgacggugacuagcaucguggcuuuaaauagaagccagcugucauccugaacucacaucuucucagcuccuugcaguaagcaaugcacagggcaaagguuuuuuacugcgcccuggagcaaugcgagauuccucucucccauuaccuugcagaccuguuuauugucugcauuugauucccaugauucuagauguugauucauagauaaaauugaacuugagaccugcaagaaagugaaacucucagaaggccaccuggaaacaggaagauuuuuagccauaucgauagacuugaccuuuaauaauccaucaccuucaaaagaaugagcauuucauaucguguuaccauugaaccgccagccuggaaaugaagacaaagccccuucugaauaguagagcagagauccucuugagcgauguauuuaagaggucauucuuucaauauucugauggcaaaaaucuuuugcuagguucgguuaugguuauaauccauucucuugaagaaauaaaagcaaguuuaaccuuccugaccaagaaaacuucauugacuccaaguaagccuggaagcagcugcggaaugacacuuugcuaguugaagaagaugauuaucuucugugacuaucuugaugacuaaaaaucucagucuuggccacuccgaagcuauccccaagcucauggcccacacguucaaagccaccaccaguuacuagagcguauuuuauuucugucuuuuggggaggacacugaaaagcagccuugggaagguugaaaagcaaucagauuccaaggaaacuagguuuauauaugugguguuaugaaaucuugcagccagcuugcacuggcaagcuugacacauuuuuuuuacugaggcugguuacccauuuggcaucaacauaaucagcagaggcaagugaacucugagcagagugggacauaauuagugccacguuggaacccuaaaagaaggaagauaagcuuucauaaaugacuaugaguaacuugguaaaaauggucugucaggaguagcaagaaugacaauucucaaauaaaacucugauggcacagaaagacaggcuuuuucuaaugaaagucucucaggacuuacaguguucguacacacuaaagagcacuuugaggccaggcacggugguucacgccugcaaucccagcacuuugggaggccgaggcggguggaucacaaggucaggaguucgagaccagccuggccaauauggugaaaccccaucucuacuaaaaauacaaaaauuagccggguguggcggugggcgucuguagucccagcuacucgggaagcuaaggcaggagaauugcuugaacccgggaggcagacguugcagugagccgagaucaugccacugcacuccagccugggcaacagagugagacuccgucucaauaaauaaauaaauaaagagcacuuugagugauuacuggagaccugccuucuccuccccuauacguuuccugugauuucucauaacuucaagcucuacacugguaucuaauacacccuuuauuccuucuuuucuccuugucuccuucuucccuuccuccacagccugacacuuaauguuucagcccuugucugagucuguuguuuagcugaaguccuuuagguauccuuguugaaugcuagguguuccucaggaggucuucuuaugaggggaacaugaagaucgucacauuuccagagucaggcuuuaucacagacccuauauucuguugacauuuguuacucaaggagguccacacuggaccacagcucugucugugugauauccacccugccuagagucauugucaaggccuugccugcuggaaaucuaucugcugucuguuuucaugugaaccuuuuugguguuuugaggguugccuguggccaagccuauuugaauuggaagaaaaugauguuuuaugaguggcaaauugcauaagauggggcauuugugcaaacccagcaugucuugaugggaucacuauacaaauaugcagcaaaagagauuaaagccagucuucaggggaaaugagaaacuuuccaaggcuauaaaacauggaauacggguggccugcauggguucuugaauuccuuucauuuucuggaggaaaugauuaaagaacaguauauauagcuauccuucugggguagaagagaugaaguucaacauggaaacagaagaguggucuaaucaaccuuuucauuucuggaaauguguaauuuaagguuaaaaauguuuuaaaaaguguaacuaaaaaauuuuuuuaaacuaacacaagauagauuuuauccaggugggaaaccaagucccuccuugaagaguauagugugggaguaucagccuaaugcgaggccauccugaauuugagugugauugcaaauaaaaauaaaaucaagcacaauugauacuuaucagugcuucucaaaugagcaacugcaucagaaccguuccucugagguuacugugcuggacugaccuggguaucagucucuucacaaccugagcuucugaaaaagucaugaaauaccuggaccugggauuuucugugaugggagagaauuauuuuugugcagaaagacuguauugcuacuugaagaacauggcuuucugaggggaucagaaacauguccauuucagaaaacauugaaagcauaggaaucaaauuuuaggagaaaauaguacuuacuugcuucuacuucaaccugaaguagaaacagaaaugacaaguuauaaggaaaugcuucucaacacagccuucaugaucccuguuccuggauuguggcccgccaaauucauuuguuuuuuguguugcugaaccaaauacauguucgugcucauuucauuagcucacugcugggucaagccucagguagagucugaaacaaaagccaucauuagcaaagacaggguaaaaggcuuucaccugcugccagaacucucuggauaccucugcacggucauuagauuccuccuggucccgcgcugucugcauuguauuugaacucgcuuguuaaccugcuuccugagcugugguucugcuucagucccaaaugaaucacuggcaagguagcacaucauuucauccaaaguucaguguaauggcaucucugcccuggacaugaaacccugauccuuuccaucugcuacuggaaugcugcugccuuggcagucuuuuaucugcuuaccucagcccauaaacaucucuuucugaucaucaggucacaagaguagguguuagcuucuaaccccgaugcugucuuaggcauuccuuaucaauagcuuguucuuucuuucuguaagauucuggcuguguuccaguugagcaguggggucuuugaagguaauccauaugauuccucuuucauuaggagguugggugagugcugcugcucugagaaguugauuuucacaguaggugaccuuauuuguugaccagguacgugcaggaucucaaggcccacauuccuuaagaauuuguugucuccaucccaggaucagaagucuucauuuucccccaccccaaucgccaccuucuauuuucugucacagaaccuaugaguucuaggccagaccuuugaccacaaaacugacuguuguuucccucuggccauacggagaucauugcucagggaaaacuuuggcucaaauggugaauuuaagguuucuaaaggcacuagauagacauaugauuauaaaagcaagagcuucuguacagucuggccuggaggauauugagaagcuuuucucucuggccuaguguauuuauaagaacuggauguacuugaucucgggaccucaccaggcuuggaaaguaagccaaccgaagguaaguagaaauggaagauguacaccuggagcccucuaaagggaagcaggcuagggaaacgacugaugucuggaaauggcaugaaaguggcauaauaugcagggcuaccugggcagccagccgucuuuauguucaucuggaacagcagucccugugugauuuggucaaagccccugaguccuagccucuaaccuucucuucccauauauucagcucuaccuacaaggacuccaacacucugcaccucccuacggagcguuucuccccugugcgccgguucucagauggggcugcgagcauccaggccuucaaagcucaccuggaaaaaaugggcaacaacagcagcaucaaacagcugcagcagguaauggaagagguggcaggcaucccuggaggagcaugggugacagaggccaggauugcaggaggacuggggugguaaacguaccccuuuuaugucagcaacauugcaguuuuauagguuaaaaaaguauagcuuucugggccgggcgcaguggaucccgccuauaaucccagcacuuugggaggccaacgugggaggauugcuugagcccugaaguucuagaccagccuaggcaacguggcaaacccuuucucccccaaaagauuaaaaauuagcauagucccagcuacuccugaggcugagaugggaggaucacuugaaccugggagguagagguuguaguaagcuaagaucacaccccugcacuccauccuggcaacagaacgagacucugucuuaaaagaaaaagaaaguauagcuuucuaaugcacuuucuuuacuuuguguuauguacagcccuccccaggaucaaacuuccuuccccugugaagggacuaaauuuuucuccugucucuaguucauuggaaaggaauuucugggcuuggguuucugugggaaccaccagagaaggugcuacuuuuuuuuuuuuuuuuugagaccaagucuugcucugucacccaggcuggagugcaguggcacaaucucagcucacugcaucguccgccuccuggguucuagagauucuccugccucagcauccuggguagcugggacuacaggcgugcaccaccaugccagcuaauuuuuguauuuuuaguagagacaggguuucaccauguugaccaggcuaugucucgaacuucugaccucaggugauccgcccgucucggccucccaaagugcuaggauuacaggcgugagccaccuugcgcgccuggcacucugcgcaugauuuaggaugcugggucuugauuaaaccugcuguacauuguuaccaccuggcauucucuccaggugguauggaacggcacucucagaggaaggaaauguaccucuauauguuucuguacuauaaagauucuauaaagagccaauuuccuuucugccuuccugaugaccaagcuuccaauggcgugugcuuuguacacagauuucacauuggacacuuguacucauacaaaggccauccuugauguuuuccauucauucauacagaacaggaugugaaucuauuuagugcaccagauacuuagguaaaugaguuaauugcucaucaaggacacuguucucuugcggcucuuucugcccaugagagcuuggaggcagaucugcaucugcugaaaucacugcaugaggcgggucuggcugcaucccaucuguauuaacuacuuucccuucaggagugugagcagcugcagaagauguacggggggcagauugaugaaagaacccuggagaagacccagcagcagcauauguuauaccagcaggagcagcaccaucaaauucuccagcaacaaauucaaguaggcccucacucuuugcuuucuccaacuuguuuggaguuugcuuucaggcugauuugccugugcauuuuggaggagaccacucagugcaaaguggauuugaggucuguuuaugguugacauguuugaguaaagguaaucagaccuucuggugaacaacaaaagcauaaaucugagacacagauaguucuuucuguuucuucccuuccugagaauagcucugaguaaucuucaagcucacaauaauuuuuuuccuuuccccauauauguuuuaggacucuaucuguccuccucagccaucuccaccucuucaggcugcaugugaaaaucagccagcccuccuuacccaucagcuccagagguaugagucauuuuguguugugccuaagccauugucucgauagccugguacccuuggcuugacucacugggagauauggacugacuugagcauucaucuugcaagaaucuauuugaaaaggagagaaaccacuguaaauuucaggagccuucuugaaaucccaacuuccugugccacuucauuuccuuagccccaugagcaaaguaaucugauaucuaauacaggagccagacauaggcccacaaugaacucugccauuuuggcugaguucuuuucaaacaagauguagauagguuuuaaauacacugugguggauggcuuauguauauuuuucuaacaugaggcuuaucaaaguaaaaaaaaauaguuuccacugauauauguuguauggcugaaacuuaagauuguacugucaccuuaggaagcuucuuuguguaucucuuuuguuauuuuuaagguuaaggauucagccuucaagcccaccccccaaccaccccaacaaccaucucuucaggcagcccaguaauaguccuccccccaugagcagugccaugauccagccucacggugaguggagagguucagaccaaacaguucauuuuaugccacaugggaaaaaaugauggucucaguuuugagcaccauaaaccauuugaaaggcagaauaacauaguauucagggguauggacucuagagccaagcugcuuugguuugcauccugguuccaucaguuucuuagcuguaaacccuuggguaaguuaacuugacuucuugaauuaguccauuucacacugcucuaaagaacugacugagacuggguaauugauaaaggaaagagguuuaauugacucacaguuccacauggcuggggaggccucagaaaacuuacaaccauggcagaaggagaagcaaggcucaucuuccaugguggcaggagagagauugcacaggggaaagcgccagaaacuuaucagacaaccagaucucaagaauucccucauuaucaugagaacagcauggaggaaacugccccgugauccagucgccucccaccaggucccucccuugacacauggggacuacacuucaagauguggguacacacagagccaaaccauauuacuucucaaaugucaacugaggauaauuaugguacaguauguagauauacguaaaacacuuggaacagucucuggcacaaaauaguucucaauaaagguuuacuauuauuaauauuuuuaacaaaaccuccagcccuaccaaauaaaaagcagcuaccagaaccuuccuuauagacaugccuccguuuggcugucuacuauacacgugggccccucucuuguggguguacagaugggagugaagauaaguauaaugugacugugagucuucagaggucagccgucuuaggaucucuugaguaacacuccacgagcuacgucccuagucagucucccuaggauccuugagaagagucugaauuggccucuaggcucuuccuacuuaaaguggggucccccagccaccaauauugggagaaaaaguaagaucucaggucguauuccagaccuguuagagucuguuuuuuuuuuuuuugagauggagucucccccugucacccaggcuggagugcagugguaugaucucggcucacugcaaccuccaccuccggguucaaaugauucuccugccucagccucccaaguagcugggauuacaggcgcccgccaccacacccagcuaauuuuuguauuuuuaguagagacaggguuucgccaugguggccaggcuggucucgaacuccugaccucaugauccgcccaccucggccucccaagugcugggauuacaggugugagccaccacgcccggccuagagucugcauuuuuaaccagaugccaggccauuugugugcaugugaaaguucaagaagcacugccuagauccgaguuaccccauguaauccauggaccagcuuuuaagggaacuuguuggaaacacaaauucuuaggggcccauccugaccuacugaaucagaguuugaaacagaauuauauagauaggacccaggaaucuucuguuuaacaaguucuccagacuuguccuaugcucagugcaguuugagaagcacuguucuagcugguaugucgucugaguauucucauuagcucucauuacuucuggcuggcugguggccugggcacuuggucacucugagguuccuuucucuccaggggcugcaucuucuucccaguuucaaggcuuaccuucccgcagugcaaucuuucagcagcaaccugagaacuguuccucuccucccaacguggcacuaaccugcuuggguaugcagcagccugcucagucacagcaggucaccauccaaguccaagagccuguugacaugcucagcaacaugccaggcacagcugcaggcuccagugggcgcggcaucuccaucagccccagugcuggucagaugcagaugcagcaccguaccaaccugauggccacccucagcuaugggcaccgucccuuguccaagcagcugagugcugacagugcagaggcucacagguaagaccgccuaacgucacccagccaucuaugcaugggauccaggugggaggaagccccuuagcagagugagagaaaaggagggaaggagaaugggucugacuaggcugugcucuuguuucacgcuuucuaaaaucaggaugcuggguuuggaaugaacuugucagcuuuuuauugacccaggguuaaaauucuaaugagacugagguggaaaaugggaaagcuaccuuauuauuugcuaccuuauuauuugcuugcaaagaagaaaauggccuguuagaggaauguauaaaaauuccaguuccccuuuucuugaagggagcaucuugaaguugcuuccuucaaaaugagcuagaucuauuacccacgcagugcccucagucccuuggagguuacuggacaagccaguaauggaauaaauagggacaaugcauacaucugccacuucucugucacaccacaguucucuguaccaguggguucucccuacugaggaggaggagcuguucccaggaagucuaguacuuguuacauggaugucugguacucccuuuugugucugcagcuugaacgugaaucgguucuccccugcuaacuacgaccaggcgcauuuacacccccaucuguuuucggaccagucccgggguucccccagcagcuacagcccuucaacaggagugggguucucuccaacccaagcccugaaagucccuccacuugaccaauuccccaccuucccucccagugcacaucagcagccgccacacuauaccacgucggcacuacagcaggcccugcugucucccacgccgccagacuauacaagacaccagcagguaccccacauccuucaaggacugcuuucuccccggcauucgcucaccggccacucggacauccggcugcccccaacagaguuugcacagcucauuaaaaggcagcagcaacaacggcagcagcagcagcaacagcagcaacagcaagaauaccaggaacuguucaggcacaugaaccaaggggaugcggggagucuggcucccagccuugggggacagagcaugacagagcgccaggcuuuaucuuaucaaaaugcugacucuuaucaccaucacaccagcccccagcaucugcuacaaaucagggcacaagaaugugucucacaggcuuccucacccaccccgccccacggguaugcucaccagccggcacugaugcauucagagagcauggaggaggacugcucgugugagggggccaaggauggcuuccaagacaguaagaguucaaguacauugaccaaagguugccaugacagcccucugcucuugaguaccgguggaccuggggacccugaaucuuugcuaggaacugugagucaugcccaagaauuggggauacaucccuauggucaucagccaacugcugcauucaguaaaaauaaggugcccagcagagguaagugucuccucacaguggaaguccugggccagucugcccuaaucaacugacucaguaauguuaucuuuuuucagcuaguauucuguguuccuaagaaaaaaagaauuucugagcuucacgaccuucuuggggagaagcauguaggaaguggguauuggugggcaagggguccauuuucaaaaucaaaggaccaugauacaaaauuaacacuuagucaauaagauagaugauccauuucccuuauucauaccacaguuucuuggaauccagaaauuccugacugccauccaaacagcuaacuuuaaacuugugcaauagaaaaaaagucagcccaacauaauuuaguguaaauagugugggaacaagagucagagcaccuuaauucugcucuugcagcuaucauaaauacgauaacuuugucauuuaaucccucugauucugauuuuccucaucugugaagaagguguuggaggaacaauggaguaucuuacgguguaucuguggagaugaaaacauguauauauguguuuguuucuacauaauguuugcaugagagagagaggcacauucagaucaucugaaauguuugaguucagugcauaaaugugagguauuauuacucuggucguuuuauuagugagcuaaaugcagaauauuacagcaucauaagggcccccauuaucauuucauuuuguaccacuuuauaauuaaugaguauauucauuaucauucugaaggagaucaggauugcaauuaguaaguuauacuuagaaaauauaguuccauuagcaucacggcauucauccuagacaaaaucaggaaucuugcaauuuaccacuccucaccauugccauccaagggaauaaaaagcaauuuaucuguaaacuguacaacccugagacugagcaguuucuuccauccuucccuccccggaacuaccugcaucuccugcccugucauuuaaagucagugcugaaaacucagccccagggggaauucgguccugcagcacagagcaguagagaaggccuugcuguaaagcggugucugugaaaacgccuugguggugccagguuguacucauuaugcgcucuuaggggggaauuguugccugaaaugccaauucaauccugaccuuuugaacagaugggugucauccagcugagagauuggcuccagugagauguacuguguucaccuguggcugcuguauucuuaguagacauaggagggugggagcuuucagaaccagaucauagguggaaugguuaacagaccugaggguguuuaggauugggaggaaaaacuaagagaaacaucacgcuuguuagauggaagaagggauuagauuuuucuggguucauauuauggggcagaaccaagaucaagauagaaguugcagcaaauuucaacacccuguggaagaccuuuauaagaacucuccagaacaggcugccuuagcagccugggagcuuucuaacagaggugggauaaugguauggggauguuguggaaaagauuccccugcaaauggaagcuuccagcagauuagcacacuauaguuggcaugaaaaggagaugagcucacguuucuuuuuuuuuuuuuuuuugagacggagucuugcucugucacccaggcuggagugcaguggugcgaucucagcucacugcaagcucugccuacaaugcucacgccauucuccugccucagccucccgaguagcugggacuacaugugcccgccaccacgcccggcuaauuuuuuguauuuuuaguagagacaggguuucaccguguuagccaggauggucucgaucuccugaccucgugauccgcacgccuuggccucccaaagugcugggauuacaggcaugagccaccgcgcccggcugagcucacaugugccaggcaccaaaugcuguucacauacggauucauuuaauccuuacaacaacccuacaacccuagaauaaccaacucuuauucccauuuaccagugaaacagcggaggcacagagauuaaguaacuuguccccaaagucaagagguagucaggggcagcugaacauaagaguacucacacuagcugucacugacacgagagaugcucaccgagcaagucccgggugugcagggcacugaggaaggagcauagcugcagcaaacagugcugcugcccuccaccccugccccaggcugaguuaccguguacuuucaauacuuccugaaauguuuuucuucaaaaauuauuuucucuaguuucucuuuaccuuccuuccugugugacuuguguguguagaaagucuggagagcauaauuccccauuguccccugauugucagaggaccccuucuucggcaggcacgcuagucuguugaguacccacuguuggugcaagugcugugggcgcaccagaggagggagagauuacuucaauccaaggaacaacguagguuuccagcaauaaguagccuguggguuggguccugguggaugaagaagguuugccauuuggaucuagaggagaagcaagagaaaagaacaaugggugagacugucucaaggaauuuuccaaggacagcagcaggcuuggcugguuugaaguacaguguacaugaaggcauuaguagaagcuaaggacagagguuuucuaaaaugcaucgucuagauucagcuguacugugaaaaaaacucaaguuuuuuuuuuuuuuuuuuuuuuuuuuggcagagucucacacugucacccaugcuggagugcaguggcacgaucucggcucacugcaaccuaccccuccuggguucaagcgauucuccugccucagccuccuaaguagcuaggauuacaggugugcacuaccgcacccggcuaauuuuuuuuuguagagacgggguuucaccauguuggccaggcuggucuugaacuccugacuucaagugauccaaccaccucggccucacaaagugcugggauuacaggcaugagccaccaugccuggcuuucagguuucuuuuaaaaacuccagagcuuacauuuuuacuuuacugaaaaaaucaucagauaauuugcuguucacuucugucacgaaaggcuuauaaugcugugcccccaccacucugcaggcaagugggggagcucacucuucucaaccuuuuugccaggaaggaaugccugcuguuucuuuuaauggucccuccaucucaacuguguugcacaagacucuacuguaggugcugugagaaugcagagaugaaaggauaaccuguccucagggagcuucuacucuacuaggggauguaaaacaagcucauaaacagcuuugcuaugaagugcuagguacugagugcugcaagaaguaucacugagaagagcagagcuagugugaucuucuuagcauuucuuaaggguagaugaacagggauuguugguguuauuuaguuacuuuuugagucagggucuugcucugucaccuaggcuagagugcaguggugcaaccacgguucacugcagccucgaccuccugggcucaagcaguccucccaccucaaccuccugagcagcugggacuacaggcgcgugccacuacacccagcuaauuuuuuuuuuccuuugguauagauggggucuugcuaugucgccggggcugaucuugaacuccugggcucaaacaauccucccuucuuggccucccaaaaugcugguauuacaggcaugagccaccacacccagccauauugguauuaguaaaggaaaauuagaugccaucauaucaguguccaugguuaccuauuuccuugauggcgauuugccaccagccaguaugaggccaggcacugugagagcacuaagcaggcagcaugccaaagguuucuucccaauuuguagaagugucaggauuucacaugccccaugcuguccguaaucucccugccugccacccuagaaggaaaaacaagguuugucuuucuucuauagugguacacacacuugaucuuuuugacuuugcaaauaaacacagcagcauaaccaaucuacaccaugagauuaccaacuggaacucacaaagaaaaccacauccucuucucugagcucagucagccucagcuuuauuacucaggccucauagagcaguaaaaugcugacagagugggagggguuaccccagaaccuuuaaggggaguaugcagucacguuauugcucccauuuucucucaaaacccaguaagugagucaggacgagucaacauugacagauucaauagagaauugugcagguugccccaaaguuccccgggaagguggguggcgugcauuguguccauuugugcacuuuuccccuugugugaucggacgaucaucccaccucugcacucucuuagcuuuaguuugauaaauauucgagcauguagcucuugggaaccaucuuuccuccaugacuuugguagcugcugaauuggcauaaaggguugccaaagauuugauccugaaugucauguuccuugggcaguggguuagucuguuuguaccccccaaaauggucgauagggucuuauuuauagagugucacaaaggacuucuagacucagggucagcauucuuaccaaaaaucagacuugacuuauuuggucuuuuacaguugauuaaagacucuuucacauguguugucuuuucgagcccccaaacaaccgucauuuuucagaucaggaaccuugaggagaagcugaaagauuugccaacacuuugcuggugagggagcuggguccugacuucaaguuuucugauccccuggucauguauuuuuuccuuuacgccuccuugcccacucugcacccuccaagcacagcugccaagugaaagaugcuagcccuuccaggucuuugaccuacugaugauacugaaacuugagcagacagagcccugggguauccccugacuccuauuaauacucuuuuucaucuggcuuuuaacugacauuugucuguccugaaucagaggcuucuccuggaaauuaaaguuucccugagucauuuguucauuuacauauggguauauugucccucauaauucugcaagcaggguucugugauuaaaucaauuuccuuguuuguuuuugucagcugacucagcacguccuuaugcacucagaaauaacaucucuaaacugaauauaaaucaugcuagacuuuauugagccuuuacaguguaguaaccucuaugaagcacuccacacccauggagucaguccaguuguacagauaacuaagacccagcaaagcaagauaacuugcccgagcuccugcuccucaggaagcagcuaagccaggauucacggccaacucuuccugaccccagaacuugugcucaugacccuugugcucaacuccagcuuggcugagggaugagcucugggcugggagucaggaaggcccccuacaugauuugucaggugguugcuugcucugucuuggugccuacaggcaucagaccugaaggcggggaagacagcagacaaggcagagcccaaaggaggguggguguuuugguuugcagaggccccauucucagggauaaaaacaagucugagagagggaaggaaaagagccuuaaaagacacagcaaacaaaccaaaacacugaggccuccagaagaggcaggaaggcuccaaccaggacuauauacauuuuguuagcuuugcuguuuccucaugguuaguaaugauguuuuaaaaaucuuuaaacaggagagcgcucauguuuguccuugcggagagcaaagagaugcaacugaugagauuugcauccaacuauauaaucaggcuuaaaggaaaaaagcaccccgaggaauugaguggaugauguuaguuaucaaagaagacaauauagguuuuugaaaaaguaagaagcggcugcucgcauugcuucuuggcaaagcagacagaaucaccauuuccucacucccacacaaccauguugccccacuuccugccagugguuuuugguuggcccuggcgccaacaugcgagcagugcccacugagaggaauugggcagaguggguaggacgggcgggcuaaucccacagagcaaguccugguguagguuuucuuuuaucuucucucugcuggcuuuuagcuuucuguagcaaaauaguuggcuucuggcuguuccuuuuaccucuuugcucagagaacuuucaaaagauuucucacuugccaucaucuuugguagcugggaagcucccuccucuaauuuuucuccagaaugucuugcauuacuagcaaugggcaugucaguuagcuccccucccuuuccauccugccucugccccuaagucccagccuaaccuuaaucauuauagaaaaccauugaaauacagagaccugaaauccuuuacccaacauucaagaaguaugcuuuacuuucauuauuuaaauagaucauuggaauggcacaguuagcauuacagcuguguuugcuauuaagagcuuuuguuuuaaacuuagucccaccaagagucaguucauccaagauaagcucaguaguuuccaagaagcuuuaacucagaaaaccaaccaagcaaacacaacuuauuuucaagucccaggcuuuuaaagacugaagucaaaagugcuaccaggaggauccugucaacauagguguggcuuugauagucuucuugacuauccuugaucaagaagaaguacucauuccuuuuucucuccaauucuaguccauagaaugguaugcucugacaggauaguaacccauauuaagagaguauuuauuuuuauuauucuuuuuugagauagagucucacucuguugcccaggcuggagugcaguggcauggucuuggcucacugcaaucucugccuucugaguucaagcaauuccccugccucagccuccugaguagcugggacuacaggugcacaccaccacacccagcuaauuuuuguaauuuuaguagaggugggguuucaccauguuggccaggcuggucucaaacuccugaccucaggugauccacccgccccggccucccaaaaugcugggauuacacgcacccggccuaaagagcauuuacugacaucagugaaagagaucauaauacuggguauaggacaauguucuagaacacugaagauucacagacauacaugagauauaguucuugccugcaaagaauuuauagucuaaugugaaugauuaaguacauaauugaacaugguaccaaggauaauguuagagcaaucagagacaaagucuuuugaaguuuaaaggaagagaugaucuauuucuguuugaaaggaaaaguuuaauaaaaacaauagcauaugauaauggauguagaaugaugaguugcuuuggauuggcaggagugaaggcagaagaaucaguuauuugcagauagaaggaacagugagggcaaaugcauagaauugugcauagauggggaacaguuaaguggucccauuugacuagagcuuagaauguauggagaggggaauaugagacacugauuggaagauagcccagggcaguguuguaaaaugaaagugaauggacuacagaacgguuggucuuuguaggguaguaguaggggauugguuaugaggcuagcauaauaauccaggcaagagguaaucagguuuccaugagauuggcaacaaagggacugaagugaccagcauugcagaguuagauucagcaccaggaguaaggaaucaauaguggccccaagagcuuaugccuggaagauuuggaaaaugaggcaucaaaacgacaaugucugaaggaguagcagguuaugggggaaguggauggguuuggaauuggacaugguaaguguuacaugcugguuagauauccagggaaagauaccuaguaaguagcuggaaguauggaucuggggcuuaaaggagcacuucaguaauucuuuacauaaaggcaguacagccaugaaaauagaugauguugccagaguaaguguggggagagagaaggucaaggacaaaaauguggagaguacuugcuuagaaaggguggaggggccaucaaaggagucagaagcagcaguuagagaaguagaaagaggagaguagcagcgugguacacugaggucaccgggggaggagagaggacgcagccagccacagaacagaugcauccucuagggcuagaggguccugaaagcuccgagaguaauucucaugugcauuuagguuugggaauagaucacuguuaauucaacagagaaaugaaagaagagaagguucggugggguccagccaugcccuguuacguggaauuuuuucccuaagggugugguccccuccccuacagcucgucuuuuggagggcugguccaggcuccucuaagccaugacgccggcugaggaucagcgguugguguacaugaucuccucagccuugcccauugucccuugcaagacauuucuuggaugggaguuuccagugcugggagaaguuccgccccacugacucuauucugcugugucuccucagagccugucauagggaacugcauggauagaaguucuccaggacaagcaguggagcugccggaucacaaugggcucggguacccagcacgccccuccguccaugagcaccacaggccccgggcccuccagagacaccacacgauccagaacagcgacgaugcuuauguauguuggucccaccugcugcacagagguggauccucccagucccagccuugaaacagaguauagugaugugggguagccucucuuggccgcucuccucagucagcauucagccuuucuggaaacgguggggagcauuucuuuuuuuuucuuuuuugagauggagucucacucugucgcccaggcgggaggacaguggcgcgauaucagcucacugcaacuucuaccuccccaguucaagugacuuuugugccucagcuuccugaguagcugggacuacaggugccugccaccacaccuggcuaauuuuuguauuuuuaguaggcaugggguuuuaccauguuggcuaggcuggucucgaauuccugagcucaggcaauucgccuaccuuaagagcauuuucuuugagucacccuaacagaccaaaccuuaauucaaguagaaucuaugcuccaaauuuuagaccaaagaaucagaaauaguugccaucuguucccuguaguuuugguuauuaaaccucuucucagucuaaacucaggccccagcaaaugagcccauaggcuucugguuauuuuucagcagcuacauugagcuuacucagaucaggggagcuggugggccucagcaaaguuuuguuuuccuaggguggugcuagucuaguagcuagccacauguggcuauucaaaucuaaaccaauuaaaauuaaaaacaauuuaaaauucaguuccucagucacaccaguuacacuuuauuuuuuauuauuauuauuuuuugagacagagucuugcucugucacccagguuggagugcaguggcgcaaucucggcucacugcaagcuccgccucccggguucacgccauucuccugccucaaccucccgaguagcugggacuacaggcgcccgccacccuuuuuuguauuuuuaguagagcuaaauuuuuuuagcccagcuaauuuuucguauuuuuaguagagacgggguuucaccguguuagccaggauggucucgaucuccugaccucaugauccaccagccucagccucccaaagugcugggauuacaggcaugagccaccgugcccagcccagucacacuuuaagugcucaguagccacuuguggcuacugguuaccauauuggacaggacagagaacauuuccaucacugcagagugugacuggacggugcuguccuaagacaaagucccaguggagauggggauaggucagaaaccugguuuuagaaggccauguagguaucaagaugucaccaccagcugagauuugccacauccgccccacccucagcccccccacugggcagagccaagcagcuucccacacugucgcuguggagcacccccuuuggguggugcuuuagaggaaggagucuggaguggggccccgggcugucuuuugccugggcuccuucagaaggaccagcugucucuagggguugccugagaguggugucuugugugcuuauuucuucucuuaacuguuuucugcagguacagcuggauaacuugccaggaaugagucucguggcugggaaagcacuuagcucugcccggaugucggaugcaguucucagucagucuucgcucaugggcagccagcaguuucaggauggggaaaaugagggugaggagccuuaugcauggggcacuccagagaaguuccuggaggggccucccuccaucuuccguaacugcuccucucuucguaggaagagcucauggggagguagagccacagcaucccacagguucuggacacagccccuuuccccacuggucuucccugaguguggguguguaaaggagguguggcuucuggccagauggcacagggcucucccauuccugucucucaucucugugaugauaugccuucaaucacuuuuuccaguucugcuuagagggcaucagguccuaauggcacauuucuaccucuucuuggagccagucaagggagggugucauaacaaauaauaggcguaggccuugggcggggcaggucugccaccagucccaaggcuguccuuuucaggcucugcaggugaggcacuuggcuuucuggaccccgagauccucaucuguaaaguggcaaaaacgauagagccuuuauccuacauugugcccugagggcuggcuggcuuagugaguaucaagugcuuagcacagugucuggaagacagacagugcccaggaaugggugccugcaggcaguaaaauuauucucccuuucacucuuuaagaggugauccuuucugaaggaguccucuaucuucucucacacuacaguaguugaucuuaccuaaggaugggaaaggguaaaggaaaagggaaaaaagcagaacagguagaggagaauauaggaagaaucuuggcccccgcccaucgucacucaacaccuugagggccugcugugagcuagaauucagggcugggagucaggcugugggaugcucgacagguugccuucaauuccuccucucucucccccuugcucuccuagucccccaguucccugccaaccucauacguucuuuuuggucuugcagaauguggggcaagccugggaggucaugagcacccagaccugagugauggcagccagcauuuaaacuccucuugcuauccaucuacguguauuacagacauucugcucagcuacaagcaccccgaagucuccuucagcauggagcaggcaggcguguaacaagaaacagagagugagugucacccuggccagagccaaaccagcccuguggcccagugccugcucccaaucccaucaggagcuucagcccauguguugugguggccagugcagucgacaguaccacgccuccccucguggccuucacaguuucuugcuuuucauuaacgacgcugcuaguuuuagggcgcgagguaggggugggggugugcagaagaaaugcuaaacacagucucuugguucgguuaugggaauaagacacaagacucgccguguguuacaggugcucuagccuucauagcgacagaagugagcuacggcuccagaggaugcaggugaccuccggucagcauaaugaggaaaggaggaaguccuuaaacucaguccuaaaagacaaaaccuggcaggaaaauauguccagccauauuuuuuaaggccauacagaagcaaguggcaggauauuccagauuagggaaaugugugaugagaggcccaugguagaaagaauggggaaauuggcuuguuuggcuggaguaaugcaaagaguacacagcaggcaccauugguuguaucuggaaaauccuugacagaagaggccugaugaaagggaagccacuuggcaaauccacaucagagccucaguauggcaagcuaccugaacaccugagggaaaguaaacccguugcauuuuuuaaaagguuuuaaauggaauauuugagccuuucucuuuucaaacuaauucuccucugugucugcuuuauuccagguuuuguguacagcuugggaaugaaaagguugauuguaaacccacaguaucuagcagcguugugccaaauugcccuuguguuucucuccacccaaaauaucacagcugcuuuccucacauuugguucauccgugugcuguucuuuuggguucugagaggguuuugccauguuugcuuguaugaccaagucaccaaggaaauaaacaggaaggaaauccauguucuccaucuuuugugaaaguauauuugaguuggugguuuuuuguuuuguuuggggguuuguguuuuguuuuguuuuugguauguuuucuuccagaggugauauacuuucuuuuuuuucuuccuuucuuuuuuuucuuucguuccuuuuuugaaacaggagagcaaagcaguuagaguucagaggccagcggccucagggccacucccucccuagccuucaucagcagagcacccuccaucccccugcauugcucuucugugaaagcaaauacuaaaggaugccauccucuggaauccuaauggcaggcaaagggagagaggaagggugacggcuucuggcacuuagaaaacaaaaagaacaaaaaaagagaaacccccaagccuggaacgcagagaggucuuuacugcugggauccacggaaaacaugucuguccuagccaagaucauaugaagaguuuggcacggaggcugagaaugaccuggcauagaugguuugccaguuaggaugucucaauuugagccuuugcuuuugguggauaacucagcuccccucuuguaaccuggaaaguugguugccuuuaucauccugcugguuuuauccauggacugaacacccaacagcagugcacuaugcuuucuauggcaucuuucauucucauuuuauauugugcuauaaaaaggauuguuucuccauauauauauuauauauguguguauauauauaauauaauauauguguauauauauauuauauauauaauauauaauauaauauauuauauauauauuauauauauaauauauauauaaaauauauauauauaugcucuccucuuucagccucuuugucacagggaagaaguguaggagguugccuugggcccugccucucuccuaaccuccucuuccccacuggguacccucagccccuauauuuuaauucuugaucauguagaaauuguuuuugguaaauguugauauuauuguuauuaucauuauuaauaaauaaagagaaaaggaauuuuuguuuaaaugagaaauguuuaaccagauucuguucuauuugaauugugacuugcaccuuuuguucaaaguauuuccuuuaggcauuguaauugugaacagcucuuacuugugccagugacagaugcaguggucuccuuuccccaguugaagcagugcauacgcaguagcuauuauuuguguuaucuuuauuucucuucauuguuagaaaccaaagucuucucugcuggcuggggcugagagagggucuggguuaucuccuucugaucuucaaaacaagagagagaccuugaauacacugacucuuccacccuuuuuuuuucugggaaaggagagcaagaggucccgaguccccuccuagucuuucauccugaauuugcacagaggaaagcgggugcccggcauggccauccugauguugcuggcgggauccccaugcaccuuguccuucuccacugauacuggcagcucggcuccuggacccaagaucccuugaguggaauucugcagugcaagagcccuucgugggagcugucccauguuuccaugguccccagucuccccuccacuugguggggucaccaacuacucaccagaagggggcuuaccaagaaagcccuaaaaagcuguugacuuaucugcgcuuguuccaacucuuaugcccccaaccugcccuaccaccaccacgcgcucagccugauguguuuacaugguacuguauguaugggagagcagacugcacccuccagcaacaacagaugaaagccagugagccuacuaaccgugccaucuugcaaacuacacuuuaaaaaaaacucauugcuuuguauuguaguaaccaauaugugcaguauacguugaauguauaugaacauacuuuccuauuucuguucuuugaaaaugucagaaauauuuuuuucuuucucauuuuauguugaacuaaaaaggauuaaaaaaaaaaucuccagacucaaguugcuaa

SEQ ID NO: 192049 - RNA, 77660 nt, Homo sapiens
gagaccggugacccgcggcugggcgccucggccaugacugcggagcugcagcaggacgacgcggccggcgcggcagacggccacggcucggugggcuccgcggcggcgagcgggagcugggggcgggcuccaggcccugaggggagcgugcggggccugcagggcugcggguugcgggcugcggagggcgccccggccgggcgggacagggggugcgcccgccagcgugggugagaaggccaagggcucugcggggcucgggccgcggagauugaggacugcaucuucgcguccgugggcgagcugaaguuguagggggauuuccagauuuuggaaaaccaaauauaaagggcuggacgugggguucuccgccgcagggaucaguaaggugagcccuccugggccccguccggggugagaaacuuccgaaagcggcagcguugguugguuuuguuuugcuuugacuuuuaaaucaguuuuauggcggcguuuuuaaaagguuaaagcagaccgaaguuaucucacuuaaaguccggaauuaaucaccgucuucuauaagaccaggggucccaguuaccaccacuucccucccucccaacccggcuuuaaaaacaaaacagcgcagccuccccaauuauugccuucaucgcucuagauuuuuaaggagggggaggagcugcgugaugaauagaaagucuacugaugaugaucuccuguucccaaugucuaagaagauugaaaucaauauaaggacuucugaucuaagaaucuggugagagugaaagaacccugguuugagagaaaagcuaaugucuguaugaagaaacuugggaagagggcaauuugagcaugucuucuaguguuacuucggaauguuauaacuuaacaccaccuccucaccccucaaguacugcacuuuuucaagagaaaacgggaaaucugugccaguuguucaaauacgaguuuggagaugagaaacuauauuugucguacaaagcuggcagacagauacccucaggugagaauccuuuuauaccuuuuuacucuuuugucuggaaggccaguaguauuuagcauggagacacuuuuuuuuuuuuuuuuuuuuuuuuuucgacagagucucccucuguugccuaggcuggagugcuguggcgcgaugucggcucacugcauccuccgccucacccuccugaguagcugguauuacaggugcuugccaccggcccggcuaauuuuuguauuuuuaguagagucgggguuucaccauauuggucaggcuggucucaaacucccgacuuaaggugauucgcccgccucggccuuccagagugcugggauuacaggcgugagccaccgcgcccagucuggacgcacuuuuuuuuuuuuuuuuuuuccagacggagucucacuuugucgcccaggcuggggugcaguggcgcgaucucggcucacugcaacuuccgucucccggguucaagcgauucuccugccucagccucccgaguagcugggacuacaggcgcgugccaccacgcccagcuaauuuuuguauuuuuaguagagaugggauuucacuguguuggccaggauggucucggucucuugaccucaugauccgcccgccucggccucccaaagugcugggauuacaggcgugaaccagggcgcccagccuggaugcgcuuuuuaaaacucauguagaaaaagauacuuccagguccugggcuccgaaacgaaaguaucaugcacugacuucuaauggaaauauuguuagauguucacaagugccuauugaaaugugucaagauuuuucucuggcuucagaggucaguucuauuuguuuuuagcacagugauuuaaaaacaugggaaaauuuuaguuuggagacuaucauauugauuuagagaagagacuauuuuaagggagagagaagucauauuuaaauuugucguggcucagucauuuaagaccaugugccuauuaaucaguggcaucuucauuuaccucugccgcaguuugaguagugacccuauuucagcauucuccguuugagacugugugugagcuacuugaugagcauuuguauguaagucauagcuauuuugggaaggcuuggaacuccaguggcuguggcuggcuggaguacuccgauuccuggccaccugcagagugaugacauuuacuguucuucccagugauuugcccuauacggaaagcugauaagcuuggaaugcuugauaauguuugccccuuuuauuuuugcuaauaaaaugcuucaaguuaccaggauagguugaaggaacuuacaggaaaaguaccuuuugaucuuacaggaaagauuuuaauaacuucuuccucaucuugguaaguuucauguuagaauggauucuuuuauuuugaacucucugaggcauucuaccuuucccuuaaaggauauuucauuguucuaguugaggagagcuauccuucccugacacucagaagcuauuuaaagccuagacugcuucccuucccuuauuggucaguuguacacaggacagacaaaacccuuuauggccucccaagaauuuuagugcgagaaauauguaguacucuugaaauaugcuaucaguauggacucgaaucugagaguagacacuuuaugauuucacuaaauccucuagacugcaaacugguauucgaauaucuaaagagguuacauagugacagauuccuguauuuuaaucaauucuugacuucgauagcagcaaaauuuacuguuauuacaggagaaacaacuugaagucaguuugguucuuauaaaccugucauucuuggcagcuguacugaggguucacaucacacauucuuuaugucagcugaagccuuauaaaaaccugccaguuucagugaaaauuuaaugcccuuuuugcuuucucuugauuuauugaccuuucguuuccuuuugucucauuaacugauuuuuaaaacaucaguaagucagugauugguuccacaacucucaugccccucugcccccaaaugcaaacaguauuuuuuuuuuuuuuugagacggagucucgcucuguugcccaggcugaagugcaguggcgcgaucucugcucacugcaagcuccgccccccggguucaugccauucuccagccucagccuccugaguagcugggacuacaggugcccaccaccacgcccggcugauguuucuguauuuuuaguagagacgggguuucacaguguucgccaggauggucucgaucuccugaccucaugauccgcccgccucggucugcaaacaguauuuuuaagacuuacuggcaaauagcaucuuaccaggcgagaucucuccauguguucuguuucaucaaagaaauuaaaucaauaguaaaaugaagcaaguacuuaacaaggaaaauaaugcugguaauaguaauagcuaaugcuaauugagcaugcacuaugugccagacucggugcucagaacuuaacauagcauucucucaguacuuacacaacuccaugaaguuucuaugagaaggcuuauacuuguuaaguaauucguccaaggucacccagugaggauaugguacaguuggaauuguaucuaggcaguucugaccccaagagcccaaggcgccccugguccuaucucauaguugaugggcccauugcccuggaucacagacuuuccacuacucuuauaaugccuuuucuagaacucuccuaauguuuuaaacuuccaguccucccuacagucuuucuaaauagauaaucuucuuuucuacuugacugagcucgcugaugucuaaaaagagcucccugccuucuguuuugucccccucucccuacgccaucucaucucuuuucucuuauuucaguggaaaagguucccuuccuuuuucccccuuucauuucuuagagauaaaccuagauuaaugguuuuuacuagggagagauuuuguaaucuaggaagcauuuggcaaugucuggagacuuugauugugacucuggagggaggaugcuacuggaauguagugcguagaagccgggaaugcugcuaaacauccugcaguguacaggaguaagccccucuaaacagaguuauguguaaauuguauaaaauagugcugagcuugacaaacucugaucuagaugaugucucucuucucuuucuauuaugucccuucuccuuaguccuagucuaacccccagacaccuucacugucuucucccuugcuacucacauuaugguccacagaccagcagcauucacauccccuaggauuuagacaugcagaaaguugagugugcuagagccagcuugcucugccucuccagcugauuuuguacaucucuuuccagcucuguguucaaugaccucguguugauaacugugccaaggugggaauauuuauaccaaggaaacaagcauacacugccaaucagcauaccacugccuguacccccacucuagaccuauucaaucaguuucugccuuuugacaagauucuugggugauucauuugcauauuacauuuugaauuugcauuuuccauuuuaccgugcacuuguccucuaucuugaaaccaaauaacaacaacaaaagugucuauugcccaguccagcuguugucuccaccuuccuccucuuguuugcuuuuggaacaaaguuucuaaccccaccuguuucauuucuaaaacauuuuuccagugacaauguauucagacucaauauacaaaacuuggaaaagacagacuugagcaagacuaacucuuagcugacaggagauugaggaagguugguucccagauucugcuacagagcuuaagguggcaauaacagcuucugcaaaagccaaauaaugagauggccguguggaccagucugggcuccagcaaauggcugauuguucagaggccugcagagggacugacuaggcagcagcagguuagguugaaaggcagugagugguuuuauguaaucagaaucugcucagcagccuacuuugccaaggcaggaucucucccucugucacccagacuggggugcagcgaugugauuauagcucacuuuggccuugaccuccuaggcucaagcgauccucccaccucagccuccugaguagcugggaccacaggcgugcaucaccgcacuuggcuguuuuuuuaauuuuuuauagagacgaggucuugcuauguugcccaggcuggucuugaacuccugggcucaagcaguccuccugccuuggccucccaaaguguugggauuacaggcaugagccaccacaccuggcccccucauacuuuuauuauuuuaugcuuuuaugaucccucauuaccacuuuuuugcuguuacuuuuuucuuguuuuguuuuuugagacggaguuucgcucuuguugcccaggguggagugcauuggcacgaucuuggcucacugcauccuccgccuccuggguucaagugauucuccugccucagccucccgaguggcugggauuacaggcaugcaccaccaugcccagcuaauuuuguauuuuuaguagagacaggguuucuccauguuugucagguuggucuugaacuccugaccccaggugaucugcccaccucagccucccaaagugcugggauuacaggcgugaacaccuggcuccaaaucuacauuucuaauccugaguugcaaaugacuucuauacucuguuucccagugcuuuuugaacaggucugcuugaauaucaaccuccuuggcuauaaacguuugcuucauacuuauuuucccaggguuguuauacuaggcaugggaauguacacuuguauuacucgugucugccauaugcuauguaccacccuaagcacuuuuccauacauuuuuauuuacaaaaacccagcaaggugugaacuauuacccuauuacugaugaggaaacugagaugucuuguuuguuuuuugagauaggguuucacucugucacccaagcuggaguguggugacaccgucaaggcucacugcagccuugaccacccagacccaagcaauccucagacacuugaguagcugggaccacagguaugcaccaccacaccuggcuacuuuuguuuuauuuuauuuuuugagacggaccgcagucuguugcccaggauggaguacaguggcgugagaucagcucacuguaacccccgccuuccggguucuauugauucuucugccucugccucccaaguagcugggauuacaggcacaugccaccacgccuaauuuuuguauuuuuaguagagacgggguuucaccauguuggccaggcuggucuugaacaccugaccuccggugauccgucugccuuggccucccaaagugcugggauuauaggcgugagccaccgaacccagccugugguuaauuuuaaaaguuuuuuuagcaauggggucucucuguguugcccaggcuggucucaaacuuaugaaccaagucauccugccucagccuccaaaagugcugggauuacaggcaugagccaccgugccugaccucagauguuaguaugccuuauaagggccucauaugagauuuauuuuauuuauuccuuuucuuucuuuugucuuuuuuuuuuuuuuuugagacauggucuuacucugucaccuaggcuggaguagugcaguggcucuaucauggcucacugcagccucaaccuccugggcccaagcaauucuccuaccucagccuacagaguagcuggaacuacagacaugugccaccaugccuagcuaauauuuuuaguuuuuguagagauggggggucucuuuauguugcccaggcugguuuugaacucccgcgcuccagugauccucccgccugagccucccaaaguuuugggauuacaggcgugaaccaugguaccuaucucuuuuuuucuuuauucguaugagauuuuaaacugaagucuguuugcuucuaucuuacagaugagaaaugcagcuuaugaccaugauugaauuauaaguagcagagcugugacuucaagccauucugacuugaagcauaacauuucuccgacuuuaguacaagccuuucuaaaaccaaaguuucugacuuaccacuugacuauguagcacuuuaauaauuuuaauaacuuuucauugaacccucauaggcacucuaugaaauaaaauuuaguaugagcaggaaguagaauuugcaaagugacacagcaaguaagugauaaaaccaaaacuauaacacaggauaucaguauuuuuacuguaaacucuagaggaguuuaguugaacaggcaagucccaguauuuuucauuucuauugcauuucuucauuuugcuaacaauuuauuugcaguacuuccuuugauagucauacagggcugucaaagcuuuugguguacuucauuuuccauucuggaaacugaugcugaggaagauugagauuugccaggaggcugaugugugcuggagucugggcugcauggcacuauuuccagcgucuaggcuuucuacguaaaacaggggucaaaauaucagacacacaaaaccaaacuaaagaucugccucaguaaguaccagcugcaugcuacaugauggcugguaggcacuuuaacccuaagaagauuuucuaaacaacauuuucuuuuucaaucuucuugcccaaguuaguacuuucuuguguccccucccucccucccuuccucccuuucuuccucccucccuuccucccucccucccuccccccuuccuucuuuccuuuuguguggggauguguauacagguuuccuuauucauuuguuuuuucauagaguuggggucuagcuauguugcucaggcuggagugcaguggcuauucacaggcaugaucgugguguacuacuguuugaaaauccugggcacaagugaucauucugccucagccugcugcagagcuggaacuacaggugugugccacugcacccaggugauuuuuuuuuuuucaauugaggcaaaauuuauauaacauaaaauuauuuuaaaguggggcugggugagguggcucacugaggucaggaauucaagaccagccuggccaacauggugaagccccgucucuacuaaaaaauauaaaaauuagccagaugugguggugagcaccuguaauuccagcuacuugggaggcugaggcaggagaaucacuugaacccgggaggcagcgguugcagugagcggagaucaugccacugcacucuagccugagugacaagaguaaaacucugucuccaaaaaaaaaaaguucaaguguacaaguucagugacauuuaauauauucacaauauugugcaaucaccaauuccgucuaguucuaaaacauuuucauuacccugaaagaaaacuuuguaaccauuaagcagucacucccuauucccccaugcccuccaccccuggcaauaccaaucuacuuucugucucuagauuuacguauuagagagauuucauguaaauggaucaugcaauaugugaccuauuauguguggcaucugucguuuauuguaauguuuuugagauuuguucaaguuguagcauguaugaguuuuucauuuuaaucacugaguaauauuccacuguauguauagauauguuuugccuguccauucuuccauugacggacauuugaguuauuuacaccuuuugguuauuaugaauaguucuguuaugaauuuucauauacuuguauuugaguaccuguuuucccuucuuuuggguauauaccuagaaggaauuguugacucauaugguaauucuauguuuaacuucuugaggaacugccagacuguuuuccaagguugcuggggaaguuuuauauucccaccagcaauacacaaggguucuaguuuuucucuuuucucaucaaacacuuguuauuuuuuguuuuuguuagauaacagucauccuaaugggugugaaguggcaucucaucaugauuuugauuuggccauguuaauguuauggcuaauguuaagugucuucauaaacuuauugacuauuuauauaucuucuuuggagaaauaucuuuuuaaguucuuuguccauuuuugaauuggguugucucguuuuuugguuguugacuuaaagggaguucaaagagaguuuuuuauaucauccagaugcuagacucuuaccagauaaaugauuuaaaaguauuuucucccauugucuuuucacuuucuugauaauuuguacacuguguauuucuuuuuucuuuuuuuuuccccaagacagagucuggcucugucaccuaggcuggagugcaguggucugaucucggcucacugcaaccucugccuccuggguucaagugauucucuugcuucagccucccaggaagcugggauuacaggcgcgugccaacacaccuggcuaauauuuguauuuuuaguggagaugguuucaccauguuggccaggcuggucuugaacuccugaccuuaggugauccacauuggccucccggagugcucggauuacaggcaugagccaccgugcccggccagcacuguauauuucuuguuggauuucuugauguauguguuuauuucuugaauuuguauaccgguugucuuuucacuuucuugauaaugcccuuugaugcagaaaaguacaucagcccacuucagugucccaaguagcugggacuacagguacacaccaccaugccuggcucaaaaguguuauuauuuuuuucuuuuguugcuugugcuuuuggugucauagcugagaauccauugacaaauccaaggucaugaagacuuaucucuguguucuaagaauuuuauaguuuuaguuauuuauuuagguuguugauccauuuugaggaauuuuuguguauugugugagguagggguccagugugauucuucugcuguggauauccaguuguaccaauaccauuuguugaagacaugauuuuucccccaucaaaugguguuggcacucugguugaaaaucaguugaccacagauacgaguuuauuucuggauucucaguucuauucuguuggucuauauaucuguccuuaugccaguacuacacuguuaugauaaccguagcuuuggauuaauacuaaguuuugauauaagaagugugaguccuccaacuuuguucuucuuuucaauguuguuuuaguucuuccagguccuuugaaauucugugugaauuugaggaucagcuuuucuguuucugcaagaaaggccaaagcauugcagcucuuuuagaauuugucuagcagguuuucugguuuucacuagaguuccccgcaacccccagccacacgcacacacaaaggaccauuggaauuuugauagggauuacauugaacuuuugaauugcuuugaguaguauugccaccuucacaguauuaagucuucguggccagacgcagugccucacgccuguaaucacuuugggaagaggccgagacgggggggauugcuugaccucaggaguucaagaccagccugggcaacguggugaaaccucaccuuuaccgaaaauaugaaaaaucuuaguugggcuugauggcacacaucuguguucccaccuacuugggaggcugaggagggaggaucgcuugagcuuacaggguggagguugagguguacucuagccugggugacagagacagaccccaucuccaaaaaacaauacugucuucaugaugguuaaguuaaugugucaguugacugggccaugagguauguaugcagacauuuggucaaacauuauucuaggugugucugugagcgugauucuggauaagauuaacauugaaucaguagacuguguagagcaguuugaacucccuaauguggguagugggccucauucaaucaagaccugaauagaacaaaaaugcugaguaagaggaaacuuugcuugccugacuacuugagcugggacauugauuuuccuugguccuggcacuggaacuuagacaaccaucagcucuuuugguucacaggacuucagacucagacuggaacuuacacacucaacuuuccugguucuugggucucauacuuacacuaacacuacaccgcuggucuccugguucuccagcuugcuaacugcagaucuugagacuucucagucuccgcagucaugugagccaauuccuuauaauaaauuucaccucuuauauuuaucuccuuuugcuucuguuucucuggggaacucugacuaguacaguuuuccaguucaugaaccuggauguuuuucaauuuauuuaggucuuuaacuucuuucaucaguuuuuuuaccuuuuuuuugagacagagucucacucuguugcccaggcuggagugcaguggugagaucuuggcucacugcagccuccaccucuggaguucaagggauucucccgccucagccucccgaguagcugggacuacaggcacaugccaccaugccuggcuaauuuuuuguauuuuuaguagagauggggguuucaccauguuggccaggcuggucucaaacuccugaccucaggugauccauccgccucagcuucccaaagugcugggauuacaggcgugagccaccgugaccagcaauuuuuuuuuucgagacggagucucgcugugucgcccaggcuggagugcaguggcgcgaucucggcucacugcaagcuccgccucccggguucaugccauucuccugccucagccucccgaguagcugggacuacaggcgccggccaccaugcccggcuaauuuuuuguauuuuuaguagagacaggguuucaccguguuagucaggauggucucgaucuccugaccuugugauccggccgccucagccucccaaagugcugggauuacaggcgugagccaccgcgcccggccuaauuuuuuuuuuuuuuuuugagacagggucucacucuguugccaggcuggagcgcaguggcacaauguuggcucacugcaaccuccaucuucugggcucaagcaauccucccacuucagccuucugagaagcugggacuacaggcacgcgccaccacacccgacuaauuuuuguguuuucuguagagauguguuuugccacguugcucaggcuggucucgaacacuucagcucaagcaaucugcccgccucagccucccaaagugcugggauuacaggugugagccaucgcacccagccucagcagugacccacugcgcccggcccagguuuuuuaccucuuuggucaaauuuauuccuaaguauuuuauucuuuaggaugcuauuguaaauguaauuuuuuuuuaauuuccuuuuugauuucuuauugcuguuuuauaaaaacacaacugaauuuugccuguuuaccuugaagcugcugaauuuguuuaccagcucugguaacuuuuuugcagaaucuuugggauuuuguauauauaggaucaugucauuuugugaauacuguuuuacuuuuuuauacuuuauaauuuaggugccauuuauuuuuuauucuugccugguugcucuggcuuaaacuuccaguacaguguugaauagcaguggugaaagugggcaucuuugucuuguuccugauuuuagggguaaagcuuucagccuuucaccauugaauaugaucuuaacucuugguuuuuuuauaaaggcccuguaucauguugagggaauuaccuuuuauuccuaguuuucugauuguuuuuauuaugaauguguguuggauuuugucagauguuuuucuguaucaaucaaggugaccauuguuuuuuuucuccuucauucuguuggugugguauaucacauuguuugguuuccuuuuauguuauuggcaauggcauucucuuaggcauccauugcaaauguaugacuaagcuuucucucuucauucuuugagauguucagaguauguccuacuuugauguuuugccuaccagcauccugccucucucgucacaguucguuuacucaguagcccuguaacucaagcuuucuuuuccuagugucaucccacguugaaccaguuguucacgugggcuagauuaauccacuuaaaugccuuuucuuccuucguauaucuucccugcugaggagccugcagugauuauccauuguucaucagaucaaaccuaaacucuuccugacauuuagaacccuuuguaauccaaucccacaucaccucucugaucucuguuauuuauuuauuugagacagagucuugcucuugucgcccaggcuggaguacaguggcgcagucucagcucacugcaaccuccgccuccuggguucaagccauucuccugccuuagccucccaaguagcugggauuacaggcaccugucaccacacccagcuaauuuuuguauuuuuaguagagaugggguuucaccguguuggccaggcuggucuugaacuccugaccucaggugauccgcccgccucagccccguaaagugcugggauuacaggcgugagccaccacacccagcaaucucuguuauuuauuaaaaauagaaacuacacacgaagacccagcuaguaauaacuuaaaauuuuaccauugcuauauuucuaaaacuguaagcauguaaauuugauuucucauaucuuucccugauauuuucccaguuuuucaauuagcccuaccaauauguuguuaaaaauuguauuuuccuucauuuuuggagauguguucgauauguuugucagccucauuucucauauuuaguuggaacauguauucaaagaaaugaaaaauauugucuuaauguauucuaaaauaaggaaaaagcaagguauaggacauuauguaucauaugaaaaaauauauucaugugcauagacaauuucgggaaagauaacagaaacuguuaaugguaguagccccugggaaauagaacuaggucgggaagaaggugauuuccuuuucauuuuauacccuuuuguacuauuggaaucucuuaguacaugugaagaaagagauggaaaaaauuuaaaaaguaaauaaugauuaauuccuuuuuuuucuuguuuuuaagucccaguuuuaaccccucuacaugauauaauaguggcuaaauuuuaaacacuuuuaaugguuuuuaaaaacuuuaagccaguuaauaaacucaaacaggcauuuucaucauguacugacauuugcaucauucacaaaaauuaucaaguagucuauuucagggaauuuagcuguguccacagaaagcugcuguuuaucuuuuuuagacagccauauucuuauggcuacuuuagguuucuauuccaugaauaaauuggaucagcagggcauuguugcuggaagaaaaacugaaaaaauaccaaggcuuuugagggccauuccuuguuuuauggagguuggaaagguuagcaaccaucucuguuguccagacagaggugguuuuuuuuuuuuuuuugagguguagucucgcuuugucgcccaggcuggaguggaaugcaguggugcgaucuuggcucacugcaaccuccaccuccagguucacgccagguucuccugccucagccucccgaguagcugggacuaccggugccugccaccucgcccaucuaauuuuuuguguuuuuaguagagacggaguuucacuguguuagccaggauggccucgggcuccugaccucgugaucugccugccucggccucccaaagugcugggauuacaggcaugagccaccaagcccggcccuuauuuuuuuuuuuuucgagacacagucuugcucuguugugcaggcuggagugcagcggugcaaucuuggcucacuucaagcuccgccucccagguucaagcaauuccucugccucagccucccgaguagcugggacuacaggugcccgccaccaugccuggcaaauuuuuguauuuuuuuuuucuuuaguagagaugggguuucaccauauuggccaggcuggucuugaacuccugaccuugugauccgccugccuucaccuuccaaagugcugggaucacagacaugagccacugcaccuggccagaguuuuuggcauugauacuauauguuuucuuugacucuucaguugguuuuguuuuuguuuuuuguuuuuucuuuuuuuuuuuuuugcuucccuuggguacuuaaguuuuauuuuauaauugcgaaccagaucuuuagcuuuggaaggaauuuuauuaggcacaccuugguaguucuuuggaguaagggaacauuuauuaauuauuuacuuaguuguaaauuuagaaaugucuuuguaagacuagacaauugauaucaggaaauaugugcaucagaaugaugaaaauagcaucacuguuugaaggaauggaauaaccuauaaagcuucucaucacaaugcuaaauuaggaguuuuaacgauuaguaaugaaauauuuugcauuauuucaucagagaguuuuaaccuaguuacugugggaucaggccagguauugauuguuacagaaacuugauagcuuaagguuuuuagugucugaauaaucuuguuaauugcugauugugggugaguuguuuuugcucuaagaaaaucuccuuccugagaagugggcuagauugcaccaaaaccacugaguagcagugaggucaaaaagcuugaguuccuuccugguaaagguuuguguuugccugucuuucuuuacugccucugggcaagaaaagggaguacuuuuuguuuugugaaaacaaugugaauuuagcucaggaaaugcaaaccuguuggcucuugcaaguuauuugacuucauugugagaggaguacaggcuuugucuugucuccuuguuggguguguacuuuacauauagcaagguagagugaaguuaauauuuaaauccucuuucugugaaguucaggugaagugaguuaguaauaugguaggauccugauggguuuaguguuacuguaaaauuaauauuuauauaaauauauauauauaguacgaggauuuggagugcggguucuguuaagaacuuuagcuaaaucuuuacaagacugggucaugucauagcauuuguauauguauauaaauaaugcaugugaaauuuguuauucauaccauacucuuuacauuuuauuuuuauuuuuaaauuauggaacacuucaugaauuugcauguuauucuugcacaggguccaugcuaaucucuguauuguuccaauuuuaguuaauguacugcucaagcaagcacuuagacccuuaauagcuauguguuuuauagcuaucuuugauuuagcuuuuaauucaagucauuugaugauaaauagauuuuguaaaccuuaauuuccuaacgugugcaaugccugccuuuguuauuaggauuacaugcauguaaggugccuguuuccugucauauguuaagccagguauggugaugugugccuguagucccaacaaccuggaaggcuguggugggaggauccuuugaguccagcaguuaggccagccuggucaacauagcgagacccccauuuccaaaaagaaaaaaaaauuaaaguaguuguucaauaaauguuaguucucauuauuaucagcacuguccuauggaugauucaaauuaggcaguguacugcaugauucuuccuuuaaagaaggcaagaauuucauauuuaaaacaauuagagaacaggccuggcccgguggcucaugccuguaaucccaacacuuugggaggccgagguggguggaucacuugagguaagaguuugggaccagccuggccaacaugaugaauccucaucucuacuaaaaauacaaaaauuagcuaggcgugguggugggugccuauaaucccagcugcucagguggcugaggcaggagaaucgcuugaacccaagagguggaguuugcagugagcugagauugcgccgcugcgcuccagccugggugacagcaagacuccgucucaaaaaaaauuaaaauaaaauaaaacaauuagagaaccacaugaugaggaauaucaagugaagacagggagccacauucagucacaggcguauucauuuccuuaacaugggagaugagaaaggggagagaacaguaugggccagaguucuuagaaggacuucauauggaggagguaagacaaauauaaccccugaauguaguuggcauaccauaguuuaauaauguaggugguauuacuagugauuuuaggagcaacagucuaugcaugagagaaugaguuugcaguaaggaacugagaggagaaaagguggaacaggcuaaggggggaucagguaauggucuuugaaugacaagaugaggaauuuggauuugaauuuccauguagaacauuguuguuggagcuauacaaaauuauuuuacauaguugucaucucuacccaguagccuuuaaaaaaaggucacuaggccaggugcaguggcucacgccuguaaccccaguacuuugggaggcugagacagguggaucacuugaggccagaaguuugagaccagccuggccaacauggagaaaccccaugucuacuaaaaauaggaaaacuagcugggcgugguggugggcacccguagucccaacuacucgggaagcugaggugggagagucaccugagccugggaugccgaggcugcagugagcuaagauuguaccaugcuauugcacuccagucugggccacagagcgagacccugucucaaaaaaaaaaggaaacgaaagaguuuauuuuccuuuccugauuguguuaucccagauauauugauguccacugcuaccuauuacaaaauggagaaagaggaaugguaauauuacaguguaacugacuuuaauccaaggucaaauguaaauaauuaguaaauuaguauuuggauacuauauuucauugauucacauuuauuuggcauucugagaucucugagaucaagauguucuuaacauuuuuacuaucauccaaguagcagaugugauguugucauugucugcacuuguaugaaccuggucauagcuguuacuauuguuauaacaacaguugacagucuguuaguaccacaugguuuacuugccauugcguaugucacuuaaaaauuuacacugugauucaacauugagauuaaaacaaaacaaaaaaaccaaaaaaccuguguaugaagaaaggcauggaagcagaauggcgggguauaaauuugauuuuauaugaagcaaaauauuuaccuuuggaggaauguuuacaguuucagauuuucuugcaaagcuacagucaagugcuuuaugcaacccagaagggaagauagcauaaauguauuaugcuguguuaaguuuuguugccgagaaauaugugaaagaauugccuaucacaugccaagcagugcaccuggaagcaggggaaauugcuguauuccucaacauaaaugaaaaaguucagagauuuaagaagcuagugugacuuauuuauaugucucccaggacugccgugaagacauugugucauaguucaaguggcagcaguuuuccuuucuuuguuuucaaccgauggcaccuuagauuuagucaaauguaauauuuaccucucuacuucugaugauagcugguuuagaacagauugcacuacuaaguaaucaaacuugugauuguauaaggacaagcagauuuuuaaaauaaacuuguuagggugcaaagaucaaggucaaaauauaaaaauaggcugggugugguggcucacaccuguaauccuagcacuuugggaggcugaggcaggagaaucgcuugaacccgggagucggagguugcagugagccgagauugcuccauugcacuccagccugggcgacacagugagacucugucucagaaauaaauaaauaaauaaaaauaaauaaaacauacaagaauaagauauuugcguuuuuuugcauuagauagguauucuugccuaucuuuuugucuucucagauacagcgugguauagugcaucccuuaucagcaguaacuuuguguaaaguuaaucucucugugccucagcuuuuuguaggacaggcguaauaccuaugucauaggucuguuaugaggguucagugaguuaaauuaguuaauacuugcuaaguguuuauagcagcaccuggcuaaaaguaagcaguauauguuagcuauuacuuuuuacuggauuauuuucucugaaucauaaauguuaauuuuuauacagaauaauucccaaugaagaugggauuaucccauuguuaccuucuugacgcuaguuugguauuaauauacuacugauucccccucucgauuauuccacccuuuuuuggguauauugauguugaucuuuuagaaaauuaugugugauuugugugagauacauagauucauaccgcuuuuauacaguaaaaucaaauggaauuagaauuaguuuaaaacaacuaguauuuaauuuuucuaaaaauuacaugcuugcgauuuuaguuuuugcucaggcugaaucuggauaccuuuuaguaugauaaucacucucccagugcacaggcaaugacuggaguugacaagacucauagcgugaaagucugcuggucucagcaggguaggauuccauuuguagccuaugacuauagucugacuacagcagaacgacuguuggugcuucuuugaggacuuuauuuauuuauuuauugagacggaguugugcucuuguugcccaggcuagaguugcaaugccgcgaucuuggcucacugcaaccuccaccuccuggguucaagcaauucuccugccucagccuccugaguagcugggauuacaggcacgugccaccacgcccaacugauuuuguauuuuuaguagagacggggccauguuggucaggcuggucucgaacucccaaccucaagugaucugcccacccuggccucccaaagugcugggauuacaggcaugagccaccaugcccgaccucuuuaggacuuuagagggauguuucaguuaguuauuucuaguuguguaauacuuuaguguugcauugggcccacagcuguugaagaacauaagauacuguuucuauuauagcugggaguaaauguaggcuaucucucugagacauacuacuaacuuaauuuaagcauaaccuuaggaaugguauaaauuagauuucuuguugcugaauuaauuucgaacuacuuuguuuucaacauucaucuaaaaagaucauugugucucaaguugggccagccaguuguuuagauugagcuguacuugcaaaucgguguuuuguauugucuuuguguaaaacaggauaaaaugauagagugaagauguuaaggcugaagggguuguaaacugauuuuguguuagcuggaaguuaacaauuuagguuuuuccaugauuuagguuaaugaagagaaaacauuucauacuuuauacccuuugaaauuauguauuuaauugagaaaauucuagcuuuagcuguacuuuuuaauuagucaaacacagaguuuuaaauauguugguguuaucauugguuaauuacaugauuggaaacuuauugucagugaaaaaugauacacacuaauggcaugugcaggaaagcuuaaaauagcacaucuuuauauccaugcaaauuccccggacuccuuauaugcccuacuuaaugcacugccuaccaaaagaaaaaccuggagaacuuuuaaguguccauuaaggcuagaauauuacauuuaaauguuuuauauauuuguaauuuuacugucaucuauuucuuucguaaguaccaaagguauuuccaugauugaacuuuuaaaagagaaauagauuuggcauuucagaauauuucugacagccaauaccuuguuucuuggagcuuguugguucuuuagaguaaaaaaaugcagggccguuugcauuggcccacaccuguaaucccagcggacuuugggaggccuaggcggguggaucacgaggucagcagaucaagaccagccugaccaacaaugugaaaccccgucacuacuaaaaauacaaaacuuagcugggcgugguggccugugccuguaaucccaacuacucgggaggcugaggcaggagaaucgcuugaaccugggaggcggagguugcagugagccgagauccggccacugcacuccagccugggcaagccucaggccuguuuauccaagaugcuuuuaguuauucuuuaaauguacccagguuuacuuucugacugacauguuugugguuuuuuuguuuugcaaauauagagcugccaaaugcuguuaaaucaacugagagaaaucacaggcauucaggacccuuccuuucuccaugaagcucugaagguugguuuccagaucucuguuagucaggaggcuuuaaagcagcugucuauauuauaguuaugucaguucaagcuauuucuauucccaaauuaaagcacauauagggacagaagcucuacaggucaaaugacugacccaaugucuucaacauguaaauuauaaggggcugggggagauuugugguucggguaacccugcaggguauaaaagagauuuaagaaacaucaaccaguugcacuguuuaggccuuauauuuccugauccaaaccagcaaacuaaauaauauuugagucagggaaguuugaacugguuaucugauauugaaaaaaccuguuguuauucuuaagguauguauauauauauacuuuuuuuuuuuuuugagauggagucucacucugaugcccaggcuggagugcaguagcacaaucuuggcucacugcagccucucccucccgcauucaagcuguucucccaccucagucagccucccaaguagcugggauuacaggcaugcgccaccacaccuggcuaauuuuuguauuuuuaguagagacgggguuucaccauauuggccaggcuggucuugaacuccugaccucaagugauccacccgaccuggccucccacaguguugggauuacaggcaugagccaccacgccgggccauggguuauauuuuuaaaagauauguucugaaauguugaccagugauaagaugguuaggguuugauucagaauaucuacgagaguauaggagguuuagagaaaauaagaaagguuaugacuaagugacuagguaauuguugaagaugagugauagguacaugggguucuguuauucccuuuccugguauauauguuagaaauguuuccucauaaaacauuaaaaacaagaaugaucaccacuagaaaacagguaacugcguggcuuuuuuuuuuuuuuuuuuuuuuuuuuugagacaggagacaggaucucacucaguugccuugccugcagugcaguggugugaucucggcucacugcagccucugcccucugccuccugggcucaagcgauccucccaccucagccucccuaguagcugggacucacgccuggcuaguuuuuguauuuuugguagggaugggguuuugccaaguugcucaagcuggucuccaauuccugggcucaagcgaucugcccgccuuggccucccagugugcugggauuacaggcgugugagccacugcgccugcccugcuuggcauuuuuauuguagggcugacuucauuuagaaugucuauguuaauugccagcccccuuuuuugacacaucgugcuuuagacuguucagagaaaucaugaguaguaguauccgaagcaaugggaacaaaucuccaucaagauuucacuuuuguuuggguguugugggaagucagagcauggaaacucccuccuguaaugaggcauuuaauagacgcuucaagcacauuagaccuacuguccaccauagucucauaauucuacccuagaauuaugccugaaaguacucagugugucaccaggguaauaaaguuaauacucaaaacugguuuuaaauucuaugauuacuuuugaaauuucuauugucuuuuucucccauaggccaguaauggugacauuacucaggcagucagccuucucacugaugagagaguuaaggagcccagucaagacacuguugcuacagaaccaucugaaguagaggggagugcugccaacaaggaaguauuagcaaguagguaccauauauccugucuugguccuuugcugaacuagcagaaaauaacaaaccaaguauaugugaguucccugucaaucacaucagcccuuugaaaauaauaguaauaacagcuuauuacugagcuauugcuauguggcaggcacaauucuaagcacguaaaaaguucuggccgggugcaguggcucaugccuguaaucccagcacuuugggaggccgaggcaggcggauuacgaggucaggagaucgagaccauccuggcuaacacggugaaaccccgucucuacuaaaaauacaaaaaauuagcugggugugguggugggcaccuguagucccagcugcucgggaggcugaggcaggagaauggcaugaacccgggaggcagagcuugcagugaacugagaucgcaccacugcucuccagccugggcgacagagcaagacuccgucucuuaaaaagaaaaaaaaaguuucauuuguucauuuacucauuguuuagcauuuauuuagugaggaccaacuaugugccaagcacucuugaagcccugccugcauuuagcuuguuuuuuagugggagaagaucaacaaguaaauaaauuauuaauauauuagaaugugauaaauaccauggagaaaaaggacagaagaaagaaaugaaaaaaagagugcuggggacuguauuuccaauuggauggacuuuuuuuuuuuuuuuuugagauggagucucacucugucauccaggcuagagugcaauagcgcgaucugcgcucaccgcaaccucugccucugggguucaagccucaaccuccugaguagcugggauuacaggcgcccaccacuacgccuggcuaauuguuuguauuuuuaguagagacgggguuuuaccauguuggccagcuggucuugaacuccugaccucaggugauccacccgccucagccucccagagugcuaggauuacaggugugagccacugcuccuggcugggauggacuuuuaagaaugugcaggggaggugagggaguaagucauuugaggcccuaagaugggagugcaccuuggcuugcucagggaacagcaaggaggccagggcuaaggcuuagugagugaggagggccgaaagggauggggccauggaaagagaaggagguggaucauucagaaccuuccuaaguacuagcuuuugcugugaguuagguggguagccuuugaagaguuuggagcaaaggaaugauauaaacugauuuccauuuuccaucacucugacugugguguugagaacagaaugugggggaggagguagugacaagcaugggucagauuagggaacccaggccaggcugcugugguggaggguaagcagugcuggcauuccggcauauauuauuuuuaagguaaaggcaguaggauuuacuuacugaggagguaggguugugugagagagagaggaguuaaaggugacucaaaaauuuuuuuccuaagcaacugaagcauuuaaccaagaugggaaucacuguagguggagcagauuugagaugguagaugaagagaucaguuuggggaauacuaaauuugaaaugccuguuagacauucacggcagaagugucagaaagaugguggagacccaggugcacaguucagaggagagguccaggcuggagguagguggacuuggaaucguaaccuauaaaggcucuguaaagcugugagacugaggagcucuccaagggaguggguauaggggaaagaaaagguucugcagcuuaagcacugguugcugccuauguucagaggucuggggaggugaagagugcccacggaaagccaggagaaugggacucuggaagccacggaggcuucugggaggagagaccaaggagaaccuucuggaaccuucugggaggaaggcgaggugguguuaauggacauuugggccguuaacaguuuugagcuauucuggaugaugcugcugugaguauucucauauguuucucuugguacacacugcaacuuuuuucggucaacauuguucuuuuugagacucacccaugcugaggauuauaacuguaguucauucauuuucacugguguguaguauuccauggucugaauauauaccacauuguauguauuuguugauugacuuugggguuguuuucaagcuuuugcuauucaagccugcugugagcuguucggauucaugcugcuuguccuuguaugcgagaguuuuuuuaguguauauaucuagugauguaguugguagguauuaagauacgcuuaucuucaacuuuauagguaaugacagucuuuuccaaaauaauuuuuuaccuauuuauacucucuuuaacagggcuugagaguaaccauugcucucaaauuuguuaucuuagauugggaaauugucacccuucuccugugaaaugcuaccucagcuuccccucaugggucuuacagaugcuaauaaaaacauuagguuaauuaacaaaagaauggggaaggggagagucaaacggcucacuccaggaagguggaaauuuuuaaaugguucuauugugguauuucuuuagcacugaaagcauuugcauggucuguugggauaguaaaacccaguucagagucagugccuauaccugucaggacccauuuguaguccccuaggguugccagcaucagucucacuggccagcagcguucagggccuugccaccagggaaucuccccauagcugucggcacuaucuuucucuuccuggcagacagaacaguucuuauuggcguuuuguucuugagaggguggaaaaggaacaugucuagacucagcccaucucugcacuguugcaguacccccauaucaacacaucuaagggauuucuucugguuggcaucgacauguccuacuuuaaugcgcccuucaaauuuccauagggccaugccucauacggacaucccuuuaauaggccagguuuccauugcucuccugccugaucaugugaccacuggccacugcccauaagugaguaaaaagccuaacacgggcuuuuaucacuguucaauucuuccaucacugcuagaaaaacaacaugcaaucaacacaugcugcugauuuguuuuuaccuucuuugaucccauuggcguccuuccuuccaaauaggauguuguccauucaccuuggaacugccaucugcaaaccaagcagcucuuuauuggucuauugggagcuguuuauugggaaacugucaaaguguggauaggauccagcaguuccucacacaauuccagagucaguccuaggggaaaagaggcuuucugcuaccuggggaaugcaaagaccuccuugcauuuuccagguagcaagagccuguauaaaccauuuccauuguauuauggaacucucuugggcacugccauccucacugaaguguuucucugacauccgccagcaagacagcaugaguauuucagguuucaagauuauuuuauguccucaauuauagggguagcuucaauuaaugucucauagcaagguaauaaaugccccucaagugguaauucucuaguccaaagucucaggagucaucucugggaggcacucacaggcuuuugccauaagcccugguaaacgcuccgcaaucaguuugucccuaccagcacuucagcuucaauucucuguuguguaggcucagggaaucuuucugguucccauuuagcaugucuaauuauuauugcuugaaggacaaguuuacaugccuucuguuuuacaggaguagguagagggaacauucuccaggcagauacaguauccauccccauaauacaaucaaguagaaaagauggaaccacuucacauugaagcagcuucagauauaacaacucgccuauaaaauuuuauccuaauuccaucaacacuuacuuuccuaaguauagccuccauuaggacuuuaucaacagguuuugaaaucacagugcauugugcuucugugucacgaagccccagaaagguuucuacuccacacccugaccccuucaccacugguguacauaaggcuuuggguccccagcaagggauugagccaaaguacucuuggcuguuugucagucuuuaucuugauuaaccugccucaacauugccccacacaauuguugaucaucuuucucuuuguggucucugccuuucagcuuguaaaguuucuccaaacugggguaaaugcaagaaacuuguuugaagcccuuuaauguugguuaaucagcagaguucccuuugguccacccaccuuugguagugcuguauuaaaauguuuaaucaguauguuuaauugaaagacuguaauuccccacugaucugcaguaucaauucuguguuaucucaaaauuucuuuuucccuuuaguuucaccccaucaguguuuucuuuacucacuuccuuaauaauccuuuaaacauuuccaccuuuguccuuugacuuuucccaucugccuuucaccauuuuccuguuaaugaaccuguuguuuuuuuauuagcaucugugagacccaugagaggaaguugagauagcaaaucuaauaaggcuuccagaacuguuugucaguuuugcuacagucauguuguaugagggguccacacugaagggguguccuuaaccagcaugaccuggguaaugggcauauucagugagugaauaucccugucaugauaaagccagugucuauuucacugaguauccauuuucaguucuuuuguguauauaccuagaaauagaauugcugggucauaugauaauucuauauuuagcuuuuuggguaacauuucuaaaagaggacuguuuauuuuuuaaaacugcaacauuaucacacuaaaaauaaucccuuaauaucaucaguaaucccuuaaucucaucaaauaccccauguagaaauuucccugguuaucucauuaacaguguuggcaguuuuuguuaagaacaaugauccaaauaaauuagaacauuaaguauguuugaagugucuuuuaagacucucuuuauuuauaaaucuccaccccgcccccccacccccgucccguuucuugcagcuuaauauccaaagaaaucaaguccuuuguuaugucaguuuucacacauucuggaguuuggcgauuguauuacugugguaucuuucaauggauuuuucugucuccugucuuuccuauaaauguagaugcuuaucuggcaugacugugucaucgguaguguuguguauauaucuucuauuuuguuacauugagaagcauauaaugucugguugcccucuuuuguguuguuaaaaucguaauuguuuuuagguauugucagguuaauuuaucuauuaugaaguuucucacuuagcauuuucagcagccauugaugauuguuaccuagauucauuauuuugguaaaaauaaauggaaauagaaugguaauauucuaucauaauuaugguaauuggaauaguuauagugauaauuggauuauuuauuaauuuauuuauuuuugagaaggaagcucgcucugucacccaggcuggagugcaguggugugaucucggcucacugcaaccuucgccuccuggguauaagcuauucuccugccucagccucccgaguagcugggauuacuggcacacgccaccacacccagcuaauuuuuguguuuuugguagagacuggguuucaccauauugguuggccaggccggucucaaacuccugaccucaggugauccgccugccucagucucccaaaguguugggauuacagaugugagccacagugcccagccugauaauuggauaauuuauuacuugaaauuauuauuuuaguaaaaaacacauuacauaaaaucuaaggauaucucaaauauucgauuuuuaaauacuuuauccauucuuaaauguagaguucaguaguguuaagaauagucaaauuguugugaaacaacccccagaauguuaccauauugcaaaucugcacuccauacccagccccugguaacuaccauucuguuuucuguuucuaugaauuugacuacuuuaaauacuucauauaaguggacuuauacaguauuugucuuuuugugacuggcuuauuuaauuuggcauaauaucugucuuaaguuucauccauguuguagcaugugacaguauuucuucuuuuuuccagucuuuuuugguaaaacauacaguuugccaucuuaacuacuuaaauguacaguucagaaauauuaaauaaauucauauuguugugcaacugucaccaccauccauuuccaaaacauuucacuuacuuaguaugcguugaauaguaacccccauuuuuucuguccuccauucuacucuuuaucucugaauuucuaagaaccucguauaaguagaaauacacuguuuguccuuuugcagugggcuuauuucacuuaccaaugucuucagacuucauguuacaguaugccucaaauuucuuugcuuuuuaagguugaguaauacuccauuguauguauaugccauguuuuguuuauccauucauuaauggacauuuggguuguuuccaccucuuggcucuugugaauaguguugcugugaacuuggauguacagauaucucuacaagacccuguuuuaguccgggcacuguagcucauaucugugaucccagcacuuugggaggcugaggcagguggauagcuugagccuaggaauucaagaccagccagggcaauauggugaaucccugucucuacaaaagauagaaaaauuagccaggugugaugguguaugccuguagucccagcuaccugggaggcugaagcaaguagaucccuugagcccuggagguugaggcuacagugagcugagauuguaccuacugcccucuagcccuggugacagagugagacucucucaaaaaaagacccugcuuuagauucuuuuggauacccagaaguaggauuacugguucauacgguuguucuauuuuuaauuuuuugaauagcuuccauacuguuuucuguagcaguugcaucauuuauuuuauuuuauuuauuuauuaauuuuuuuuuuugagacagggucuuuaccuuucgcccagguuggagugcaguggcgcgaucucagcucaguggagccuccaccucccggguacaagugauucucgugccucagcccccuguguagcugggacaggcaugucccaccacgccuagcuaaguuuuguauuuuuaguagagacgguguuucaccauguugcccaggcuggucucgaacucaugaccucaagugauccgccugccuuggccucccugagugcuggaauuaaaggcaugagccaccaugccuggccguauuuuauuuauuuauuuuguuguuuuuuuuuuuuuuuugagaagggucucacuguuacccagguuggagugcaguugugcaaacagggcucacugcagccuugaccucccaggcucaagugauccucccaccucagccucccaaguaccugggacuaugggcucacaccaccaugcccagauauuuuuuauuuuuauuucuuuugaauuuuuuuuagaggcaagguuucgccacauugcccaggcuggucuugaacuccuuagcucaagccaucugcccaccuuggucucucaaagugcugggauuacaggcgugagccaccgcaccuggccaguugcaccaucuuaaaaucccaccaacagugcacaaaguuuccaguuucuccacuuccuugccaguuuuauuauuaauauuauuuuuugauagcugucccuaugggugugaaauuauaucucauugugguuuugauuugcauuuuucugaugauuagugauguugagcaucuuaugcuuauuggucauuuaucuuguguauucuuuggagaaaugucaauucagauuuucugcccauuuuugaaaucacuauuuguguguuucauucagucacaggaguucuuuguauguucuguguguagaucucuuaucagaugcauguuuugcaaauauuuucucccuuucuaugaguugucucuucuuuuuuuuuucuuuuuuuaagacggagucucacacuguugcccaggcuggagugcagugguacgaucucggcucacugcaaccucugccucccggcucccggguucaagccuccugccccagccucccgaguagcggagauuacaggcaccugccaccacgcccggcuaauuuuuuuguauuuuuauuagagaugggguuuuacuauuuuuaucaggcuggucucgaacuccugaccucgugauccacccgucugggccucccaaagugcugggauuauagaugugagccaccaugcccggcugucucuucacuucuugaugguguccuuugaagcccaaaggauuuuuuaaucuauuuuuucuuugguuccuuaugcucuggaugucaucuaagauuccguugccuaaucuaaggucaugaagauuuacaccugugucauccucuacuuuuauauuuuagcucucaucuugaggacuugauccauuuugacuuaauuuuuguauguggggcuagguagggguucagcuuuauucuuuugcaugugguguucaguugucacagcaccauuuguugaaaagauauucuuuccuucuugaguugucuaguacuuaggucaaaaaucaauugaccgggaauguaagaguuuauuucuggacuauaaauucuauuccauugauguauaugucuccuuaugccagcagcacacagucuugauuacuacaguuuuguaauauuuguguuuuauuuuauuaaaaaaauuuuuuuuuaguuuuuuuuuuuuuuuuuuugagauagaguuucgcucuuguugcccaggcuggagugcaauggcaugauguugggucaccauagccuccgccuccuggguucaagccguccuccugccucagccuccugaguagcugggauuacaggcauacaccaccgcgccuggcuaauuuuguauuuuaaguagagaggggguuuauccuuguuggucaggcugaucucgaacucccaaucucaggugaucugccugccuuggcaucccaaagugcugggauuauaggcaugagccacugcuuccagccucuuuuuauuuuuuuuuaacugcuccuguggaacagggcuaccacacaggcagugugccagaguagcuguggauuauuuuggguuucccuuguaggugauuauuauccaugaauuaugacagcuuugcuucuuauuuuccagucuauauuuccagagugagauggagucucacucugucgcccaggcuguaguauagugacacaaucucagcucauugcaaccuccgccuccuggguucaagugauucuccugccucagccucccaaguagcuggaauuacaggcacgugcaaccaugcccagcuaauuuuuuguauuuuuaguagagacgagguuccaccauguuggccagguuggucucaaacuccugaccucaacugauccucccaucuugaccucccaaagugcugggauuaaaggcgugagccaccaugcccaaaaguucuuauugccugccuagaacuuccagaaccauggugaauaaaagcagugauaauagauguguuugucuuagucuugauuuuaaagcaaauauacuuaacguuucuccguuaaguauaaaaguuuucuaugggcuuuucauggauacuuuuucucagccuaaggauauuuuuuucucuuccuaguuggcuuugaguuuuuauccugaaagaaaguugaauguuaucaaauacauuuucuguaucuguuaagaugaucauuuuuuucuuuuaacuguuaagauagugaauuuuacugcuccaucuaguauuaacucauuuuuuuuuccugcaguaaacucaacuuggucuuuuuuuuuuuuucugagacggagucucacucuguugccuaggcuggagugcaguggcguggucuuggcucccugcaagcuccaccucccggguuuacgccauucucccaccucaaccuccugaguagcugggacuacaggcgcccgccaccacgcccggcaaauuuuuuguauuuuuaguagagacgggguuucaccguguuagccaggauggucucgaucucuugaccucgugauccgcccgccucggccucccaaagugcugggauuacaggcauaagccacugcgcccagccaacuuggucuuaauauguaauuuuuuuuuuuuauauuauuggguucuauuugcuaauauuuuguuuagguauuuuguaucugugaguauuuuguaucacgugugaguuucacuuuuucuuucucuuaccguucuuaacuaguugaggaguauaucccuauucucuggaauauuuuguaugagauuuaaaauaucuguucccuggguguuugauauuuggcugauguuuugugauaauagagacuauuuaacccacauguaugggaucuacuuuugacuuuguggagugagaauacagaagaggguauuugguucauuugauuuuugcagcuuguuauuucuguacugugggcuagucuaagguuacaguguagccgaaguuacucauuugacuaugcaguaggguaauaaaauuguuacacaguugagccauuguuguagugaaagcuagggaguaugucuuuaccuuuuucuuauauuacagaagggcaguguuuccuauauauagacuaauuaaauuucuguuuaucuuacagaaguuauagaccuuacucaugauaacaaagaugaucuucaggcugccauugcuuugagucuacuggagucucccaaaauucaagcugauggaagagaucuuaacagguuauugauuuaacuuauaauucuugccccccacauuuguguguaucucaaaggcaacagcucugugaaugccacucaggaauaauucuguuaagcaccugaaugacauuucuuuuaggagaaauuuugaauuugcauuagcuuacucuuugguucacuuuugaaaaagcgaaacugaaaggggucuuauugcaucgugugucuuugaguagaagugugcaagguguuucaguuuacaauugcuagggugaauuaaaaacaaccuaguccagguaucugauaaauguauauucucuuuuauaaacuuugaggguuaugcugcugcauaguuuuaagugaaaguuauucaacuacccugucucauaagugaucaaggaaucuauuuuuuugaacugguacuaauugggugguuguuugguacuguucaccaacauccaguuccagugguggccuaucaguuucuggacauguuuauucccucacacugcugagauguuuauuucagggaacacagggcuguguuuuauguccugggcaauuuggaggcucuuaucuuuagcacagugucucuccugcccuauucgauggugaggucuuagauaguacacuguguugaaaucuaaaauuucuaauaugguagccuuaaauagucuugaauuucaacuuaguucaaucauggaccuuauuaguaauaaugucuguuauggagggauuaacauuucuauguauaaaucuugcuuuucaguugcauuacagucuuacaguuccuuauauagcuagggauuauccaguaaauacuuuuucugguguuuugaauuauccacgaaaaguuauagcauccuccauaugcuauauuauucuuuaacuauuuucuuuuuugcuguguggcacgcugcacaauauaggaugcaugaagcaaccucugcagaaacuaaacgcucaaagagaaaacgcugugaagucuggggagaaaaccccaaucccaaugacuggaggagaguugaugguuggccaguugggcugaaaaauguuggcaauacauguugguuuagugcuguuauucagguaugauauuuuuaagagauaacugugucuuuuggaaauaacuuuguaauuuauuaaacugaaauguagaaacauagcuuucaaaggauuaaaauagauauuuaaaauuaggggaguuuuucuggcauuauuguguauggauuuagaugcuuugaugucuaaguugggcaguacuaaaaagaaaucugcugugguuguaaauauauugaauagguguuuuggauaagcauuuaguggauacuauauuauagcagugagagugaauaaggaggaaucaguuguugaaggcuaucauagcuauccagguaggcgacagugguggccuggaguagagaaguggcagaagucauggaaggagagaagugaaugcauucuugaggcgcugaggagaucaaaucuacaggauuggugggcaguuggauccaggauaugccugcaguaguugaguaagaguaagacuaugagguuucuaguucgaguaaccagguggauuauaguaccauuugacccuggaggaggaauaauuuggguguguguuaacaguggguuucaguucagguuuuuuuguuuuuuguuuuuuucuuucugacacagugucucgcucuguugcccaggcaacaguggugcgaucucagcucacugcaaccuccgccucccagguuuaagcaauucuccugccucuccaguagcugagacuacaggcauguaccaccaggccuggcuaauuuuguauuuuuagucgagaugggguuucaucauguuggucaggcuggucuccaacuccugaccaugugaucugccugccucggccucccaaaguacugggauuagaggcgugagccaccgcgccuggccacccggcuaauuuuuuaguagagacaggguuucgccauguuggccagguuggucucgaacuccugaccucagguguuccgcccgccucagccucccaaagugcugggauuucaggugugagccgcugcaccuggcgcaaugucuucauuuuuaaaauuuauuuuuauuauuuauuuaguuauucauuugagacaagauggcgcaaucuaggcucaaugcaacuucugccucccagguucaagggauccucuugccucagccucccaaguagcugggaugacaggcgugugccaccacaccuggcuaauuuuuguauuuuuaguagagaugagguuucaucauguuggccaugcuggucuugaacuccugaccucaagugauccaccugcuuuggccuuccaaagugcugggauuacaggccugagccaccaugccccacaaucaguucaguuuuagauaugccgagucugaggugccugugccuguguaugcuauggucuuaacuacccuucauugaauucacagagugcccuuuuguccuuugaucacauacccagcaaauccuccaacuuaaaugaguugaguuuaaggagauaccauguaggcagauaauuauaugaaucuguacuucagaaaaagugcugggcucuagauacaguuuuggaaauuaguaccauauagauggcaauaaaaccaagggagugaaugaauucacuagaggguaguggcucuccagaaguaucgaucaggcaucuuaaacuuacauagccccaaugcaacccuuggugcucaccacagcagucuucuccaucaugguacauggcaccuacccagcugcucaagccaaaaaauggaauucucccuuucuacacaucugcuacauccagcuucuaugugccuggcacugucuuaggcucuggggaaacagcagugacuaaaacaaagcccguacucucaugguuuacuuuggaaagaguggcacagacaguaaacaaaacaugaggaggugacaaguguaaagaugaaugaaugagucugggggacuggacaggguucagcuggagagggcagagggucagggauggccuuucugaugaggcgggaauuugagcagaggucugaagguggccagggaaugugcuauuuaauuacauagggaacauuucagacaaggaacagcaaauaagcagacugagguucaggagcuugcuuaaugugucugacaaauagcaaauagcuaagacggagugauccagaacugauagcagugggauaggaaaggugguggagguggaguggaagagcuuggggucaugaugaagauuugggaauucuagaugaaauaggaauguauuggaagguuuggagcagagaagugauaugaucauacuuccaguuuaaaaggaucacuggcaucuguguugagaauagaacauaggaagauaauguggaacaugucaguucuuuccuaucugaaaggauagagagagagaaagauaaugcuccuuggauucacaaccaccgcccccccaccauuagccuucacuccuguggaggguggacaagagccagcagauggagaagauagcugaguaaggcuucugggacagcaugagcagacagcauagaaaguauaucugaggagucggccuuaacaaggaaaagggcaggagaguaaugggaagggaagaggaagaaaugauaacugccaauuagaguugaaguagugucuagucuuuuuuuuuuuccucugugaaauuagcagcuauuuuuugagacaguggagaagugacagagucagauuuuaaagggagugaaaguuugaaauaguuguuggagauggugggagaaccaguuggcaccagaguacaguaguaggauuuccaaaaauuugaagaucugcuugaaauuguugacuuuaaauguguggugauacgaaaauguucaguuucuaucaggacauccucuugacagcacuuugaaccucuuacauggaaaacucaacucauuuaauuuggagcauuugcuggguaugugaucaaaggacaaaagggcacucugugaauuuaaugaaggguaguuaagaccguagcaucaaagcuagauggagaaagaaaugaagauaggaaggaacugauuguuagggagccaggaaagagaucaauuugcuugggccccugcugaagucaaagaacagauauccugcagguaauuggacacaaagaagacauguaauggucccagagugagcuuuucugaacguguaaucugcgaacugacaccuuucauguguugguguauuuuugggugcagccugggauguggauguagauagagauggaguggaggaaugugucacuagagaugggaugcccaagaagccgagagaucuccauacuggaugcaugcgaguucccucagcaaacaauugaacaccugcucuaugucuagcaguguucuaggcccuugauguaggagugaacaaaacaaagacaacugugcccacauggaauguaaauucucaugaggugagauagaaaaugaacaguaaacuaaaaacuaacagaaugaugaacuagcugaauaaaauguguauaauacauuagacugugauugguccaguagaaaaaagagcaagguuagggagauuggaacugcaggagaggugggaacagguugcaguauuaacugugguguuggaugagccucacugugguggggaaggggaugagacugaaaagggagugaaccaggcagcuauugggauaaaaaaacauuccagguagaggaacacauagagcaguggcuucauggugggaaugggcuugguguguucagggaacgugcuggaguccaaguggcuggaugcuaagagcaaagggagggucacuggagaggagggucugaguggacagggaguuacugaaaguccccaguggcagacugaucaacucuggcucaaguauuaagagucucccucuggcuccuguggcgagaugaggauggaggggcaaggaugcacagggagagacccauggcugucauccaugaagagugauggugacucggacuggacugguagcccuggaaauagaaaagaguuggaguucuugauauauucucaaggcagcacugacaggauguccucagggauuggauguugacucuagucaccuaggaggaugucaggacuugggagagugaggaaagcuguuacuagaugacagucuucagugaaucgggagcuucauuuuugccauauuagcgagguacuuagaaggagcugcguggcaguugugagcaagugugaguggguggagggaaguucuggaagcagagagaccaugugcaagugagcggcgaugggaguuggauuagagcagcugauggggugcugauggggagaaagcaguuagguuauaaagagcaccuagagucagaggccaagggacuuguuacuuacuagaugugaauggcgaggagaaagauucaaggauuuuucugcaguucuaaacuuuggugacugggggaggaggauguaauaaugaagugacgcagaaaacacagaagcagcagcgguuggguaaggaauaaauugggagaugugaauaguauuagcucacacuuaauguguucuuuuuuguuguuuuucuuuuuuuuuguuuugagacaguuucguucuuguugcccuggcugguaugcaauggugcgaucucggcucacggcaaccucugccuccaggguucaagcgauucuccugccucagccucccgagcagcugggacuauaggcaugccaccaugcccggcuaauuuuguauuuuuaguagagaugggguuucuccauguuggucaggcuggucuugaacuccugaccucaggugaucugcccgccucagccucccaaagugcugggauuacaggcguaagccaccacuuccagccuaaugugguuuuuaagaauaauggcaaagcccgauuuuccugauggugaagagguggaguuaaauggcugagaauguaaagccauuuuucucacagcagaauagaaacucaagaaugucacaggguagccagcagaguaggaaugcaaguguguuagguagacaggugagguggaagagaagagaguggcagaggauacagcucaccagccaagcccuggucccagagagaacuuuggugcagcaugaccuggguuuacacuucaguccgguugaacacucacccuguuggcugaaucccgccagggcuuguguuagagugagggaagccagagaggugcacgugggcucuagucaguaccgacacuuggauucuuugguugacauuaggaaauauaccuggggcuuuuagaauaccaagaagcuguuuuauuuaguucuaauuccaaaguuuugccuauuaucuaccuaggaugcuucuucaggaguuccaccgugcaggccugagaggguuuucauuugaggagcauguugggaugaggaguuguauauucauacaggagauauuuuuaaagaaaauuaacuuaugaaagguauucauaguagaaaaaugugauuugcaaauaauaaaaagaaucccucucuccaguucuaccaucugcuguuaaacuuuuaaaaaauacaauacuaugacaaggaguggagaauaguaaacacugcuauacuaaccaccuagcuuaaaaaauuaauguuacaaauuucuguucuauugaguuccuguugugacauccucccuuucccacagucauaaccacacauggauguaucccugaacaauacguaguauuguuuuacauguuguuaaacuuaauauaagcaguauaauacuuuuuuucuguaacuuuuuuucacucaaaauguguuuuugagguuuauccauguugauacacauagcucuuguuuuuuucauuuucacuuuauauaguaggucauuuuauaaacacuuuuuacaauauuauuucaaugacugcuuaauagucuauuguauaaauguaguauaguuuauauaaacuacuucuuuuggcugggcuugguggcuuaugcuuguaaucccaacacuuugggaggccaaagcgggcagaucccuugagcucaggaguuugagaccauccugggcaacauagggagacccugucucuacaaaaccaaaccaaaacaaaacaaaagcuacuccuuuuguuagacauuagguuguuucuauuuuuuaccuaaaaguauuaauauucuuugagcuaauuuuuugugcacaaccauuauuuccuuagaaauaacauaagucaaauugccagguugauaguuuugcauacuuuuaaauaugaaauaaaauauuugaagugaaaaauacauauguugcugcaguuauuuucaggaaaggcuaugaaucccuuucuuucuuuauuucagucucucuuucaauugccugaauuucgaagacuuguucucaguuauagucugccacaaaauguacuugaaaauugucgaagucauacaguaaguuggugucaaggaauuucuucacuguuguuuagucccuuucaucccuaaggcuucuagauuuuugccuaaagcugauauccgugauacucuuuggcuugugcuaauuauuuguuuucauuucuaaauggcucauuuuccuuuuuugggauaacauauaaggguaugcaaaaauguaaaauuaaguaggaguaaaaugagaaaaacagcuccaagaauauguggguggggagacccugaauaccuguuguguuuguuguauccuuucucuuccugagcugcuuaggcaaugugaugcuggagagaugcccugaugccagagaccugagccgccuuagucuauuuuauucuguuuuugccaaaggucguagccuccuccuagcaauuuaacccuucccaggauuucaccuuggcgcaaugcauuuuccucaugagaaggagggcagcagcuucagaaaguggacauuucuguuuuuccaacagugcugucucuggcuucuacauaguuauucuucaguuuagaguacaguccuuaccagagucccuguaacacacauagcccugugacuuugaccuagaucuagguaaauauaaaugagggcaugauuauugacaacuuuuuuuucuuuacacguucugauuuucuaaaugagauauuguaagaguacauguacuguguuuucuacaggaaaagagaaauaucauguuuaugcaagagcuucaguauuuguuugcucuaaugaugggaucaaauagaaaauuuguagacccgucugcagcccuggaucuauuaaagggagcauuccgaucaucugaggaacagcagguacaaaagaagccuuguucuugaguuugaagucaugccuugucaguguuaaugcgguacugcuucauuucaacugcguaacaagcugugaacaugacuaagcaggacuauggaugcucguuucugacuuuuguuuugccuacagaacagguggugagagagaaagcaugugugugugagagagugugcguguguugcacgggggcuggcaguucuaaagagaagaagaaauaguaguagaaagaauguagaauuauaccggggcuauugauguagaaaggaggagauuggaaaauaccucaaugagcuguaacaaaagggauaccaagaaaaguaguccuuugucugcaccuuugucuuggaaugguccagauggaaauaguaucuuuaaaacuaucuaaaccugaguucaggagcuuuucggagcuuuucucagcaacuucucucuucuagacuuucccuucccuaccuccuauuaaaaaauagccgggcauggugguacgcaccuguagucccagcuacuugggagguugaggcaggaagaucccuggaacccaggaguuugaggcugcaauaagcugugauugcacuacuguacuccagccugggugacagagugagaccccgucucugaaaaaauaauuuaaaaacaaaaacaaagcugucacuaauuagaucaucuucuuccucauaugauuuuuuuucuuucucuauuugaagguccuacaguucuacaaaauucucaaaacauugaaguuuucuuucuuuauucagaucucuguauuguucuagaguuccuugggccuuuuucuuaaaaaguccuacuuggaagauuuuguuuauuuuucuuucuuugucauaaauagauguggcuggaaguaguagaguuccagcuuccuucuagcuacaacuuucagguugcuuaaugcaccuucuuuuuuauguauaguagcuggguuucaguguuccuauguuuucaugauauucagcccccaaaaauaaacgcuuucaggcugugcgcaauagcugaugccuguaaucccagcacuugcgacgccgaggcagguggaucauuugaggucaggaguucaagaccagcuuggccaacauggugaaaccccgucucagcuaaaaauacaaaaauuagccaggcaugguggcaugugccuguaaucccagcuacuugggaggcugaggcaggagaaucgcuugaaucugggagguggaggcugcauugagcugagaucgcgccacugcacuccagucugggcgacagagugagacccugucucaaaacaaaaaaagaaaagaaaaaaagaaaugcuuuuauaguaguauaaucuuaauucauuggugggauaaggauaaauuuuaauuucucuuaguauugcaucuaacuuuuaugcaauuugugccucucuuauagcaagaugugagugaauucacacacaagcuccuggauuggcuagaggacgcauuccagcuagcuguuaauguuaagugaguguugaggguuuguuuguacauccuuccgacucacagugggccagugagaauuauaugcuggaaaguuacucuccuuaacuagaaauugcugguuuuuaaccauaccuccugggauaaccacugagguaguccucaucauguaucccugucgccuucagcuuuccccucugaggauguaccagucaucuuauccugcagcuuuuuuuuuuuucuaacuaaaggacuguaacuguuaacuuuguuaauaaacucagcaugugcuguaaaauguauuuguaaaaaggacaaaucaaccucuguugugaacaugaugguauaauauggguacuuaaauuuaagaucccuuuugaggucuacuaagaauguguagaggauagguuauagucauuucagucacugagagaagugaaacuuagggcacgauacggauaucccucugagaaaucuguguuuuaaaugguuucaauucuagguagaagcauuguaacuauaaaauaguuuuggaaacggcaacucaacguagcaauuuaagaaggacuuguaaggagaaacuuuuuauuucuguuguaccauggagaaaaauuuuuuguauuuauuuguaaaacuaugcaacagaguucauucuuaccuuuauacugcuucuauaccuuguauacaucuaucauuggauauagauguauauacugaaagcauauuugucugcaugugugacuccacuauuaggcuuuaagcuccuuaaguccagggauugggccuucuugucuuugugucuucagaguuuagcacaaugcucgaaagaagguguucaauaaauauuugaacugaacuaauuguuacuuauuuagaucauaccuggcucuuuggggguugaugaaaaugcacuauuuuugcuuuugaaugaugcuuggauuuuauguagcacauaucuuaauccaaacaauccagaauugucuccuuuuccuaaaagcagcagucccaggaacaaaucugaaaauccaauggugcagcuguucuaugguacuuuccugacugaagggguucgugaagguaaauucucugcucugaauuuuaauucuagaccuuugaucauaucuuuauuacugugucccuuugaggaggcaguauagugaauaggcuugagagucagcaguacucagcucugaauauugguucugccucuugguaucuguuuaacuguggauaaacuaugggagcuucuggauccucagucucuucaucuguaaaaugugcacaaucuuuaucucagauuugucauauuaauacuugcacagcccaaaucugacauuaaugucagauagugauuuuacucgguuuucucuguguugcuuauucuaauauaauacuuaaucucaaaagguuuuauugagugagacugccaaaaauguuuuucuagacuagaggcuuuucacucuggaggcuuaucuaucuaagcuacaugcaaggcacauaauuuauuuuuaauuaugaagaguuuagaauacauucaaauagagcaauuuuacaaccuccaugaacccagccuuagcccacagccagucauuccccaucucaccccacucuuaccaaucugauacucuuuuuaaaacauaacccaauaccaauaugacucugaaaaauagcauuuuaaacuaucaaauaucuagucaguguugagauuucuaauuuguuuucauaauuuuuuaaaaauagaaaauuuauuuuuagaguuuguuuuagucaggaccccagugugugauucauuuaugacugaauauuuguaggcucccccuccaucguuuuuuccuugaaauguauuuuuuggagaaacuggguuguuuguucuguagcauuucccacaguuggaaauuuugcuguuugcauguccucugauacauauuuaacauauuuuaacauauccccauguucuucucuauuccuccucuuauaaauugguaguuggaucuagagauuugacuagacuuagcuaaggcuuuuuuuggcaagacuauucacagauggugagaaaacucuugauuaggaaguacauaaugucugguugucuuugcauuuuuuuuuuuuuuuuuuuuuugagacaaguccuugcucuguugcccagguuguagcgcaguggcaacaucauagcuuacuguaaccuuggacuucugggcucaagaaauccuccuaccuuauccuccugaguagccaggacuucaggcguguguuacugcacccggauaauuuuuauuuuuuguagagacaggggugucacuguguuuuccaggcuggucaaacuccuggccucaagugauccucccaccuuggccucccaaaguggugggauuacaggcauaagccacgaagccccuggucuuuuuccaguguuacugguuuucauuguucagugucuagauugacuggcucacuagagguugcuauaaaggcguaagugcauuucuaaccagcuaucaggaaguugcugaauuuaaaauguugucucuguggagccagaagauaggcuuuagauagucauagugaugucuuuuuuaaaaagucucucucuuugccuaggaaaacccuuuuguaacaaugagaccuucggccaguauccucuucagguaaacgguuaucgcaacuuagacgaguguuuggaaggggccaugguggagggugauguugagcuucuucccuccgaucacucggugaaguauggacaagagguacguuggagaucuuuauuugcugugccagugacaaagccaguuaaguaggagugagcuuuugggcagacuaguuucccaucacauauuaaguaacuuuacacuuagcagaacuugaauuugucuuaagucucucaucaguugaugugagucagugaguaucaguacuuugauaaauaauuuuuacuaaaacuaugaauuugaguuacucguguaaagguuguaugcugcuucugauguuuuaaguaugaucaaguuucucucuuucuguugaagccuaccuguaccugaguagggagaacccacugccuccauauuuucggaggguaaaaguacagugauuaacuccuaugguaugccauuuagaauauuuucccuauuauaguauuuacuguucucaauuguaaauucugccuuugcuuuuaacauuuuuaaaauuuaauuuucauuuguuuauuuauguaucuauuuuuuuucuggguuggaaagacgggggaaguuaaagggagagcauggguaguuaacaucucaguauuccaguuagguuaagaauuagugaauagcauuuguaacauaauucuuuacacaguugggauuguucuccauugaucauacauuuugagacaaaacuguggcuuauauaugauuccaacucaguaauuacuauaggagaaaguggagcuuuccugaauuaaaauagggagccuaacaugagccauaugaaaauacauucacuguagagcaguguuggaacucagagagcugcugccucccuggauuuucaaggaaaaacugauuccuaauggaggaauuacgucaucuguaccaucugugcaaaccuggugcauccucuuacaaaagagggagucuucaccagcuauacuuaggccuguggagaccuguauuccaggaugggaauucuauaaaaauuaaacaaaacaacaaaauugucaugcucauuuagauuucacccugagguggucucacaggcugugugaauucaccucauuaugcugacaggguaucugaagggaauguugcuugcacuugugguaaaggaaauauuuuaaagcuguugacaggaaccucagacauacaggugaauugaauagaaaagccaaaucugauuuagcuuuuccucaccugugaucccugacuguugagucuuuuuuaugucagugccuuccuucuuugaaacucaaguaacaucguagguugauuugacuggcuucuuuaugagaccucuguaaguuuuugaaauucagagauuuuucuuagaaauugagaaauuguaaaaccaugaggcuauuucaaauuuccuuuguauauauaaaggagauucaaauuaugguuaauagacuaaaacagcauguaauauauguacacauaugagucuuuuuagcuggcacauggaguugucucuuuagcuacaugcugcuucgaucauaauuucauauucuguaguuaggcuagcuguuaaguuuuuaaaccucuucugaauacugaugauguaacgaaugaguuauguagaugcuuagugcgguucacauauucaagggugguuuauucugaggaugaugguugaguaaaauucuguugacuggcuaguaaauuuggagucuugaggaauguugaaccauauucuguaagagaaugagauucuaaguguugauucccuuuaguguuugggauaaaaaaaaguucuaguaugaguuugccuugaguauaaguucuauaccaaaggaagaaacuuuaaugagagauauuuuaaaucugguuauuguaauuuccuaaaauuaauuuuucuuucucucacauuucuacucuugacacuagcguugguuuacaaagcuaccuccaguguugaccuuugaacucucaagauuugaguuuaaucagucccuugggcagccagagaaaauucacaauaagcuggaauuuccucagauuauuuauauggacaggugaguucuuggcugauuuuuuuuuuuccugagguauuacagcaguagagaugagcacguacuaaguauagugugcguaggaaucaccugggagacaugauaauaugcaaauuuggauucuaugagucuagguugagggucuuugccuuuuucugagaccucccaggguugugcucauguugcuucugaucuccggaagcaagacuuuaggugaaagcccuccuccuuuuggggguaggaacuaccugaauucugggggugggggugcuccuagcagacuuacauuauagaauuuuuguuuuuuuuuuuuuuugagacagaguuuugcucuuguugcccaggcuggagugcaauggcgcaaucucggcucaccgaaacaucugcuucccggguucaagugauucuccugccucagccucccaaguagcuggaauuacaggcaugcaccaccacacccggcuaauuuuauauuuuuaguagagacgggguuucuccauguuggucaggcuggucgcgaacucccgaccucaggugauccgccugccuuggccucccaaagugcugguauuacaggugugagccaccgcgcccggccuagaauuuuaauuuuauaaaagucugguugagaccaggcaugguggcucacaucuguaauccuagcacuuugggaggacgaggagggcagauaucuugagcgcaggaguuuaagacuagccugggcaacauggcaaaacccugucucuuaaaaaaaaaaaauuagcuggguguaguggugugcaccuguagucccagguacuugguggggccagugagcccuguucaugucacugcacuccagccuggguaacagagugagacccugucucaaaaaaaaaaaaaaaaaaaaaaaaaaaaaugggugugguggcuugauuuucuuuucuuuucuuucuuucuuuuuuuuuuuuuuugagaaggagucuugcucuguugcccaggcuggaaugcaguggcacgaucucggcucacugcaaccucugcuucccggguucaagcgauucuccugugucagccucccaaauagcugggauuacaggcacgcaccaccacacccagcuaauuuuaguauuuuuaguagagacgggguuucaccauguuggccaggauggucucaauccccugaccuugugaucugcccgucucugccucccaaagugcugggauuauaggcgugagccauggcuucuuuuacuuauuuuuuauguagucauucuuaucccaugguuuauuuuuaggcauauaaccagugaguucugacaaauguacagucaaauaaacuaccaucacagucaauauguagggcauuccagcacccaaaagguuuuccuugucccauugugaucauucccuuucucuccaucuccagguccuggcaaccacuuaauguuuuuggacccuauaauguuaccauuucuagaauguggcauuaguaacauuaauauuuaguagguacccuguucugguuguguccuuucuuuaggauaauguuuuugggauucacccauguuguucauauauaaguaauuugcuccuuuguauugcugaguaauauucuauuguaauauguacugcagugauuuuuugccauucaccauuuggugacguaucuaguuuuaggcuauuaugaaugaagcugccaugaacauucacauauaauccuuggcauaauuuuuaguuuucuuggguaaaauauguaggaguaggauugcuugguucuaugaaaaguguauauuuaacauuauaagaaauuuccaaacuauuuucuaaagugacuauacaauuuugcauucccucuagcagugugugagggcuccauuugcucuacauccuugccagugcuuggaauuauaaguguuucuaauuuuagccaucuagugggugugugggaauaucuuauuuuuccuuugauuuauauuuccuuuucccccauugaauuaucuuggcacugugucaaaaauuaauugaacauauacaugggggucuauaucuggagucuguucugucuguugucuggucuuaugucagugccauauuguuuugauuacuauggcuuuauuguaaaucuugacauuagauaguaugaauccuucaacuuuguucuuuuucaaaauuguuuuaggugugcugguccuuugcauuucuauguaaauuuuuaucagcuugucaguuucuacccaguggcuauugggauuuugauugguuguguuuugaacuuacagaucaguuuggggaaaauugacaucuuuuuuuuuuuuuuuuuuuaagacggaguuucgcucuuguugcccaggcuggagugcaauggugcgaucuuggcucaccgcaaccucugccucccggguucaaaugauucuccugccucagccucccaaguaucugggauuacaggcaugugccacaacgcccagcuaauuuuguauuuuuaguagagaugggguuucucccacguuggucaggcuggucuugaacucccguccucagguaauccgccugccucggccucccaaaguguugggauuacaggcgugagccaccgccccugguccaacaucuuaauaauaauauugaguuuuucggccagacaugguggcucacaccuguaaucccagcacuuugggaggcugagguggguggaucaccugagguagggaguuugagaccagccugaccaaccuggugaaaccccaucucuacuaaaaaauacaaaaauuaaucagacuuggugaugggcaccuguaauuccagcuaccugggaggcugaggcaggaggauugcuugaacccgggaggcggaggucacagugagccgagauugcgccguugcacuccagccugggugacgagugagacuccaucucaaaaauaauaauaauauugaguccuucaauccaugaacaguguauagcuccauuuauuaaauaaguuaauagagauuuaaguccuuauuaauaucucucaacaguguuuuguaauuuuuaguguacaggucuugcacauguuugauuaaauuuaucucuaauuccugcuuuuaauuucauuuuucauuuguucuuuacaaguguauagaauugcaguugauuuuuuuucuuuuuuuaaauugauuuuguauccuuugacuuuacuaaacucacuuauuaguucugauguauuuuuuuagguuccuuaagauuuucugcaugcuuacaucauguggaacuaaaaggcagcuuuacuucauucuuuacuaucugcaugccuuucauuuguuuuucuuacuuuauugcauugguuauaucuucaguuaaguauuuaauagaaguagcaagaguggguauccuuguuccugauuuuagggggaaugcaucaguuuuaaccuugaguaugcugucagccguauguuuuuuauagaugcccuauaucugauugaagaaguuuccuugaaucuuuaguuuacugagacuuuaugucauuaauguuuuauaauauaaauuguguuugugggauuauuuacuuagguacauguacaggagcaaggagcuuauucgaaauaagagagaguguauucgaaaguugaaggaggaaauaaaaauucugcagcaaaaauuggaaaggugaguuuuggacaccuucaugcuuagaaauguaaaagaauauuaaaaacagauaauuuguuuuucuuuaaaaauuaacucaacguuuaaauauuaacuagaauauuuuauaaaacagcuaagaaaauuuuuugucuaagugugaagcagucuucaggaucagcuaguauuauucauggggguaaauaauagucccagacuacugaagugacucagagucacacaguuaguuacugcaguguaccaaggagaaacugaguucugauuuuauagacuuuuuuucuacuccccuugccaucuuuuucacaaacaugagagaagcaagugucacgauggucccguccacuuuuggaaaagcaguuucugaagugucuaagaaagauaaaaaacagugcuuuucuaccuagagcagugcuaacugauuaaaagggcuaauauuucugaugcauacaaaguucuuucucuuuuggaggaauuuucacuuuuuugauuguugguuuuacacuauuucuguagaaugguuuucuguaauuuccuuaggagucaguuuaauuucuuucucgucuagauagaucccguugauuuugcgcuuaagaaagagaucccauacacagucaauagcuucuccucccuuuauccacuuaacaguuuucuuucuaagaccaccacaccuccaccuacucccuuauuaggccauuaauuucccugaagggcaacacuuuccauaccaggccuaagauggacccugcacuguacccccaccgcuaccacugcagcuuccacucucacuccagaagagcuuauacaagauguauugugacuagucauuugucuuuauagagacuuaagcugaaaaccaguuccucaaauacuguccuggaagugauuuucaggacuuuuaagucuguuaguauuuuacuaaaccuuuaaguuuuagugauacuuuguaaggcuggaaauuuuaaauuauuuuuauagaaccaaccauaccaacuggaugcaguaucaugugccuauaaucccagcuauaugggaggcugaggcaagaggauugccugugcucaggaguuugagaccagccugugcaacuuagugagaccccaucucucucucucucucucucucucucucucucucucucucucuguuuuuuuugaagauggagugucgcuuuguuuuccaggcuggagugcaguggcacgaucucagcucgcugcaaccuccgccuccuggguucaagcgauucuucugccucagccuccagaguagcugggauuacaggcaugugccaccaugcccggcuaauuuuguauuuuugguagagacaagguuucaccauguuggccaggcuggucuugaacuccugaccucgugauccaccugccucagccucccaaaguccugggauuauaggcgugagccgcuguuccuggcccccaucucuucacaacaacauaagagaccccaucuuuucacaacaacauaaaagaaaugagaauaccugauguuuuauaguucaaaaauaccaauuuaccaggagacaacaggguauucuuuauuuuaaaauagaguauaggagcauuuuccuuagcaugauaauacuuuuguuuuaaaauaaaaugagaccuucgaguuguaccuucaugaagcuagaggggccagggaacguauucccccacucccccaccccacccucacacccuccaccacccacuguccccaugucuaccugacuccucaaucgggauuugguggaaccuccucccaaaaaggcauuagaaagaacugccaagcacaaaauuuuguuaagaaauggcaacuuuuggaacagagaggcuuucugaauaaaaagaaccagcccccuagcaagacacccaaguugcacucagaaccuccaaagaaagaggaaacuccuagggugcauggcacuuggaagaccccucccuucccagaaaagaaggcagcugccuccagcagugugucagaagagucccuggacaggaaagcugcggugucauggcuguccccugccccuucaaagaaugcugauucuguugcagcuaaguagauuugcuggaggugcccuucuaaagauuaacagccacccgacccacucccagaagaaaggccuccagaacaaauccucucagcucagcgccccacagaacucuacccaagcucacucagaauaaaugcuuuggagcaucccagaaguugccaaggaagaauaguggcaauuggcugugagaugcuggacacaggacccaaggggcauguuacuuucuugguuccauguagcacugucagcuacagcggagaugugcuucauaacgaguacauccuucccccuggccacacuguggacugccagaccagguggagugguguccagaagcagcacauggugaaugccaugcucuucaagauugcucauggcauauauugaagauacagggaagauggugguggacaugccauccacaaugacuucaaagccccaguacuuucaucccaagucccucaccagugacaacucccauaucccccuucuccuccccaacuggaaggcugauugcccagugaacgucaccaugucuuugaagcaucucaucaagaaucugcugaauugggacaucuggguugggaaaauaggcauuccucuguggaagacacccaggcuaccauggagcuauacaaauugguugaacucaagugggaagaacaccuugcccagaauuccccgaaagacuggugacaauggggauguuggugacguggggaggcagaagcagcaccaggagaaauagggcaguggaccaauggacaucucaacuaguuccacaucuuuggaagcuaaaauuguuggcaagagaaagguucuacucuagauuuaauauccauugaaauuccaucucugguguuauguccugugucugguuaagugucccauggaaggagggcgccuccaugucagaaccagcccugugucuuuuaccucuuucauggugcuaucccuaggucccagggugcgcugugccagugaagcguuuugaauuucaagggacagggcauacugagaaauguaguuucccaaagugccugaucacuagaguggcuauauggcucauuuugugccucuucuucuugaguaauuaacagcaccuucuuucacucucagaaguauccugguuugauaauaaauuauauggucccauuccuaacacaaccucugcuuuuggcucacagucugcaucuagccuguuucaggacauugcucauucuuccuacuugacugccagaggugccauugcaggugagguuuaguucuccuuuggguucuaaggcaguggagguaagacaguagcuuggaagucaacuuuucugauuuaggaaagcagucucuuuccuaaggcuauagaggauuuauuucauguaggucccaguugguagguuaaaaaagaauuuguaaaguguuucuaacucauuuaugcuggagguugcaaauuuuuuuggugaaaaauaagaccuuggcaaugaccuugagcaguaggauauuaaauuuuaacucccacaagcuuagcauuccaauaauggaacacuacgcauaaauggguuaaugguuuuuagucuggccgggcgcgguggaucacuugaggucaggaguuccagacccgccugaccaacauggugaaaccccgucucuacuaaaaauacagaauuagccgagcgugguggcgcaugccuguaguccuagcuacucgggaggcugaggcaggagaaucacuugaaccggggagguggagguugcagugagccaagaucacgccauugcaccccagccugggcaacaagagcaaaacucugucucauaaauaaauaaauaauuguuuuuagucuuuaucuugguaaaccaagccccuaaaaauucuaauuauucccuugauacauuuuuauaauggaaaaaauaaaaugauuauaaauuucagauuuuauuuuuuaagguuacacauaucugcuuguauaugugugacacaguccugggaaaauauaaaagaaacuguuaauggauaccauuagguaguagaacugagauggagguagaugacuuuuauggucuguuuuauacuuuuuuguauuugaauuuucguaccagguacaugcauuacuuuuacaguuuaagaauaaaaauguuggccaggcacaguggcucacaccuguaaucccagcacuuugggaggcugagguggguggaucaguugagaucaggaguucgagaccagcuuggcugacacagcaaaaccccaucucuacuaaaaauauaaaaauuagcugggcguggcaucgcacaccuguagucccagcuacucgggaggcugaggcaggacaauugcuugaacccaggaggcagagguugcaguaagccgagaucgugccgcugcacuccagccugggugacaaaaugagacucugucucaaaaaaaaaaaaaaagaauaaaaaugcucacuauuucuucuucuguaagauaaccuugauauauuuuugaaaauugaauuucuuguguauaguauagacaucuuuuuuuuaaccacuuuugcucugauucuacuaaacugauagagguguacauuguaugaaguaguugguccuaaaaguuguauaaaggaauucaguagaugaacaugaaaaugauuaugucuugucuucuuuguuuuuuuuuuuuugguguuuuguuuugcuuuuuuugagacagagucucacucugucacucaggcuggagcacaguggcaugaucuuggcucacuguagucucaaccucccaggcucaagcgauccuccugccucagccucccaaggagcugggacuacaggagugugccaucaugccuggcuaauuuuuuucauuuuuuguggagacaggguuuugucauguugccuaggcuggucuugaacuccuuggcuucaagccaucuaccugccuuggccuccccaaguacugggauuacaagcaugagucaccaugcccagcugaaaauuguuaugucauaaaauugaagauaaguuucuuaaagaaaaaaaucucuugggauuuaguguaaguauuguauuaaaaugcagcaaaccugggaagaauuaaaguuguaaaaugaugacuuaaaaauugccaggcgcgguggcccuuaaucccagcacuuugggaggccaaggcggguggaucacgaagucaggagaucgagaccauccuggcuaauacagugaaacccugucucuacuaaaaauacaaaaaauuagccaggcgugguggcggguuccuguagucccagcuacuggggaggcugaggcaggagaauggcgugaacccaggaggcggagcuugcagugagccaagauagcgccacugcacuccagccugggcaacagagggagacucugucucaaaaaaaaaaaaccaaaaaauaaaaaauaaauaaaugaccaaagccuaaauguaauaugacaucaugagaaaguguaacuggcaugacuuugauuaggagccuauuugaaauguuuccugccagauauaaaacuucagauuguuggcaauuuuuaguuuuguaguuagagaauuuuuacccuauagauuguuugaggacccuauuaaauauuguauagccucuaggaauaagccuuuccauugacuugcugugauaaacagaucuuuugucagcgacucuuaaaauacaaaacagccuugggcaguagaguaccacugucuuugucgcuuagguaugugaaauauggcucaggcccagcucgguucccgcucccggacaugcugaaauauguuauugaauuugcuaguacaaaaccugccucagaaagcuguccaccugaaagugacacacauaugacauuaccacuuucuucagugcacugcucgguuucugaccagacauccaaggaaagguaaugaaaacauuuuuuuuuuaaugguauguauuguuuuucugguauaauuuaaacuaugcaccaucuuuguacuugauugacagucaccuauaagagcacaggagcugugagcucuuugucuuaaagggaaggguuuugcugacugucacuugggugggagugggcccaccagugcauuugucuuauccguagaaugguuggguuauuucagaggcuucucaaacuguucaggauaguguucaggcuccacccagugaugccuuguuuugaacuacaagccagcugccauuaaaggccuuucucagaggaaaccucaagcccugcucuuccaaaacaucucaugcucacacacuugaaguaugcaugacuaagaaacaucaaggaaagagagacuuauucuugaauagaaaauuaguacuugaaaaagaacuggcuagaaauaagaggacagcuuagaggggcuucucuaguaaaggcagagggaggcaaagucacaggagcccucugauuuuauuccauccagucaugugcaacaaucuuuauugccuagaggagccaugaaagguagcuaggacauuugauauguguuaccuggcuaauaaaaacacuaauacucaauaaaaaguuagacuuuuuugucaaaaaaucuuaacuauucuccccaacacaucccccgccaccgccccacguauuaauauuuauucauccauguaugcauagaaaugcuuauuuggauagaacauaccaaaugucaagaaugauuaucucuaaggagugacaugagucuggggauaggaguggggcugcucuuucacuuuuuauauucuacuuaaauuuuuuaauuuuuguaaaaauagaaucuuuuuauguauauuaugaaauguaaaguuuuaauuuuuaaaaagugguucggcaggcuauuuaaucaaauaaaauaauagugcuugguauuagauuuaaaaauuacagggagguguauguguguaaucuccucugaaauugagauaucuguucccuuguugggcuuauuuuuccauaaguauggaccuuagggaaaagagauuuccuccauuauuuugugcaugugagagagugaggaggagggagugagguuuuuuuguuuguuuguuuguuuguuuuuuugagauggagucucacucugucgccaggcuggaguacaguggcaugaucucagcucacugcaaccuccgccuucuggguucaagcgauucuccugccucagccucccaaguagcugggacuacaggcgugccaccaugcccagcugaguuuuguauuuuuaguagagaugggguuucaccauguuggccaggguggucucgaucucuugaccugguaauuugcccuccuuagccucccaaagugcugggauuacaggcgugagccaccguacccggcaggagugagaguuuuuuuuuaagucaaaguaaaggaaguuuauauucuucagcuuugguguaaaagagaaaccuaacuacaauuagaagcuuauuuuauauuccugcugguuuguugaccugcaguuuuacucugacaauagagaaauuaacauuuacuugauaugcuuuauucucuguuaguuuacagaaaagacguaaagaacuuaagauuuauauuuuguagaugagauauuaauacuuuuuuccuuggguauuuagcuaaaguaguagagcuaggauuguuugacuugaagcccuucucucagaacucuccaaggugucaccuaguguguauuccugugaguuguauguucagcugaugcuuccuuuuucuuccuucuguguauuuuguuccaggaaggauagugucacuuuaguuggcuucaucuuguaaacucuguaguugauuccuugauucuuccaggccuagucuucucuuuuccauuuuccuucucuucccauccucaugggaaggaauaaucagugaucagagaacaugagcuaaagacuggccgaucuggcuuuggauucauuuucauuaccuuccagcuuggugaacuugggcauguugcuuaauuuauuuaaaccuuaggcucacaguugguaaaauagggauagaaaaguaucuaccucacaggccaguugugguacgugagaugauagagaaaaagguuggcucuguaccuuuauagaguuaaugcucacugaauaccuguacuuuuucauauagcaucuugcuuuccaaaguacauaauuuaggccaagguaucuuuuggaaauuaucauaugagcaugauuuuugucuuccucaguacaaguacagaaagcucuucucaggauguugaaaguaccuuuucuucuccugaagauucuuuacccaagucuaaaccacugacaucuucucggucuuccauggaaaugccuucacagccagcuccacgaacagucacagaugaggagauaaauuuuguuaagaccugucuucagagauggaggagugagauugaacaagauauacaagguuggcucuuuuaaaauuugucaguuacucuuugcuuuuucuguuuuuugacuauuuggagguuaagcaccucgguacacuuccugacauuacuguacaugcuacagaauuucccccccgccgagauggagucucacucuaucacccaggcuggagugcaguggugcaaucucagcucacugaaaccuccgccuuccggguucaggcgauuuucauggcucagccucccaaguagcugggauuauaggcauguaccaccacaccuggcugauuuuuuuuuuuuuuuuaguagagaugggguuucaccauguuggucaggcuggucuuaaacuccugaccaaaacugaucugccugccuuggccucccaaagugcugggauuauaggugugagccacuacgucuggcccaugcuuuugaauuuugacaugguaauugugacuucuuuugcacuuuuagugcccuguaaacuuggcucacacacccccauuauacagauauggaaagaucucccccucaaaauuucugggaaaugaucaccuuugcugagauuuuucugcaucaacugauuucuguuucugugguagauuaucugaacuccagcuuaaguugacccagauuuagcauuuagcuuuucuggacuucuacucuucagucuuuucuauaggaagcaugcuuuacugaagguuaaugagguauuugagcaguaugcacaauguaaaauuggauuauucagcauuguauucuuaaaaagcccuuugaccucauugcccauauugcucagacuaaccuuaccccccuuccugucuccuuuugucuagggaacaaaaagaugauggaaaauacagauucuucccagauuccuauucagagaaauuuagccuuacccuuuguucugcuuucucauuucagauccugucugaggcauacauuuuacagccaagugacccauuaagaucuuuuccuaaacagcuuacucuuuaagaaauuuuggcaauuauaaaaaauaauguuuuaaaaccuuaauguaauuauauugaacuaaaagcuuucauaaccuaaaguacuagcugcuuuaaaacuguauauugcuucgugguucauagagggaagcugaaaucauuaggacccuagcaauauucuuugcuuaguuaaaguagccugugugacauagaaugagaucauuuuagugaagcuuuuguuuuucuuuuuccaaacagauuuaaagacuuguauugcaaguacuacucagacuauugaacagauguacugcgauccucuccuucgucagguagaaugaaaauugaugggaaaguagucaaggcaugugcuaaugguagauacaaaaaucaaauuugauaguuuucuuuuaaacccaaugggaaucccccuaagauaaaagaauaaacuuaagauauaaauugauguuguucuguuucuuuauuuuaggcuaaagaaagcaauauaccuuuuaccaaaaacaggaccuaacacauacuuguuugaauucugccacauggaauuuuuucauauuguagaaagguuugcugucagauacuaauaaaaauuacuuacaaaaugguacuuuaaguagugcagugggaaaaacugaacuagagaacaguuauccuuucuuucccaaaguuccaugauucuucaagaucuuuaauuuaacaacaugcguucaagcuuuauuucuguaauaauaaauuccaaaagagaguuaggacagaaauucuuaacuauccacagaaguguuuguuagaauaaauucugggaauggagggguaaagagccuccaggagugucucugaaccuauucugguuaggggcauggacuuucaguggcuucuguaugaaugacuggaaugggcagaauggcuuggaggaggggagcccuguuucuagaauggcauugaggcacagucccauugcuuaacaggaaugcaccauguaaaacgcaggcuuccccauuuuuucuuuuguguuaauucaaaaaucuucaccaguaauuaaaauaggucaaaguaaguguaaauuuaauuugauucugugacugacuuucaucucuuuuacuaguauuuaguuagcauuuaagcauugcucuauuuucucuauauugaaaauacacaaaugugcuuuucaaauguuguaacaaacaaguaugucauuaaaagggucuucacuccagauagauaaguggucacuuaacucuaagaagcauguggcugaauuaaauauguuaacuuaaauuuuguugccaaauaaaauaggcauggaacaaaauagcugcuaaccuuuguaggucccaaauaugcuaagcauuuucagcaugaguggucaaggugauucuauuuuuagauaaacagaguuuugaauuagaaggaugcauauguuuagguuauguuugguuuuagaucugaggaguuuagaguugaaagagucuucagagaggucauguaguucagcgaucugguuuucaagguuuuggaacugagacauaauugaucaauuccaaggcuguguuuuuguggacuucaucuugaaucaacaagauguuuuaauaugaaccccacauuaaucacaucauaaacaguaauuucuuaauaaccuaaacuuuaucagauuacuuugcuucaccugacuggggaauguacauucugacuuacaggugccuuaucgcuugcaugcaguucuuguucaugaaggacaagcaaaugcuggacacuauugggccuauaucuauaaucaaccccgacagagcuggcucaaguacaaugacaucucuguuacugaaucuuccugggaagaaguugaaagagauuccuauggaggccugagaaauguuagugcuuacugucugauguacauuaaugacaaacuacccuacuucaaugcagguaaaaguaucuuggcagaaucuauagauuggggaaaaucuguacugcucagggagaagaacagucuuguacugcuuuuuaaaaaauuuacaacuuacuauuauauaauaauagauuuaaaaaauauagacaguauaaaaggaaaugaaaaggaaaaacaaguuugcuuuacuacuuucuuccuugaccaugggucccacucccaacaaguacacaauguuagguuucuuauguagucuucaagacacauuguauacauaugcuagauucuauuuaucuguaucuuccccucccccuuuuccccaaguagauuauuuuuccauucaacucugaaccuuuuucauuaaucgaguauuuagcaaucucuauauuuuuaguaaaagaaucuuaacuguuuaacaacuauauaguaauucauuguguggaauauacguauuuuuaaaauuuacucguagauagacuaauucucuaguuguuguuguuuuuagugacaucuuuuuuuuuucuugccccaucuuauggugcugauaguacauauauuuuugcacccuuuggagaauaacuaaauuuuuucuuucuuuuuuuuuugagacauagucuugcuuugucgcccaggcuggagugcaguggcgcaaucucagcucacugcaaccuccgccugccagguugaagugauucuccugccucacucucgcaagcagcuggaauuacaggugcccaccaccaugcccagcugauuuuuguauuuuuaguagaaacgguguuucaccaucuuggccaggguguuuuugaacuccucaccucaggugaucugccugcuucggccucucaaagugcugggauuacaguuguggggcccagaauaacuaaauuuuacagguguauuugccugaauaguuucacaguuguuguaauacuacuacucauacagagagcaauaauaauuaucauuuauauugguacuuuacuucuuaaagcaugcuuucaaacuuuuauuucucuaagaacuuacagcugugaaaaggagggaaagaguuugaaaauguugucaucuucauuuuccagcuggauaacagauuccaaaggguucuaaaguugaguaaucacauagucaauaaauggcagucccaagauucaaauacaauucuccaaauucugugguguuuucaauuuacauuauucucucuuucuuucacauccucuaugagaggucuuaugaugaacauuuuauaaguaagauaguagaaagcuuuugccuguaguauucaaacuuuacuguguggcguaaguaaggaaacaucgccccggcauggugguucacgccuguaaucccagcacuuugggaggccaaggcgggcggaucacuugaggccaggaguugaagaccaaccuggccaacaugguaaaacccugugucuacuaaaaauacauaaauuagcugggcaugguggcacacaccuguaaucccaccuacuugggaggcugaggcaggagaauugcuugaaccugggaggcaaagguugcagugagcugagaucgugccacugcacccagccugggcaacagagugagacuuugucucaaaaaaaacaaacauguaagguguucuguccaggcagcacguuaucuuucugauuugcuagugugguuggggauuagggaauggagagaaugauaaaugaacaguaaguaaucuucacaauuguauauuuaugcugcgaaggaaugaauagcugcuugaauguacuagcuguuguuaauauauaggagccuuguuauugcaugcaugguuuauuuuucuauuauagaaacaaacaaguggaaacugucauuugcuuagugaaaaggcugauuaauggcaaccaguaagugaauguguuaaucugcuauagacuuuuuuuguuuguuuuggucacaggguuagaaaaugaaauuuuauaugucauugauauccuugccauuaaagccagguauuauugaccauuucaccauuguaucaaauugcuuucucauaguacugaauuguaugaaaguuggugguauaaaugucuugaaauucaucucuaaccuuuuugaaauggacauucuuauccgccaaaugcagugguuaaauggauaaaacuguuuaucuugaaauuuuuauuggcucuaaugauuuucugaauuucccugaaaugauugguauauccagugauugacagugaccaguuuccaaaucuuuuuuuuuuuuuuuuuuuuuuugagauggagucucacucugucucccaggcuggagcgcaguggcgcaaccucagcuuacugcaaccuccuccucccagguucaagcgauucucccacuucagccuucuaaguagcugggauuacaggcaugcgccaccacgcuugacuaauuuuuguauuuuuuuuaguagagacaggguuucaccauguuggccaggcuggucuugaacuccuaccucaagugauuggccugccuuggccucccaaagugcugggauuacaggcgugagccacugcacccggcccacuuuccauaucuuuaacucuguguuauucauucacuuagcagauguuuaaugagugccuacuaaaugucaggcacuguuaucaauuguugcccuuacauuguccauacagguugagcaucccacaugugaauauccaaaaucccaaaugcuccaaaauccacaaaacuuuaugagccuuuuucauuacaugaugcuggaagggaaugcucauuggagcauuuugaauuucagauguuggauuuuaggauuugggaugcucaacuauaacuaauugugcagauuuucuaaaauaugaaaaaaauuugaaguccaaaacaguucuagucccaaucauuuuggauaagagauacucagccugcauuucugauggauucuaugugcauguauuuuuaguuaggaguaagauaaagaugaaauacccugcuuucuucuuuucuaaaaaggauguuuucguuccuugugaccuuuuaacucuaucuuugcuuuuccucagaggcagccccaacugaaucagaucaaaugucagaaguggaagcccuaucuguggaacucaagcauuacauucaggaggauaacuggcgguuugagcaggaaguagaggagugggaagaagagcagucuugcaaaaucccucaaauggaguccuccaccaacuccucaucacaggacuacucuacaucacaagguaucugagaaggcauuuaugccagugauccaguaacaucucaugcuguacuccccuagccagcccuauacccuucagcuggcuaggugaugccacagucuucacaguauauuucauauacaguugguaugccagguacaaccugauggaaugaauuguggcauuagaaugugauuucugaugaacagaagcaguaucagaaagacuaacuaccugugaccuucacuguguauauaguuuugcuuauuucccagguuaugggagaaacuaugauaggguuaauagguagacuuuaugaaaaccauucuccaaaggugaucuuccuaaaagaugcuuguuuguagaaaguuuucuuaauggauagaaauaugacaaaguugggagugcauuaaauuuuacagaaucaucuguggguucaaaguuuacagacuuuaucaauagaguucuugcugaaguagccauuucuuauaguuauuaauuucuagggaaaaucugcauaggcuuuuguaaaaagcuguguuaacaggguuguauauuaaacuguauacauucugcuugcuuuuuaucugaguguucuagacuauuuaucauuagaugcuaagaccuuuguucaauucuuuaucagagccuucaguagccucuucucaugggguucgcugcuugucgucugagcaugcugugauuguaaaggagcaaacugcccaggcuauugcaaacacagcccgugccuaugagaagagcgguguagaagcggcacugagugaggugagaaugacugggaagcccaaguucaggagagccgggcuuucagcagcgauggccaguuuucucacauuucuauuauucugugucucugcugccuuuaaccaaccccuauuuauuucuccuguuuuuucuuacucuuucuccccacucugcugccacagcuuaaagaagcugaacccaagaagcccaugccccaggaaacaaaccuugcagagcagucagaacagcccccaaaggcuaaugaugcagagucuacugcccagccuaauucugaggucucugaagucgagauucccagugugggaaggauucugguuagaucugaugcagauggauaugaugaggagguacagagaugagugcaggauauaguuguuuguugucagucuuauauuuccuucucuugugacuauauuaagguaucugccaauagcugauauuuucucguugcaaaaaaugauugucaagaaagccuauuugguuuugaccuuaguuaccauuauuuaaaagauagccauguuucuauuguauagcgcucccagcauauguauaucuacccaggcuuauacuuaauggggccacugcagagucuagauggcucagaaaaguaaaauuaaguucccuuuuugguauuauggacaaaagauugccuucuaauuuaaaauagggaaucuuuuuuuuggauauuaguccauuguuuuaccuccagauauaaauuuuucaguuguccagugagcuaaacaaauguggauugaaguuauuuuuaauuguaaaggaauucuauaggaagaagcuauagaaccccaaguuguuuguugucugucuccucuucaguugcacugcacauaaacaauaaugaauucugucucucucagauuucuguuuuuuuucugugggguauuuaaaaaaaaaaaucauugacaaggcugggcacggagguuuacgccuauaaucccagcccuuugggaggccaaggcggguggaucaccucgggucgggaguucaagaccagccuggccaacauggugaaaccccugucucuacuaaaaauacaaaaauuagcugggcaugguggcauacaccuauaaucccagcuacuugggaggcugaggcaggagaaccgcuugaacccgggaggcggagguugcagugagcugagaucacgccauugcacuccagccugggcgacagagcgagacucugucucccaaaaaaaaaaaaaguccuugaaaaguuuuuacuuuauggagucauauuuguauagucgcuaguuuccagacuauuuuaaauguacuguuuauccuaguaaaacucuaaaguauuuguguguuuaagauauacacccaaaguacagaacuaaauuggaauucugaccuuagacacuuccccucugagaacuauaauuuaacuuaauucuucagcagugccauauugggagauauuuuuaggcauacaucuuucuuuauccuacugaauuagaacauagagcguaggaauagcuugucuugggcaggguguugacauuauauagaaggacagaggcagugggugcacauaggaaugggugugugaaacucagcuugcaauacaugcuggccaaagagcacacugcucugcugcccuuuagcacucuguucagccugcuuucauacagucuucugcugaaccuuucuucucuccuuucucucuguguuuugugcccccuugugguaggugaugcugagcccugccaugcaaggggucauccuggccauagcuaaagcccgucagaccuuugaccgagaugggucugaagcagggcugauuaagguaucucuguuuuuaaaauucuaauucuuacaauauaggcaucauaauauuggggaaauaauucuauaagaagggaaaaaaugggguuaaggcugggugugguggugugugcauguagucccagcuacucaggaagcugaaguagaggcucacuugagcucaggaguuggaggcugaaauguacugugauugcaccacugcacuccagccugggcaacauaaugagaucccaucucuuuaaaaauaaaaaggacugggcacaguggcucacaccuguaauuuagcacuuugggaggcccaggagggaggcuugcuugaagccaggaguucaaaaccagccgggucaacauagugagacccccaucucuacuaaggaauuuuuuuuuuuuuuaauuagcugggcaugguagcacauaccuguagucccagcuaauuuggaggcugaggcaggaggaucacuugagcccagguguucaagguugcagugaaccaugauugugccacugcauuccagucugggugacagagugagacccugucuccaaaaaauaaaaaaaaagucuucugugaagugaaauaugagacuuccuuuccuguccaacugaugaacaagcuguucacuucucuucucuugacccuaacccagccuuggcuagcaguaacauucucugugacaccuagccuagagggcuuuucauuguuguuguuaggaguugucuguuaguaacacugaguuagauugugccuuuguaauuuugaggccauaacaaaguaggcuguguuuuuaaaaauacuugaguaaaauugcauuuguauagauucuuuaaguuuaagucauugacacacaaggaucugccuuuuauaacaauuaaaacuaaauauuuguuuuucugagaacuuuaugagaaaacugaauuucuuaagaguacaguaggcugggcgcaguggcucaugccuguaaucccagcacuuugggaggccaaaguggguggauugcuugagcucaggaguuugagaccagccugggcaacauggcgaaacccaaucucuaucaaaaauacaaaaauuaacugggcauggugguauaugccuguagucccagcuacuugggaggcugaggugggaggaucaccugagcccaggaguucagggcugcagugagcugugaucaugucacugaacuccagccugggugacaaagugauacucugucucaaaaaaaaaaaaaaguacaguauguuuuuggugccagaaugcuaaaagaguuucaucccuuaugaaaugcaagaaacuuaaaaauuccauaguuguuuuuguaauucgauaugaauuuuuuagaagucuuuuuagagucaagagacugccuagcuccuaggcaucaauuucugugugcagaagcccacagcacacuauuuucuaaccauugauucugcccuuaauaggcauuccaugaagaauacuccaggcucuaucagcuugccaaagagacccccaccucucacagugauccucgacuucagcauguccuugucuacuuuuuccaaaaugaagcacccaaaaggguaguagaacgaacccuucuggaacaguuugcagauaaaaaucuuagcuaugaugaaaggugagaagagaauauucaggugaaucccuuggucuggguugggcuagauggacuccucuguuggggaaguuuugcccugugccuuuucauugcuuucugaacuuugucccacacagaucaaucagcauuaugaagguggcucaagcgaaacugaaggaaauugguccagaugacaugaauauggaagaguacaagguaaaguguuuucuuuaagucuauagagcaaaaacauuaauuccugagguaaaugguaccugaggcaaaauaaacaauuuugugcuauuacaaacugacuuguucuuccacuuuccccucaaaauccugguaaagaauggauaaaugauauuuucuugcccucagaauagcaggucucuuuauuuucauucuucauuuagagugagucaacauuucacuucccuuaaauaccuauuuuagccuuguccuaggcaguaaaauucuugaaaucaugcuuuugguuuguuuuaaaugauaaaguuuuaaaaauacgcauuaaaauacauagcuacacauguuuucaauugcaucccauguaaaacaauguuauguaccacccaagguguauucaccacacuuacugaacuugaacuugcucuguaugacuagaaauguccguguccuuccauauuuucaauaucuggaugguuuuaccaguccuaaagaggucauucacuuaagcuagagcugaauaucuuuuacauagcuguuagaaauuaggauaaaauccgaagcucguaggaaauaaguacuucuguuacucaagugaaaggaacagaacauugaaaauuaaggucagugguagacuuuuauuuuaaauguugaguagguuuuuaucugaaagcuuuuguuuguuauuuuuguggcuagccagaugugcucaguaaauauuuguaaugaauuuaaaacuuagaugggaaggacacuaacaaucuauuaugaucaugauuauuaauaaucgucauucuuuuucagaaguggcaugaagauuauaguuuguuccgaaaagugucuguguaucuccuaacaggccuagaacucuaucaaaaaggaaaguauguuggccuuuuauuuuaccaagauuauuagucaggaugcuguucucuguagaugccuaccugggaauacuaagagucacagccaugcauaaccucccuugucacauacacuagugugccucuucucuugcagugcuuugguuuugcucuaaacaucacacaugguuuuucauccuucaaaugauuagauguauuagcugcgagauaauauugugccaggcugucuuugugaucaaugaagaugaacucagaaaaugaauuuuugaguugacauagacccuagugagcauuucuuguuuuagagaugggaaaaccugaggccuagggaaguuucauauuugcuuuggauggcuaggccaauuuguagaagagaugagacuggcuacggucuuugguccuucacuuuuucagaauugcagccaaguagguucuugaaauggggaaaagugaggucuaagcccuagauuuuaguaaaagagcacucagcuguuguuuaucucccauuuuucuaagguaccaagaggcacuuuccuaccugguauaugccuaccagagcaaugcugcccugcugaugaaggggccccgccggggggucaaagaauccgugauugcuuuauaccgaagaaaaugccuucugguuuguacuguuuguaaagccuuaagguuuuuuuguuguuuaccucugcuccuugaagccaggaaaauauauggcuuucaaaacagacuaucuccaacagguuguagauuuccccccaaaauucucaugaacaguuuuacauuggaacagguuuuuuuucaguuacuuuuagugaaugucauucuucuucaaugauaacugauagaaguuaagaugagaaucagucaucccucugugugcccuucauguaugccugcauuauagauuuuaucacauugcuuuccuacuagguuguaaauuccuugagcucagauccuuuucucacucagccauuuccucugugccugucauguaggaaccauguaauaaauguguguggaaggaaugcagcauuuuuuccauguucacauuuaagcugguagacuuaaaguuuuagugacuucugacacuccauuuuuuuaaaauaaagguaggaacuguaagaauugguccugcuguucugauaacaucauugucacauacuagugaagacuaacucucuccuggccugauuugcacuguauaacuacauggaaaggcagaccuacauccccuugccuccccagggguuuaugugauguguguccuuuggagaacuguaaagggguggccugccuucagagugugggcuuguguguguuuucaccaauacccagcaaauuugcccuucacagaagucaggccaauauuucuaccacugccuuuaccuuguucauaccgaaugggugagauuaagucaugacauauacucaauagcuuuauuuucugauuuauacuuugacaucuguauuaguuauagguguggcagggccacuuugaagcugaaaagggaucuuguugguuugauggaucugaauuuuauuagagccauguuuuuauauuuuaaaucaccaaauagauugacauuuugaauauccuacucagcuucugaaguaaugcaauuauagggauuuagacucuuuccauuauugagucccaaccccuagugugcaucagaaucauauagggagcuuucagacagucgugaagcucaggccucucccuagcaauuaaaccagaaucccugggaagggcccugggcaucagugugucuucugcaggugauucugaugcucagaggagauagacaaccagugaacaggucuuugguugaaacagguguuaagcaugaccuugacuuacaaguuuaggccaaugggucauaaacuuuacagcauuagaaucacuuugggagcuuucauaaaaucccagugucccggucaucuaaacacuaauuaaaucagcuuaucagaagugggaaccaggcaucaguaguuuuuaaagaucccuaaguacauccaaugugcaguaaaguuugggaaccacuuguuuagacuguuauuaaagagauauuuaucuuuuucagacucuuccccaccuaauucuaccuuuuaucuguaggagcugaaugccaaagcagcuucucuuuuugaaacaaaugaugaucacuccguaacugagggcauuaaugugaugaaugaacugaucauccccugcauucaccuuaucauuaauaaugacauuuccaaggaugaucuggaugccauugaggucaugagaaaccauuggugcucuuaccuugggcaagauauugcagguauaugcucuugguaauaauauucugagguuuugagaauuguagaaauuucaguguucucacuugauagcacugguugccaaaccuuuuuaaggaauuggaaccuucuagcauauaaguaaauuaaaaauggaucugcucuauugaaacaagaggagggagccugggccucugccccucuuaaccucccuuuagcuuccccaugacugccaaaucaccuccaugggcaaccaacaagccugguuugaaaaaagucacugcucuccaggaaugucagacuuccauuacucucucaugugccaaaagaugaacucuuuuauaguuuaaaaaucaaaaucugacugggugcaguggcucacaccuguaaucccagcacuuucagaggccgaggugggcagaucaccugaggccaggaguucaagaccaagucuggccaacaaggcgaaaccccaucucuacuaaaaauacaaaaauuagcuagguguggucaugggcgccuguaaucccagcuacucgggaggcugaggcaggagaaucacuugaaccugggcagcggaguuugcaaugagccgagauagcaccagugcaauccagccugggccacggaaugagacuccauauccaaaaaaaaaaaaaaaaaaucaugcagaguaugguuaugggaggggugccuugaugaauuuuuucuguggcuugaaguuauauagcauauuaacuaugaugacuucaagauuaauuaguggacuguccuugcuuguuuaaagcaucuuaaggagggaauguaaagcugguuguuuuuaggugaguucaguagacuuggaaaauuguuauauauucugauaugaauccucuuuguuagguucucacugacauagagauacucuauugauggggcuaggcacaguggcugacacuuguagucccagcacuuugggaggccaagguggguggcucacuugagcccaggaguuugagaccagccugggcaacauagugagacccugccucuacaaaaaaugaaaacuuagcuggguauaguguaguucuagcuacucaggagccugaggugagaggauugcuugagucugggaggccgaggcuacagugacccaagaucauaccacugcacuccagcuuggagugagacccuaucuuuaaaaaacaaacaaaacaaaaaaggccgggcgcaguggcucacgccuguagucccagcgcuuugggaggcugaggugggcggaucacgaggucaggagauggagaccauccuggcucacauggugaaaccccgucucuacuaaaaauacaaaaaauuagccgggugugguggcgggcaccuguagucccagcuacuugggaggcugaggcaggagaauggcgugaacccgggaggcggagcuugcagugagcaaagauggcgccacugcacuccagccugggcgacagagugagacuccgucucaaaaaaaaaaaaagauauuccauugacuuguucaaguguuuaaguugauaguauuuauuuaaaaauccuguaauagcuaguugccauguguuucccuuuacugucuucaguuuuuauuuagaccaagcuuguccaaccugaagcccaacacaaauuucuaaacuuucuuaaaacauuaugaauuuuuuuuuaaccucaucagcuauuguuagugagguucauguguggcccagggaagccaaaagacuguacaccccugauuuaaaaccauguguauacacugauauauuguaaacauuugaaagaaaauaauuaccaucauaucuaugcuagaguaucauaucuacuuccuuguauuuuaagaagacaauugguuagaagacccuuucguaauaaaguaauuauauaguuguuauauagcagugagcuaaaguuugguuuauuugccuuugcuccugguuuggccugaaggaauaaucauuuauuaguaacuggccagcauaaugcuuugaccuuugagguuagguaaggggcuaauagaaggcuuguucacuuuuacucagaaaucuguuuagcuguauauguaaccaucuguuuucccuccacagaaaaucugcagcugugccuaggggaguuucuacccagacuucuagauccuucugcagaaaucaucgucuugaaagagccuccaacaauucgacccaauucucccuaugaccuauguagccgauuugcagcugucauggagucaauucagggaguuucaacugugacagugaaauaagcucccacauguucaaggcccauucugguuccuggcugccugccucuugcacagaaguucguugucauagugcucaccuugggaaaaggauuaggugggcacauaagauuccgaucagaccccaaccaugcugcauguguaaagaaggauugaaaauaaaauugcacuuuuuagguacaaaaucauaaaagcuguuucacuagaaaaggcagaaagcaguguauuaagguguugaauuacgccagaagaccugaaaugccuuguaccuacaacaaugcuuaggcuuuucuaagccucuugccacuuuuaaaauuauccuucaggcauaaauauuuuugacagcagaauagaagaaugauucaugagaaccugaaccagaugaacagcuacuaguuauuuuaucaaauacagaugacauuuaaaaauucuuaacuacaagagauuagaaauauaaaccuugccuggcucuugccaggagauaacaaaauggguugcugaugaacugcacccuuuuacauguggguagaauauaagcucacauggcagugagauguugaaaagucaaaagagaccugucucucuccuuucuuuucuaucuuuaaaccagaaaaccucauacucaguccucagugaaagaaaguaaaguauuaaggacuuuagacagaagagcauuguguaacuugacugaagaucauccauuaauaguuauuaggcauuuagguaaaauuuucuaauaccuaaaaauugucaaaaacagucaauagggcuacugcuggcccaaagaccauuuagguccaccuccucuuuuuugcucuuuuuuuuuuucugugacaguuucacugugucgcccaggcuggcguucaguggugcaaucucagcucacugcaaacucugucuccugggcucaagugauucucgugccucagccucccgaauagcuggaauuacgggcaugcaccaccacaccuggcuaauuuuuguauuuuuaauagagaugggguuucaccauauuggccaggcugaucucuaacuccuggccucaagugaucuaucugccucccucagccucccaaagucugggauugcagacaagucaucguacccggccuucuuuuuugcccuuaaaaguaagggauguggguuuguacaaaaaaaaaaaaaaaaaaaaaaaaaccagcauacauaugcaaaacuauauauauauguauauguagagaaaaauacuucccauugaucauuuuuaaaaggcuucugauuggauauuguguuuuaaccaaauuuuaaagauuaauggaaucaugaaagggaaaaaaauugauacaacuaugcagauuuuauaaaugugcaauaaaaguauuuguuuua

SEQ ID NO: 192050 - RNA, 77660 nt, Homo sapiens
uaaaacaaauacuuuuauugcacauuuauaaaaucugcauaguuguaucaauuuuuuucccuuucaugauuccauuaaucuuuaaaauuugguuaaaacacaauauccaaucagaagccuuuuaaaaaugaucaaugggaaguauuuuucucuacauauacauauauauauaguuuugcauauguaugcugguuuuuuuuuuuuuuuuuuuuuuuuuguacaaacccacaucccuuacuuuuaagggcaaaaaagaaggccggguacgaugacuugucugcaaucccagacuuugggaggcugagggaggcagauagaucacuugaggccaggaguuagagaucagccuggccaauauggugaaaccccaucucuauuaaaaauacaaaaauuagccaggugugguggugcaugcccguaauuccagcuauucgggaggcugaggcacgagaaucacuugagcccaggagacagaguuugcagugagcugagauugcaccacugaacgccagccugggcgacacagugaaacugucacagaaaaaaaaaaagagcaaaaaagaggagguggaccuaaauggucuuugggccagcaguagcccuauugacuguuuuugacaauuuuuagguauuagaaaauuuuaccuaaaugccuaauaacuauuaauggaugaucuucagucaaguuacacaaugcucuucugucuaaaguccuuaauacuuuacuuucuuucacugaggacugaguaugagguuuucugguuuaaagauagaaaagaaaggagagagacaggucucuuuugacuuuucaacaucucacugccaugugagcuuauauucuacccacauguaaaagggugcaguucaucagcaacccauuuuguuaucuccuggcaagagccaggcaagguuuauauuucuaaucucuuguaguuaagaauuuuuaaaugucaucuguauuugauaaaauaacuaguagcuguucaucugguucagguucucaugaaucauucuucuauucugcugucaaaaauauuuaugccugaaggauaauuuuaaaaguggcaagaggcuuagaaaagccuaagcauuguuguagguacaaggcauuucaggucuucuggcguaauucaacaccuuaauacacugcuuucugccuuuucuagugaaacagcuuuuaugauuuuguaccuaaaaagugcaauuuuauuuucaauccuucuuuacacaugcagcaugguuggggucugaucggaaucuuaugugcccaccuaauccuuuucccaaggugagcacuaugacaacgaacuucugugcaagaggcaggcagccaggaaccagaaugggccuugaacaugugggagcuuauuucacugucacaguugaaacucccugaauugacuccaugacagcugcaaaucggcuacauaggucauagggagaauugggucgaauuguuggaggcucuuucaagacgaugauuucugcagaaggaucuagaagucuggguagaaacuccccuaggcacagcugcagauuuucuguggagggaaaacagaugguuacauauacagcuaaacagauuucugaguaaaagugaacaagccuucuauuagccccuuaccuaaccucaaaggucaaagcauuaugcuggccaguuacuaauaaaugauuauuccuucaggccaaaccaggagcaaaggcaaauaaaccaaacuuuagcucacugcuauauaacaacuauauaauuacuuuauuacgaaagggucuucuaaccaauugucuucuuaaaauacaaggaaguagauaugauacucuagcauagauaugaugguaauuauuuucuuucaaauguuuacaauauaucaguguauacacaugguuuuaaaucagggguguacagucuuuuggcuucccugggccacacaugaaccucacuaacaauagcugaugagguuaaaaaaaaauucauaauguuuuaagaaaguuuagaaauuuguguugggcuucagguuggacaagcuuggucuaaauaaaaacugaagacaguaaagggaaacacauggcaacuagcuauuacaggauuuuuaaauaaauacuaucaacuuaaacacuugaacaagucaauggaauaucuuuuuuuuuuuuugagacggagucucacucugucgcccaggcuggagugcaguggcgccaucuuugcucacugcaagcuccgccucccggguucacgccauucuccugccucagccucccaaguagcugggacuacaggugcccgccaccacacccggcuaauuuuuuguauuuuuaguagagacgggguuucaccaugugagccaggauggucuccaucuccugaccucgugauccgcccaccucagccucccaaagcgcugggacuacaggcgugagccacugcgcccggccuuuuuuguuuuguuuguuuuuuaaagauagggucucacuccaagcuggagugcagugguaugaucuugggucacuguagccucggccucccagacucaagcaauccucucaccucaggcuccugaguagcuagaacuacacuauacccagcuaaguuuucauuuuuuguagaggcagggucucacuauguugcccaggcuggucucaaacuccugggcucaagugagccacccaccuuggccucccaaagugcugggacuacaagugucagccacugugccuagccccaucaauagaguaucucuaugucagugagaaccuaacaaagaggauucauaucagaauauauaacaauuuuccaagucuacugaacucaccuaaaaacaaccagcuuuacauucccuccuuaagaugcuuuaaacaagcaaggacaguccacuaauuaaucuugaagucaucauaguuaauaugcuauauaacuucaagccacagaaaaaauucaucaaggcaccccucccauaaccauacucugcaugauuuuuuuuuuuuuuuuuuggauauggagucucauuccguggcccaggcuggauugcacuggugcuaucucggcucauugcaaacuccgcugcccagguucaagugauucuccugccucagccucccgaguagcugggauuacaggcgcccaugaccacaccuagcuaauuuuuguauuuuuaguagagaugggguuucgccuuguuggccagacuuggucuugaacuccuggccucaggugaucugcccaccucggccucugaaagugcugggauuacaggugugagccacugcacccagucagauuuugauuuuuaaacuauaaaagaguucaucuuuuggcacaugagagaguaauggaagucugacauuccuggagagcagugacuuuuuucaaaccaggcuuguugguugcccauggaggugauuuggcagucauggggaagcuaaagggagguuaagaggggcagaggcccaggcucccuccucuuguuucaauagagcagauccauuuuuaauuuacuuauaugcuagaagguuccaauuccuuaaaaagguuuggcaaccagugcuaucaagugagaacacugaaauuucuacaauucucaaaaccucagaauauuauuaccaagagcauauaccugcaauaucuugcccaagguaagagcaccaaugguuucucaugaccucaauggcauccagaucauccuuggaaaugucauuauuaaugauaaggugaaugcaggggaugaucaguucauucaucacauuaaugcccucaguuacggagugaucaucauuuguuucaaaaagagaagcugcuuuggcauucagcuccuacagauaaaagguagaauuagguggggaagagucugaaaaagauaaauaucucuuuaauaacagucuaaacaagugguucccaaacuuuacugcacauuggauguacuuagggaucuuuaaaaacuacugaugccugguucccacuucugauaagcugauuuaauuaguguuuagaugaccgggacacugggauuuuaugaaagcucccaaagugauucuaaugcuguaaaguuuaugacccauuggccuaaacuuguaagucaaggucaugcuuaacaccuguuucaaccaaagaccuguucacugguugucuaucuccucugagcaucagaaucaccugcagaagacacacugaugcccagggcccuucccagggauucugguuuaauugcuagggagaggccugagcuucacgacugucugaaagcucccuauaugauucugaugcacacuagggguugggacucaauaauggaaagagucuaaaucccuauaauugcauuacuucagaagcugaguaggauauucaaaaugucaaucuauuuggugauuuaaaauauaaaaacauggcucuaauaaaauucagauccaucaaaccaacaagaucccuuuucagcuucaaaguggcccugccacaccuauaacuaauacagaugucaaaguauaaaucagaaaauaaagcuauugaguauaugucaugacuuaaucucacccauucgguaugaacaagguaaaggcagugguagaaauauuggccugacuucugugaagggcaaauuugcuggguauuggugaaaacacacacaagcccacacucugaaggcaggccaccccuuuacaguucuccaaaggacacacaucacauaaaccccuggggaggcaaggggauguaggucugccuuuccauguaguuauacagugcaaaucaggccaggagagaguuagucuucacuaguaugugacaaugauguuaucagaacagcaggaccaauucuuacaguuccuaccuuuauuuuaaaaaaauggagugucagaagucacuaaaacuuuaagucuaccagcuuaaaugugaacauggaaaaaaugcugcauuccuuccacacacauuuauuacaugguuccuacaugacaggcacagaggaaauggcugagugagaaaaggaucugagcucaaggaauuuacaaccuaguaggaaagcaaugugauaaaaucuauaaugcaggcauacaugaagggcacacagagggaugacugauucucaucuuaacuucuaucaguuaucauugaagaagaaugacauucacuaaaaguaacugaaaaaaaaccuguuccaauguaaaacuguucaugagaauuuuggggggaaaucuacaaccuguuggagauagucuguuuugaaagccauauauuuuccuggcuucaaggagcagagguaaacaacaaaaaaaccuuaaggcuuuacaaacaguacaaaccagaaggcauuuucuucgguauaaagcaaucacggauucuuugaccccccggcggggccccuucaucagcagggcagcauugcucugguaggcauauaccagguaggaaagugccucuugguaccuuagaaaaaugggagauaaacaacagcugagugcucuuuuacuaaaaucuagggcuuagaccucacuuuuccccauuucaagaaccuacuuggcugcaauucugaaaaagugaaggaccaaagaccguagccagucucaucucuucuacaaauuggccuagccauccaaagcaaauaugaaacuucccuaggccucagguuuucccaucucuaaaacaagaaaugcucacuagggucuaugucaacucaaaaauucauuuucugaguucaucuucauugaucacaaagacagccuggcacaauauuaucucgcagcuaauacaucuaaucauuugaaggaugaaaaaccaugugugauguuuagagcaaaaccaaagcacugcaagagaagaggcacacuaguguaugugacaagggagguuaugcauggcugugacucuuaguauucccagguaggcaucuacagagaacagcauccugacuaauaaucuugguaaaauaaaaggccaacauacuuuccuuuuugauagaguucuaggccuguuaggagauacacagacacuuuucggaacaaacuauaaucuucaugccacuucugaaaaagaaugacgauuauuaauaaucaugaucauaauagauuguuaguguccuucccaucuaaguuuuaaauucauuacaaauauuuacugagcacaucuggcuagccacaaaaauaacaaacaaaagcuuucagauaaaaaccuacucaacauuuaaaauaaaagucuaccacugaccuuaauuuucaauguucuguuccuuucacuugaguaacagaaguacuuauuuccuacgagcuucggauuuuauccuaauuucuaacagcuauguaaaagauauucagcucuagcuuaagugaaugaccucuuuaggacugguaaaaccauccagauauugaaaauauggaaggacacggacauuucuagucauacagagcaaguucaaguucaguaaguguggugaauacaccuugggugguacauaacauuguuuuacaugggaugcaauugaaaacauguguagcuauguauuuuaaugcguauuuuuaaaacuuuaucauuuaaaacaaaccaaaagcaugauuucaagaauuuuacugccuaggacaaggcuaaaauagguauuuaagggaagugaaauguugacucacucuaaaugaagaaugaaaauaaagagaccugcuauucugagggcaagaaaauaucauuuauccauucuuuaccaggauuuugaggggaaaguggaagaacaagucaguuuguaauagcacaaaauuguuuauuuugccucagguaccauuuaccucaggaauuaauguuuuugcucuauagacuuaaagaaaacacuuuaccuuguacucuuccauauucaugucaucuggaccaauuuccuucaguuucgcuugagccaccuucauaaugcugauugaucugugugggacaaaguucagaaagcaaugaaaaggcacagggcaaaacuuccccaacagaggaguccaucuagcccaacccagaccaagggauucaccugaauauucucuucucaccuuucaucauagcuaagauuuuuaucugcaaacuguuccagaaggguucguucuacuacccuuuugggugcuucauuuuggaaaaaguagacaaggacaugcugaagucgaggaucacugugagaggugggggucucuuuggcaagcugauagagccuggaguauucuucauggaaugccuauuaagggcagaaucaaugguuagaaaauagugugcugugggcuucugcacacagaaauugaugccuaggagcuaggcagucucuugacucuaaaaagacuucuaaaaaauucauaucgaauuacaaaaacaacuauggaauuuuuaaguuucuugcauuucauaagggaugaaacucuuuuagcauucuggcaccaaaaacauacuguacuuuuuuuuuuuuuugagacagaguaucacuuugucacccaggcuggaguucagugacaugaucacagcucacugcagcccugaacuccugggcucaggugauccucccaccucagccucccaaguagcugggacuacaggcauauaccaccaugcccaguuaauuuuuguauuuuugauagagauuggguuucgccauguugcccaggcuggucucaaacuccugagcucaagcaauccacccacuuuggccucccaaagugcugggauuacaggcaugagccacugcgcccagccuacuguacucuuaagaaauucaguuuucucauaaaguucucagaaaaacaaauauuuaguuuuaauuguuauaaaaggcagauccuugugugucaaugacuuaaacuuaaagaaucuauacaaaugcaauuuuacucaaguauuuuuaaaaacacagccuacuuuguuauggccucaaaauuacaaaggcacaaucuaacucaguguuacuaacagacaacuccuaacaacaacaaugaaaagcccucuaggcuaggugucacagagaauguuacugcuagccaaggcuggguuagggucaagagaagagaagugaacagcuuguucaucaguuggacaggaaaggaagucucauauuucacuucacagaagacuuuuuuuuuauuuuuuggagacagggucucacucugucacccagacuggaaugcaguggcacaaucaugguucacugcaaccuugaacaccugggcucaagugauccuccugccucagccuccaaauuagcugggacuacagguaugugcuaccaugcccagcuaauuaaaaaaaaaaaaaauuccuuaguagagaugggggucucacuauguugacccggcugguuuugaacuccuggcuucaagcaagccucccuccugggccucccaaagugcuaaauuacaggugugagccacugugcccaguccuuuuuauuuuuaaagagaugggaucucauuauguugcccaggcuggagugcaguggugcaaucacaguacauuucagccuccaacuccugagcucaagugagccucuacuucagcuuccugaguagcugggacuacaugcacacaccaccacacccagccuuaaccccauuuuuucccuucuuauagaauuauuuccccaauauuaugaugccuauauuguaagaauuagaauuuuaaaaacagagauaccuuaaucagcccugcuucagacccaucucggucaaaggucugacgggcuuuagcuauggccaggaugaccccuugcauggcagggcucagcaucaccuaccacaagggggcacaaaacacagagagaaaggagagaagaaagguucagcagaagacuguaugaaagcaggcugaacagagugcuaaagggcagcagagcagugugcucuuuggccagcauguauugcaagcugaguuucacacacccauuccuaugugcacccacugccucuguccuucuauauaaugucaacacccugcccaagacaagcuauuccuacgcucuauguucuaauucaguaggauaaagaaagauguaugccuaaaaauaucucccaauauggcacugcugaagaauuaaguuaaauuauaguucucagaggggaagugucuaaggucagaauuccaauuuaguucuguacuuuggguguauaucuuaaacacacaaauacuuuagaguuuuacuaggauaaacaguacauuuaaaauagucuggaaacuagcgacuauacaaauaugacuccauaaaguaaaaacuuuucaaggacuuuuuuuuuuuuugggagacagagucucgcucugucgcccaggcuggagugcaauggcgugaucucagcucacugcaaccuccgccucccggguucaagcgguucuccugccucagccucccaaguagcugggauuauagguguaugccaccaugcccagcuaauuuuuguauuuuuaguagagacagggguuucaccauguuggccaggcuggucuugaacucccgacccgaggugauccacccgccuuggccucccaaagggcugggauuauaggcguaaaccuccgugcccagccuugucaaugauuuuuuuuuuuaaauaccccacagaaaaaaaacagaaaucugagagagacagaauucauuauuguuuaugugcagugcaacugaagaggagacagacaacaaacaacuugggguucuauagcuucuuccuauagaauuccuuuacaauuaaaaauaacuucaauccacauuuguuuagcucacuggacaacugaaaaauuuauaucuggagguaaaacaauggacuaauauccaaaaaaaagauucccuauuuuaaauuagaaggcaaucuuuuguccauaauaccaaaaagggaacuuaauuuuacuuuucugagccaucuagacucugcaguggccccauuaaguauaagccuggguagauauacauaugcugggagcgcuauacaauagaaacauggcuaucuuuuaaauaaugguaacuaaggucaaaaccaaauaggcuuucuugacaaucauuuuuugcaacgagaaaauaucagcuauuggcagauaccuuaauauagucacaagagaaggaaauauaagacugacaacaaacaacuauauccugcacucaucucuguaccuccucaucauauccaucugcaucagaucuaaccagaauccuucccacacugggaaucucgacuucagagaccucagaauuaggcugggcaguagacucugcaucauuagccuuugggggcuguucugacugcucugcaagguuuguuuccuggggcaugggcuucuuggguucagcuucuuuaagcuguggcagcagaguggggagaaagaguaagaaaaaacaggagaaauaaauagggguugguuaaaggcagcagagacacagaauaauagaaaugugagaaaacuggccaucgcugcugaaagcccggcucuccugaacuugggcuucccagucauucucaccucacucagugccgcuucuacaccgcucuucucauaggcacgggcuguguuugcaauagccugggcaguuugcuccuuuacaaucacagcaugcucagacgacaagcagcgaaccccaugagaagaggcuacugaaggcucugauaaagaauugaacaaaggucuuagcaucuaaugauaaauagucuagaacacucagauaaaaagcaagcagaauguauacaguuuaauauacaacccuguuaacacagcuuuuuacaaaagccuaugcagauuuucccuagaaauuaauaacuauaagaaauggcuacuucagcaagaacucuauugauaaagucuguaaacuuugaacccacagaugauucuguaaaauuuaaugcacucccaacuuugucauauuucuauccauuaagaaaacuuucuacaaacaagcaucuuuuaggaagaucaccuuuggagaaugguuuucauaaagucuaccuauuaacccuaucauaguuucucccauaaccugggaaauaagcaaaacuauauacacagugaaggucacagguaguuagucuuucugauacugcuucuguucaucagaaaucacauucuaaugccacaauucauuccaucagguuguaccuggcauaccaacuguauaugaaauauacugugaagacuguggcaucaccuagccagcugaaggguauagggcuggcuaggggaguacagcaugagauguuacuggaucacuggcauaaaugccuucucagauaccuugugauguagaguaguccugugaugaggaguugguggaggacuccauuugagggauuuugcaagacugcucuucuucccacuccucuacuuccugcucaaaccgccaguuauccuccugaauguaaugcuugaguuccacagauagggcuuccacuucugacauuugaucugauucaguuggggcugccucugaggaaaagcaaagauagaguuaaaaggucacaaggaacgaaaacauccuuuuuagaaaagaagaaagcaggguauuucaucuuuaucuuacuccuaacuaaaaauacaugcacauagaauccaucagaaaugcaggcugaguaucucuuauccaaaaugauugggacuagaacuguuuuggacuucaaauuuuuuucauauuuuagaaaaucugcacaauuaguuauaguugagcaucccaaauccuaaaauccaacaucugaaauucaaaaugcuccaaugagcauucccuuccagcaucauguaaugaaaaaggcucauaaaguuuuguggauuuuggagcauuugggauuuuggauauucacaugugggaugcucaaccuguauggacaauguaagggcaacaauugauaacagugccugacauuuaguaggcacucauuaaacaucugcuaagugaaugaauaacacagaguuaaagauauggaaagugggccgggugcaguggcucacgccuguaaucccagcacuuugggaggccaaggcaggccaaucacuugagguaggaguucaagaccagccuggccaacauggugaaacccugucucuacuaaaaaaaauacaaaaauuagucaagcgugguggcgcaugccuguaaucccagcuacuuagaaggcugaagugggagaaucgcuugaaccugggaggaggagguugcaguaagcugagguugcgccacugcgcuccagccugggagacagagugagacuccaucucaaaaaaaaaaaaaaaaaaaaaaagauuuggaaacuggucacugucaaucacuggauauaccaaucauuucagggaaauucagaaaaucauuagagccaauaaaaauuucaagauaaacaguuuuauccauuuaaccacugcauuuggcggauaagaauguccauuucaaaaagguuagagaugaauuucaagacauuuauaccaccaacuuucauacaauucaguacuaugagaaagcaauuugauacaauggugaaauggucaauaauaccuggcuuuaauggcaaggauaucaaugacauauaaaauuucauuuucuaacccugugaccaaaacaaacaaaaaaagucuauagcagauuaacacauucacuuacugguugccauuaaucagccuuuucacuaagcaaaugacaguuuccacuuguuuguuucuauaauagaaaaauaaaccaugcaugcaauaacaaggcuccuauauauuaacaacagcuaguacauucaagcagcuauucauuccuucgcagcauaaauauacaauugugaagauuacuuacuguucauuuaucauucucuccauucccuaauccccaaccacacuagcaaaucagaaagauaacgugcugccuggacagaacaccuuacauguuuguuuuuuuugagacaaagucucacucuguugcccaggcugggugcaguggcacgaucucagcucacugcaaccuuugccucccagguucaagcaauucuccugccucagccucccaaguaggugggauuacaggugugugccaccaugcccagcuaauuuauguauuuuuaguagacacaggguuuuaccauguuggccagguuggucuucaacuccuggccucaagugauccgcccgccuuggccucccaaagugcugggauuacaggcgugaaccaccaugccggggcgauguuuccuuacuuacgccacacaguaaaguuugaauacuacaggcaaaagcuuucuacuaucuuacuuauaaaauguucaucauaagaccucucauagaggaugugaaagaaagagagaauaauguaaauugaaaacaccacagaauuuggagaauuguauuugaaucuugggacugccauuuauugacuaugugauuacucaacuuuagaacccuuuggaaucuguuauccagcuggaaaaugaagaugacaacauuuucaaacucuuucccuccuuuucacagcuguaaguucuuagagaaauaaaaguuugaaagcaugcuuuaagaaguaaaguaccaauauaaaugauaauuauuauugcucucuguaugaguaguaguauuacaacaacugugaaacuauucaggcaaauacaccuguaaaauuuaguuauucugggccccacaacuguaaucccagcacuuugagaggccgaagcaggcagaucaccugaggugaggaguucaaaaacacccuggccaagauggugaaacaccguuucuacuaaaaauacaaaaaucagcugggcaugguggugggcaccuguaauuccagcugcuugcgagagugaggcaggagaaucacuucaaccuggcaggcggagguugcagugagcugagauugcgccacugcacuccagccugggcgacaaagcaagacuaugucucaaaaaaaaaagaaagaaaaaauuuaguuauucuccaaagggugcaaaaauauauguacuaucagcaccauaagauggggcaagaaaaaaaaaagaugucacuaaaaacaacaacaacuagagaauuagucuaucuacgaguaaauuuuaaaaauacguauauuccacacaaugaauuacuauauaguuguuaaacaguuaagauucuuuuacuaaaaauauagagauugcuaaauacucgauuaaugaaaaagguucagaguugaauggaaaaauaaucuacuuggggaaaagggggaggggaagauacagauaaauagaaucuagcauauguauacaaugugucuugaagacuacauaagaaaccuaacauuguguacuuguugggagugggacccauggucaaggaagaaaguaguaaagcaaacuuguuuuuccuuuucauuuccuuuuauacugucuauauuuuuuaaaucuauuauuauauaauaguaaguuguaaauuuuuuaaaaagcaguacaagacuguucuucucccugagcaguacagauuuuccccaaucuauagauucugccaagauacuuuuaccugcauugaaguaggguaguuugucauuaauguacaucagacaguaagcacuaacauuucucaggccuccauaggaaucucuuucaacuucuucccaggaagauucaguaacagagaugucauuguacuugagccagcucugucgggguugauuauagauauaggcccaauaguguccagcauuugcuuguccuucaugaacaagaacugcaugcaagcgauaaggcaccuguaagucagaauguacauuccccagucaggugaagcaaaguaaucugauaaaguuuagguuauuaagaaauuacuguuuaugaugugauuaaugugggguucauauuaaaacaucuuguugauucaagaugaaguccacaaaaacacagccuuggaauugaucaauuaugucucaguuccaaaaccuugaaaaccagaucgcugaacuacaugaccucucugaagacucuuucaacucuaaacuccucagaucuaaaaccaaacauaaccuaaacauaugcauccuucuaauucaaaacucuguuuaucuaaaaauagaaucaccuugaccacucaugcugaaaaugcuuagcauauuugggaccuacaaagguuagcagcuauuuuguuccaugccuauuuuauuuggcaacaaaauuuaaguuaacauauuuaauucagccacaugcuucuuagaguuaagugaccacuuaucuaucuggagugaagacccuuuuaaugacauacuuguuuguuacaacauuugaaaagcacauuuguguauuuucaauauagagaaaauagagcaaugcuuaaaugcuaacuaaauacuaguaaaagagaugaaagucagucacagaaucaaauuaaauuuacacuuacuuugaccuauuuuaauuacuggugaagauuuuugaauuaacacaaaagaaaaaauggggaagccugcguuuuacauggugcauuccuguuaagcaaugggacugugccucaaugccauucuagaaacagggcuccccuccuccaagccauucugcccauuccagucauucauacagaagccacugaaaguccaugccccuaaccagaauagguucagagacacuccuggaggcucuuuaccccuccauucccagaauuuauucuaacaaacacuucuguggauaguuaagaauuucuguccuaacucucuuuuggaauuuauuauuacagaaauaaagcuugaacgcauguuguuaaauuaaagaucuugaagaaucauggaacuuugggaaagaaaggauaacuguucucuaguucaguuuuucccacugcacuacuuaaaguaccauuuuguaaguaauuuuuauuaguaucugacagcaaaccuuucuacaauaugaaaaaauuccauguggcagaauucaaacaaguauguguuagguccuguuuuugguaaaagguauauugcuuucuuuagccuaaaauaaagaaacagaacaacaucaauuuauaucuuaaguuuauucuuuuaucuuagggggauucccauuggguuuaaaagaaaacuaucaaauuugauuuuuguaucuaccauuagcacaugccuugacuacuuucccaucaauuuucauucuaccugacgaaggagaggaucgcaguacaucuguucaauagucugaguaguacuugcaauacaagucuuuaaaucuguuuggaaaaagaaaaacaaaagcuucacuaaaaugaucucauucuaugucacacaggcuacuuuaacuaagcaaagaauauugcuaggguccuaaugauuucagcuucccucuaugaaccacgaagcaauauacaguuuuaaagcagcuaguacuuuagguuaugaaagcuuuuaguucaauauaauuacauuaagguuuuaaaacauuauuuuuuauaauugccaaaauuucuuaaagaguaagcuguuuaggaaaagaucuuaaugggucacuuggcuguaaaauguaugccucagacaggaucugaaaugagaaagcagaacaaaggguaaggcuaaauuucucugaauaggaaucugggaagaaucuguauuuuccaucaucuuuuuguucccuagacaaaaggagacaggaagggggguaagguuagucugagcaauaugggcaaugaggucaaagggcuuuuuaagaauacaaugcugaauaauccaauuuuacauugugcauacugcucaaauaccucauuaaccuucaguaaagcaugcuuccuauagaaaagacugaagaguagaaguccagaaaagcuaaaugcuaaaucugggucaacuuaagcuggaguucagauaaucuaccacagaaacagaaaucaguugaugcagaaaaaucucagcaaaggugaucauuucccagaaauuuugagggggagaucuuuccauaucuguauaaugggggugugugagccaaguuuacagggcacuaaaagugcaaaagaagucacaauuaccaugucaaaauucaaaagcaugggccagacguaguggcucacaccuauaaucccagcacuuugggaggccaaggcaggcagaucaguuuuggucaggaguuuaagaccagccugaccaacauggugaaaccccaucucuacuaaaaaaaaaaaaaaaaucagccagguguggugguacaugccuauaaucccagcuacuugggaggcugagccaugaaaaucgccugaacccggaaggcggagguuucagugagcugagauugcaccacugcacuccagccugggugauagagugagacuccaucucggcgggggggaaauucuguagcauguacaguaaugucaggaaguguaccgaggugcuuaaccuccaaauagucaaaaaacagaaaaagcaaagaguaacugacaaauuuuaaaagagccaaccuuguauaucuuguucaaucucacuccuccaucucugaagacaggucuuaacaaaauuuaucuccucaucugugacuguucguggagcuggcugugaaggcauuuccauggaagaccgagaagaugucagugguuuagacuuggguaaagaaucuucaggagaagaaaagguacuuucaacauccugagaagagcuuucuguacuuguacugaggaagacaaaaaucaugcucauaugauaauuuccaaaagauaccuuggccuaaauuauguacuuuggaaagcaagaugcuauaugaaaaaguacagguauucagugagcauuaacucuauaaagguacagagccaaccuuuuucucuaucaucucacguaccacaacuggccugugagguagauacuuuucuaucccuauuuuaccaacugugagccuaagguuuaaauaaauuaagcaacaugcccaaguucaccaagcuggaagguaaugaaaaugaauccaaagccagaucggccagucuuuagcucauguucucugaucacugauuauuccuucccaugaggaugggaagagaaggaaaauggaaaagagaagacuaggccuggaagaaucaaggaaucaacuacagaguuuacaagaugaagccaacuaaagugacacuauccuuccuggaacaaaauacacagaaggaagaaaaaggaagcaucagcugaacauacaacucacaggaauacacacuaggugacaccuuggagaguucugagagaagggcuucaagucaaacaauccuagcucuacuacuuuagcuaaauacccaaggaaaaaaguauuaauaucucaucuacaaaauauaaaucuuaaguucuuuacgucuuuucuguaaacuaacagagaauaaagcauaucaaguaaauguuaauuucucuauugucagaguaaaacugcaggucaacaaaccagcaggaauauaaaauaagcuucuaauuguaguuagguuucucuuuuacaccaaagcugaagaauauaaacuuccuuuacuuugacuuaaaaaaaaacucucacuccugccggguacgguggcucacgccuguaaucccagcacuuugggaggcuaaggagggcaaauuaccaggucaagagaucgagaccacccuggccaacauggugaaaccccaucucuacuaaaaauacaaaacucagcugggcaugguggcacgccuguagucccagcuacuugggaggcugaggcaggagaaucgcuugaacccagaaggcggagguugcagugagcugagaucaugccacuguacuccagccuggcgacagagugagacuccaucucaaaaaaacaaacaaacaaacaaacaaaaaaaccucacucccuccuccucacucucucacaugcacaaaauaauggaggaaaucucuuuucccuaagguccauacuuauggaaaaauaagcccaacaagggaacagauaucucaauuucagaggagauuacacacauacaccucccuguaauuuuuaaaucuaauaccaagcacuauuauuuuauuugauuaaauagccugccgaaccacuuuuuaaaaauuaaaacuuuacauuucauaauauacauaaaaagauucuauuuuuacaaaaauuaaaaaauuuaaguagaauauaaaaagugaaagagcagccccacuccuauccccagacucaugucacuccuuagagauaaucauucuugacauuugguauguucuauccaaauaagcauuucuaugcauacauggaugaauaaauauuaauacguggggcgguggcgggggauguguuggggagaauaguuaagauuuuuugacaaaaaagucuaacuuuuuauugaguauuaguguuuuuauuagccagguaacacauaucaaauguccuagcuaccuuucauggcuccucuaggcaauaaagauuguugcacaugacuggauggaauaaaaucagagggcuccugugacuuugccucccucugccuuuacuagagaagccccucuaagcuguccucuuauuucuagccaguucuuuuucaaguacuaauuuucuauucaagaauaagucucucuuuccuugauguuucuuagucaugcauacuucaagugugugagcaugagauguuuuggaagagcagggcuugagguuuccucugagaaaggccuuuaauggcagcuggcuuguaguucaaaacaaggcaucacuggguggagccugaacacuauccugaacaguuugagaagccucugaaauaacccaaccauucuacggauaagacaaaugcacuggugggcccacucccacccaagugacagucagcaaaacccuucccuuuaagacaaagagcucacagcuccugugcucuuauaggugacugucaaucaaguacaaagauggugcauaguuuaaauuauaccagaaaaacaauacauaccauuaaaaaaaaaauguuuucauuaccuuuccuuggaugucuggucagaaaccgagcagugcacugaagaaagugguaaugucauaugugugucacuuucagguggacagcuuucugaggcagguuuuguacuagcaaauucaauaacauauuucagcauguccgggagcgggaaccgagcugggccugagccauauuucacauaccuaagcgacaaagacagugguacucuacugcccaaggcuguuuuguauuuuaagagucgcugacaaaagaucuguuuaucacagcaagucaauggaaaggcuuauuccuagaggcuauacaauauuuaauaggguccucaaacaaucuauaggguaaaaauucucuaacuacaaaacuaaaaauugccaacaaucugaaguuuuauaucuggcaggaaacauuucaaauaggcuccuaaucaaagucaugccaguuacacuuucucaugaugucauauuacauuuaggcuuuggucauuuauuuauuuuuuauuuuuugguuuuuuuuuuuugagacagagucucccucuguugcccaggcuggagugcaguggcgcuaucuuggcucacugcaagcuccgccuccuggguucacgccauucuccugccucagccuccccaguagcugggacuacaggaacccgccaccacgccuggcuaauuuuuuguauuuuuaguagagacaggguuucacuguauuagccaggauggucucgaucuccugacuucgugauccacccgccuuggccucccaaagugcugggauuaagggccaccgcgccuggcaauuuuuaagucaucauuuuacaacuuuaauucuucccagguuugcugcauuuuaauacaauacuuacacuaaaucccaagagauuuuuuucuuuaagaaacuuaucuucaauuuuaugacauaacaauuuucagcugggcauggugacucaugcuuguaaucccaguacuuggggaggccaaggcagguagauggcuugaagccaaggaguucaagaccagccuaggcaacaugacaaaacccugucuccacaaaaaaugaaaaaaauuagccaggcaugauggcacacuccuguagucccagcuccuugggaggcugaggcaggaggaucgcuugagccugggagguugagacuacagugagccaagaucaugccacugugcuccagccugagugacagagugagacucugucucaaaaaaagcaaaacaaaacaccaaaaaaaaaaaaacaaagaagacaagacauaaucauuuucauguucaucuacugaauuccuuuauacaacuuuuaggaccaacuacuucauacaauguacaccucuaucaguuuaguagaaucagagcaaaagugguuaaaaaaaagaugucuauacuauacacaagaaauucaauuuucaaaaauauaucaagguuaucuuacagaagaagaaauagugagcauuuuuauucuuuuuuuuuuuuuuugagacagagucucauuuugucacccaggcuggagugcagcggcacgaucucggcuuacugcaaccucugccuccuggguucaagcaauuguccugccucagccucccgaguagcugggacuacaggugugcgaugccacgcccagcuaauuuuuauauuuuuaguagagaugggguuuugcugugucagccaagcuggucucgaacuccugaucucaacugauccacccaccucagccucccaaagugcugggauuacaggugugagccacugugccuggccaacauuuuuauucuuaaacuguaaaaguaaugcauguaccugguacgaaaauucaaauacaaaaaaguauaaaacagaccauaaaagucaucuaccuccaucucaguucuacuaccuaaugguauccauuaacaguuucuuuuauauuuucccaggacugugucacacauauacaagcagauauguguaaccuuaaaaaauaaaaucugaaauuuauaaucauuuuauuuuuuccauuauaaaaauguaucaagggaauaauuagaauuuuuaggggcuugguuuaccaagauaaagacuaaaaacaauuauuuauuuauuuaugagacagaguuuugcucuuguugcccaggcuggggugcaauggcgugaucuuggcucacugcaaccuccaccuccccgguucaagugauucuccugccucagccucccgaguagcuaggacuacaggcaugcgccaccacgcucggcuaauucuguauuuuuaguagagacgggguuucaccauguuggucaggcgggucuggaacuccugaccucaagugauccaccgcgcccggccagacuaaaaaccauuaacccauuuaugcguaguguuccauuauuggaaugcuaagcuugugggaguuaaaauuuaauauccuacugcucaaggucauugccaaggucuuauuuuucaccaaaaaaauuugcaaccuccagcauaaaugaguuagaaacacuuuacaaauucuuuuuuaaccuaccaacugggaccuacaugaaauaaauccucuauagccuuaggaaagagacugcuuuccuaaaucagaaaaguugacuuccaagcuacugucuuaccuccacugccuuagaacccaaaggagaacuaaaccucaccugcaauggcaccucuggcagucaaguaggaagaaugagcaauguccugaaacaggcuagaugcagacugugagccaaaagcagagguuguguuaggaaugggaccauauaauuuauuaucaaaccaggauacuucugagagugaaagaaggugcuguuaauuacucaagaagaagaggcacaaaaugagccauauagccacucuagugaucaggcacuuugggaaacuacauuucucaguaugcccugucccuugaaauucaaaacgcuucacuggcacagcgcacccugggaccuagggauagcaccaugaaagagguaaaagacacagggcugguucugacauggaggcgcccuccuuccaugggacacuuaaccagacacaggacauaacaccagagauggaauuucaauggauauuaaaucuagaguagaaccuuucucuugccaacaauuuuagcuuccaaagauguggaacuaguugagauguccauugguccacugcccuauuucuccuggugcugcuucugccuccccacgucaccaacauccccauugucaccagucuuucggggaauucugggcaagguguucuucccacuugaguucaaccaauuuguauagcuccaugguagccugggugucuuccacagaggaaugccuauuuucccaacccagaugucccaauucagcagauucuugaugagaugcuucaaagacauggugacguucacugggcaaucagccuuccaguuggggaggagaagggggauaugggaguugucacuggugagggacuugggaugaaaguacuggggcuuugaagucauuguggauggcauguccaccaccaucuucccuguaucuucaauauaugccaugagcaaucuugaagagcauggcauucaccaugugcugcuucuggacaccacuccaccuggucuggcaguccacaguguggccagggggaaggauguacucguuaugaagcacaucuccgcuguagcugacagugcuacauggaaccaagaaaguaacaugccccuuggguccuguguccagcaucucacagccaauugccacuauucuuccuuggcaacuucugggaugcuccaaagcauuuauucugagugagcuuggguagaguucuguggggcgcugagcugagaggauuuguucuggaggccuuucuucugggagugggucggguggcuguuaaucuuuagaagggcaccuccagcaaaucuacuuagcugcaacagaaucagcauucuuugaaggggcaggggacagccaugacaccgcagcuuuccuguccagggacucuucugacacacugcuggaggcagcugccuucuuuucugggaagggaggggucuuccaagugccaugcacccuaggaguuuccucuuucuuuggagguucugagugcaacuugggugucuugcuagggggcugguucuuuuuauucagaaagccucucuguuccaaaaguugccauuucuuaacaaaauuuugugcuuggcaguucuuucuaaugccuuuuugggaggagguuccaccaaaucccgauugaggagucagguagacauggggacagugggugguggagggugugaggguggggugggggagugggggaauacguucccuggccccucuagcuucaugaagguacaacucgaaggucucauuuuauuuuaaaacaaaaguauuaucaugcuaaggaaaaugcuccuauacucuauuuuaaaauaaagaauacccuguugucuccugguaaauugguauuuuugaacuauaaaacaucagguauucucauuucuuuuauguuguugugaaaagauggggucucuuauguuguugugaagagaugggggccaggaacagcggcucacgccuauaaucccaggacuuugggaggcugaggcagguggaucacgaggucaggaguucaagaccagccuggccaacauggugaaaccuugucucuaccaaaaauacaaaauuagccgggcaugguggcacaugccuguaaucccagcuacucuggaggcugaggcagaagaaucgcuugaacccaggaggcggagguugcagcgagcugagaucgugccacugcacuccagccuggaaaacaaagcgacacuccaucuucaaaaaaaacagagagagagagagagagagagagagagagagagagagagagauggggucucacuaaguugcacaggcuggucucaaacuccugagcacaggcaauccucuugccucagccucccauauagcugggauuauaggcacaugauacugcauccaguugguaugguugguucuauaaaaauaauuuaaaauuuccagccuuacaaaguaucacuaaaacuuaaagguuuaguaaaauacuaacagacuuaaaaguccugaaaaucacuuccaggacaguauuugaggaacugguuuucagcuuaagucucuauaaagacaaaugacuagucacaauacaucuuguauaagcucuucuggagugagaguggaagcugcagugguagcgguggggguacagugcaggguccaucuuaggccugguauggaaaguguugcccuucagggaaauuaauggccuaauaagggaguagguggaggugugguggucuuagaaagaaaacuguuaaguggauaaagggaggagaagcuauugacuguguaugggaucucuuucuuaagcgcaaaaucaacgggaucuaucuagacgagaaagaaauuaaacugacuccuaaggaaauuacagaaaaccauucuacagaaauaguguaaaaccaacaaucaaaaaagugaaaauuccuccaaaagagaaagaacuuuguaugcaucagaaauauuagcccuuuuaaucaguuagcacugcucuagguagaaaagcacuguuuuuuaucuuucuuagacacuucagaaacugcuuuuccaaaaguggacgggaccaucgugacacuugcuucucucauguuugugaaaaagauggcaaggggaguagaaaaaaagucuauaaaaucagaacucaguuucuccuugguacacugcaguaacuaacugugugacucugagucacuucaguagucugggacuauuauuuacccccaugaauaauacuagcugauccugaagacugcuucacacuuagacaaaaaauuuucuuagcuguuuuauaaaauauucuaguuaauauuuaaacguugaguuaauuuuuaaagaaaaacaaauuaucuguuuuuaauauucuuuuacauuucuaagcaugaagguguccaaaacucaccuuuccaauuuuugcugcagaauuuuuauuuccuccuucaacuuucgaauacacucucucuuauuucgaauaagcuccuugcuccuguacauguaccuaaguaaauaaucccacaaacacaauuuauauuauaaaacauuaaugacauaaagucucaguaaacuaaagauucaaggaaacuucuucaaucagauauagggcaucuauaaaaaacauacggcugacagcauacucaagguuaaaacugaugcauucccccuaaaaucaggaacaaggauacccacucuugcuacuucuauuaaauacuuaacugaagauauaaccaaugcaauaaaguaagaaaaacaaaugaaaggcaugcagauaguaaagaaugaaguaaagcugccuuuuaguuccacaugauguaagcaugcagaaaaucuuaaggaaccuaaaaaaauacaucagaacuaauaagugaguuuaguaaagucaaaggauacaaaaucaauuuaaaaaaagaaaaaaaaucaacugcaauucuauacacuuguaaagaacaaaugaaaaaugaaauuaaaagcaggaauuagagauaaauuuaaucaaacaugugcaagaccuguacacuaaaaauuacaaaacacuguugagagauauuaauaaggacuuaaaucucuauuaacuuauuuaauaaauggagcuauacacuguucauggauugaaggacucaauauuauuauuauuuuugagauggagucucacucgucacccaggcuggagugcaacggcgcaaucucggcucacugugaccuccgccucccggguucaagcaauccuccugccucagccucccagguagcuggaauuacaggugcccaucaccaagucugauuaauuuuuguauuuuuuaguagagaugggguuucaccagguuggucaggcuggucucaaacucccuaccucaggugauccacccaccucagccucccaaagugcugggauuacaggugugagccaccaugucuggccgaaaaacucaauauuauuauuaagauguuggaccaggggcgguggcucacgccuguaaucccaacacuuugggaggccgaggcaggcggauuaccugaggacgggaguucaagaccagccugaccaacgugggagaaaccccaucucuacuaaaaauacaaaauuagcugggcguuguggcacaugccuguaaucccagauacuugggaggcugaggcaggagaaucauuugaacccgggaggcagagguugcggugagccaagaucgcaccauugcacuccagccugggcaacaagagcgaaacuccgucuuaaaaaaaaaaaaaaaaaaagaugucaauuuuccccaaacugaucuguaaguucaaaacacaaccaaucaaaaucccaauagccacuggguagaaacugacaagcugauaaaaauuuacauagaaaugcaaaggaccagcacaccuaaaacaauuuugaaaaagaacaaaguugaaggauucauacuaucuaaugucaagauuuacaauaaagccauaguaaucaaaacaauauggcacugacauaagaccagacaacagacagaacagacuccagauauagacccccauguauauguucaauuaauuuuugacacagugccaagauaauucaaugggggaaaaggaaauauaaaucaaaggaaaaauaagauauucccacacacccacuagauggcuaaaauuagaaacacuuauaauuccaagcacuggcaaggauguagagcaaauggagcccucacacacugcuagagggaaugcaaaauuguauagucacuuuagaaaauaguuuggaaauuucuuauaauguuaaauauacacuuuucauagaaccaagcaauccuacuccuacauauuuuacccaagaaaacuaaaaauuaugccaaggauuauaugugaauguucauggcagcuucauucauaauagccuaaaacuagauacgucaccaaauggugaauggcaaaaaaucacugcaguacauauuacaauagaauauuacucagcaauacaaaggagcaaauuacuuauauaugaacaacaugggugaaucccaaaaacauuauccuaaagaaaggacacaaccagaacaggguaccuacuaaauauuaauguuacuaaugccacauucuagaaaugguaacauuauaggguccaaaaacauuaagugguugccaggaccuggagauggagagaaagggaaugaucacaaugggacaaggaaaaccuuuugggugcuggaaugcccuacauauugacugugaugguaguuuauuugacuguacauuugucagaacucacugguuauaugccuaaaaauaaaccaugggauaagaaugacuacauaaaaaauaaguaaaagaagccauggcucacgccuauaaucccagcacuuugggaggcagagacgggcagaucacaaggucaggggauugagaccauccuggccaacauggugaaaccccgucucuacuaaaaauacuaaaauuagcugggugugguggugcgugccuguaaucccagcuauuugggaggcugacacaggagaaucgcuugaacccgggaagcagagguugcagugagccgagaucgugccacugcauuccagccugggcaacagagcaagacuccuucucaaaaaaaaaaaaaaagaaagaaagaaaagaaaagaaaaucaagccaccacacccauuuuuuuuuuuuuuuuuuuuuuuuuuuuugagacagggucucacucuguuacccaggcuggagugcagugacaugaacagggcucacuggccccaccaaguaccugggacuacaggugcacaccacuacacccagcuaauuuuuuuuuuuuaagagacaggguuuugccauguugcccaggcuagucuuaaacuccugcgcucaagauaucugcccuccucguccucccaaagugcuaggauuacagaugugagccaccaugccuggucucaaccagacuuuuauaaaauuaaaauucuaggccgggcgcgguggcucacaccuguaauaccagcacuuugggaggccaaggcaggcggaucaccugaggucgggaguucgcgaccagccugaccaacauggagaaaccccgucucuacuaaaaauauaaaauuagccgggugugguggugcaugccuguaauuccagcuacuugggaggcugaggcaggagaaucacuugaacccgggaagcagauguuucggugagccgagauugcgccauugcacuccagccugggcaacaagagcaaaacucugucucaaaaaaaaaaaaaaacaaaaauucuauaauguaagucugcuaggagcacccccacccccagaauucagguaguuccuacccccaaaaggaggagggcuuucaccuaaagucuugcuuccggagaucagaagcaacaugagcacaacccugggaggucucagaaaaaggcaaagacccucaaccuagacucauagaauccaaauuugcauauuaucaugucucccaggugauuccuacgcacacuauacuuaguacgugcucaucucuacugcuguaauaccucaggaaaaaaaaaaaucagccaagaacucaccuguccauauaaauaaucugaggaaauuccagcuuauugugaauuuucucuggcugcccaagggacugauuaaacucaaaucuugagaguucaaaggucaacacuggagguagcuuuguaaaccaacgcuagugucaagaguagaaaugugagagaaagaaaaauuaauuuuaggaaauuacaauaaccagauuuaaaauaucucucauuaaaguuucuuccuuugguauagaacuuauacucaaggcaaacucauacuagaacuuuuuuuuaucccaaacacuaaagggaaucaacacuuagaaucucauucucuuacagaauaugguucaacauuccucaagacuccaaauuuacuagccagucaacagaauuuuacucaaccaucauccucagaauaaaccacccuugaauaugugaaccgcacuaagcaucuacauaacucauucguuacaucaucaguauucagaagagguuuaaaaacuuaacagcuagccuaacuacagaauaugaaauuaugaucgaagcagcauguagcuaaagagacaacuccaugugccagcuaaaaagacucauauguguacauauauuacaugcuguuuuagucuauuaaccauaauuugaaucuccuuuauauauacaaaggaaauuugaaauagccucaugguuuuacaauuucucaauuucuaagaaaaaucucugaauuucaaaaacuuacagaggucucauaaagaagccagucaaaucaaccuacgauguuacuugaguuucaaagaaggaaggcacugacauaaaaaagacucaacagucagggaucacaggugaggaaaagcuaaaucagauuuggcuuuucuauucaauucaccuguaugucugagguuccugucaacagcuuuaaaauauuuccuuuaccacaagugcaagcaacauucccuucagauacccugucagcauaaugaggugaauucacacagccugugagaccaccucagggugaaaucuaaaugagcaugacaauuuuguuguuuuguuuaauuuuuauagaauucccauccuggaauacaggucuccacaggccuaaguauagcuggugaagacucccucuuuuguaagaggaugcaccagguuugcacagaugguacagaugacguaauuccuccauuaggaaucaguuuuuccuugaaaauccagggaggcagcagcucucugaguuccaacacugcucuacagugaauguauuuucauauggcucauguuaggcucccuauuuuaauucaggaaagcuccacuuucuccuauaguaauuacugaguuggaaucauauauaagccacaguuuugucucaaaauguaugaucaauggagaacaaucccaacuguguaaagaauuauguuacaaaugcuauucacuaauucuuaaccuaacuggaauacugagauguuaacuacccaugcucucccuuuaacuucccccgucuuuccaacccagaaaaaaaauagauacauaaauaaacaaaugaaaauuaaauuuuaaaaauguuaaaagcaaaggcagaauuuacaauugagaacaguaaauacuauaauagggaaaauauucuaaauggcauaccauaggaguuaaucacuguacuuuuacccuccgaaaauauggaggcaguggguucucccuacucagguacagguaggcuucaacagaaagagagaaacuugaucauacuuaaaacaucagaagcagcauacaaccuuuacacgaguaacucaaauucauaguuuuaguaaaaauuauuuaucaaaguacugauacucacugacucacaucaacugaugagagacuuaagacaaauucaaguucugcuaaguguaaaguuacuuaauaugugaugggaaacuagucugcccaaaagcucacuccuacuuaacuggcuuugucacuggcacagcaaauaaagaucuccaacguaccucuuguccauacuucaccgagugaucggagggaagaagcucaacaucacccuccaccauggccccuuccaaacacucgucuaaguugcgauaaccguuuaccugaagaggauacuggccgaaggucucauuguuacaaaaggguuuuccuaggcaaagagagagacuuuuuaaaaaagacaucacuaugacuaucuaaagccuaucuucuggcuccacagagacaacauuuuaaauucagcaacuuccugauagcugguuagaaaugcacuuacgccuuuauagcaaccucuagugagccagucaaucuagacacugaacaaugaaaaccaguaacacuggaaaaagaccaggggcuucguggcuuaugccuguaaucccaccacuuugggaggccaaggugggaggaucacuugaggccaggaguuugaccagccuggaaaacacagugacaccccugucucuacaaaaaauaaaaauuauccgggugcaguaacacacgccugaaguccuggcuacucaggaggauaagguaggaggauuucuugagcccagaaguccaagguuacaguaagcuaugauguugccacugcgcuacaaccugggcaacagagcaaggacuugucucaaaaaaaaaaaaaaaaaaaaaaugcaaagacaaccagacauuauguacuuccuaaucaagaguuuucucaccaucugugaauagucuugccaaaaaaagccuuagcuaagucuagucaaaucucuagauccaacuaccaauuuauaagaggaggaauagagaagaacauggggauauguuaaaauauguuaaauauguaucagaggacaugcaaacagcaaaauuuccaacugugggaaaugcuacagaacaaacaacccaguuucuccaaaaaauacauuucaaggaaaaaacgauggagggggagccuacaaauauucagucauaaaugaaucacacacugggguccugacuaaaacaaacucuaaaaauaaauuuucuauuuuuaaaaaauuaugaaaacaaauuagaaaucucaacacugacuagauauuugauaguuuaaaaugcuauuuuucagagucauauugguauuggguuauguuuuaaaaagaguaucagauugguaagaguggggugagauggggaaugacuggcugugggcuaaggcuggguucauggagguuguaaaauugcucuauuugaauguauucuaaacucuucauaauuaaaaauaaauuaugugccuugcauguagcuuagauagauaagccuccagagugaaaagccucuagucuagaaaaacauuuuuggcagucucacucaauaaaaccuuuugagauuaaguauuauauuagaauaagcaacacagagaaaaccgaguaaaaucacuaucugacauuaaugucagauuugggcugugcaaguauuaauaugacaaaucugagauaaagauugugcacauuuuacagaugaagagacugaggauccagaagcucccauaguuuauccacaguuaaacagauaccaagaggcagaaccaauauucagagcugaguacugcugacucucaagccuauucacuauacugccuccucaaagggacacaguaauaaagauaugaucaaaggucuagaauuaaaauucagagcagagaauuuaccuucacgaaccccuucagucaggaaaguaccauagaacagcugcaccauuggauuuucagauuuguuccugggacugcugcuuuuaggaaaaggagacaauucuggauuguuuggauuaagauaugugcuacauaaaauccaagcaucauucaaaagcaaaaauagugcauuuucaucaacccccaaagagccagguaugaucuaaauaaguaacaauuaguucaguucaaauauuuauugaacaccuucuuucgagcauugugcuaaacucugaagacacaaagacaagaaggcccaaucccuggacuuaaggagcuuaaagccuaauaguggagucacacaugcagacaaauaugcuuucaguauauacaucuauauccaaugauagauguauacaagguauagaagcaguauaaagguaagaaugaacucuguugcauaguuuuacaaauaaauacaaaaaauuuuucuccaugguacaacagaaauaaaaaguuucuccuuacaaguccuucuuaaauugcuacguugaguugccguuuccaaaacuauuuuauaguuacaaugcuucuaccuagaauugaaaccauuuaaaacacagauuucucagagggauauccguaucgugcccuaaguuucacuucucucagugacugaaaugacuauaaccuauccucuacacauucuuaguagaccucaaaagggaucuuaaauuuaaguacccauauuauaccaucauguucacaacagagguugauuuguccuuuuuacaaauacauuuuacagcacaugcugaguuuauuaacaaaguuaacaguuacaguccuuuaguuagaaaaaaaaaaaagcugcaggauaagaugacugguacauccucagaggggaaagcugaaggcgacagggauacaugaugaggacuaccucagugguuaucccaggagguaugguuaaaaaccagcaauuucuaguuaaggagaguaacuuuccagcauauaauucucacuggcccacugugagucggaaggauguacaaacaaacccucaacacucacuuaacauuaacagcuagcuggaaugcguccucuagccaauccaggagcuugugugugaauucacucacaucuugcuauaagagaggcacaaauugcauaaaaguuagaugcaauacuaagagaaauuaaaauuuauccuuaucccaccaaugaauuaagauuauacuacuauaaaagcauuucuuuuuuucuuuucuuuuuuuguuuugagacagggucucacucugucgcccagacuggagugcaguggcgcgaucucagcucaaugcagccuccaccucccagauucaagcgauucuccugccucagccucccaaguagcugggauuacaggcacaugccaccaugccuggcuaauuuuuguauuuuuagcugagacgggguuucaccauguuggccaagcuggucuugaacuccugaccucaaaugauccaccugccucggcgucgcaagugcugggauuacaggcaucagcuauugcgcacagccugaaagcguuuauuuuugggggcugaauaucaugaaaacauaggaacacugaaacccagcuacuauacauaaaaaagaaggugcauuaagcaaccugaaaguuguagcuagaaggaagcuggaacucuacuacuuccagccacaucuauuuaugacaaagaaagaaaaauaaacaaaaucuuccaaguaggacuuuuuaagaaaaaggcccaaggaacucuagaacaauacagagaucugaauaaagaaagaaaacuucaauguuuugagaauuuuguagaacuguaggaccuucaaauagagaaagaaaaaaaaucauaugaggaagaagaugaucuaauuagugacagcuuuguuuuuguuuuuaaauuauuuuuucagagacggggucucacucugucacccaggcuggaguacaguagugcaaucacagcuuauugcagccucaaacuccuggguuccagggaucuuccugccucaaccucccaaguagcugggacuacaggugcguaccaccaugcccggcuauuuuuuaauaggagguagggaagggaaagucuagaagagagaaguugcugagaaaagcuccgaaaagcuccugaacucagguuuagauaguuuuaaagauacuauuuccaucuggaccauuccaagacaaaggugcagacaaaggacuacuuuucuugguaucccuuuuguuacagcucauugagguauuuuccaaucuccuccuuucuacaucaauagccccgguauaauucuacauucuuucuacuacuauuucuucuucucuuuagaacugccagcccccgugcaacacacgcacacucucucacacacacaugcuuucucucucaccaccuguucuguaggcaaaacaaaagucagaaacgagcauccauaguccugcuuagucauguucacagcuuguuacgcaguugaaaugaagcaguaccgcauuaacacugacaaggcaugacuucaaacucaagaacaaggcuucuuuuguaccugcuguuccucagaugaucggaaugcucccuuuaauagauccagggcugcagacgggucuacaaauuuucuauuugaucccaucauuagagcaaacaaauacugaagcucuugcauaaacaugauauuucucuuuuccuguagaaaacacaguacauguacucuuacaauaucucauuuagaaaaucagaacguguaaagaaaaaaaaguugucaauaaucaugcccucauuuauauuuaccuagaucuaggucaaagucacagggcuauguguguuacagggacucugguaaggacuguacucuaaacugaagaauaacuauguagaagccagagacagcacuguuggaaaaacagaaauguccacuuucugaagcugcugcccuccuucucaugaggaaaaugcauugcgccaaggugaaauccugggaaggguuaaauugcuaggaggaggcuacgaccuuuggcaaaaacagaauaaaauagacuaaggcggcucaggucucuggcaucagggcaucucuccagcaucacauugccuaagcagcucaggaagagaaaggauacaacaaacacaacagguauucagggucuccccacccacauauucuuggagcuguuuuucucauuuuacuccuacuuaauuuuacauuuuugcauacccuuauauguuaucccaaaaaaggaaaaugagccauuuagaaaugaaaacaaauaauuagcacaagccaaagaguaucacggauaucagcuuuaggcaaaaaucuagaagccuuagggaugaaagggacuaaacaacagugaagaaauuccuugacaccaacuuacuguaugacuucgacaauuuucaaguacauuuuguggcagacuauaacugagaacaagucuucgaaauucaggcaauugaaagagagacugaaauaaagaaagaaagggauucauagccuuuccugaaaauaacugcagcaacauauguauuuuucacuucaaauauuuuauuucauauuuaaaaguaugcaaaacuaucaaccuggcaauuugacuuauguuauuucuaaggaaauaaugguugugcacaaaaaauuagcucaaagaauauuaauacuuuuagguaaaaaauagaaacaaccuaaugucuaacaaaaggaguagcuuuuguuuuguuuugguuugguuuuguagagacagggucucccuauguugcccaggauggucucaaacuccugagcucaagggaucugcccgcuuuggccucccaaaguguugggauuacaagcauaagccaccaagcccagccaaaagaaguaguuuauauaaacuauacuacauuuauacaauagacuauuaagcagucauugaaauaauauuguaaaaaguguuuauaaaaugaccuacuauauaaagugaaaaugaaaaaaacaagagcuauguguaucaacauggauaaaccucaaaaacacauuuugagugaaaaaaaguuacagaaaaaaaguauuauacugcuuauauuaaguuuaacaacauguaaaacaauacuacguauuguucagggauacauccaugugugguuaugacugugggaaagggaggaugucacaacaggaacucaauagaacagaaauuuguaacauuaauuuuuuaagcuaggugguuaguauagcaguguuuacuauucuccacuccuugucauaguauuguauuuuuuaaaaguuuaacagcagaugguagaacuggagagagggauucuuuuuauuauuugcaaaucacauuuuucuacuaugaauaccuuucauaaguuaauuuucuuuaaaaauaucuccuguaugaauauacaacuccucaucccaacaugcuccucaaaugaaaacccucucaggccugcacgguggaacuccugaagaagcauccuagguagauaauaggcaaaacuuuggaauuagaacuaaauaaaacagcuucuugguauucuaaaagccccagguauauuuccuaaugucaaccaaagaauccaagugucgguacugacuagagcccacgugcaccucucuggcuucccucacucuaacacaagcccuggcgggauucagccaacagggugaguguucaaccggacugaaguguaaacccaggucaugcugcaccaaaguucucucugggaccagggcuuggcuggugagcuguauccucugccacucucuucucuuccaccucaccugucuaccuaacacacuugcauuccuacucugcuggcuacccugugacauucuugaguuucuauucugcugugagaaaaauggcuuuacauucucagccauuuaacuccaccucuucaccaucaggaaaaucgggcuuugccauuauucuuaaaaaccacauuaggcuggaagugguggcuuacgccuguaaucccagcacuuugggaggcugaggcgggcagaucaccugaggucaggaguucaagaccagccugaccaacauggagaaaccccaucucuacuaaaaauacaaaauuagccgggcaugguggcaugccuauagucccagcugcucgggaggcugaggcaggagaaucgcuugaacccuggaggcagagguugccgugagccgagaucgcaccauugcauaccagccagggcaacaagaacgaaacugucucaaaacaaaaaaaaagaaaaacaacaaaaaagaacacauuaagugugagcuaauacuauucacaucucccaauuuauuccuuacccaaccgcugcugcuucuguguuuucugcgucacuucauuauuacauccuccucccccagucaccaaaguuuagaacugcagaaaaauccuugaaucuuucuccucgccauucacaucuaguaaguaacaagucccuuggccucugacucuaggugcucuuuauaaccuaacugcuuucuccccaucagcaccccaucagcugcucuaauccaacucccaucgccgcucacuugcacauggucucucugcuuccagaacuucccuccacccacucacacuugcucacaacugccacgcagcuccuucuaaguaccucgcuaauauggcaaaaaugaagcucccgauucacugaagacugucaucuaguaacagcuuuccucacucucccaaguccugacauccuccuaggugacuagagucaacauccaaucccugaggacauccugucagugcugccuugagaauauaucaagaacuccaacucuuuucuauuuccagggcuaccaguccaguccgagucaccaucacucuucauggaugacagccaugggucucucccugugcauccuugccccuccauccucaucucgccacaggagccagagggagacucuuaauacuugagccagaguugaucagucugccacuggggacuuucaguaacucccuguccacucagacccuccucuccagugacccucccuuugcucuuagcauccagccacuuggacuccagcacguucccugaacacaccaagcccauucccaccaugaagccacugcucuauguguuccucuaccuggaauguuuuuuuaucccaauagcugccugguucacucccuuuucagucucauccccuuccccaccacagugaggcucauccaacaccacaguuaauacugcaaccuguucccaccucuccugcaguuccaaucucccuaaccuugcucuuuuuucuacuggaccaaucacagucuaauguauuauacacauuuuauucagcuaguucaucauucuguuaguuuuuaguuuacuguucauuuucuaucucaccucaugagaauuuacauuccaugugggcacaguugucuuuguuuuguucacuccuacaucaagggccuagaacacugcuagacauagagcagguguucaauuguuugcugagggaacucgcaugcauccaguauggagaucucucggcuucuugggcaucccaucucuagugacacauuccuccacuccaucucuaucuacauccacaucccaggcugcacccaaaaauacaccaacacaugaaaggugucaguucgcagauuacacguucagaaaagcucacucugggaccauuacaugucuucuuuguguccaauuaccugcaggauaucuguucuuugacuucagcaggggcccaagcaaauugaucucuuuccuggcucccuaacaaucaguuccuuccuaucuucauuucuuucuccaucuagcuuugaugcuacggucuuaacuacccuucauuaaauucacagagugcccuuuuguccuuugaucacauacccagcaaaugcuccaaauuaaaugaguugaguuuuccauguaagagguucaaagugcugucaagaggauguccugauagaaacugaacauuuucguaucaccacacauuuaaagucaacaauuucaagcagaucuucaaauuuuuggaaauccuacuacuguacucuggugccaacugguucucccaccaucuccaacaacuauuucaaacuuucacucccuuuaaaaucugacucugucacuucuccacugucucaaaaaauagcugcuaauuucacagaggaaaaaaaaaaagacuagacacuacuucaacucuaauuggcaguuaucauuucuuccucuucccuucccauuacucuccugcccuuuuccuuguuaaggccgacuccucagauauacuuucuaugcugucugcucaugcugucccagaagccuuacucagcuaucuucuccaucugcuggcucuuguccacccuccacaggagugaaggcuaauggugggggggcggugguugugaauccaaggagcauuaucuuucucucucucuauccuuucagauaggaaagaacugacauguuccacauuaucuuccuauguucuauucucaacacagaugccagugauccuuuuaaacuggaaguaugaucauaucacuucucugcuccaaaccuuccaauacauuccuauuucaucuagaauucccaaaucuucaucaugaccccaagcucuuccacuccaccuccaccaccuuuccuaucccacugcuaucaguucuggaucacuccgucuuagcuauuugcuauuugucagacacauuaagcaagcuccugaaccucagucugcuuauuugcuguuccuugucugaaauguucccuauguaauuaaauagcacauucccuggccaccuucagaccucugcucaaauucccgccucaucagaaaggccaucccugacccucugcccucuccagcugaacccuguccagucccccagacucauucauucaucuuuacacuugucaccuccucauguuuuguuuacugucugugccacucuuuccaaaguaaaccaugagaguacgggcuuuguuuuagucacugcuguuuccccagagccuaagacagugccaggcacauagaagcuggauguagcagauguguagaaagggagaauuccauuuuuuggcuugagcagcuggguaggugccauguaccaugauggagaagacugcuguggugagcaccaaggguugcauuggggcuauguaaguuuaagaugccugaucgauacuucuggagagccacuacccucuagugaauucauucacucccuugguuuuauugccaucuauaugguacuaauuuccaaaacuguaucuagagcccagcacuuuuucugaaguacagauucauauaauuaucugccuacaugguaucuccuuaaacucaacucauuuaaguuggaggauuugcuggguaugugaucaaaggacaaaagggcacucugugaauucaaugaaggguaguuaagaccauagcauacacaggcacaggcaccucagacucggcauaucuaaaacugaacugauuguggggcaugguggcucaggccuguaaucccagcacuuuggaaggccaaagcagguggaucacuugaggucaggaguucaagaccagcauggccaacaugaugaaaccucaucucuacuaaaaauacaaaaauuagccaggugugguggcacacgccugucaucccagcuacuugggaggcugaggcaagaggaucccuugaaccugggaggcagaaguugcauugagccuagauugcgccaucuugucucaaaugaauaacuaaauaaauaauaaaaauaaauuuuaaaaaugaagacauugcgccaggugcagcggcucacaccugaaaucccagcacuuugggaggcugaggcgggcggaacaccugaggucaggaguucgagaccaaccuggccaacauggcgaaacccugucucuacuaaaaaauuagccggguggccaggcgcgguggcucacgccucuaaucccaguacuuugggaggccgaggcaggcagaucacauggucaggaguuggagaccagccugaccaacaugaugaaaccccaucucgacuaaaaauacaaaauuagccaggccuggugguacaugccuguagucucagcuacuggagaggcaggagaauugcuuaaaccugggaggcggagguugcagugagcugagaucgcaccacuguugccugggcaacagagcgagacacugugucagaaagaaaaaaacaaaaaacaaaaaaaccugaacugaaacccacuguuaacacacacccaaauuauuccuccuccagggucaaaugguacuauaauccaccugguuacucgaacuagaaaccucauagucuuacucuuacucaacuacugcaggcauauccuggauccaacugcccaccaauccuguagauuugaucuccucagcgccucaagaaugcauucacuucucuccuuccaugacuucugccacuucucuacuccaggccaccacugucgccuaccuggauagcuaugauagccuucaacaacugauuccuccuuauucacucucacugcuauaauauaguauccacuaaaugcuuauccaaaacaccuauucaauauauuuacaaccacagcagauuucuuuuuaguacugcccaacuuagacaucaaagcaucuaaauccauacacaauaaugccagaaaaacuccccuaauuuuaaauaucuauuuuaauccuuugaaagcuauguuucuacauuucaguuuaauaaauuacaaaguuauuuccaaaagacacaguuaucucuuaaaaauaucauaccugaauaacagcacuaaaccaacauguauugccaacauuuuucagcccaacuggccaaccaucaacucuccuccagucauugggauugggguuuucuccccagacuucacagcguuuucucuuugagcguuuaguuucugcagagguugcuucaugcauccuauauugugcagcgugccacacagcaaaaaagaaaauaguuaaagaauaauauagcauauggaggaugcuauaacuuuucguggauaauucaaaacaccagaaaaaguauuuacuggauaaucccuagcuauauaaggaacuguaagacuguaaugcaacugaaaagcaagauuuauacauagaaauguuaaucccuccauaacagacauuauuacuaauaagguccaugauugaacuaaguugaaauucaagacuauuuaaggcuaccauauuagaaauuuuagauuucaacacaguguacuaucuaagaccucaccaucgaauagggcaggagagacacugugcuaaagauaagagccuccaaauugcccaggacauaaaacacagcccuguguucccugaaauaaacaucucagcagugugagggaauaaacauguccagaaacugauaggccaccacuggaacuggauguuggugaacaguaccaaacaaccacccaauuaguaccaguucaaaaaaauagauuccuugaucacuuaugagacaggguaguugaauaacuuucacuuaaaacuaugcagcagcauaacccucaaaguuuauaaaagagaauauacauuuaucagauaccuggacuagguuguuuuuaauucacccuagcaauuguaaacugaaacaccuugcacacuucuacucaaagacacacgaugcaauaagaccccuuucaguuucgcuuuuucaaaagugaaccaaagaguaagcuaaugcaaauucaaaauuucuccuaaaagaaaugucauucaggugcuuaacagaauuauuccugaguggcauucacagagcuguugccuuugagauacacacaaauguggggggcaagaauuauaaguuaaaucaauaaccuguuaagaucucuuccaucagcuugaauuuugggagacuccaguagacucaaagcaauggcagccugaagaucaucuuuguuaucaugaguaaggucuauaacuucuguaagauaaacagaaauuuaauuagucuauauauaggaaacacugcccuucuguaauauaagaaaaagguaaagacauacucccuagcuuucacuacaacaauggcucaacuguguaacaauuuuauuacccuacugcauagucaaaugaguaacuucggcuacacuguaaccuuagacuagcccacaguacagaaauaacaagcugcaaaaaucaaaugaaccaaauacccucuucuguauucucacuccacaaagucaaaaguagaucccauacauguggguuaaauagucucuauuaucacaaaacaucagccaaauaucaaacacccagggaacagauauuuuaaaucucauacaaaauauuccagagaauagggauauacuccucaacuaguuaagaacgguaagagaaagaaaaagugaaacucacacgugauacaaaauacucacagauacaaaauaccuaaacaaaauauuagcaaauagaacccaauaauauaaaaaaaaaaaauuacauauuaagaccaaguuggcugggcgcaguggcuuaugccuguaaucccagcacuuugggaggccgaggcgggcggaucacgaggucaagagaucgagaccauccuggcuaacacggugaaaccccgucucuacuaaaaauacaaaaaauuugccgggcgugguggcgggcgccuguagucccagcuacucaggagguugaggugggagaauggcguaaacccgggagguggagcuugcagggagccaagaccacgccacugcacuccagccuaggcaacagagugagacuccgucucagaaaaaaaaaaaaagaccaaguugaguuuacugcaggaaaaaaaaaugaguuaauacuagauggagcaguaaaauucacuaucuuaacaguuaaaagaaaaaaaugaucaucuuaacagauacagaaaauguauuugauaacauucaacuuucuuucaggauaaaaacucaaagccaacuaggaagagaaaaaaauauccuuaggcugagaaaaaguauccaugaaaagcccauagaaaacuuuuauacuuaacggagaaacguuaaguauauuugcuuuaaaaucaagacuaagacaaacacaucuauuaucacugcuuuuauucaccaugguucuggaaguucuaggcaggcaauaagaacuuuugggcaugguggcucacgccuuuaaucccagcacuuugggaggucaagaugggaggaucaguugaggucaggaguuugagaccaaccuggccaacaugguggaaccucgucucuacuaaaaauacaaaaaauuagcugggcaugguugcacgugccuguaauuccagcuacuugggaggcugaggcaggagaaucacuugaacccaggaggcggagguugcaaugagcugagauugugucacuauacuacagccugggcgacagagugagacuccaucucacucuggaaauauagacuggaaaauaagaagcaaagcugucauaauucauggauaauaaucaccuacaagggaaacccaaaauaauccacagcuacucuggcacacugccugugugguagcccuguuccacaggagcaguuaaaaaaaaauaaaaagaggcuggaagcaguggcucaugccuauaaucccagcacuuugggaugccaaggcaggcagaucaccugagauugggaguucgagaucagccugaccaacaaggauaaacccccucucuacuuaaaauacaaaauuagccaggcgcggugguguaugccuguaaucccagcuacucaggaggcugaggcaggaggacggcuugaacccaggaggcggaggcuauggugacccaacaucaugccauugcacuccagccugggcaacaagagcgaaacucuaucucaaaaaaaaaaaaaaaaaaacuaaaaaaaaauuuuuuuaauaaaauaaaacacaaauauuacaaaacuguaguaaucaagacugugugcugcuggcauaaggagacauauacaucaauggaauagaauuuauaguccagaaauaaacucuuacauucccggucaauugauuuuugaccuaaguacuagacaacucaagaaggaaagaauaucuuuucaacaaauggugcugugacaacugaacaccacaugcaaaagaauaaagcugaaccccuaccuagccccacauacaaaaauuaagucaaaauggaucaaguccucaagaugagagcuaaaauauaaaaguagaggaugacacagguguaaaucuucaugaccuuagauuaggcaacggaaucuuagaugacauccagagcauaaggaaccaaagaaaaaauagauuaaaaaauccuuugggcuucaaaggacaccaucaagaagugaagagacagccgggcaugguggcucacaucuauaaucccagcacuuugggaggcccagacggguggaucacgaggucaggaguucgagaccagccugauaaaaauaguaaaaccccaucucuaauaaaaauacaaaaaaauuagccgggcgugguggcaggugccuguaaucuccgcuacucgggaggcuggggcaggaggcuugaacccgggagccgggaggcagagguugcagugagccgagaucguaccacugcacuccagccugggcaacagugugagacuccgucuuaaaaaaagaaaaaaaaaagaagagacaacucauagaaagggagaaaauauuugcaaaacaugcaucugauaagagaucuacacacagaacauacaaagaacuccugugacugaaugaaacacacaaauagugauuucaaaaaugggcagaaaaucugaauugacauuucuccaaagaauacacaagauaaaugaccaauaagcauaagaugcucaacaucacuaaucaucagaaaaaugcaaaucaaaaccacaaugagauauaauuucacacccauagggacagcuaucaaaaaauaauauuaauaauaaaacuggcaaggaaguggagaaacuggaaacuuugugcacuguuggugggauuuuaagauggugcaacuggccaggugcgguggcucacgccuguaaucccagcacuuugagagaccaaggugggcagauggcuugagcuaaggaguucaagaccagccugggcaauguggcgaaaccuugccucuaaaaaaaauucaaaagaaauaaaaauaaaaaauaucugggcaugguggugugagcccauagucccagguacuugggaggcugaggugggaggaucacuugagccugggaggucaaggcugcagugagcccuguuugcacaacugcacuccaaccuggguaacagugagacccuucucaaaaaaaaaaaaaaaacaacaaaauaaauaaauaaaauacggccaggcaugguggcucaugccuuuaauuccagcacucagggaggccaaggcaggcggaucacuugaggucaugaguucgagaccagccugggcaacauggugaaacaccgucucuacuaaaaauacaaaacuuagcuaggcguggugggacaugccugucccagcuacacagggggcugaggcacgagaaucacuuguacccgggagguggaggcuccacugagcugagaucgcgccacugcacuccaaccugggcgaaagguaaagacccugucucaaaaaaaaaaauuaauaaauaaauaaaauaaaauaaaugaugcaacugcuacagaaaacaguauggaagcuauucaaaaaauuaaaaauagaacaaccguaugaaccaguaauccuacuucuggguauccaaaagaaucuaaagcagggucuuuuuuugagagagucucacucugucaccagggcuagagggcaguagguacaaucucagcucacuguagccucaaccuccagggcucaagggaucuacuugcuucagccucccagguagcugggacuacaggcauacaccaucacaccuggcuaauuuuucuaucuuuuguagagacagggauucaccauauugcccuggcuggucuugaauuccuaggcucaagcuauccaccugccucagccucccaaagugcugggaucacagauaugagcuacagugcccggacuaaaacagggucuuguagagauaucuguacauccaaguucacagcaacacuauucacaagagccaagagguggaaacaacccaaauguccauuaaugaauggauaaacaaaacauggcauauacauacaauggaguauuacucaaccuuaaaaagcaaagaaauuugaggcauacuguaacaugaagucugaagacauugguaagugaaauaagcccacugcaaaaggacaaacaguguauuucuacuuauacgagguucuuagaaauucagagauaaagaguagaauggaggacagaaaaaauggggguuacuauucaacgcauacuaaguaagugaaauguuuuggaaauggaugguggugacaguugcacaacaauaugaauuuauuuaauauuucugaacuguacauuuaaguaguuaagauggcaaacuguauguuuuaccaaaaaagacuggaaaaaagaagaaauacugucacaugcuacaacauggaugaaacuuaagacagauauuaugccaaauuaaauaagccagucacaaaaagacaaauacuguauaaguccacuuauaugaaguauuuaaaguagucaaauucauagaaacagaaaacagaaugguaguuaccaggggcuggguauggagugcagauuugcaauaugguaacauucuggggguuguuucacaacaauuugacuauucuuaacacuacugaacucuacauuuaagaauggauaaaguauuuaaaaaucgaauauuugagauauccuuagauuuuauguaauguguuuuuuacuaaaauaauaauuucaaguaauaaauuauccaauuaucaggcugggcacuguggcucacaucuguaaucccaacacuuugggagacugaggcaggcggaucaccugaggucaggaguuugagaccggccuggccaaccaauauggugaaacccagucucuaccaaaaacacaaaaauuagcugggugugguggcgugugccaguaaucccagcuacucgggaggcugaggcaggagaauagcuuauacccaggaggcgaagguugcagugagccgagaucacaccacugcacuccagccugggugacagagcgagcuuccuucucaaaaauaaauaaauuaauaaauaauccaauuaucacuauaacuauuccaauuaccauaauuaugauagaauauuaccauucuauuuccauuuauuuuuaccaaaauaaugaaucuagguaacaaucaucaauggcugcugaaaaugcuaagugagaaacuucauaauagauaaauuaaccugacaauaccuaaaaacaauuacgauuuuaacaacacaaaagagggcaaccagacauuauaugcuucucaauguaacaaaauagaagauauauacacaacacuaccgaugacacagucaugccagauaagcaucuacauuuauaggaaagacaggagacagaaaaauccauugaaagauaccacaguaauacaaucgccaaacuccagaaugugugaaaacugacauaacaaaggacuugauuucuuuggauauuaagcugcaagaaacgggacgggggugggggggcgggguggagauuuauaaauaaagagagucuuaaaagacacuucaaacauacuuaauguucuaauuuauuuggaucauuguucuuaacaaaaacugccaacacuguuaaugagauaaccagggaaauuucuacaugggguauuugaugagauuaagggauuacugaugauauuaagggauuauuuuuagugugauaauguugcaguuuuaaaaaauaaacaguccucuuuuagaaauguuacccaaaaagcuaaauauagaauuaucauaugacccagcaauucuauuucuagguauauacacaaaagaacugaaaauggauacucagugaaauagacacuggcuuuaucaugacagggauauucacucacugaauaugcccauuacccaggucaugcugguuaaggacaccccuucaguguggaccccucauacaacaugacuguagcaaaacugacaaacaguucuggaagccuuauuagauuugcuaucucaacuuccucucaugggucucacagaugcuaauaaaaaaacaacagguucauuaacaggaaaauggugaaaggcagaugggaaaagucaaaggacaaagguggaaauguuuaaaggauuauuaaggaagugaguaaagaaaacacugauggggugaaacuaaagggaaaaagaaauuuugagauaacacagaauugauacugcagaucaguggggaauuacagucuuucaauuaaacauacugauuaaacauuuuaauacagcacuaccaaagguggguggaccaaagggaacucugcugauuaaccaacauuaaagggcuucaaacaaguuucuugcauuuaccccaguuuggagaaacuuuacaagcugaaaggcagagaccacaaagagaaagaugaucaacaauuguguggggcaauguugaggcagguuaaucaagauaaagacugacaaacagccaagaguacuuuggcucaaucccuugcuggggacccaaagccuuauguacaccaguggugaaggggucaggguguggaguagaaaccuuucuggggcuucgugacacagaagcacaaugcacugugauuucaaaaccuguugauaaaguccuaauggaggcuauacuuaggaaaguaaguguugauggaauuaggauaaaauuuuauaggcgaguuguuauaucugaagcugcuucaaugugaagugguuccaucuuuucuacuugauuguauuauggggauggauacuguaucugccuggagaauguucccucuaccuacuccuguaaaacagaaggcauguaaacuuguccuucaagcaauaauaauuagacaugcuaaaugggaaccagaaagauucccugagccuacacaacagagaauugaagcugaagugcugguagggacaaacugauugcggagcguuuaccagggcuuauggcaaaagccugugagugccucccagagaugacuccugagacuuuggacuagagaauuaccacuugaggggcauuuauuaccuugcuaugagacauuaauugaagcuaccccuauaauugaggacauaaaauaaucuugaaaccugaaauacucaugcugucuugcuggcggaugucagagaaacacuucagugaggauggcagugcccaagagaguuccauaauacaauggaaaugguuuauacaggcucuugcuaccuggaaaaugcaaggaggucuuugcauuccccagguagcagaaagccucuuuuccccuaggacugacucuggaauugugugaggaacugcuggauccuauccacacuuugacaguuucccaauaaacagcucccaauagaccaauaaagagcugcuugguuugcagauggcaguuccaaggugaauggacaacauccuauuuggaaggaaggacgccaaugggaucaaagaagguaaaaacaaaucagcagcauguguugauugcauguuguuuuucuagcagugauggaagaauugaacagugauaaaagcccguguuaggcuuuuuacucacuuaugggcaguggccaguggucacaugaucaggcaggagagcaauggaaaccuggccuauuaaagggauguccguaugaggcauggcccuauggaaauuugaagggcgcauuaaaguaggacaugucgaugccaaccagaagaaaucccuuagauguguugauauggggguacugcaacagugcagagaugggcugagucuagacauguuccuuuuccacccucucaagaacaaaacgccaauaagaacuguucugucugccaggaagagaaagauagugccgacagcuauggggagauucccugguggcaaggcccugaacgcugcuggccagugagacugaugcuggcaacccuaggggacuacaaauggguccugacagguauaggcacugacucugaacuggguuuuacuaucccaacagaccaugcaaaugcuuucagugcuaaagaaauaccacaauagaaccauuuaaaaauuuccaccuuccuggagugagccguuugacucuccccuuccccauucuuuuguuaauuaaccuaauguuuuuauuagcaucuguaagacccaugaggggaagcugagguagcauuucacaggagaagggugacaauuucccaaucuaagauaacaaauuugagagcaaugguuacucucaagcccuguuaaagagaguauaaauagguaaaaaauuauuuuggaaaagacugucauuaccuauaaaguugaagauaagcguaucuuaauaccuaccaacuacaucacuagauauauacacuaaaaaaacucucgcauacaaggacaagcagcaugaauccgaacagcucacagcaggcuugaauagcaaaagcuugaaaacaaccccaaagucaaucaacaaauacauacaaugugguauauauucagaccauggaauacuacacaccagugaaaaugaaugaacuacaguuauaauccucagcaugggugagucucaaaaagaacaauguugaccgaaaaaaguugcaguguguaccaagagaaacauaugagaauacucacagcagcaucauccagaauagcucaaaacuguuaacggcccaaauguccauuaacaccaccucgccuuccucccagaagguuccagaagguucuccuuggucucuccucccagaagccuccguggcuuccagagucccauucuccuggcuuuccgugggcacucuucaccuccccagaccucugaacauaggcagcaaccagugcuuaagcugcagaaccuuuucuuuccccuauacccacucccuuggagagcuccucagucucacagcuuuacagagccuuuauagguuacgauuccaaguccaccuaccuccagccuggaccucuccucugaacugugcaccugggucuccaccaucuuucugacacuucugccgugaaugucuaacaggcauuucaaauuuaguauuccccaaacugaucucuucaucuaccaucucaaaucugcuccaccuacagugauucccaucuugguuaaaugcuucaguugcuuaggaaaaaaauuuuugagucaccuuuaacuccucucucucucacacaacccuaccuccucaguaaguaaauccuacugccuuuaccuuaaaaauaauauaugccggaaugccagcacugcuuacccuccaccacagcagccuggccuggguucccuaaucugacccaugcuugucacuaccuccucccccacauucuguucucaacaccacagucagagugauggaaaauggaaaucaguuuauaucauuccuuugcuccaaacucuucaaaggcuacccaccuaacucacagcaaaagcuaguacuuaggaagguucugaaugauccaccuccuucucuuuccauggccccaucccuuucggcccuccucacucacuaagccuuagcccuggccuccuugcuguucccugagcaagccaaggugcacucccaucuuagggccucaaaugacuuacucccucaccuccccugcacauucuuaaaaguccaucccagccaggagcaguggcucacaccuguaauccuagcacucugggaggcugaggcggguggaucaccugaggucaggaguucaagaccagcuggccaacaugguaaaaccccgucucuacuaaaaauacaaacaauuagccaggcguaguggugggcgccuguaaucccagcuacucaggagguugaggcuugaaccccagaggcagagguugcggugagcgcagaucgcgcuauugcacucuagccuggaugacagagugagacuccaucucaaaaaaaaaaaaaaaaaguccauccaauuggaaauacaguccccagcacucuuuuuuucauuucuuucuucuguccuuuuucuccaugguauuuaucacauucuaauauauuaauaauuuauuuacuuguugaucuucucccacuaaaaaacaagcuaaaugcaggcagggcuucaagagugcuuggcacauaguugguccucacuaaauaaaugcuaaacaaugaguaaaugaacaaaugaaacuuuuuuuuucuuuuuaagagacggagucuugcucugucgcccaggcuggagagcaguggugcgaucucaguucacugcaagcucugccucccggguucaugccauucuccugccucagccucccgagcagcugggacuacaggugcccaccaccacacccagcuaauuuuuuguauuuuuaguagagacgggguuucaccguguuagccaggauggucucgaucuccugaccucguaauccgccugccucggccucccaaagugcugggauuacaggcaugagccacugcacccggccagaacuuuuuacgugcuuagaauugugccugccacauagcaauagcucaguaauaagcuguuauuacuauuauuuucaaagggcugaugugauugacagggaacucacauauacuugguuuguuauuuucugcuaguucagcaaaggaccaagacaggauauaugguaccuacuugcuaauacuuccuuguuggcagcacuccccucuacuucagaugguucuguagcaacagugucuugacugggcuccuuaacucucucaucagugagaaggcugacugccugaguaaugucaccauuacuggccuaugggagaaaaagacaauagaaauuucaaaaguaaucauagaauuuaaaaccaguuuugaguauuaacuuuauuacccuggugacacacugaguacuuucaggcauaauucuaggguagaauuaugagacuaugguggacaguaggucuaaugugcuugaagcgucuauuaaaugccucauuacaggagggaguuuccaugcucugacuucccacaacacccaaacaaaagugaaaucuugauggagauuuguucccauugcuucggauacuacuacucaugauuucucugaacagucuaaagcacgaugugucaaaaaagggggcuggcaauuaacauagacauucuaaaugaagucagcccuacaauaaaaaugccaagcagggcaggcgcaguggcucacacgccuguaaucccagcacacugggaggccaaggcgggcagaucgcuugagcccaggaauuggagaccagcuugagcaacuuggcaaaaccccaucccuaccaaaaauacaaaaacuagccaggcgugagucccagcuacuagggaggcugaggugggaggaucgcuugagcccaggaggcagagggcagaggcugcagugagccgagaucacaccacugcacugcaggcaaggcaacugagugagauccugucuccugucucaaaaaaaaaaaaaaaaaaaaaaaaaaagccacgcaguuaccuguuuucuaguggugaucauucuuguuuuuaauguuuuaugaggaaacauuucuaacauauauaccaggaaagggaauaacagaaccccauguaccuaucacucaucuucaacaauuaccuagucacuuagucauaaccuuucuuauuuucucuaaaccuccuauacucucguagauauucugaaucaaacccuaaccaucuuaucacuggucaacauuucagaacauaucuuuuaaaaauauaacccauggcccggcgugguggcucaugccuguaaucccaacacugugggaggccaggucggguggaucacuugaggucaggaguucaagaccagccuggccaauauggugaaaccccgucucuacuaaaaauacaaaaauuagccaggugugguggcgcaugccuguaaucccagcuacuugggaggcugacugaggugggagaacagcuugaaugcgggagggagaggcugcagugagccaagauugugcuacugcacuccagccugggcaucagagugagacuccaucucaaaaaaaaaaaaaaguauauauauauacauaccuuaagaauaacaacagguuuuuucaauaucagauaaccaguucaaacuucccugacucaaauauuauuuaguuugcugguuuggaucaggaaauauaaggccuaaacagugcaacugguugauguuucuuaaaucucuuuuauacccugcaggguuacccgaaccacaaaucucccccagccccuuauaauuuacauguugaagacauugggucagucauuugaccuguagagcuucugucccuauaugugcuuuaauuugggaauagaaauagcuugaacugacauaacuauaauauagacagcugcuuuaaagccuccugacuaacagagaucuggaaaccaaccuucagagcuucauggagaaaggaaggguccugaaugccugugauuucucucaguugauuuaacagcauuuggcagcucuauauuugcaaaacaaaaaaaccacaaacaugucagucagaaaguaaaccuggguacauuuaaagaauaacuaaaagcaucuuggauaaacaggccugaggcuugcccaggcuggagugcaguggccggaucucggcucacugcaaccuccgccucccagguucaagcgauucuccugccucagccucccgaguaguugggauuacaggcacaggccaccacgcccagcuaaguuuuguauuuuuaguagugacgggguuucacauuguuggucaggcuggucuugaucugcugaccucgugauccacccgccuaggccucccaaaguccgcugggauuacaggugugggccaaugcaaacggcccugcauuuuuuuacucuaaagaaccaacaagcuccaagaaacaagguauuggcugucagaaauauucugaaaugccaaaucuauuucucuuuuaaaaguucaaucauggaaauaccuuugguacuuacgaaagaaauagaugacaguaaaauuacaaauauauaaaacauuuaaauguaauauucuagccuuaauggacacuuaaaaguucuccagguuuuucuuuugguaggcagugcauuaaguagggcauauaaggaguccggggaauuugcauggauauaaagaugugcuauuuuaagcuuuccugcacaugccauuaguguguaucauuuuucacugacaauaaguuuccaaucauguaauuaaccaaugauaacaccaacauauuuaaaacucuguguuugacuaauuaaaaaguacagcuaaagcuagaauuuucucaauuaaauacauaauuucaaaggguauaaaguaugaaauguuuucucuucauuaaccuaaaucauggaaaaaccuaaauuguuaacuuccagcuaacacaaaaucaguuuacaaccccuucagccuuaacaucuucacucuaucauuuuauccuguuuuacacaaagacaauacaaaacaccgauuugcaaguacagcucaaucuaaacaacuggcuggcccaacuugagacacaaugaucuuuuuagaugaauguugaaaacaaaguaguucgaaauuaauucagcaacaagaaaucuaauuuauaccauuccuaagguuaugcuuaaauuaaguuaguaguaugucucagagagauagccuacauuuacucccagcuauaauagaaacaguaucuuauguucuucaacagcugugggcccaaugcaacacuaaaguauuacacaacuagaaauaacuaacugaaacaucccucuaaaguccuaaagaggucgggcaugguggcucaugccuguaaucccagcacuuugggaggccagggugggcagaucacuugagguugggaguucgagaccagccugaccaacauggccccgucucuacuaaaaauacaaaaucaguugggcgugguggcacgugccuguaaucccagcuacucaggaggcugaggcaggagaauugcuugaacccaggagguggagguugcagugagccaagaucgcggcauugcaacucuagccugggcaacaagagcacaacuccgucucaauaaauaaauaaauaaaguccucaaagaagcaccaacagucguucugcuguagucagacuauagucauaggcuacaaauggaauccuacccugcugagaccagcagacuuucacgcuaugagucuugucaacuccagucauugccugugcacugggagagugauuaucauacuaaaagguauccagauucagccugagcaaaaacuaaaaucgcaagcauguaauuuuuagaaaaauuaaauacuaguuguuuuaaacuaauucuaauuccauuugauuuuacuguauaaaagcgguaugaaucuauguaucucacacaaaucacacauaauuuucuaaaagaucaacaucaauauacccaaaaaaggguggaauaaucgagagggggaaucaguaguauauuaauaccaaacuagcgucaagaagguaacaaugggauaaucccaucuucauugggaauuauucuguauaaaaauuaacauuuaugauucagagaaaauaauccaguaaaaaguaauagcuaacauauacugcuuacuuuuagccaggugcugcuauaaacacuuagcaaguauuaacuaauuuaacucacugaacccucauaacagaccuaugacauagguauuacgccuguccuacaaaaagcugaggcacagagagauuaacuuuacacaaaguuacugcugauaagggaugcacuauaccacgcuguaucugagaagacaaaaagauaggcaagaauaccuaucuaaugcaaaaaaacgcaaauaucuuauucuuguauguuuuauuuauuuuuauuuauuuauuuauuucugagacagagucucacugugucgcccaggcuggagugcaauggagcaaucucggcucacugcaaccuccgacucccggguucaagcgauucuccugccucagccucccaaagugcuaggauuacaggugugagccaccacacccagccuauuuuuauauuuugaccuugaucuuugcacccuaacaaguuuauuuuaaaaaucugcuuguccuuauacaaucacaaguuugauuacuuaguagugcaaucuguucuaaaccagcuaucaucagaaguagagagguaaauauuacauuugacuaaaucuaaggugccaucgguugaaaacaaagaaaggaaaacugcugccacuugaacuaugacacaaugucuucacggcaguccugggagacauauaaauaagucacacuagcuucuuaaaucucugaacuuuuucauuuauguugaggaauacagcaauuuccccugcuuccaggugcacugcuuggcaugugauaggcaauucuuucacauauuucucggcaacaaaacuuaacacagcauaauacauuuaugcuaucuucccuucuggguugcauaaagcacuugacuguagcuuugcaagaaaaucugaaacuguaaacauuccuccaaagguaaauauuuugcuucauauaaaaucaaauuuauaccccgccauucugcuuccaugccuuucuucauacacagguuuuuugguuuuuuuguuuuguuuuaaucucaauguugaaucacaguguaaauuuuuaagugacauacgcaauggcaaguaaaccaugugguacuaacagacugucaacuguuguuauaacaauaguaacagcuaugaccagguucauacaagugcagacaaugacaacaucacaucugcuacuuggaugauaguaaaaauguuaagaacaucuugaucucagagaucucagaaugccaaauaaaugugaaucaaugaaauauaguauccaaauacuaauuuacuaauuauuuacauuugaccuuggauuaaagucaguuacacuguaauauuaccauuccucuuucuccauuuuguaauagguagcaguggacaucaauauaucugggauaacacaaucaggaaaggaaaauaaacucuuucguuuccuuuuuuuuuugagacagggucucgcucuguggcccagacuggagugcaauagcaugguacaaucuuagcucacugcagccucggcaucccaggcucaggugacucucccaccucagcuucccgaguaguugggacuacgggugcccaccaccacgcccagcuaguuuuccuauuuuuaguagacaugggguuucuccauguuggccaggcuggucucaaacuucuggccucaagugauccaccugucucagccucccaaaguacugggguuacaggcgugagccacugcaccuggccuagugaccuuuuuuuaaaggcuacuggguagagaugacaacuauguaaaauaauuuuguauagcuccaacaacaauguucuacauggaaauucaaauccaaauuccucaucuugucauucaaagaccauuaccugauccccccuuagccuguuccaccuuuucuccucucaguuccuuacugcaaacucauucucucaugcauagacuguugcuccuaaaaucacuaguaauaccaccuacauuauuaaacuaugguaugccaacuacauucagggguuauauuugucuuaccuccuccauaugaaguccuucuaagaacucuggcccauacuguucucuccccuuucucaucucccauguuaaggaaaugaauacgccugugacugaauguggcucccugucuucacuugauauuccucaucaugugguucucuaauuguuuuauuuuauuuuaauuuuuuuugagacggagucuugcugucacccaggcuggagcgcagcggcgcaaucucagcucacugcaaacuccaccucuuggguucaagcgauucuccugccucagccaccugagcagcugggauuauaggcacccaccaccacgccuagcuaauuuuuguauuuuuaguagagaugaggauucaucauguuggccaggcuggucccaaacucuuaccucaagugauccacccaccucggccucccaaaguguugggauuacaggcaugagccaccgggccaggccuguucucuaauuguuuuaaauaugaaauucuugccuucuuuaaaggaagaaucaugcaguacacugccuaauuugaaucauccauaggacagugcugauaauaaugagaacuaacauuuauugaacaacuacuuuaauuuuuuuuucuuuuuggaaaugggggucucgcuauguugaccaggcuggccuaacugcuggacucaaaggauccucccaccacagccuuccagguuguugggacuacaggcacacaucaccauaccuggcuuaacauaugacaggaaacaggcaccuuacaugcauguaauccuaauaacaaaggcaggcauugcacacguuaggaaauuaagguuuacaaaaucuauuuaucaucaaaugacuugaauuaaaagcuaaaucaaagauagcuauaaaacacauagcuauuaagggucuaagugcuugcuugagcaguacauuaacuaaaauuggaacaauacagagauuagcauggacccugugcaagaauaacaugcaaauucaugaaguguuccauaauuuaaaaauaaaaauaaaauguaaagaguaugguaugaauaacaaauuucacaugcauuauuuauauacauauacaaaugcuaugacaugacccagucuuguaaagauuuagcuaaaguucuuaacagaacccgcacuccaaauccucguacuauauauauauauuuauauaaauauuaauuuuacaguaacacuaaacccaucaggauccuaccauauuacuaacucacuucaccugaacuucacagaaagaggauuuaaauauuaacuucacucuaccuugcuauauguaaaguacacacccaacaaggagacaagacaaagccuguacuccucucacaaugaagucaaauaacuugcaagagccaacagguuugcauuuccugagcuaaauucacauuguuuucacaaaacaaaaaguacucccuuuucuugcccagaggcaguaaagaaagacaggcaaacacaaaccuuuaccaggaaggaacucaagcuuuuugaccucacugcuacucagugguuuuggugcaaucuagcccacuucucaggaaggagauuuucuuagagcaaaaacaacucacccacaaucagcaauuaacaagauuauucagacacuaaaaaccuuaagcuaucaaguuucuguaacaaucaauaccuggccugaucccacaguaacuagguuaaaacucucugaugaaauaaugcaaaauauuucauuacuaaucguuaaaacuccuaauuuagcauugugaugagaagcuuuauagguuauuccauuccuucaaacagugaugcuauuuucaucauucugaugcacauauuuccugauaucaauugucuagucuuacaaagacauuucuaaauuuacaacuaaguaaauaauuaauaaauguucccuuacuccaaagaacuaccaaggugugccuaauaaaauuccuuccaaagcuaaagaucugguucgcaauuauaaaauaaaacuuaaguacccaagggaagcaaaaaaaaaaaaaagaaaaaacaaaaaacaaaaacaaaaccaacugaagagucaaagaaaacauauaguaucaaugccaaaaacucuggccaggugcaguggcucaugucugugaucccagcacuuuggaaggugaaggcaggcggaucacaaggucaggaguucaagaccagccuggccaauauggugaaaccccaucucuacuaaagaaaaaaaaaauacaaaaauuugccaggcaugguggcgggcaccuguagucccagcuacucgggaggcugaggcagaggaauugcuugaaccugggaggcggagcuugaagugagccaagauugcaccgcugcacuccagccugcacaacagagcaagacugugucucgaaaaaaaaaaaaauaagggccgggcuugguggcucaugccuguaaucccagcacuuugggaggccgaggcaggcagaucacgaggucaggagcccgaggccauccuggcuaacacagugaaacuccgucucuacuaaaaacacaaaaaauuagaugggcgagguggcaggcaccgguagucccagcuacucgggaggcugaggcaggagaaccuggcgugaaccuggagguggagguugcagugagccaagaucgcaccacugcauuccacuccagccugggcgacaaagcgagacuacaccucaaaaaaaaaaaaaaaaccaccucugucuggacaacagagaugguugcuaaccuuuccaaccuccauaaaacaaggaauggcccucaaaagccuugguauuuuuucaguuuuucuuccagcaacaaugcccugcugauccaauuuauucauggaauagaaaccuaaaguagccauaagaauauggcugucuaaaaaagauaaacagcagcuuucuguggacacagcuaaauucccugaaauagacuacuugauaauuuuugugaaugaugcaaaugucaguacaugaugaaaaugccuguuugaguuuauuaacuggcuuaaaguuuuuaaaaaccauuaaaaguguuuaaaauuuagccacuauuauaucauguagagggguuaaaacugggacuuaaaaacaagaaaaaaaaggaauuaaucauuauuuacuuuuuaaauuuuuuccaucucuuucuucacauguacuaagagauuccaauaguacaaaaggguauaaaaugaaaaggaaaucaccuucuucccgaccuaguucuauuucccaggggcuacuaccauuaacaguuucuguuaucuuucccgaaauugucuaugcacaugaauauauuuuuucauaugauacauaauguccuauaccuugcuuuuuccuuauuuuagaauacauuaagacaauauuuuucauuucuuugaauacauguuccaacuaaauaugagaaaugaggcugacaaacauaucgaacacaucuccaaaaaugaaggaaaauacaauuuuuaacaacauauugguagggcuaauugaaaaacugggaaaauaucagggaaagauaugagaaaucaaauuuacaugcuuacaguuuuagaaauauagcaaugguaaaauuuuaaguuauuacuagcugggucuucguguguaguuucuauuuuuaauaaauaacagagauugcugggugugguggcucacgccuguaaucccagcacuuuacggggcugaggcgggcggaucaccugaggucaggaguucaagaccagccuggccaacacggugaaaccccaucucuacuaaaaauacaaaaauuagcuggguguggugacaggugccuguaaucccagcuacuugggaggcuaaggcaggagaauggcuugaacccaggaggcggagguugcagugagcugagacugcgccacuguacuccagccugggcgacaagagcaagacucugucucaaauaaauaaauaacagagaucagagaggugaugugggauuggauuacaaaggguucuaaaugucaggaagaguuuagguuugaucugaugaacaauggauaaucacugcaggcuccucagcagggaagauauacgaaggaagaaaaggcauuuaaguggauuaaucuagcccacgugaacaacugguucaacgugggaugacacuaggaaaagaaagcuugaguuacagggcuacugaguaaacgaacugugacgagagaggcaggaugcugguaggcaaaacaucaaaguaggacauacucugaacaucucaaagaaugaagagagaaagcuuagucauacauuugcaauggaugccuaagagaaugccauugccaauaacauaaaaggaaaccaaacaaugugauauaccacaccaacagaaugaaggagaaaaaaaacaauggucaccuugauugauacagaaaaacaucugacaaaauccaacacacauucauaauaaaaacaaucagaaaacuaggaauaaaagguaauucccucaacaugauacagggccuuuauaaaaaaaccaagaguuaagaucauauucaauggugaaaggcugaaagcuuuaccccuaaaaucaggaacaagacaaagaugcccacuuucaccacugcuauucaacacuguacuggaaguuuaagccagagcaaccaggcaagaauaaaaaauaaauggcaccuaaauuauaaaguauaaaaaaguaaaacaguauucacaaaaugacaugauccuauauauacaaaaucccaaagauucugcaaaaaaguuaccagagcugguaaacaaauucagcagcuucaagguaaacaggcaaaauucaguuguguuuuuauaaaacagcaauaagaaaucaaaaaggaaauuaaaaaaaaauuacauuuacaauagcauccuaaagaauaaaauacuuaggaauaaauuugaccaaagagguaaaaaaccugggccgggcgcagugggucacugcugaggcugggugcgauggcucacaccuguaaucccagcacuuugggaggcugaggcgggcagauugcuugagcugaaguguucgagaccagccugagcaacguggcaaaacacaucucuacagaaaacacaaaaauuagucgggugugguggcgcgugccuguagucccagcuucucagaaggcugaagugggaggauugcuugagcccagaagauggagguugcagugagccaacauugugccacugcgcuccagccuggcaacagagugagacccugucucaaaaaaaaaaaaaaaaauuaggccgggcgcgguggcucacgccuguaaucccagcacuuugggaggcugaggcggccggaucacaaggucaggagaucgagaccauccugacuaacacggugaaacccugucucuacuaaaaauacaaaaaauuagccgggcaugguggccggcgccuguagucccagcuacucgggaggcugaggcaggagaauggcaugaacccgggaggcggagcuugcagugagccgagaucgcgccacugcacuccagccugggcgacacagcgagacuccgucucgaaaaaaaaaauugcuggucacgguggcucacgccuguaaucccagcacuuugggaagcugaggcggauggaucaccugaggucaggaguuugagaccagccuggccaacauggugaaacccccaucucuacuaaaaauacaaaaaauuagccaggcaugguggcaugugccuguagucccagcuacucgggaggcugaggcgggagaaucccuugaacuccagagguggaggcugcagugagccaagaucucaccacugcacuccagccugggcaacagagugagacucugucucaaaaaaaagguaaaaaaacugaugaaagaaguuaaagaccuaaauaaauugaaaaacauccagguucaugaacuggaaaacuguacuagucagaguuccccagagaaacagaagcaaaaggagauaaauauaagaggugaaauuuauuauaaggaauuggcucacaugacugcggagacugagaagucucaagaucugcaguuagcaagcuggagaaccaggagaccagcgguguaguguuaguguaaguaugagacccaagaaccaggaaaguugaguguguaaguuccagucugagucugaaguccugugaaccaaaagagcugaugguugucuaaguuccagugccaggaccaaggaaaaucaaugucccagcucaaguagucaggcaagcaaaguuuccucuuacucagcauuuuuguucuauucaggucuugauugaaugaggcccacuacccacauuagggaguucaaacugcucuacacagucuacugauucaauguuaaucuuauccagaaucacgcucacagacacaccuagaauaauguuugaccaaaugucugcauacauaccucauggcccagucaacugacacauuaacuuaaccaucaugaagacaguauuguuuuuuggagauggggucugucucugucacccaggcuagaguacaccucaaccuccacccuguaagcucaagcgauccucccuccucagccucccaaguaggugggaacacagaugugugccaucaagcccaacuaagauuuuucauauuuucgguaaaggugagguuucaccacguugcccaggcuggucuugaacuccugaggucaagcaaucccccccgucucggccucuucccaaagugauuacaggcgugaggcacugcgucuggccacgaagacuuaauacugugaagguggcaauacuacucaaagcaauucaaaaguucaauguaaucccuaucaaaauuccaaugguccuuugugugugcguguggcuggggguugcggggaacucuagugaaaaccagaaaaccugcuagacaaauucuaaaagagcugcaaugcuuuggccuuucuugcagaaacagaaaagcugauccucaaauucacacagaauuucaaaggaccuggaagaacuaaaacaacauugaaaagaagaacaaaguuggaggacucacacuucuuauaucaaaacuuaguauuaauccaaagcuacgguuaucauaacaguguaguacuggcauaaggacagauauauagaccaacagaauagaacugagaauccagaaauaaacucguaucuguggucaacugauuuucaaccagagugccaacaccauuugaugggggaaaaaucaugucuucaacaaaugguauugguacaacuggauauccacagcagaagaaucacacuggaccccuaccucacacaauacacaaaaauuccucaaaauggaucaacaaccuaaauaaauaacuaaaacuauaaaauucuuagaacacagagauaagucuucaugaccuuggauuugucaauggauucucagcuaugacaccaaaagcacaagcaacaaaagaaaaaaauaauaacacuuuugagccaggcauggugguguguaccuguagucccagcuacuugggacacugaagugggcugauguacuuuucugcaucaaagggcauuaucaagaaagugaaaagacaaccgguauacaaauucaagaaauaaacacauacaucaagaaauccaacaagaaauauacagugcuggccgggcacgguggcucaugccuguaauccgagcacuccgggaggccaauguggaucaccuaaggucaggaguucaagaccagccuggccaacauggugaaaccaucuccacuaaaaauacaaauauuagccagguguguuggcacgcgccuguaaucccagcuuccugggaggcugaagcaagagaaucacuugaacccaggaggcagagguugcagugagccgagaucagaccacugcacuccagccuaggugacagagccagacucugucuuggggaaaaaaaaagaaaaaagaaauacacaguguacaaauuaucaagaaagugaaaagacaaugggagaaaauacuuuuaaaucauuuaucugguaagagucuagcaucuggaugauauaaaaaacucucuuugaacucccuuuaagucaacaaccaaaaaacgagacaacccaauucaaaaauggacaaagaacuuaaaaagauauuucuccaaagaagauauauaaauagucaauaaguuuaugaagacacuuaacauuagccauaacauuaacauggccaaaucaaaaucaugaugagaugccacuucacacccauuaggaugacuguuaucuaacaaaaacaaaaaauaacaaguguuugaugagaaaagagaaaaacuagaacccuuguguauugcuggugggaauauaaaacuuccccagcaaccuuggaaaacagucuggcaguuccucaagaaguuaaacauagaauuaccauaugagucaacaauuccuucuagguauauacccaaaagaagggaaaacagguacucaaauacaaguauaugaaaauucauaacagaacuauucauaauaaccaaaagguguaaauaacucaaauguccgucaauggaagaauggacaggcaaaacauaucuauacauacaguggaauauuacucagugauuaaaaugaaaaacucauacaugcuacaacuugaacaaaucucaaaaacauuacaauaaacgacagaugccacacauaauaggucacauauugcaugauccauuuacaugaaaucucucuaauacguaaaucuagagacagaaaguagauugguauugccagggguggagggcaugggggaauagggagugacugcuuaaugguuacaaaguuuucuuucaggguaaugaaaauguuuuagaacuagacggaauuggugauugcacaauauugugaauauauuaaaugucacugaacuuguacacuugaacuuuuuuuuuuuggagacagaguuuuacucuugucacucaggcuagagugcaguggcaugaucuccgcucacugcaaccgcugccucccggguucaagugauucuccugccucagccucccaaguagcuggaauuacaggugcucaccaccacaucuggcuaauuuuuauauuuuuuaguagagacggggcuucaccauguuggccaggcuggucuugaauuccugaccucagugagccaccucacccagccccacuuuaaaauaauuuuauguuauauaaauuuugccucaauugaaaaaaaaaaaaucaccugggugcaguggcacacaccuguaguuccagcucugcagcaggcugaggcagaaugaucacuugugcccaggauuuucaaacaguaguacaccacgaucaugccugugaauagccacugcacuccagccugagcaacauagcuagaccccaacucuaugaaaaaacaaaugaauaaggaaaccuguauacacauccccacacaaaaggaaagaaggaaggggggagggagggagggaggaagggagggaggaagaaagggaggaagggagggagggaggggacacaagaaaguacuaacuugggcaagaagauugaaaaagaaaauguuguuuagaaaaucuucuuaggguuaaagugccuaccagccaucauguagcaugcagcugguacuuacugaggcagaucuuuaguuugguuuugugugucugauauuuugaccccuguuuuacguagaaagccuagacgcuggaaauagugccaugcagcccagacuccagcacacaucagccuccuggcaaaucucaaucuuccucagcaucaguuuccagaauggaaaaugaaguacaccaaaagcuuugacagcccuguaugacuaucaaaggaaguacugcaaauaaauuguuagcaaaaugaagaaaugcaauagaaaugaaaaauacugggacuugccuguucaacuaaacuccucuagaguuuacaguaaaaauacugauauccuguguuauaguuuugguuuuaucacuuacuugcugugucacuuugcaaauucuacuuccugcucauacuaaauuuuauuucauagagugccuaugaggguucaaugaaaaguuauuaaaauuauuaaagugcuacauagucaagugguaagucagaaacuuugguuuuagaaaggcuuguacuaaagucggagaaauguuaugcuucaagucagaauggcuugaagucacagcucugcuacuuauaauucaaucauggucauaagcugcauuucucaucuguaagauagaagcaaacagacuucaguuuaaaaucucauacgaauaaagaaaaaaagagauagguaccaugguucacgccuguaaucccaaaacuuugggaggcucaggcgggaggaucacuggagcgcgggaguucaaaaccagccugggcaacauaaagagaccccccaucucuacaaaaacuaaaaauauuagcuaggcaugguggcacaugucuguaguuccagcuacucuguaggcugagguaggagaauugcuugggcccaggagguugaggcugcagugagccaugauagagccacugcacuacuccagccuaggugacagaguaagaccaugucucaaaaaaaaaaaaaaaagacaaaagaaagaaaaggaauaaauaaaauaaaucucauaugaggcccuuauaaggcauacuaacaucugaggucaggcacgguggcucaugccuguaaucccagcacuuuuggaggcugaggcaggaugacuugguucauaaguuugagaccagccugggcaacacagagagaccccauugcuaaaaaaacuuuuaaaauuaaccacaggcuggguucgguggcucacgccuauaaucccagcacuuugggaggccaaggcagacggaucaccggaggucagguguucaagaccagccuggccaacauggugaaaccccgucucuacuaaaaauacaaaaauuaggcgugguggcaugugccuguaaucccagcuacuugggaggcagaggcagaagaaucaauagaacccggaaggcggggguuacagugagcugaucucacgccacuguacuccauccugggcaacagacugcgguccgucucaaaaaauaaaauaaaacaaaaguagccaggugugguggugcauaccuguggucccagcuacucaagugucugaggauugcuugggucuggguggucaaggcugcagugagccuugacggugucaccacacuccagcuugggugacagagugaaacccuaucucaaaaaacaaacaagacaucucaguuuccucaucaguaauaggguaauaguucacaccuugcuggguuuuuguaaauaaaaauguauggaaaagugcuuagggugguacauagcauauggcagacacgaguaauacaaguguacauucccaugccuaguauaacaacccugggaaaauaaguaugaagcaaacguuuauagccaaggagguugauauucaagcagaccuguucaaaaagcacugggaaacagaguauagaagucauuugcaacucaggauuagaaauguagauuuggagccagguguucacgccuguaaucccagcacuuugggaggcugaggugggcagaucaccuggggucaggaguucaagaccaaccugacaaacauggagaaacccugucucuacuaaaaauacaaaauuagcugggcaugguggugcaugccuguaaucccagccacucgggaggcugaggcaggagaaucacuugaacccaggaggcggaggaugcagugagccaagaucgugccaaugcacuccacccugggcaacaagagcgaaacuccgucucaaaaaacaaaacaagaaaaaaguaacagcaaaaaagugguaaugagggaucauaaaagcauaaaauaauaaaaguaugagggggccaggugugguggcucaugccuguaaucccaacacuuugggaggccaaggcaggaggacugcuugagcccaggaguucaagaccagccugggcaacauagcaagaccucgucucuauaaaaaauuaaaaaaacagccaagugcggugaugcacgccuguggucccagcuacucaggaggcugaggugggaggaucgcuugagccuaggaggucaaggccaaagugagcuauaaucacaucgcugcaccccagucugggugacagagggagagauccugccuuggcaaaguaggcugcugagcagauucugauuacauaaaaccacucacugccuuucaaccuaaccugcugcugccuagucagucccucugcaggccucugaacaaucagccauuugcuggagcccagacugguccacacggccaucucauuauuuggcuuuugcagaagcuguuauugccaccuuaagcucuguagcagaaucugggaaccaaccuuccucaaucuccugucagcuaagaguuagucuugcucaagucugucuuuuccaaguuuuguauauugagucugaauacauugucacuggaaaaauguuuuagaaaugaaacaggugggguuagaaacuuuguuccaaaagcaaacaagaggaggaagguggagacaacagcuggacugggcaauagacacuuuuguuguuguuauuugguuucaagauagaggacaagugcacgguaaaauggaaaaugcaaauucaaaauguaauaugcaaaugaaucacccaagaaucuugucaaaaggcagaaacugauugaauaggucuagaguggggguacaggcagugguaugcugauuggcaguguaugcuuguuuccuugguauaaauauucccaccuuggcacaguuaucaacacgaggucauugaacacagagcuggaaagagauguacaaaaucagcuggagaggcagagcaagcuggcucuagcacacucaacuuucugcaugucuaaauccuaggggaugugaaugcugcuggucuguggaccauaaugugaguagcaagggagaagacagugaaggugucuggggguuagacuaggacuaaggagaagggacauaauagaaagagaagagagacaucaucuagaucagaguuugucaagcucagcacuauuuuauacaauuuacacauaacucuguuuagaggggcuuacuccuguacacugcaggauguuuagcagcauucccggcuucuacgcacuacauuccaguagcauccucccuccagagucacaaucaaagucuccagacauugccaaaugcuuccuagauuacaaaaucucucccuaguaaaaaccauuaaucuagguuuaucucuaagaaaugaaagggggaaaaaggaagggaaccuuuuccacugaaauaagagaaaagagaugagauggcguagggagagggggacaaaacagaaggcagggagcucuuuuuagacaucagcgagcucagucaaguagaaaagaagauuaucuauuuagaaagacuguagggaggacuggaaguuuaaaacauuaggagaguucuagaaaaggcauuauaagaguaguggaaagucugugauccagggcaaugggcccaucaacuaugagauaggaccaggggcgccuugggcucuuggggucagaacugccuagauacaauuccaacuguaccauauccucacugggugaccuuggacgaauuacuuaacaaguauaagccuucucauagaaacuucauggaguuguguaaguacugagagaaugcuauguuaaguucugagcaccgagucuggcacauagugcaugcucaauuagcauuagcuauuacuauuaccagcauuauuuuccuuguuaaguacuugcuucauuuuacuauugauuuaauuucuuugaugaaacagaacacauggagagaucucgccugguaagaugcuauuugccaguaagucuuaaaaauacuguuugcagaccgaggcgggcggaucaugaggucaggagaucgagaccauccuggcgaacacugugaaaccccgucucuacuaaaaauacagaaacaucagccgggcgugguggugggcaccuguagucccagcuacucaggaggcugaggcuggagaauggcaugaacccggggggcggagcuugcagugagcagagaucgcgccacugcacuucagccugggcaacagagcgagacuccgucucaaaaaaaaaaaaaaauacuguuugcauuugggggcagaggggcaugagaguuguggaaccaaucacugacuuacugauguuuuaaaaaucaguuaaugagacaaaaggaaacgaaaggucaauaaaucaagagaaagcaaaaagggcauuaaauuuucacugaaacuggcagguuuuuauaaggcuucagcugacauaaagaaugugugaugugaacccucaguacagcugccaagaaugacagguuuauaagaaccaaacugacuucaaguuguuucuccuguaauaacaguaaauuuugcugcuaucgaagucaagaauugauuaaaauacaggaaucugucacuauguaaccucuuuagauauucgaauaccaguuugcagucuagaggauuuagugaaaucauaaagugucuacucucagauucgaguccauacugauagcauauuucaagaguacuacauauuucucgcacuaaaauucuugggaggccauaaaggguuuugucuguccuguguacaacugaccaauaagggaagggaagcagucuaggcuuuaaauagcuucugagugucagggaaggauagcucuccucaacuagaacaaugaaauauccuuuaagggaaagguagaaugccucagagaguucaaaauaaaagaauccauucuaacaugaaacuuaccaagaugaggaagaaguuauuaaaaucuuuccuguaagaucaaaagguacuuuuccuguaaguuccuucaaccuauccugguaacuugaagcauuuuauuagcaaaaauaaaaggggcaaacauuaucaagcauuccaagcuuaucagcuuuccguauagggcaaaucacugggaagaacaguaaaugucaucacucugcagguggccaggaaucggaguacuccagccagccacagccacuggaguuccaagccuucccaaaauagcuaugacuuacauacaaaugcucaucaaguagcucacacacagucucaaacggagaaugcugaaauagggucacuacucaaacugcggcagagguaaaugaagaugccacugauuaauaggcacauggucuuaaaugacugagccacgacaaauuuaaauaugacuucucucucccuuaaaauagucucuucucuaaaucaauaugauagucuccaaacuaaaauuuucccauguuuuuaaaucacugugcuaaaaacaaauagaacugaccucugaagccagagaaaaaucuugacacauuucaauaggcacuugugaacaucuaacaauauuuccauuagaagucagugcaugauacuuucguuucggagcccaggaccuggaaguaucuuuuucuacaugaguuuuaaaaagcgcauccaggcugggcgcccugguucacgccuguaaucccagcacuuugggaggccgaggcgggcggaucaugaggucaagagaccgagaccauccuggccaacacagugaaaucccaucucuacuaaaaauacaaaaauuagcugggcgugguggcacgcgccuguagucccagcuacucgggaggcugaggcaggagaaucgcuugaacccgggagacggaaguugcagugagccgagaucgcgccacugcaccccagccugggcgacaaagugagacuccgucuggaaaaaaaaaaaaaaaaaaagugcguccagacugggcgcgguggcucacgccuguaaucccagcacucuggaaggccgaggcgggcgaaucaccuuaagucgggaguuugagaccagccugaccaauauggugaaaccccgacucuacuaaaaauacaaaaauuagccgggccgguggcaagcaccuguaauaccagcuacucaggagggugaggcggaggaugcagugagccgacaucgcgccacagcacuccagccuaggcaacagagggagacucugucgaaaaaaaaaaaaaaaaaaaaaaaaaagugucuccaugcuaaauacuacuggccuuccagacaaaagaguaaaaagguauaaaaggauucucaccugaggguaucugucugccagcuuuguacgacaaauauaguuucucaucuccaaacucguauuugaacaacuggcacagauuucccguuuucucuugaaaaagugcaguacuugaggggugaggaggugguguuaaguuauaacauuccgaaguaacacuagaagacaugcucaaauugcccucuucccaaguuucuucauacagacauuagcuuuucucucaaaccaggguucuuucacucucaccagauucuuagaucagaaguccuuauauugauuucaaucuucuuagacauugggaacaggagaucaucaucaguagacuuucuauucaucacgcagcuccucccccuccuuaaaaaucuagagcgaugaaggcaauaauuggggaggcugcgcuguuuuguuuuuaaagccggguugggagggagggaaguggugguaacugggaccccuggucuuauagaagacggugauuaauuccggacuuuaagugagauaacuucggucugcuuuaaccuuuuaaaaacgccgccauaaaacugauuuaaaagucaaagcaaaacaaaaccaaccaacgcugccgcuuucggaaguuucucaccccggacggggcccaggagggcucaccuuacugaucccugcggcggagaaccccacguccagcccuuuauauuugguuuuccaaaaucuggaaaucccccuacaacuucagcucgcccacggacgcgaagaugcaguccucaaucuccgcggcccgagccccgcagagcccuuggccuucucacccacgcuggcgggcgcacccccugucccgcccggccggggcgcccuccgcagcccgcaacccgcagcccugcaggccccgcacgcuccccucagggccuggagcccgcccccagcucccgcucgccgccgcggagcccaccgagccguggccgucugccgcgccggccgcgucguccugcugcagcuccgcagucauggccgaggcgcccagccgcgggucaccggucuc

SEQ ID NO: 192051 - RNA, 39465 nt, Homo sapiens
acaaaccugaaacgaaaucuuugcaaccaguacagccugcgcggggcgcggcccaguccaucccccuucggaugcgcagaagcagaggucaccacgccggaccccucgauucccucgcgggcgauuccuggcuccuucaccaccccagcacuccaagacccccgcccuuuggccugaggcucccacugcccuagccaguucccgggcucacuuccagcuuuuccagaaagcuuggccacgccccucggcccagacucucaggccacucggccgcaauuaacccgcgucucugcgccuuuuuaggccccucccccucggucgugcccuugucaucucuuaggccccgucucacccuuucggaugccuccccuagaacccuaccacuuuccaccccuuuccgucuguuauuucucccaaacuugcgcccgcacaggccccucuggaacacuccugccccguagugccccucguccccgcuccguagagaaagagcgugcgugccgcgcauuucuggccuggggagcggguggaguaaaccugcgggaaccauuuuacgacaacgugcggcugugcgguguggcugacggcaacgccgcugcucuuggagaggucacuccggagacggcguugguuuuggggugugggggguugguggcacuauguggcgcgucugugcgcgacgggcucagaauguagccccaugggcgggacucgaggcucgguggacggccuugcaggagguacccggaacuccacgagugaccucgcgaucuggcccggcucccgcucgucgcaacagcgugacuacaggguauggcgggguccgggcacugugcggcuggacccccaguucuggggccacgccgcggaaccgcuuacugcugcagcuuuuggggucgcccggccgccgcuauuacagucuucccccgcaucagaaggugagcccuagaccccccuucucgggaccccguuguccuucagagcugacuggaugccugcaagauccuccuugagaggccucacugauccuccacccauucccaguaucugcuuuggcccuuuguccaauaguuggcuuugcuguagcuccuuagugucccucucaugaucuauuucauugaaaggagagcuucaagacuggggcuguaugcagaauaucugccgagguucaugcuuugucagacccacaggacuguggaggagaaagccugucacuggaaauuacuaacuucucauggacaggaacucccuuggcaucccuaguucccaaugugcaauggaacuguauacacuuugcaugaaauugaauugaaugaaaucuuaagccagacugagaguuagguaguccuuaaaaauuuuaauguuucuucuuuuccuuuuccagguuccauugccuucucuuucccccacaaugcaggcaggcaccauagcccguugggaaaaaaaagagggggacaaaaucaaugaaggugaccuaauugcagagguaaguuuuuuuuuuuuuuuuuaauuaauuuauuuauuuuuuuuauugaucauucuuggguguuucucgcagagggggauuuggcagggucauaggacaauaguggagggaaggucagcagauaaacaagugaacaaaggucucugguuuuccuaggcagaggauccugcggccuuccgcaguguuugugucccuggguacuugagauuagggaguggugaugacucuuaaggagcaugcugccuucaagcaucuguuuaacaaagcacaucuugcacugcccuuaauccauuuaacccugaguggacacagcacauguuucagagagcacaggguuggggguaaggucacagaucaacaggauaagaauuuuucuuaguaccgagcaaaaugaaaagucucccaugucuaccucuuucuacacagacacggcaaccauccgauuucucaaucuuuuccccaccuuuccccccuuucuauuccacaaaaccgccauugucaucauggcccguucucaaugagcuguuggguacaccucccagacagggugguggccgggcagaggggcuccucacuucccaguaggggcggcugggcagaggcgccccucaccucccgggcggggcagcuggccaggcgggggcugacccccccacuucccucccggacggggcggcuggcugggcggggggcuggccccaccaccucccucccagacggggcggcuggccuggcgggggcugacccccaccucccucccggacgggguggcugccgggcggagacgcuccucacuucccagacgggguggcugccgggcggaggggcuccucacuucucagacgggguggcugccgggcggaggggcuccucacuucucagacggggcgguugccaggcggagggucucuucacuucucagacggggcggccgggaagagacgcuccucaccucccggacggggucgcggccggguagaggcgcuccucacaucccagacggggcggcggggcagaggcgcuccccacaucucagacgaugggcggccgggcagaggcgcuccucacuuccuagaugggauggcagccgggcagagacgcuccucacuuuccagacugggcagccaggcaguggggcuccucacgucccagacgaugggcggccaggcagagacgcuccucacuucccagacgggguggcagccgggcagaggcugcaaucucggcacuuugggaggccaaggcaggcggcugggagguggagguuguagcgagccgagaucacgccacugcacuccagccugggcaccauugagcacugagugaaccagacuccgucugcaaucccggcaccucgggaggccaaggcuggcggaucacucgcgguuaggagcuggagaccagcccggccaacacagcgaaaccccgucuccaccaaaaaaauacgaaaaccagucaggcguggcggcgcgugccugcaaucgcaggcacucagcaggcugaggcaggagaaucaggcagggagguugcagugagccgagaaggcagcaguacaguccagcuucggcucagcaucagagggagaccguggaaagagagggagagggagaccguggggagagggagagggagacggagagggagagggagaggguaaguuguuuuaaaguaacggagaugaguucgaagagacuggcuuugccuaauugacugaacauugacuuucuggauguguagcuaccccuuuguuuaagaaacugaaguguuuuucacaacuugauguuagacaagauugguuggauaaguugucagcagcuggccaaacugauuuuaaccaaggcguuucuaaaguaauuucuucuuugaaaucugucguaguggccuuaucuucacaugaacuguauaauucuagacacaaaggccaggcuggccaacauggugaaaccccgucucugcuaaaaauacaaaaaucagccgggcauggcagccuguuccuguaaucccagcuacucgggaggcugaggcaggauaaucgcuugaaccugggagggggagguugcaaugagccgagauugcaccacugcacuccagccuuggugacagaaugagacucugugucucaaaaaaaaaaaaaaaaaaaaaaaaauucuagacacaagcuaauaaauuacauaccaacaguacaaaccugagcuacugcuuuuuguguuaaaagguugaaacugauaaagccacuguuggauuugagagccuggaggaguguuauauggcaaagauacuuguugcugaagguaccagggauguucccaucggagcgaucaucuguaucacaguuggcaagugaguagugcgcucauaauuuguggaacuucauugcuugguggaguauuuuacccagaauugagaauuaggaguuaaagacuauuuuuuaagacuacuuuugugaaagcugaaucugcccauuauauuuaugcauucuuucucuuccuuaggccugaggauauugaggccuuuaaaaauuauacacuggauuccucagcagcaccuaccccacaagcggccccagcaccaaccccugcugccacugcuucgccaccuacaccuucugcucaggcuccugguagcucauaucccccucacaugcaggugaggcucagccucugaguuuuugcucuaggugauuacuuacuuacucacuuuuuuucauagauggcuacuacaucuuggaaacugacauuaaaugugguuaggucuugucauuugggaguauauagguuuaaacaugaagauugacaacuauucuuccugguuguuauuuccaguuauaagaacuugaacaguuccuguaaccuuucucagccucaguguaguacacaggguaaugcguggcacuuuucauucaagaacauuacauuacagauuuugaggaugauuuuuacuaacaucuauucccuguauaauuagaguuuauagcaggcuguguuagucuguuuuacuuuggcaugaagaaauaccuagggcuggguaauuuauaaagaaaaaagguucauuuggcucaagguucugcaggcuguacaagaagcagggcgccagcaucuguuucucuuguggccacaggaagcuuacaaucaugguggaaguuggaagggaaaggggaaggguggugugucccaugagagagggaacaagagacagaggggaguggguaaccaggcucuuuauagcaaucagauuuccccuuaacucauuaccauggggcaugcagcaagccauucacgagggauccuccuccaauacccagacaccugccaccagaccccaucucuaacauuggggaucauauuucuuuuuuuuuuuuuccacauacaaaaaaacuuuauuuacacagucuuggauucugaaucuccaguacuuccagggucucuugaucaaauggggcagcagcaggcagggaagcaaacacaggggccaguccagauuaucuuacucaagaacaccaccaagaagggaaggccuaauucagucuuggucuggacuacaucuccccgcacuuugagaucaccacaguaguuugggcuuauuguuggggccugugggaacauucugaaucuuucucaucacuagaaguccaucagugauuuuuccaaacauuacaugcuucccauccagccaaucacacuuagagcaggugauaaagaacugacagccauuuguacugggaccgcuguuugccguggaaagcaggccuggagcugagugucuaaguuuaaaauuuucgucugcgaaugucuccugguaaauacuggcgacuccaguaccaucuccauuaacaaaaucuccacccuaaaucaugaaauccuuuaugacccuguggaaagugcuuccuuuguauccuauuggaaccccaucuuuucugaauucucuagugcagaacuacccaaaguucucggucgucuuaggcacaacgucugcagagagcucgaucuuugugcggccaacuuccugacugccauugcugacaucaaagaacaccaugggguuagcagggcuugaaguugccaccaccauggcucugacccggaaacggaagucgggggaucauauuucagcaugagauuuggaggggacagacauccaagcuguaucauaggugucaagugcugucuguugaaugaaaguccccaguugguguucuuuugacauguggugaucuauuuuccaagagugggugaaguaguccaauaguauuaauaaaugagaaaacugacaaaaguuaaguguaagauacacauauguaauaguguugcaucaaaguugaaggcagugaauguaaucacuguugauugugcuaacuaaaucaguuucuaagaaacuaagucaguuuauuagguauuaggguuaucgucuguauauuugugugcuuuagauguuaaaaguggauaaaaauccagccguccuuuucuaaauaauucugacuggcauuucuccuuaaucuaguuuauuuguagaaauuuuuguauaggaaucuuuuucuccuuuggaaauaauguucuacuccauggucuguuaguaacaaucauuuaggauuuuuugccagguguucaguucacacauguauuacaugcuguucggcaaauucuaucucaugauguaagacugacuuaauuuuccucuacuuugugucuguagcuuugugugcauguguuaggguuuuaccuuaauuauucuuuaagauacugaauuggauucugaaucucugauaguauucuuuaagauacuguauagagauuauuggcuucacuguuucuuaagaagcagaugaagauggcaaauucugcacaaaaaaagcacuuacaauuuuuuuucuaaggcuugucuuacuuuccccucucuggaaacaucuucaauugaaguuauuuuccucuccgcauaauccuguugcuaaucagauacagaagacaaagaggauagcaaaugaaaccaaauucaguggauacacaagccauauaaauaguaaagcaauuuuacauuuagauaggcauucugauguuuggauauuauugggguggaaauggcuauuauaaaaacagggcuuuuuuuaccccugguuuuuuauuuuuauuuauuuauuuuuugaaacagggucucacuccaucaccuaggcuggagugcaguggcaugauuucggcucacugcaaccucugccuccuggguucaagcgauucuccugccucagccucccgacuagcugggaauacaugcacauaccaccacaccuagcuauuuuauuuuuugagauagggucucacucuucaccuaggcuggagugcaguggugcaaucuuagcucacuguagccuugaccuccuggcucaagccauccucccaccucagccucccaagacgcugugacuacaggcacgugccaccaugcccagcuaauuuuuuuuuuuuuuuuuuuuuaagagaugagguuacaucauguugcucaggcuggucgugaacuccugggcucaagugauccuccugcaucagccuaccaaaaugcugagauuauaggcaugagccaccaugcuggucuuuccuguuuuuuuuuuuuuuuuuuuuuuuuuuuuuugagacagucuugcucugucaccauggcuggaguguaguggcacgaucuuggcucacggcaaccucugcgauucucaugccucagccuccugaguagcugggacuacaggugggugucaccaugcccagcuaauuuugguauuuuuagcagaggaggggguuucgacaugauggcccggcuggucuugaacuccuggccucaagugauccgccccucccaagugauccuuggccucccaaagugcugggauuacagaugugaacagcugugccuggccuccuguuuuauuuuuuugaaugaucaucaugccacugcacuccaggcugggcaacagaguaagacuccaucucaaaaaaaaaaaaaauuaucaaauaaaauucuguguaagaauucuguguacauauauuauauacaacaaguuguuuugaaauauguauauauuguggaauggcuagauugagcuaauuuauauaugcauuacuuuauagacuuaucuuuuaggccacuuaaaaaucuacugucaggaauuuacaagaauacaauacauuguuauuaacuauugucaccaaauaauguuuuuuuuuuuaauauggaaugcuucacgaauuuguuguccuugcgcaggggccaugcuaaucucuauaucguuccaauuuuaguauauguguugcugaagcgagcacagaacaguucuuaauauuacguuuuuaucuuggaaagauaucugguaagguugggacaaaugcaguuuccuguggguaaaaaauagguagaugcuaaguacagagcgcaguaaaauuuuaacagaaugguuuggaccaaggucauuuugugaaaaugaaaaacuucuugguuaaaaaaaaaugaagucugggcgcgguggcucacgccuguaaucccagcacuuugggaggccagggcgggcggauuacuuguggaugggcguucagagaccagccuggccaacaugguaaaaccccaucucuacaaaaauacaaaaauuagugggcaugauggcacccgccuguaauccagcuacucgggaggcugaggcaggagaaucacuugaaaccaggagguggagguugcagugagccgagauugcgccauugcucuccagccugggggacagagcaagacucugucucaaaauaaaaauaaaaauaaaaauagaugaaaagaugcuccauacuuagauguugagaaauuaauuuugacugucugaaagaaaucuuucccaugugcuuguugcauuuaacuuggaguguguguuagagugugggcgagaguauaagaguaugggucagaguaugagauuugaaggaugauuuaccuggugggaagcuauugaggugugaagcuuuugcuguggugaguauuuggauuaucauagucaccaucauucuaugaaaccacauaagucugccagacuuuuauuauguagaagucuuccugguauuaagcaauaauauguguuuguuucugcagguacuucuuccugcccucucucccaccaugaccaugggcacaguucagagaugggaaaaaaaagugggugagaagcuaagugaaggagacuuacuggcagagauagaaacugacaaagccacuauaggugagauuucuucagcucuuaaugguugaggcacugaguuucccaaugaggaagaggauugccauucuuuccuauaaugagugagugauaauaugaaaacuuuauaauucuuaggauucauuuucugggacagaauauuuuauuuuuauuuaguuauauguauucuuuaguuuuuauuuauuuauuuguuuauuugcuuauuuuucagacagggucuuaaucuguugcccaggcuggagugcgguggcaagaucauagcucauuguagccuugaacuccugggcuuaugcccaaaugauccuccugcuuuagccucacaaguagguaggacuacaggccugaaccaccacaccuagcugauuuuuuaaauuuuuuguagagauggggucucacuuuauugcccaggcugguuuugaacuccuggcucaagcgauccuccugccuuggccucucaaagugcugggacuccaagcgugagccccuguuccuggcccagcauaauuuauaacaaaaauaaugcguagucagauuugucaguuccauccugugcucacugaaucaaaggcaaucaaucugucaauucacagauuauuuuuaggcccaaguuugcuucuuggccuuauuauguuacugagaagcuauaucagaauugcugcugucuaaacuaggcaaaggaagucaagaagaaacaggagaaaaucacuuccauggcaggauaauagcaaagaauuuaagaugacuuugagggaaaacugaaaccaggguugagauuguuuucauaguuugagaaugacugauagaauguauguguguaauauauauauguucagauaugucauauguccacauaucuccuucuuaauucauuuuuaggcuaaaaaaacccauauagacaauaauauauuuauuauuauuauuuuuuuuuuuuuugagacggagucucgcuguguugcccaggcuggagugcaguggcgcagucucagcucacugcaagcuccaccuccuggguucacgccauucuccugccucagccucccgaguagcugggacuacaggugcccgcugccacgccuggcuaauuuuuuguauuuuuaguagagaugggguuucacuguguuagccaggauggccuugaucuccugaccucgugauccaccugucuuggccucccaaagcgcugggauuacaggcgugagccauggcgauuuguaguauuaugaauuucuucucucugcacccccgcuuuuucuuuuuuuuuuuugagacagaguuuugcucugucacccaggcuugaguacaguggugcgaucuuggcuuacugcagccuccgccuccuggguucaagcaauucuccugccucagccucccgaguagcugggacuacaggcaugcaccaccaugccuggcuaauuuuuugcauuuuuaguagagauggaguuucaccauguuggccaggcuggucucgagcucuuuaaccucaggugaucugccugccucggccucccaaagugcugggauuacaggcauaagccaccgcacccagccucucugcuucauaaucaccaccaaagggaagccuuucccaaagauguaaugggagguacugggcauccucugccuugguuguuuucagauuguguucuucaaaucccaucauuccuuuaaggcaccuugaggcaaagggggaauuaaagagcaggaccuuacagcccugccucccugccuuacuuccagcagagcaguucuuuucuaucuuuuuguauuuugugcuuccccauaaauuuuauuugaagaaaggauucuguuucuuaaaaacacagaaacuuuggaaacaguaguucugcuucaccauuuaacuugaauaccagugucacuauagagacuagucacuagagaaguguuaccuugguugaacuuugaagucuauuguggcccaggagccuuuucauuuuaaacacuucuuuuuuuuuuuuuuggaaacagagucuggcucuguuguccaggcuggagugcgguggcgugaucucggcccaccacaaccucugccuccuggguucaagcgauucuccugccugagccuccugaguagcugggacuacaggugcaugccacuacgcccggcuaauuuuuguauuuuuaguagaaaugugguuucacuaugugggccaggcuggucuugaacuccugaccucgugaucugacugccuugugccucccaaagugcugggauuacaggcgugagccaccaccgcacccagccuuuuuuuuuuuuuuuuuugagauagagucuugcuuugucgcccaggcuggagugcaauggcaugaucuuggcucacugcaauuuccaccucccggguucaagcaauucuccugccucagcugcccaaguagcugggauuacaggcgccugccaccaugccuggcuaauuuuuguauuuuuaguggagaugggguuucaccauguuggccaggcuggucuugaacuccugaccucagguaauccaccuaccuuggccucccaaagugcugggauaacaggcgugagccaccgugcccagccuuaaacauauauauauauaucuccagacuuaaacauauauauauguguguguauauauauauauguguguguauauauguguguguguguguguguguguguguguguguguuuuuuuuuuuuuuuuuuuuuuuuuuuuugagacggaguuucgcucuuguugcccaggcuggagugcaauggcacgaucucggcucaccacaaccuccaccuccuggguucaagugauuuucuugccucagccucccgaguagcugggauuacaggcaugcgccaccaugccuggcuaauuuuguauuuuuaguagagacgggguuucuccacguuggucaggcuggucucgaacucccgaccucaggugauccacccgccucggucucccaaagugcugggauuacaggcaugagccgccgcgcccagccuaaacauauuuuuuauuggguauucucagcugggaaauggaaggauucaucaaagauguguucaucaaggagaggcacaacaguacagaaagccaauggcuucuuuuaguuuuacuuuugcaauccuaaauguuuaaguucuuugcaaggaaggcaguaguugaauaaaauauaaguugucaacaccauagaaaucccaguaaagcuguaauucuuuacauugaaauacuugguauaauaucaaguauaaccucuuugaaaaguuccaaagaugcuuuuagggcugaaauccaacauuaguaucuagguugguagcucccuuaauuaggcauguaugugguucuuaucuuuagcagcauagcugacaccaucuuagaguccugugagucugcauggggacuguccuuggagauuuuuuaauaacuuugagaacuaaccacugucuguaaucuuucauaguuuuauugaacagauuuuuauuuggcauuuacuuuguaccagguuguauuauuucuaagaacuugaaaaauauuaaucuguuuaaauguauaacaucccaguaccaauccagugagauugguacuauuauuauccccguauuguagguaaagaaaccaagacacagaagguuaaauagguugcaaaaaaggcuauauagcuagcuugaaugagaaaaaucacuuuacuuaaaacugugcugugaguuuggagggauaguggaaucucuuaagucccauaauguuuuuucuuucuauuuaagguuuugaaguacaggaagaagguuaucuggcaaaaauccuggucccugaaggcacaagagaugucccucuaggaaccccacucuguaucauuguagaaaaagaggcagauauaucagcauuugcugacuauaggccaaccgaaguaacagauuuaaaaccacaagugccaccaccuaccccacccccgguagguaugcuucuagaauucaggaaacacuuaccuuguucaucucuaaauuaaggaguuuugauuagaugauauccuagguuccuuccaccuccaagauucuaugacugaggagggagauaguuuauuaacauuuguggagaccuauaguguuuguuguacugcacuguucaccuaaugguugauaguuugggccuuguagcuuuuuucuuccugcuaucuagaguccugcugagaacaaagcugagugacauguucucuuucugcuuuagauacagauaccaugcuuguggaaaguaaggcuucauugccccacccuuuuuuuuuuuuuuuaagagacaaggucucacccuguugcugaggcuggagugcaguggugcaaucauagcucacuucauugcccauuuauuauuaaauauacugaauaaucucugucacuugaaauccucuuguuauugacuuaguaggucaagcauauauuugugauacaguggaaccuugacaugacuuguuuugccuagaauuuauuauaucaccaaauacuugauacacuauauaacuauaaccugaacuuguauaacuccaaccagagauaacacugacagugaagcuucagugauucucacagaugcuagaaucaugugaguuuaaacuagguaaacauuucuauaagagaaaaguugauuucugacuacuguacauuugugggaagcuggcaaguagcauuguuguuggauuucuuuuguuguuguuguugagacggagucuugcuccgucacccaggcuggcgugcaguggcgugaucuuggcucacugcagccuaugccucccggguucaagcaauucuccugccucgaccucccgaguagcugggauuacagguguuagccaccaugcccggcuaauuuuuuuauuuuuaguagagaagggguuucaccguguuggccaggcuggucacgaacuccugaccucaggugauccacccaccucggccucccaaagugcugggauuacaggugugagccaccacaccuggccguauuucuuaagauacuuuucaacauggggccuuacagcauaauuuuauauuuugaaauuagcuggcugggugugguggcucaugccaguaaucccagcacuuugggaggcugaggcagguggaucgcuugaggucaggaguucaagaccagccuggccaacauggugaaaccccaucucuacugaaaauacaaaaaauuagcugggcgugguggugcgugccuuuaaucccagcuacuugggaggcugaggcaggagaauugcuugaacccaggaggcggagguugcagugagccaaguuugcgccacugcacuccagccugggugacagagcaagacucugucucaaauaaaaagaaaaaaaaaaaagaaguuaggauaauuaaaaauaaaaaucauguuggugauguaaaagaaugcgaauaaagaagugguaagagauuaaagugaagaaaggcuguagaauacuauacacugauuggcaauauucaauucugugcuucauguuguuauggaauaagguaacuguucugucuuugauauagaaguauauuguucucgcuguucguauuacuacauuauguugguuaagcuggcgaaaaguacauuaugaucuuuggaaaaaugaaaguuauuaauauuuaauuaaaauaguuuuaauuuauuaauaagauguaaacuuuuaaucuuucagaccagucuuugaaguggugaauuaaaacaauuuguaauuuuuuuucaaaagguggccgcuguuccuccaacuccccagccuuuagcuccuacaccuucagcacccugcccagcuacuccugcuggaccaaagggaaggguguuuguuagcccucuugcaaagaaguuggcaguagagaaagggauugaucuuacacaaguaaaagguaaaucuguuucuauagaauggacuuuauaaaguuaaaauuuaguugaauuuccuccuuaagacuugcaaguacaacuauguauagccguacuuauaauugggauaguagggacaaucauuaauaauuccuucagaagggagaaauaguucuuuuguugccaccacagaguagggaaacuuuuacugagcuuuauuuacucugccuagaaucuacccauacacuuuagauaccuuuuuuuuuccucuucuauucauggaaacugcuuguuuggugaaaguauauguaaaauuugguuaugggacuugauuauguaauaagaaaccucuguuagugcuugguugacuguagcaauaagcaaagcaaaauaaaauuugaaguuggggugauuuggaaugacuuaauaaaauucauauaaaacagaacuagagcucccugaaggcaagggaaaacgccuuacuugucugucugccgccaaagaaaaaauauagcuuugugauaagagcauggggccuggaaucagaccaccuagcauuuaauccuggcuuuauaauuuucuauguaauauguuuuccagugaauuacuuagauuguauguccuuaugucaauuacuuuucuaucuguaaaacugagguacuguacaucguauagauugugagaguuaaaugagcuauaacaggugaagugcuuagaacuguaucuagcauauaaguacucaauacauguuaguugucauucauauugauauuacugccuggugcuuaaauaaguuuuuuugaauuaaacuuaagcuaaaauuuaguguaggauaacuaagguacuuauuuggaauggggggaaguuauuaugcuuggaacuugguuugauggcuuguacuaugugucagucauuuaacuuaccauacuuaauguacacaacacuucuugaaguaagaauuaucauuccuuauuuucuggauaagaaaacagacucucagacucuucaggguucuuccuuccuguuaaauaguaaaguugcaguguaacucuagauuuguuuaacucuaaagccuguuucuucacacuacccuauccugccuucuguuuugaugcucugccauccauaauuacuaaagaaaaauaugcuuauuuccccaauuuucuaguuauggguacucaauggugguuaucccguaucugcaauuugcuaucuuguaguuagaagucaagccaaucccaagacacaagaguagaauguuguaaauuuuuuggaccucagagauucuuguaauauuggaagauucuuuuuuuuccaucuuaaugccauuucaguaguauauugcuaucauauauguauauaugauuagaaucagggacagcaguguaaguuggaguaacuuuuaaagggagaaaggacuggguuaauaauuauaucuaaagaauuuagacaagcaaagaaggaccauuuauuagauauucagcaauacucguuaccuuacuaaagauauaaguggaaaaucccuuagguaugagcugagaggaguguuaaaaaaaaaaaagaaagaaagaaaaucccacuguucuuacuaugcaggcagaguuaggugauaaauaucaucgacugcuaucuacacaucagacacuuguucaucagauggauaagauuucaguuucaguugcuuauaugaccaacaauaaagaauuaaaugaacagaaagggaguauagcauaguaguuaagagugugagcucuguagcuggaaugcuuggguaugaaccucagcucuuuauacuagcugugugaccuuuugugucacaauuucuuuguauauaaaaacauuagguuuaaugguugugagguuuaaauaaguuaaccagugccuguacagagaaagcauaucuagguauuagcuauaaugauaauaauauuuuuguuauuaaauaagaugauuugagugcuaagaaagaaagaaacucagugauauacuagugagugaaagggugaauggauauaugugcagucaugacuacuuuuagacagguugguugggagaucuuuuugaugaggugacauuugauuuguuuugaaagauaagaaggaggcagcuugagccaaccaugugaagaacuggggaaagaucauuuuggauagagagacuagcuguacacagucugaaaugggaaagaguuuagcaugucugaggaacauaaaagaggccaguguuggccaggcgcaauggcucacgccuguaaucccagcacuuugggaggccgaggcagguggaucacaggucaggagauggagaccauccuggcuaacacggugaaaccucgucucuacuaaaaauacaaaaaaauuagcugggcaugguggcaggcgccuguggucccagcuacucgggaggcugaggcaggagaauggcgugaaccugggaggccaaacuugcagugagccgagauagugccacugcacuccagccugggcgacagagcaagacuccgucucaaagaaaaaaaaaaaaggccaguguuaaugaagcauaaugagcaaagggucuaguaggagaugagauuggaaaaaaacagggaugagaacauaaaugaccuuauagauuaugguaaagaguuugaauuuuauuuaaaguacuugaggaagccauugagaaauuuaagcaaagaagugaaauaaaaugauuauguuuugaaaagaucauuuugguugcuccauggaaauggaugaaacguuuauauaguuuauguuugacaagaucccuacuuuuuguuacccauaguccaguguuguucccuuuauaccauauugcuuuaugauggccuguugugccgcccaagagagauagggaaaaggguuuacaagguuucaacuaacuccuaagucaggaaauucuuguggguggcugaagcuuagcauaaggcaggugguacuauggauuuccuccucuugagggacuguggugucuagaucagccuugguuguaaggggagguuaugguuucugucuuuuacaaaggagagaaaucuaauagggguacuaccaccucuguucuagagcuccuagugaggauaaauacaauccuagccaacucaguuuucguaaugaaggaaaggaauugggaagaacuacacacaacaagaguccuuuuuaaagucugccuugggggaagaugaaucaguuugaccaaauuuuuccuagaagugggccaguguaaaagguauucuauaauaauaacuaaauucugaaucuccguagaauuaaaggucaagauuaucuacuuggguccaaaauuaaaccuaagaggcuguaggugggaggagggaggaaauugaauauaaguaaaauuaaaccuacugagagaacuuugaagauccuuccucaugugugacauugcaccuuuuuccuucauuuccuuuaacacgggccaguuuagagccuuggcuacugugaaaaagcuaugagucauagagaccacauaaggaaugaaugauucuaaagauaagauaauugcaguaaagaguuauucgugcuauuuuggggugaaaaaaucgacuugauuugucaaaacaauuauuguuauaccuguaaauucuguauaaaaggaauucuuuauggucacauaaauccagaacccaaaugaaaucuauuucacggcuuaggaaugguuuuuuggagcuaaccaggaggaggcagcuaguuucccuuuuggagauauaaacugugcucggcauuauccuuaugccacauuucccaauuuaaaaguaaggaagaugaaaaaaauuaaguacaacuuggauaaaacucuaaaagagaaauacauaaaggaauauuugcaguaguuaaaaagaaaagacccacuccagaucacacacugguacucuguguggauuaaaauuaauaguugacaaaagcugguauuuguagguagcaccuuaagggguaggguuaaggcugugaaccuuucagaauguuuuugguaguaaacccuuaggagcuugcaguuuaggaucacagcguugaucuccuuggggaaccaaugguaugucaucauguaugugauauuuaugucucuuacagggacaggaccagaugguagaaucaccaagaaggauaucgacucuuuugugccuaguaaaguugcuccugugaguuauguguagcucuuacuuuuuuugcaguuugucucuacagccuguuagaccauuucauacauuauuuaugaacgaaauagcucaaccaagauuguuuucuucuaauuucagugguuuaauaauacagucaucccucgguacccaugagagguugguuccaggagcccccuuguauaccaaaauucgcaaaugcuuaagucucuuauauaaaauaguguaguauuuguauauaacuuacccacauccucucaaauacuuuaaaucaucucuagauuacuuauaauauuaaauacaagguaaauacuauguaaauaguuguuauauuuuauugcuuaggaaauaauaauaaggacaaaaagucuguacuugugcaguucagaugcaaccaucuguuuuuuucuggaauauuuuugauuugccuuugguugaauccagugaugcagaacuuauggauauggagggccaaguguauuuagauauuugugugcuaucauuuauauacaagaucaaagaugauauacuacauugacauguauuccacauuauguuuugagcuaguuaaucgguuuuugcuuugaaauaaaagauuuguucuuuuuuucuuuuucaaaauauuuuaaaguacaguugaaugaguuguuuuugguguuugguuuuuuuuguuuguuuguuuuugagacagucucacucugucgcccaggcuggagugcaguggcgcgaucuuggcucauugcaaccucugccuccuggauucaggcgauucucaugccccagccucccagguggcugggacuacaggugcaugccaucacaccuggcuaauuuucguauguuuaguagagacaggguuucgccauguuggccagccuggucacgaacuccuggccucaagugagucauugugaggcucaagugagccucccaacccccuuuucuuaacauuguuuaggauaauggauuagcuuguuuauacuuauuuauuauuccuugcaacuuaagaaugcuuccauugcuuuucuugaacauaauuuugcaaaaacaaaauuauuuugacacaaacuggucauugaacauacucugauacaaagaaaaaugacacuuaaaacaugacuucagaauucuaaguaaaaaaauuaaaacucuuaaaacaagcagaagucucuuuugcucacuggggacagaaauagguauucuauaaagcuuaguuuuuagacuggacaugguggcucaugcuuguaaccccagcacuuugggaagccaagguggguggaucacuugagcccaggcauuugagaccagccagggcaacguggcuaauuuccgucucuacuagaaauccaaaaaaauuagcugggcauguuggcgugcaccuguagucccagcuacucuaggggcugagaugggaggauugcuugagcccaggagguugaggcugcagugaaccaugauugagccacugcauucuagccugggugacagagcaagacucugucucaaaagacaaaaaaaaaaaacugcauagucacuggcagucuuucccagguacuuacgcuaagauugaaucacaguuacuaagagcuuuuucuuuccucccauaggcuccggcagcuguugugccucccacagguccuggaauggcaccaguuccuacaggugucuucacagauaucccaaucagcaacauucgucggguaagagaauuaccaucaucuggaaucagcuguuaggggcaucuuuagguuguuuaguugcuuccauaguuuuuaacacauuaacagaggcuuuuuaaguugggaauauuggaugauuacuuuaagggaaguuuuggccaacugaauacuugaaucacuuuguuccuauuagaagggccaggcgcaguagcucaugccuguaaucccagcacuuugggaggccaaagcgggcagaucacaagguccagacuucgagaccagccuggccaacauagugaaacaccccgucucuacuaaagauacaaaaauuagccgggcaugguggcacaugccuguagucccaaguacucgggacgcugaggcaggagaauugcuugaacuugggaaauggagguuguggugagccgagaucgcaccaccgcacuccagccugggcaacauagcgagacuccaucucaaaaaaaaaaaaaaaucuaggagguguuauauuauggcggaguccuccaucuuucaauuauaauaaugcuugagguaaguauuagcagagaguaaggugaagagacaaacagagcccuaaauuaguuaaggucuuaacucaagauaauugauuuuuuaaaucucuuugguuucagguuauugcacagcgauuaaugcaaucaaagcaaaccauaccucauuauuaccuuucuaucgauguaaauaugggagaaguuuuguugguacggaaagaacuuaauaagguaaaaguucugaaaauuccaacuuucuaaguuauaaaaauuuugucuuuccccaccaaacauuuauauuuuuguccauauauuuuguuacaauauaucaguuggugguuacuuucuugaucuuguccuuugaagcacaagauuuuaaauauugguuauguccacuuuuaucaauuuuuuucuucugugcuuuugguauuauaucuaagaaacuauuaccuagucuaaggucaugaagauuuauacuuuuguuuccuuguaacaguuuuauacuuuuaguucuuauauucaggucuuugcucuauuuugaguuaauuuuuuauagguggugugagauaggaauccaaccauuguuuugcauguggacauuuauucuuucaucccagcaccaucuuuccccaucgaauugucuugguauccuugucaaaauuaaucauauaugugagaauuuuauuuccagauuuuuuuuuuuuuguagaucuuguuauuuuuuguuuuguuuuguuuuauuauacuuuaaguucugggauacaugugcagaacgugcagguuuguuacauagguauacacgugccauggugguuugcugcacccaccaacccaucaucuacauuagguauuucuccuaaugcuaucccuccccuuagccccccaccccccuacagguccuggugugugauguuucccucccuguguccauguguucucauuguucaacucccacuuacaagugagaacaugcgguguuugguuuucuguuccuguguuaguuugcugagaaugaugguuuccagcuucauccaugucccugcaaaggacacaaacucauccuuuuuuuuauggcugcauaguauuccaugguguguaugugccacauuuucuuuauccagucuaucauugaugggcauuuggcuugguuccaagucuuugcuauugggaacagugcugcaguaaacauaugugugcaugugucuuuauaguagaaugguuuauaauccuuugggucuauacccaguaaugggauuucugggucaaaugguauuucugguucuagauccuugaggaaccgccacacugucuuccacaauggguugaacuaauuuacacuccuaccaacaguguaaaagcguuccuauuucuccacauuccagcaucuguuguuuccugacuuuuuagugaucgccauuguaacuggcgugagaugguaacucacugugguuuugauuugcauuucuuuaaugaccagugaugaugagcuuuuuuucauguuuguuggccacauaaaugucuucuuuugagaagugucuguucauauccuuugcccacuuuuugauggggucauuuguuuuuuucuuguaaauuuguuuaaguuccuuauagauucuggauauuagcccuuuguuagauggauagauuucaaaaauuuucucccauucuguagguugccuguucacucugaugauaguuucuuuugcugugcagaagcucuuuaguuuaauucgaccccauuugucuauuuuggcuuuuguugccauugcuuuuguuguuuuagucaugaagucuuugcccaugccuguguccugaaugguauugccuagguuuucuucuaggguuuuuaugguuuuaggucuuacguuuaagucuuuaauccaucuucaguuauuuuuuguauaagguguaaggaaggaguccaguuucaguuuucuacauauggcuagccaguuuucccaacaucauugauuaaauagggaauccuuuccccauugcuuguuguugucagguuugucaaaaaucagaugguuguaaauguguggcauuaugucugaggcuucuguucuguuccauuggucuauauaucuguuuugguaccaguaccaugcuguuuugguuacuguagccuuauaguauaguuugaagucagguagcaugaugccuccagcuuuguucuuuuugcuuaggauugucuuggcuauacgggcccuuuuuugguuccauaugaaauuuaaaguaguuuuuuucuaauucugugaagaaagucaaugguugcuugaugaagauagcauugaauuuauaaauuacuuugggcaguauguccauuuucacgauauugauucuuccuaugcaugagcauggaaugcuuuuccauuuguuuuuguguccucucuuauuuccuugagcagugguuuguaguucuccuugaagagguccuucacaucccuuguaaguuguauuccuagguauucuauucuuuuuauagcaauugugaauaggaauucacucacaauuuggcucucuguuugucuguuauuggcguguaggaaugcuugugauuuuugcacauugauuuuguauccugagacuucacugaaguugcuuaucagcuuaaggagauuuuggacugagaugaugggguuuucuaacuauacaaucaugucaucuacaaacagacaauuugacuuccucuuuuucuauuugaauacucuuuauuucuuucucuugccugauugcccuggccagaacuuccaauacuaugcugaauaggaguggugagagagagcauccuugucaugugccaauuuuugagacugagucucacucuguugcccagacuggggugcaguggcgugaucuuggcuuacugcaaccuccaccuuccagguucaagcaauucucgucccucagccucccgaguagcugggauuacagguaugagccaccaggcauggcuaauuuuuguauuuuuaguagggacaggauuucaccauguuggccaggcuggucucgaacucuugaccucaaaugauccacccaccuuggccucccaaagugcuggaauuacagccaugagcccccaugccuggccuauuuccagguucuuaauuccauuccauuaaucucuguauacccuuaaugucaguaccacagucuugauuacuuuagcuuuguaauaaguuguaaaaucaggaaacgugagucaucuuuguucuuuuuucucaagauuuuuuuuuuuuuuuuuuuuuuuuuuuaaagacagagucuugcucugucacccaggcuagagugcaguggcgugaucuuggcucacugccagcucugccucccggguucaugccauucuccugccucagccucccaaguagcugggacuacagacgcccaccaccaugcccggcuaauuuuuuguauuuuuaguagagacgggguuucaccguguuagccagaaucaagauuguuuugucugagucccuugcaauucuaagugaauuuuaggauuagcuuguaaauuucugcauugaagccaguugacauuuugauaaggauugauuggauguaucugcugaucaguuuggcaaguguugccauccgaagaauauagucuuuucauccaugaacauguagaugccccuguauuaguuagguguucuucagucucuuucaacaguuuuuuuauaguuuuucagaguguaaguuuugcacucuaaauuugcauuuguuaaacuuauuucuagguauuuuauucuuuuugauacuacucuaaguggaauuguuuucuagauuucauuuucagauuguucauugcuacuauauaaagguaugauugauuuuuuuuuuuuuuuaagacuagucagguauacuagugagaagggcggaagaguagaaaagaaguuagauuuauaauggacucugagcaaucaauugagauaacaauucauuuuucuauauugaucuuuuuuuucauauaccugcugaaaugggaucuauauugaccuuguauccugcaaacuugcugaagucauuuauuaguucuuacaguuuuuuaguguauuucuuagguuuuucuguaaacaagauaauguuaucugcaaauagagauaauuuuacuuuuuucauuuugaccuguaugccuuuuauuuccuuucuugccuaauugcucuggcuggcgccucuaggcaauguugaauagguguagcagaagugaacaucuugucuuguucucgaucuuugggagaauaagucuuuggucauuaaauaguugugagguuuccauagaucagguugagcaaguucccuccuguucccaguuaguaagaguguuuugaucaugaaaagggguauugaauuuuaucaaaugcucuuucugugucuguugagaugauuauguguuuuuuguccuguauucuguuaggacauuauuacauuaauggauuuucagauguuaauggaaauuugcauucuugggauaaaucagauuugaucauggugaaugauccuuuuuauauauugcuggauuuuauuugcuagcguuuuguugaagauuuuuacaucuauauucauaagauauuaguguguacuuuuuuuuuuuuuucuucuaaugucgucuuugguuuugguaucaggcuaaucccggccuuacagaauguguggggaaguguuucuugcucuucuuugauuuuucuuugaaagaauuugugaggaauugauauuaauucuucuuuaauauuugguagaauacugacgaagccauuugggucuaagcuuuucuacauggguaguuuuuaaauuaccaguucaaucucuuuguuaguuauaggucuauucagaguuuuuguuucuccuugguucaguuuugguagcuugugucuguaugguuguucauaguauucccuauaauucuuuuuacuucuguaagguagauaguaauguccccuauuucacuccuaauuuuagaaauucuagucuucucuccucuucuuggucagucuaacuaaacauuuaucauugugguugucauuugauugaucuuuucaaagaaccaaauuuuguuauuguugagaugaaugaaaaugaugacauaacauacuguaacuuaugggauuaugcuaaagcagugcuuagcaggaaacagcuguaagaguccgcauuuaaaaagaugaaagaaccaauguuugguuucauuucuuucuuuccaccucaggauauuuguauauucucuuucucuuccuccuuuucucacgauuauacaguuuuacucuuuggugagagaauuuagaaacuacaguuguccggggagggaaagcauuaggaaaaauagcugaugcaugugaggccuaauaccugggugauggguugacaggugcagcaaaccaccauggcacauguuuaccuauauaauaaaccuggacauucugcacaugcacccugaaacuuaaaauuaaaauuaaaauuaaaaaagaagaaacuacaguucuucuugucuuuccagauauuagaagggagaagcaaaauuucugucaaugacuucaucauaaaagcuucagcuuuggcauguuuaaaaguucccgaagcaaauucuucuuggauggacacaguuauaagacaguaaguauaacuggggaagauauauauccaucgguaguuuucuuguauuauuuaaugugugaguggaguugaggggauaaggagaaauggaauacagagaggcagaugacuuacauaggucaaacaacuugaaaacaacacaaaaauguuuaugaguuacugcuuuuuacuuuuuuuucuuacuggccccaauuuucaaccuuguuuuuguuuuuguuuuuguuguuguuguugauuuauuuuuuaaagagauagggucuugcucuguuguccaggcuggucuugaacucuugggcucaagcaauucuacagccucggccucccaaaguucugggauuucaggugugagccacaguguccagccugcgauauugcuggauuuagcuaguaaaggcuauagauucuuuguaugaguucagcaaagggagauuagugaacaaauauguguaauuaaguugauaaugacugucacaaagcaggguuaaacagaugauuuucauucuccugaacuuuacgggcaaaauuagaacaguaauuguuaauaauacaaugguauagaguaguaugguacucagugugucucuuuuaucucauucaauucucaugacuaucuuaugauuuaagugcuuucacuuccauuucuagauaaagaaacagacuccgugaguuaaguaacuugcccugaguuaauaaauuaguguuaggacugugauuagaaccaagauucugacuccuaagccuauucguuucuugcuguguagaugcuucuauguuauucuuauucugaaaggaaaaaaacaaacuuuuuuccuuuguacuuugcugucacacagucacagcaccgcuucugugaccagaugaguagaggcagggguggggaggguuuccccacacaccaaccaaacaauuaauucugcagugauuuccucuaauucaauucaauucaauucuggugcugucuaccuguagauagugucagaucccaaagauugagggcucaguccuacaagacugcccucacuucagaugccagucaaaaguguaggccacucauacuuguaacugacuggcuacaaacuuguugcugugaccucuuccuuggguuugauuaacuugcuaggacaauucacagaacuuggggaaacacuuuauguuuauuauaaaggauauuacaaaggauauggaugaacaccagaugaagagauggcuagggcgagguuugaggugggguggugcagagcuuccauguccuuucugggcauaccacccuuccagcacuuccacaguucagcaacuggaagcucauuaaaucuuguugaagggucuuaauagagggggcuggggagaaaaaggaaaggaagaaaaaagucuuuguagaguuugaucuccaggaucuccagccuacaucucccuccccuuucccuuaggucaguggguagagcuaaaaguuccaacucucuaauccucuagucauuuugacccuuccagugacuggcgccaucccgagguuacuuagggaucccacccuaaguauccgucauggagcuuauuauauaagggcucauuauaaauaacaaaacauacuccuaucacucaggaaauuccgguucuaggggcucuaugacaggaacuggcaacauggggacaaagaccaaguauauauuauaccacacuuacuaauauuuauuaauauuuuagggccgggcucacaccuguaaucucagcacuuugagaggccgaggcagguggaucacuugaggucaggaguucgagaccagccuggccaacauggugaaaccccaucucuacuaaaaauacaaaaauuagcugagcgugguggugcaugccuguaaucucagcuacuugggaagcugaggcaggagaauugcuugaacccaggagguggagguugcagugaacugagauugugccauugcaguccagccugggugauaagagcaaaacucugucucaaaaaaauauuuuccuaauaaauauuaaauuuagguuagaauacugcuccauggcuuagagugacuuguucuaacccuuaaucugaggucaguucccaggaggcaaacacaacuguuuguuuuuuuuuguuuuuuguguuuuguuuuugugacagagucucuuucugucgccuaggcuagagugcaguggcgugaucuuggcucacugcaaccuccgccucccgaguucaagcaauuuuccuaccucagccuccugaguagcugggauuacaggcaugcgccaccacucccagguaauuuuuuuguaguuuuaguagauaugggguuucaccauauuggccagacuggucuugaacucuugaccuugugagccgcccaccuuggccucccaaagugcugggaucacaggugugagcuaccacgcccagcccuuaaacacagcuuuuaaacuauuguuucuucugguauuuauuuaccugcagauuuccaaauaacauuuuucuguugccuuuuaugaguuuuucauuuauuuuacuuuauugacugacuccccguuaaagaacauuaauauuuagcuuuagcuccagucuugggacuagagagaaaaaaaaagguagguuuguuaugcccuuccuacauacacacacauaacaccaucuucccaaauugauuguagcacaaauuuggauuaaaucuauauuuggggccagguaugguggcucacaccuguaaucccagcacuuugggaggccaaggcagguggaucgccugaggucaagcguucgagaucagccuggccaacauggugaaacccugucucugcuaaaaauacaaaaaaaaaaaaauagcuagguaugguggugcgcgccuguagucccagcuaaucaggaggcugaggcaggagaauugcuugaaccugggaggcggagguugcagugagcugggauugcacgcgccacugcacuccagccugagcaacagagcaagacugcauuucaaauaauaauaauaauaaauaaauauaaaucuauauuugguuaauuuuuuuagaguauguguguguguccaguguuaauauuugaaugccugugacagugauuguguaugacuaagacauguaugauaccaugaaugcuaaccuaauugauuuuaauaauugcuuuagggaaggcuaguuuucuacguauaugugaauucuuucugaaacuccacaagcgaggagaggagauucagaaaccauuaaaccauuucucaaucugaucaaaccuauuggguaaacucuuuguucuaacuuuuccuuggucauucuucauuuggagaacaucuggacaucuaauauucuuuauaaacuguauaguuuuccagggcugccauuauuaaugaccacaaaguugauggauuaaaacaaauuuauucucucacaguucgggaaacaagucugaaaucaggguuucagcaggggcaaugcguucccuccaaagacuauagagaagaauccuuccuugccuuuuccaguucugguggcuuuaggcauuuagugguuugugauugcauaacuccagucucuucuuccaucuuuacauggccuucuccucugugucuguauuuucucuucucuuaagaggacaguugguauuggauuuagggccacucagauaauauaggaugaucuuaucucaggauccuaauuauaccuucagagaccuuuuuccaaauaaggucacauugauagguuccagggauuaggacaaagacuuaucuuuuggagggccaccauucaucccacuaaacagacuuuagucuuccuguuuucagcauuauucauacuacugacucguggagaguuuucuggagccuggcagaaauggcuugcuuaaggcauugacagucuuccguaauucagucaaggccuauuuuuuuuuuuuuuuuuuuuuuuuuugagauggaguccugcucugucgcccaggcuggagugcaguggcgcaaucucggcucacugcaaccuccgccucguggguucaugccguucuccugccucagccucccgaguagcugggacuacaggugugcaccaccacgcccggcuaauuuuuuuguauuuuuaguagagaugggguuucaccauguuagccaggauggucucgaucuccugacauugugaucugccugccuuggccucccaaagugcugggauuacaggcgugagccaccgcgcccggccaaggccuauauucaacuauugcuccucucuaaaccccucuucuugugccauucugaguuagccacuguuacugaacauaccuuucaguucucuccuucuaggaugcuguuugggcuuuccuguuccuugcuuuuagaugcauuccuuuuccgugcuauggccaccgugaugaucgucacagcagcaaacauucaaggaauuuauauuccuuaaauauaaauacaggauacuuaaaaucuagauaagaggcaggaauuuuuuuuuuaauauuccuuuaauucuccucugugccagcauauagacacuuuuuuuuuuuuuuuuuuuuuuuuuuuuuuuuuuuuuugagguggagucucgcucuuuugccaggcuggagugcaauggugcuaucuccgcucauugcaaccuccgccucccggguucaagcgauucuccugccucagccucccgaguagcugggacuacaggcacaugccaccacacccagcuaauuuuuguauuuuuaguagagaugggauuucaccauguuggccagaauggucucaaucucuugacuuugugaucugccugccucggccucccaaagugcugggauuacagcaugagccaccgugccuggccgcauguagacacuuuuuaacauuuaauuugccauuuuacguaucauaaaauguaccugcucuaaguguacaauuucuugauuuuuguuaaaggugcagaauuacgcagucuuuaccacaaucuaauuuuagaaauuuucaucacccccaaaagaucacucaugcucauuuauaguaaauucuuauuuucaccuucagccccugggcaauuuguuauagugcuugagucuauagauuuguauuuucuagaccuuuuauagaaauggagucauaaaauauguggucuuuugcaucuacuuucuuucacuuaacgaaauguuuuugagacucauccauguuguagcauguaucuguaguuuauucuuuuuuauugcuguauaguguuuaaucguaucaauauaccucuuuaucauucaccaguuaacauguuuuccaguuuuuugcuauuaugaaugaugcuacuaugaguauuuacauacaguuauuuguguggacauauauuuuuauuucucuucaguagauuccuaggaguggaauaccugagucauaggguaaaauuauguuuaauuuuuagagaaacuucuacauuauuuuucaaagugguugcaccauuuuaccuucccaccaauaguggauaaguguuccaguuucucuauguccucaucaauauuuguuaccgugugggugugaagugagaaccaucuacuugugagaguaucucgcuuuauugcacuuugauuuauugugcuuuuuuauaaauugaaggcuuguggcaacccucugucaagcaaguugauggcaccauuuuuccaacagcaugugcucacuuccugucucugugucacauuuuggcaauuccuagaguauuucaaacuuuauuauuguaucuguuauggugaccugugaucaaggaucuuugauguuaccauuguaauuguuucaaugccccaugaaccaugcccauauaagauggcaaacuucauugauaaauuuugcauguguucugacugguugauagaauugauagaauuaucaaccagcuguuccucugucucucucccucuccuugggccucccuauuccaugagacacaauaaaacugaaaucaggccaauuaguaacucuacaauggccucugaguguuucagugaaaggaagacuuucacgucucuuacuuuaaaucaaaagcuagaaaugauuaagcucaaugaguaaggcaugucaaaagccaagaucgguugaaagcuaggccucuugugccaaacagccaacuugugaauacaaagaaaaagcucuugaaagaaaugaaaaguacuauccuggugaacacacgaaugauaagaaagugaaacagccuuguugcugauacggagaaaguuuugaguggucuagauaaaagauuaaaccagguacagcauucccuuaagccaaagcuuaauucagagcaaggcccuaacucucuucaauucuuugaaggcugauagaggugaggaagccgcguaacagaaguuugaggcuagcagagguuggcucaugagguugaaggaaaggaggccauaauaacauaaaaguacagggugaagcagcaaauuauucagaagauacagcuaagauaauugauaucccucaucagucggcagccaucaacaucaaggcaagaucuaccagcaaaaaauuacaauucacuaaaaguucaggugauuuuuagcauauuuuagcaauaaaguauuuuuaaauuaagguguauacauugguuuuuuguuagucacgaugcuauugcacucuuaguagacaacaguguaguguuaagcauaacuuuuguauguacuaggagaucagaaaauucaugugacucgcuuuauugcaauauuauuuugguggucuggaacugaaccuggaauaucaagauauuucuauacuuagaugaagaaauugagguugucuguuaauucuaaccaaacaccauucauuuacuuguucauacacccauucaacauuuauuuaacauguacuguuuacuggauucaguggugaacaauauagggaauacuguccuuacugucucaaagggaagaugauugaacaagcaauauuguaauaauuuauucaagaaagcaguauuugcugugugauaccuuggcuacaguucugugguaauuaaugagucauacacgguauuuuuauuagagcagguuccuguguuuguuugcaagugacaaaauccugcucuagccaacuuaggcaaauugggggauuugguacccacugaucuuuuuggagcuugugccuagaaagagcuggaguucuuuggaggcagagcugugccuuuguuugaagucuuaacuuuuucucgauugcagaacacuagcaggggcccuuaggcagaccccaaggagaccacggauaaaauccaugaauccaugagcuugugaacuucaguuggggugggggaagggggggguggggggggggaaucaccuuuuuuuuuuucuacuaacauuuagcauuucuuccuuuuauaaauguagagaacagaucaaauguuaacaguacuugugucuggugaccaauaaaaaucaguuauuuucauaucacauuguaguuguauauaucucaaaauguuauuuuguucaucccugcuucaaaaugauagccauuauuagaccugcaacaagaucuuauuauugagugaauacagaagcacauuugucauaauuuugcuuuugaaccguuugauaacugaauuucaguauaguuucucucuuuuuucuaguaauuugaguauuuucaguguuaaaaagguauucugagauaagauccagaugcauagggacacauucuguagaaaagauugggacuccuugauaacagaagaucugauauuguguaaaaaaaaaaaaaagauugggaccccuuacuuuuacguucuucugagguaccaccacccauguauccugagcacuccuauuucuugcuacaaugcaguucuuucccuucacucuuccuuucaucugcucaaacuacuugcagagacucaacugcagccaauguacguccacucaaaauccaaggaguucugauuggugggguuuucuuucagcugcauucacgugucggucaaggcagacggcaggggauguuagacgauaugugcgaaaccaaccuacugcugcugacacauuucucauucuuuuuuuuuuuuuuuuuucuuggcaggcgguggggucaggggcaggggcagcguugggggauggagucucgcucugcugcccaggcuggagugcaguggugugaucucagcucacugcaaccuccaccucccagguucaagugguucuccugccucagccuccugaguagcuggcacuacagcugugcaccaccaugcccagcuaacuuuuguauuuuugguagagacagaguuucgccauguuggccaggcuggucucaaacuacugacuucaagugauccgcccaccucagccucccaaaguguugggauuacaggcaugagccaccguucccggaccucucuuugauuuuuaauaacuacaagucaaggagagggcacagcaaaauguaaaaauuaggauagacaucuuaauuuuugucuuuggcugaacaauaacacacauugguucaaaaaauuuuugaaguaaauauaaauauucuugcuuaaccuggcacacaggcucuuaauaaacaguuuuuuauuauauuuauuuuucuuuuuaaacagaaaucauguuguugaugucaguguugcggucaguacuccugcaggacucaucacaccuauuguguuuaaugcacauauaaaaggaguggaaaccauugcuaaugauguuguuucuuuagcaaccaaagcaagagaggguaaacuacagccacaugaauuccagguaggguauuaauuauugcuuucuaauuauguuauuuuuaagguuugcauaaugcauuuauugcauuuuucaccuuuugauucugucacguaauuuuuuuuuuuuuuuuuuuuuuugagacggagucucucugucacccaggcuggagugcaguggcaugaucucggcucacugcaagcuccgccuccuggguuacgccauucuccugccucagccucccaaguagcugggacuacaggcaccugccaccacgcccggcuaguuuuuuguauuuuuaguagagacugguuuucaccauguuggccaggauggucuugaucuccugaccuugugauccgccugccucagccucccaaagugcugggauuacaggcaugagccaccacgcccagcguaauucuuuuuugaaacagagucucacucuugucacccagguuggaguacaauggugcaaucuuggcucacugcaaccuccgccucccagguucaagcaauucuccuaccucugccuccugaguagcugguauuacaggcaugcaccacugcaccugacuaauuuuguguguguguguauguuuuuaguagugucgggguuucaccauguuggccaggcugguuucaaacuccugaccucaaaugauccacccgccucacccucucgaagugcugggauuacaggugugagccacugugccuggccugccacguaacucuuauugacacaccguucugaaaauaaaguaaaauucaaucauauauccaaaagaagauauuguuugaaaauaagacauuuuccggcugacauuuuuguucauauuguaaugguuguauaucuucaguaauguguauuccauucaggccuuucuuaagaccuugcaccuuuuuagcuuaaggucuuuucacagaacauuugucaaguuuucugauuuauguugacaaacuauaauuuauuuuuaauuuuuuuuccucuaggguggcacuuuuacgaucuccaauuuaggaauguuuggaauuaagaauuucucugcuauuauuaacccaccucaagcauguauuuuggcaauuggugcuucagaggauaaacuggucccugcagauaaugaaaaaggguaagugccaaaauggaggggaagucguaagcuaauuuuuauuacacuguacacuuguccugugguauccucaggggauuggcuccaggaacccccucaaauaucgugauccacaaugcucaagucccugauaugauaugauguaauauuugcauauaaccuacacacauuauucuguauacuuuauucuugacuuauaauaauacaauaccuaaacagcacuucauucacauggauccaguguagugcccggugugcagcaaauucaaguugugcuuacuggaaauuuguggaauuguuuacuuucuggauauuuugauccaugguugguugaaucuauggauucggaacccauggauauauggagggucaaccauaccuguuuuugaguaucaguguuuuuuuuguuuguuuguuugagauggagucucacucacccugucacccaggcagaagugcaguggugccaucucggcucacugcaauccccgccucccagguucaaauaauucuccugccucagccucccaaguagcuauagcugggauuacaggcauguacuaccacacuuggcuaauuuuuguauuuuuaguagacauguuguuucaccauguaggccaggcuggucuugauccugaccucaaaugaucugcucaccucagccuuccaaagugcugggauuacaggaaugagccagugugccuggccagagucucaguuuuauauauaguuauuggcaugcuauauuguaucuucaaauaaaauuauauauauauaaaaaauacgaaauucuucaaggcagcaacuuuacuaaaugcaguuaguccuauuugagguggaaagccuuauuuauucuaggugaggagucagcaugcuuuuuuuuaguuguauaguaaguauuuuaggcuuucugggacauauggcugcuguugcaaauaaucugccauuguaguaugaagggaggcauaaacaagacaaaugaauugcaguaaaucuuuaccuaauaaaaacaggcagaggacaggauuuggcccauugcccacccauacuccagguaucuggucuguuucuucaagcuauaaauuugagcuaaagguauaggagacuggaagaguagauaggaaguauuaccugguugggauuauaggguaggagugagcauuugggugguuacuggcugaaaugcaguauuuucuuucagaauaucuaaaaugucuuuaucuuuuucuagguuugauguggcuagcaugaugucuguuacacucaguugugaucaccgggugguggauggagcaguuggagcccaguggcuugcugaguuuagaaaguaccuugaaaaaccuaucacuauguuguuguaacuaacucaagaauuucuaaacucucccaggucacacugauucauucuuaacaagauauuuauauguuauuaaacaggugguucuuuuuauuuuaaccaguuauuuuuauuauugagucuguccagauaaguuauuuauaaugggcauuacugaauuuuuaaaaugccgauuacacccaaauauugugcacauuuaauaaucagacaccagauuuuuagcucuguacuccuaauuaagggacauguauguggccuugccuagcccuuuggugauaaguacuuccucuaggaaauguacgauagguagaauugugguucccuaaagacaaguacauaaaggugacccugaugaaaccuugaaguucugaaauuuaacugccuaaaauguucuccuuagaugugagagaaagagaaaucagaaaaauuaauucucuugggggaagggcuugaauugaagcuuuacuuuagaauuuagcccugguuugaaauuuuccauuacaugaucuugguuuaucaucgaugggaaggguagaaaacuucaaggaaaauaagugaaauuuuaaaagucagcauuuucuuagaccucuucagcugauuguuuauuuuucuaugaauuccuacacaugguuauuccccccuacuugagauaaucuaaauauaaaccagcuacuugauguaacugagaauuuguguggauauuuauuuaaacaaauguguaauuuugaguacagaauucaacaguuaccuccaaaaaagaaacauuguuaauauaauuuaacagaaguugugaaacuaaaauuuucuaagauuaacugguaguucauuguaaaugaacauaaugaacagaauuuaugacuccacuguggaaaaugcuaucaaauaacuaaggaauauauauggaauaaguguacauauguaaaauauuguuacuagaguuagauaugugccaaaguccauuuaucccaaauccugucugaaaaggagggguacauugguaaacauuuuggagugcuuaaaaaugccaaaaacaaaaugguaauuucuacuuugauaaaguaaaaaaguuaaauguguguaaaaaaguguucuguguccuucuacuccagcaucgucucauguaaaauaagaaagcccuaaaauacuauuggagagaaaaaauuaacuagguugcuacuuuauuugccuaaauacuuuuuucuauuuuguuagauuuugccuuucuuuuggaaggaaggaggcgauauucuggauuauaaaaaugaauugggaacauuaucacaauuccagacuuucuauuaauauuuauguguuuuaauaaacguuugaaauuauuuaugacuacuuaaaaugaaucugaccagugcuuccugguauauguaauauguggaguuagccccugaaauuugcuuuaaguguuucaguguugaaucuguuucuaaauauucauuauuacaugguacacaagugacacuccauauauuccacacagacuuuuaccuugcuguauuauuaugaaaacaauacauuaauuugauuuuucaguaauuaguaauuuuagguugaagauuauccaaaagaaacaagcuuaucacaagggaccaucaucaauaugauccaaaucugguucaaacauucaaaacuucaaagauaauucaucuuucgcuaaugcuugugguucuguuguucccuugaaaaaaaauaaaaacaguugccuucuaauaaacauuguugaguuaaaaauuaa

SEQ ID NO: 192052 - RNA, 275833 nt, Homo sapiens
ccgugagucuggccuuaggugucucgugucugggguugauccgagcugucgccgccgccgccgcaaugggcaaaacggccaacucuccggguucgggagcccgacccgacccggugcggagcuucaaucgcuggaagaaaaaacacagccauaggcagaacaaaaagaagcaguugaggaagcaacugaagaaacccgaauggcaggucgagcgcgagaguaucagccgccucaugcagaacuaugaaaaggugaggccggcgcuggggagggggcucgggccggccagcagcggggcagcgucucacugcggcgaggaguugcagaguggaggcggcggaucugucaccgggacccggccgggaaugagaggucacgccgggugccacagcucaaaccucugcaccguucuggccacucuucugcuugccacacuguuccuaaaaaaauaauagaaaugcggccguaccuaaggguagggagacuaaugcuguaauagcuacagucauauucauauuaauaauacugaugacaauagugguaauaaugacaccuacauuuuuaagcacucaccaugugcuuacaguaauuguuugacuugaucugagguauggauauuaauaauccuauuuaacagaugagauaauugagguucuaagaggaaugaaacuuguccgaaucuuucacgcuuaguaggugguguggaauuggaagcuagauccaugucuuucuaaucccaaagccuuugcuuuuaaccaugaagccagacugcaucccucaacaucaucuaugcuccuuccuguggccaccucauuuucuccacaggcuucauguccccauccaagaauuggccuagaaaagcuggaccgcuggucuguuucugucaccuaucauccccacauuguagcugguguucccagaugaguauaccuguaaugaucacuuugaccuccugacuucuucccccaaccuccagacuccacaggucugucaauuccucuuuucccuuucccuaaaucccauguuuguuggucuucacccacaucuuucagcuucucagcccccuucuagugcaguacaaucagggauuuaacagauggaacauucuuguaacuaagguugccauuguaacaaauuaccacaaacuuggcggcuuaaaacaacagagaucuugaggucaggaguucgagaccagccugaccaacauggugaaaccccgccucuacuaaaaauacaaaaaaauuagcugggccuaguggugggugccuguaaucccagcuacucgggaggcugaggcaagagaaucgcuugaacccgggaggcagagguugcagugagcccagaucgcaccauugcacuccagacugggugacaugagugagacucugucuuaaacaaacaaacaaaaaagcccagcaacaacagagauuuaccuugucacaguucuggaggccauacgucugaaaucaguuucacugggccaaaaucaaggugucagcagggacuugcucccuccagagguucuaggggagaaucuguuuccugccucuuguagcuucugguggcugcuggcauuccuuggccuguggcugcauaacuccagucucugccuucuccugugucagucuaucucuguuccucuguuauaagggcgcuuacgauugcguuuagggccuacacagauaauccaggauaaucaccccaucccaagaucuuuaauuuaaucacaucugaaaagucacuuuugccauguaagguaacauucaucccuuccagaaguuaauacauggacaugaguugggaucauuuucagcaccacauccuagcuccaccaucucagcagaccguagagcuagaaaccuaggagcagucuuagcuacuucucucuuaccuacucuuauauccagucggucacacugcugaucuguucugcuuacauuuuucaaaugcuucuucaucccuacugcauugucuucaguccccaucaucucuugccuggauuacuauaguaaauauugcuuucaacagggaucagcaaacuuucucuguaaaugauagugaauguuuucagcuuuguaguccuaaggguggaacuacucaauuguucccuuguaauacaaaagcugccauagaaauacuuaaaugaauggguguuguuuuucaguaaaacuuuaauuagugaaacagguggcugaugggcuuuguccccuaggccuuaaaccuuuuaauuuguccucuguacuucugcuagaaugauucuuuccaagaugaagaucuaaucauuuuacugccgauuagaacccuuccuuggcucacaguuacuuuuagaaaaauugucaaauacagcgugucaacauguucuagucugcugcagaguaaguuauuuguggucaggcugaccugguuuaaaucucacucuucagguauuggcuagccagguuucuucaucccucuaagucucaguuucuucuuucaaaaaaccgaaguuauuagccacccagaguguuguaaggcccaaaugagauaauguguauacaccaagugguacaugauaggcauauaugaaggaacagcuugcaguuuugugaauuguacaugcuucuugugcuucucauccugguacuugauguuuccacugugugcagugagcauacccaucugcccacucuaaggaaagguacucuuccuucaagauuuagugcaaacuucucuucaucaccuccccugaccgaguuagggcuacugugcaucuguagcauuuuguagauaccuuuaugacaacauuuaucaacugucugcgaugauuggcuucuuuaacuuuuuuaaaaaaacucuccuacuagaccaugaacauucaaggucagcaaccagugauacacucgucuuugcacuccccagagucugguagcacagugcuuguccuugaauaggugcucagucaguguuuagauguuguuugcuguaagacuagaccuuucccagguggcuuugcucugguuggcagcauuggauuauucuuuuuuguuucuuguaauugugaacauuuaucaaacuuuuauucaugcuggcuuuccguauacucaccacaaauaacccugugaaauuguucccauuauacaggugagacaacuuuaaggcacagcaagguuaaauaauuuguguaagguuaaacagcuaagaagugaaaaaggaguucuaagccagguagucugauaccagugcaccaaaccaguaggcuuuacugcauugcauuuauuuaaaucccauuuguuucauuguugaaggagcagcuuuuucccccgcuaagcauuguucuguuuuacuucuuuaauuuuagaaauauuuucuuaagauuugguugagaaauaaaugcagugugaaaucaguugucaagguuagcaauacuaggauauaauuauuugaauagcaggauuaucauucucuagguaaacaaggugcaggcccucacuauguggcuccucaggugguagcauuguacauaaaacuuacuacauagccaugguacacagguggugcucaguagccucacuggugaacuacugaacaauuugauuccgaaaccuuuuaaaacaauuugacaggcacuugucuaggcgggugugaguauauauggaaaaaaaauacgugcccaagucccuagggaaccugggcauguagggguugauacaguuugacacguuauauuaguaugcauaaaauguuauaauaguaaguuuguaacauguaccucagugcuguggaguuagaggaugguguaauuaggggaaguugaguuauccuauacugagcuccuucuggucagaugcauuacaaaaaacaugcuucuucuggguaugcuucccuuccuccuggugguugcagccucacgucuggcuuggggagcugaugugggcuggauuucauccccugcaucucagucuuagcagauuucauuguggugcauacaaacuguccagugguuugcaguugccaagaguggagcuaagcuuuuuuuuuuuuuuuaagauggagucucacucuaucacccaggcuagaguacaguggcaccaucauggcucacuguagccuugaccuccugggcucaagugacccacccaacucagccuccugaguagcuaggacuacaggugcaugccaccaggccuggcuaauuuuuuugguaauuuuuguagagauggagucuuacuguauuucccaggcuggucuugaacuccugugcucaagcgaacugcccaccuguaauuccaaagugcugggauuacaggugugagccacugugccugguggagcuaguucuugaaugaugaguucaucagauagaaaagauuggcaaggauguucuagguggagggaacauggggaaauacagagaggugaaaaugcauggcauucuuugagggaggaaaugcuccuuggaguguuggaugcauuccugaguuggcuucagauggguucgagaagaagguuggacugugaugacauuggaggcugcagcaugcaguauaauggcuucuuaaaguguccacauccuaauaccuggaaccugugaauauguuagaugguaagggguaauuaagguugcuaaucagcugaccuuaaaguagggcgauuauccuggauuaggugggcccaauguaaucacagguguccuuagauguggaagagggaggcggaagagucagugucagaaugacgugaugugagaaagacuuggagucuguugcugacuuuaaagacagaagagggucaccaccuaggaaugugggcagccucuagaagcuggaaaaggcggggaaauggacucugccguagagucaucagaaaauaacgcagcccugcugccaccuagauuuuagccaagcgaaaccuauuguggacuuuugaccuccagagcucuaagguaauauauuuguguugguuuaagccacuauuugugguaauuuauuacaguaacaguaggaaauuuauacagaggccaugcucaaagacuuuaucuggaagccaugggaaguauguggcgggacucuguauagagagaauauaucugagcuguaaagguuggaggguaagagaucagguaggagacuggagacuauugguagagucuaggucuuggguccuuugagaggcagaugacaaaaugggauugggugaacuggagcuuuagggguuacaggcacaggagggggaauguccgugaaggcugaaggagagggaacaggaguagggagggaaaggagagaaggauggaaggagcagcagguaggaagguaggaagagucucagacugcagcacaguuccaagaaagauucagccaggcugauggggagucacugauccaaaauuguccaucagaggaauccccgggccugcaguagcacugcugagccccgccauugacuaggagcagcccgggggaagcauggcuuuuccauggugggucuagaggaggcacagcuggcauugucagucaacuaugcuucucacagcaggagggugguguauuucuaaggggugguguguguuggaggggcugcuggaaaacuggggauugaggcucacugagaaauguugagcuagcuguguuaguucagcagcuguuuuuacuauugcugaaugacucuuugcaucugggauucauuuagacuguaaucagcuguacugcauagaaacugcauucaaauccugauuuuuuuuuuuuaaaucaaaauuuggucugguguaguugaggcgguuugcuguucuucucuugacggcaacagguggagcauucuagggcguuucaaugcuuuuuucaucaggcauuauucacuuuagcgagaaauaggcauuaccagagaguugugagaaguauaagaggauggucaaaugucacccuuuucuccuccgcuuuucaacuuuuccaacagccgugggaagccuuuaauaaggaccaucccugaaauaucucuucccugaauucagaagaauagugagacagauuuguagacugaguaugaguauuauggagauguaagugauuuuuccccccuaagaaagggauaaagggaaggagaaagaguuauuuuuuugagguagagucucgcucuguugcccaggcuggagugcaguggcucuaucucugcucaccacaaccucugccuccuggguucaaacgauucuccugccucagccucccaaguagcugggauuacaggcgcacgccacugcaucuggcuaauuuuuauaauuuuaguagagacaggguuucgccauguuggccaggcuggucuugaacuccugaccccaggugauccgccugccuuggccucccaaaguguugggauuacaggcgugagccaucgugccuggcuggguuauuuucuuuguaggaaccguagccaucuccugcuguggcugcuauguaauccuuggaauauaacagaauaucuagagcagggucagcaaacucuuuuucuguaaagggcuggauagucuguguuaggcuuuaugguccauacagucuccgcaacaacuacauagacaauaaauaaaugaauuauuguaguugugcucgaauaaaacuuuacuuacuaaaauaggcagcaaauuggauuuggcccguaggcuguaguuugcugggcccuauuuuagaacaucaacagaaucaaaaguuccuuuucuucgucuucuuuuaaagaauauggcgccuguaaucccagcacuuugggaagccgaggcggguggaucacgaggucaggagaucaagaccauccuggcuaacacgaugaaaccccgucucuacuaaaaauacagaaaaaauuagcugggcgugguggugggcgccuguagccccagcuacuugggaggcugaggcaggagaauggcgugaacccgggagguggagcuugcagugagccaaguucgcgccacugcacuccagccugggcgacacagcgagacuccaucucggaaaaaaaaaaaaaaaaaaaaaaaaggaauaugguauauaguuuucuguuguaaugcuugauugaagaguguuggagcaguuucauucuucuaaacuuucccuccaggagguuaacugacuuuaggaagauagaugugcugugcaauguuuuguuugaggagcucgcuuugccuguacugugucucuugcuggggauugaagaguguguuggcagccugccuccuucuguaggcauuccauucccuuugaaaacagcuuuuuagcugauaauaccacgagugcuagagugagcuacaccuaauuuuaaugccuuguuuggaagauuaucuucuaauugagguuccuugcugggacaguauguuauuugaauaaaccguucuucuaaugcugguacacugauucugccuccuuuccagugauaucugaaaugauuuguagggauuaagacaauguuuuaauauuuguauuuucagcauuggagggcacagaguaaacacugccugggcaauguuaagaaucauaggaaagauguguagauuguaaaaugaaguacaacugucauccuuuuacugccuagaguguaauuuaaauaaaugaaccauacaaaugcagcuuuuuccuuuugcgaaucauguauaauuuggcagcauauuuccagaacugagcaguaguuccugccuucagcaucuguaauaaaauaauucuccugagcagcugaaaugaaauucagaaaauuggguuugugcuaauaaagaacaucaguaaugaauauuugaauaauguaaaguuagcaaaauguuacuuauuguggcuucaaagcaugacagacauuuccccuguguugaaauaauacuccuccuucaguaaccccaaaaugaauaguuaucagguuggauuucauaggccacugauuuaugguuaaaacuuugaaaggauugugcuaacaagaaauauuucuccaacuaauuucacucuuuuuuccaaauuguguguauagaacuauuuucauugugaucugugguuugugguaauuuuguccuuguuucuuaaauugagaucccuugaaggaugauaggaaguaaauuuucuuccuaaaauugaugugguuggugaugcuuuacuguguucaacauuuuggaggucagauaguaguaugugugguguguguguauugggugacuuuuuuuuccuuaccaauugaaaugcuuacaaauguauauucgauucagggacagccucuucagggcauauuucguuacagaaggaaugauggcuuuuaauuagaagcgaugauugaauucaacccugaauuaccaaggaugagcugggcaauacaauguagagaagaaauggcugugucgugaaacaaaugaguuacccugauuccuuuuucuuuuuuuccagauaaauguaaaugaaaucacaagauuuucagauuuucccuuguccaaaaaaacauugaaagguaaguauauggugaucuugggauguguuauuggauuucuuggcauuuuugauaaaugggagaagauuuagaggguuuagccugaaaaaucuuauuuuggcaaauuuugauaucaugaaaaccaaugaaaauaagcaauauucaaguuuuaacaguacguuauucucauucuuucuggacuaauuaaaagaaaaacaaguuuccagcauccucugaauaaaaugaaaucuaauuuuguuaguuaaaauaagcaagggaacaaaccaagaugcaacacccuuuguaucuguuugcuagggcugagaugacaaaauaucagacugaguggcuuaaacaacagagacugauuuucucacaguucuggaaguuggaagucugggaucaagauguugguggcauugguuuccucuuaaggcaaaauaagggaaggauuuguuccaggccuccuuggcuuguggauggcugcccucuugcugccuuuuuauuuuuggauacauaaaaauuguauauauuuggccaggugugguggcucaugccuguaaucccaguacuuugggaggccgagguggguggaucacagggucaggaguuugagaccagccuggccaacauggugaaaccccgucucuacuaaaaauacaaaaauuagcugggugugguggcgggcaccuguaaucccagcuacaggcugaggcaggggaaucacuugaaccugggaggcggguucaugccacucuacuccagccugggcaacagagugagacaccgucucaaaaaaaaaaauuguauauauuuacaguguauacaugaugcuuugaaauauguauaugcuguggaauggcuaaaucaaacuaauuguauaugugcuaauauuaccucauccuuuuguguuuagaacucuuaaaaucuacuuaguauuuuuucuuuuuucaguauauuuuaauuaacuauagcaguauauauuaagagagauauauaauagaucucucuuuuuuuuuuuuaagauagggucuugcuccgucacccagggugcagugcaguugugugaucuuagcucacugcauccucagccuucugggcucaagugauccucccaucucagccuccugaguaguuggaacugcaggugcaugccacugugccuggcuaauuuuuaaaaauuuuugguagagauagaguuuugccauguugcccaggcuagucuugagcuccugaacuuuaaggaaucugccugccuuggccucccaaagugcugggauuauaggcgugagccaccacgccuggccuacaauagaucucuugaaguucuuccuucuaacugaaauuuuguauguuugaugaacaucuucccacucuccuuacuucccccagcuucugguaacuaccauucuacccucugcuccuuugaauuuggcuuuuuuagauucuacauauaagugagauuauguggcaucuuuauugcugugccugguuuauuucaguuaacauaagguccuccagguucauccauguuguuguaaauaacaggauuuccuuuuuaaaggcugagucauauuccauuuguguguguguguguguguguguguguguguguguguauguguauguauauaacauauauuuucuuuacucauucauggacacuuagguugauuucauaucuuggcuucugugaauaaugcugcaaugaacaugugagcacaaauacuuuucaaaguagugguuuuauuaauaaacccuuuggauuauacccaggaguggaguagguggaucacagaauaacuugucucucuucacaugguuuucccucugugcauguggacccuuggugucucuuuguucaaguuucuucucauaaagacaccguuuguguuggaucagaguccaccccuauggggcucuaacuuaaucaaccucuuuaaaggcccugucuccaaguauaguuauguucugagguacgaggcauuagggcuucaacauaggaauuuugggggacacaacucacuuagccuauaauaccauccuacagggaucuucuaaaguauaauucuucccuccauguugccagguuugcaagaagcucaguaccguuuggugacugagauacagaagcagaccauuggauuggcuuugcaagguaaagauguacuuggagcggccaaaacuggaucuggcaagacucuggcuuuucuuguuccaguaaguacauugucauugggucagacugucuguuauacaauuuuauaacauucugugcccagaugcagauuauauaaagagauguuuucauguuagauuucaugauagauuggcuagaaugcgagcuucaucaaacaggagccacaugugugucuuguucucaccauuuuccccagguucuagcacagugccuugcauguggcaggcacucaauaacuuacugaaugaaugaacuauugugccuugacaagucauuacauucuugauggaaguggagugcuccaguauggcagguuaaagugguucugugcugcaguaggacuggugggagacaguuucugcucucacccuugugagccugccaguggcauuuauacuugccaccuuguuuaggauaaagcugaaauaugcucaguuuaaggagcuuuaggcauuuguugagaauuuucugggacauugcuaucggucuuuuauggcagcaaaacaguagagcuucuuaggcuuucacuuccaucucuguuacguuggucuccuaauuuuucauuccuauaaaaugacccagaaaaaucucauuuuaguuuuuguuccaaauauugcaaaaaccacuuuucucuuaaauccuaguguguuuuugcccccuuaaaaaaaaaggcucccuauagcuagauaauucaguuacuauauaacuacagcagcuacaugggugaaaguuuauuuacuuauuuuuauuuuuuuuugagaugaagucaugcuguguugcccaggcuggagugcaguggugcaaucuuggcucacugcaaccucugccucccagguucaagcgauucuuucugccucagccucccaaguagcugagauuacagaugugggcuaccacgccaagcugauuuuuguauuuuugguaaauacgggguuucaucauauuggucaggcuggucuugaacuccugaccucaagugaugcacccgccuccuccuccaaaguucugggaucaggcgugagccacugcgcccagccaaaaguuuuagugugguuauuuagaaaaugauaaauauuauucuuaaguguguuguaaaggucuuuggguuguacauaccuuucacugauagccaguuuccugauggcauggcucuggcagcagcugaacuaccgugggguuucuuuucccuuuccucugaguuggggguggaugguucugauggaagauaaacaaaaucauuuacuuuggacuggauaaaacuugagugguaugccuucugcuuggaagaucccuuugauuuggaggggcaagguugagaugcaggucaaaaagcugacuucugaugacuuacugaacaugaauuugcugucuuuuugaggugcuggaagccuuauaucgucugcaauggacuucaacagaugggcuggggguucucauaauaucaccuacgagagaacuggccuaucagaccuuugagguucuccgaaaaguaggaaagaaucaugacuucucagcuggucucaucauugguggaaagguuuguccuuuugucuauguccuuccuuuccuucuguaaccuauacuggaguacuguggccgaugacagggaggcagcagagacuucaucuaaacagacugaccuagaccagggccucaugggauaguagcacuugguguggucgcugcuaucuacgaucugguugccaauuuugcaggcccagaaaguccauuuuuuuuugucggggaaucugaauugauuagccucucuaagacauauuuacucuaauccuguaaaguuauuuguugauauucauugggaaagauauuuccauauaugaacuaguaccuuuuaauaagguaucuaucuaagaggcugaauaauucagaggauugcuacaucagcagcguaagaaaggaagguagacucuuuagaggaauguuuauaguaggucaagauaagaccugcugcucacuuuuguucuaucuuauagcacaucuagaaugccucuaucugcuagaaucuccacuagacugugaggauaaauacuucaauuuuuaugcaaacaugcacaaaagaagaaagaauagcaucacaaacccuuacguaccuguugccuaacuuuaacaauuaacaacauucuguuuuuucccaccgccuccaggacugugagaagugguucuuguaucaaggagagaaccucggcuuuuuucaguucacaaaguacaguccuugagcggugucagagucuguucaaugucccuggguccugaauuaaagaaugagagugauuccaguuuaugucaguucugauccaaauaggaaauccugacuuggaguauucauuugauuauuuuuuuuucuuagccucaaaauccuggguaugaauaagaauuuagaacucugagcuccuuaugucuuccuguaaagacuuuuauuuagcccagaaauguggauaugguucagaaauacaagggaaaaguuauguuuauuuccaagaguaucuaaaauguugugaugaaaugcccaugcagauggcuuuuauagcuuugguacacaggcugcugagagugaugugucuguguaaucaaaauaaauaacuguuuucaggaucuaaaacacgaagcugagaggaucaacaacauaaauauacucgugugcacaccaggucggcuucuucaacacauggaugaaacaguaucuuuucaugcuaccgaccuccaaauguuaggugagucaaaucaauuucuaauuuaaaaaaaaaaaaagcucagacuuaggagagagcccuuauacauuuuuaugauagaaauuuuauguuagauaaauguuaugauucaaaacaaacuuaaaaauuacugaaacauuuuggcauuugggcucuaaacccagaaaguaaaaguagacuuaaaaaaaucagaagaauguauguacgcuuauaugugaaauuaggcacguuaguauuagaccaugccaagguuuuuaacaccugcuucuaauaacuugaaaggucaaauuggcauuuuuuuaaaugaacuuuuucuuuuuugcuugggaauacuaccugauguguauuuuuaaaucaacuuuaucuuugaacauuuuugauuuguaggaaaguugcaguggagaguuccugcauuauccuucagcugguuuccccuaauuuuuuuuuuuuuuuuuuuuuuuuuuauacagaguuucgcucuguugcuaggcuggaguacgguggcaugaucucggcucauggguucaagugauucuccugccucagccucccgauagcugggacuacaggugugcaccaccacgcccagcuaauuuuuguauuuuuaguagaggcgggguuucacaauguuggccaggauggucuugaccucuugaccuugugaucugcccaccuuggccucccaaagugcugggauuacaggccugagccacugugcccagccuuccccugguguuaaugucuuacaugacaugguacuuuuaucaaaacuaagguuaacauugcuacaucauauaaauuccagacuuuauucagguuuuaccaguuuuuccgcuaauguucuuuuucuguuuuaggauccaauccaggauacccauugcauuuagccuaauguauauuuuacauaugauaguucaacuugcauuuuccuuuuucaguucuugaugaagcagauagaaucuuggauaugggcuuugcugauaccaugaaugcuguuauugaaaaucuccccaagaaacgucagacuuuacuuuucucagcaacacaaacuaaaucuguaaaggaccuugcacgcuugaguuugaaaaacccugaguaugucuggguucaugaaaaagcaaaauauagguauguacucuuugagucaaucaagauaaauguuuuuuacuuuuuuaguuuagggauuugguauuuuaaauaucuguuuucugggaauuaagacauucuaugaguuauugguuaugcaaagcauaguaaauauaccaguuaaaauuacccaaauucugcauauaucuuuaaaugucaggguacuugaauguagcauuucccaaaauguggucugggaggggaacaaauguuuuuccauagauguuaagagguauuuuaccauuugccaacacuaccucuuaauaaacgaagggagaagggaugaaauagcaaauggugagucaaagugaaacaguuuuauuucuauuucucacaaccuuuaauauuuucagggacauugugauuguugaaagcagugggagggagguggauguagcuugcuacauuuaccaaauuuuuuggguacggaaucauccuuuuuagcaggauuaugcaguacuaauguguuauggaacacauuuuaugaagugcauuaauauuuagcaaaauaccuuucagucuaaaauucuagcaacuauuguuuugucuuggucucauuaaaaacuagagcuuaaaguauauguguuacaguaaaaguauguauguuugugauaugcaaguaguuggggaaauuuuuauuuaucucuuuuuuucgagacagggucuugcucugucacccaggcuggagugcaguugugugaauauagcucacuacagccuucaacuucugggcucaaacaauccuccugcuucagcuuccugaguagcugggacaaccagggcauaccaccaugcguggcuaauuuuaaaauuuuuuguagaguugaagacuuacuacauugcccaggcugguuucaaauuccugagaucaagcaauccucccacuuuggccucccaaaguguugagauuacacucaggcaugagccacugugcccagcugggauauguuuuaaguuguauuuucauaugacaauuagaagcauauauauuugguaugaaucacugcagacuuccaggagaaauguuuuccaguaaauauaaaguuggauuuuuuguugaagauagcaauguaaauucaacucuucuauuauuuauaucuuaaaauuuuuauuucuucuugcucugaaauguuagccuaaaaagaaauagauuuggaaaaugaauuguguuaucuggaaauuccuuaaauagagaaaauaugaguauucaggcccaucuugaccuuguauaauguaugucuaggauuuaaaaagccugagacgaagaggccagauucuuugcuucugggugaucuuggggaaucugaguacugguaucuuugacuuucaagaacuugggaauggaauaguaagauaugugagguauaguuuuuuucccuuggcuuacuuucgaguggacauugaucucuuaaagaguugagauagcuaugaaaauuuuugugacaauuaacaauuaacuugaaaauguaaagacugcuugucuaggauuuuucacuuuucucuuuuuucuguuugccuccagccuauuuuuaauauucaucagacagauuuuuuuaaucauuagaugucucuaagaccuuucauaauuuaugcaaguuaauuuguacguauuauuuccuauccccaauuucuguagguaagaguugguuauuuucuguaaauuacaaaguuuuagaaaaaaacuacaaagacuuugauauuauuucacaaaugauuuuugaaacccggucccaucacuuauaaaagugugguggacaaaauuuucagaaaaaaauuuuggaagguagacauguauugacauaauuuacaaaaccucagguuauaugauaauggcugcaguauucuaauauuccaaauuuauaggaaacauaaaaaagcagaugcucuuaggaauuucaucuaaugucaauguuagcuuuuccacuuuaguagcuuaucaaugugguucauacaccaggagagauaauaaucaagaauauuuuaagguguuagagaguaucuacucucaaauugugaaggacacaacaacuaaagaaaaauuagaucuuucugaaguuguaagucagagcauacuuagaaaaaguauacuaguguuuucauuaugugguuauauauagacaacugguauuucuaaugauuuuauuuuugagagaauaugccuuugggccauagcaauuugcuguuuuucagugacaaguugaauucuaugguggauuaugaaaaauuucaaauuugagauaugucaugagcuuauguuauuagguauauacaaauuuagaauugcauugucaauuugaaacauuaaucauuaugaaaugcuucuuuuuugcauguaugugcuuauuuucuguggacagucugucuuuuuugguuugguuuuuuugccuuuuucuuauuggcucggaggagcccuuuagauaaauuaauuauuuauuuguaauacgaguagcaaaacacuucccuacucccgguguuuuuucauuuuauaaaauguuucuuuucaucuuuacuaauucuuuuuugccuuaaagucuaguguuuuuugagauggagucuugcucugucgcccaggcuggagugcaguggcaugaucucgggucacugcagccucugccucccggguucaagcaauuuuacugccucagcuucccgagcagcugggauuacaggugcccaccaccaugcccaccuaauuuuuguauuuugaguaaagacgggguuucaccauguuggccaggcuagucucgaacuccuaaccucaggugauccacccgccucggccucccacagugcugggauuacaggccugagccauugugccuggccaacuuuaagucuaguuugauauuagucuaccuauagcaacuuucuuugaguuagcauuugcauggugaauccuuucccauccuuguacuuucuacauuguuuacacccuauguuuuuagauuugucuuugugaguagcauauuuuuaaucugguaugauaauugcuuuugacaguuaauuuaauuauuauuugggucccuuuacuucuuccuaccuuugugucuucauuguuaaguauuuuaauuccacguguaucuuaagccccauaagccacuguuaucacuguuugcaacaucaguauuuauuuagacuuacccaguucuucuucuuguauugucacccuuccaccugagaauuuuucuuuugcucagauaauuuccuuuuuagugcagacuuguuagugaaacagcguuuugaccuuucugaaaaccucuuuauuucaucuucauuuuuuuuugaagccuaucuuggcaguuuuuuuuuccucuucaaagacaucuuuguuguacucuaaguuccauuauuucugucaaagucaucugacaguucucuuguuccuuugaagguaauuuuuucuuuauuucuggccagcaaaugccuuaaggucagguugucuugaucuggucuagccuggcaauuagacucugggguuauccuauuucugguuuguccugagacuugggguauaaucuucacagauggggcauagccuuucucagggucucaaccaaaagacugagguaucuaccagggccccucugucuuggcaaguugugaaccucguagcauugugacccugccagaaucucugcucaguucuguagcuucccaguugguugguuuuugcuuguuuuuccucauuuugacuuaugugugcucuguuuagggguuggcauguuccucaaggguaaauuguaugaaaaauuuuagauucaguuuuccuucucucugggacuugcgacugauguguuuaggcuuaaggcugcuaccuuguuucuccccugucuugcaaucagcaaaugcuuuuggggagaaaagugagguuguuaacagagggcuuggcucagggcauuucuguuuuuuccuuuagcaccucaaguccuaccugccuugguagcucucagaugcugccagucuuuuuguuuuguuuuguauuuauuccugcuuuuguaguugcuauucuaggccagaggguuaaucugauacaagcagcuucuuagcccugcaauuuuagcagcugauagaaauuauugccuagcuccauuauuucaucaggguuugcaaaauugugauauuuuaauucuauuauuucuucauuaguuuaaauacuuucauaucaaagagcuuucacaugaacuaugugauucugagguacaguucuuacaggaaagccagaauauuagaauguaugcuguaacaccaaugaguugguucccuaguauuuucugaagguuagcaguauuuguuuuuggugggggguggagguuguguguacuaaaaaugaacucagauuuaaugauaauuaaugaugaauuaaugauacuuaacucauagauuaaacaucuuuuuauguccuugaaucaauagaaauuuuuauauuuaauauucaucuugugucaucccaaacuucgcuaguagaugcuucaaguuauuaucuugauucuucagaugcauuuuaguaaucuuuggacuccuugcuuucugguguucuaaguuuaucuuaucuauuuccaguucuuuuuuuuuuuuuuuuuuuaagguuauagauuuucuuuuuuuuuuuuuuaauuuuuuuuuuuauuauacucuuaaguuuuaggguacaugugcacauugugcagguuaguuacauauguauacaugugccaugcuggugcgcugcacccacuaacuugucaucuugucaucuagcauuagguauaucucccaaugcuaucccuccccccucccccgaccccaccacaguccccagaguaugauauuccccuuccuguguccaugugaucucauuguucaauucccaccuaugagugagaauaugcaguguuugguuuuuuguucuugcgauaguuuacugagaaugaugguuuccaauuucauccaugucccuacaaaggacaugaacucaucaguuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagauccccgaggaaucgccacacugacuuccacaaugguugaacuaguuuacagucccaccaacaguguaaaagugucccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguagcaaucagcgcgauuccgugggcguaggacccucugagccaggugugggauauagucucguggugcgccguuucuuaagccggucugaaaagcgcaauauucgggugggagugacccgauuuuccaggugcguccgucaccccuuucuuugacucggaaagggaacucccugaccccuugcgcuucccaggugaggcaaugccucgcccugcuucggcucgcgcacggugcgcacacacacuggccugcgcccacugucuggcacucccuagugagaugaacccgguaccucagauggaaaugcagaaaucacccgucuucugcguugcucacgcugggagcuguagaccggagcuguuccuauucggccaucuuggcuccucccaagguuaucuccaguucuuauaaaauccuucuagcaggaucugguauauaaagaccauagucuaagugcuaacaggcauggucauuguguuaagcuuuacaguggacaggccuuuuuaaaagaguucaugcugauaauuacaaaugguauuuagaauuacaagguuuuuauuaagccucauuuaaaaaauauguaucucuuuucucuucugccaaacauucauuccuaaagacuucuguuucaucugucaguguaucuaaaauaguuucaggauaauaccaauauuauuacugauaauaugauuacuuauaaaaguuuaagauuccuuugcauuucucuuuuucuccuuagacaucccaguaaagauguaggaaucaaauuccuucaaaggcauuuccuuugaaauaauuccuuugucauuuagucaucaacuugauauauauuugggcuuauuguuuucauuuugcucuuuuguaaaacuucauucuguuucccauaauucccuauagauauggccuauuucuucuuuaaagacuguuuuuuuagagcaguuuuagguuaaucucaaaauugaaaggaagguacagagauuugccacauaccugcuguccccaugcagccucugccauuaucaacacucuugcuagaaugguggugcauuugcuacaauggauggaccuauguuuuugcauccuuaucacccaaagucuguuacuuuaggguucacucuuggugugguacagcccauugauuuggacaaauuuaugauaacauaugucuacuguuauaguauuucacaguauauucacugcccugaaaguccucugugcucugccuauucauuuauucaucuccccuggcagccgcugaucuuuuuacugucuccauagugucaucuuuucagaauguuguauaguuggaaccauacaguaugguagccuuuucguauugguugcuuucacuuaauauuacgcauuuaagauugcuccaugucuuuucauggagugauaugauagcucauuucauuuuagcacugaauaauauuccauugucuggauguaccacaguuuauuuauccauucacuuacugaaggacaucuugauugccuucaaguuuuggcaauuaugaauaaagcugcaauaaacauccuuuugcagaucuuuguguggacguauguuuucaacucuuuuugguaaauaccaaggaacgugauaguugggucagguacuaaaaguauguuuuuuugagacagagucuugcucugucgcccaggcuggagugcaguggcauaaucucccuucacugcaagcucugccccucggguucaugccauucuccugccucagccucccaaguagcugggacuacaggugcccgccaccacgcccggcuacuuuuuuuguacuuuuaguagagauggggucucacuguguuugccaggauggucucgaucuccugaccucgugaucugccugccucagccucccaaagugcugggauuacaggcaugagucacugcgcccggccucaaguauguuugguuuuaagagacugcuauacugucuuccaaaauggcaguaucauuuugcauuucugccagcagugaaggauaguuccuguggcuccacauccuugccagcguuuggugucgucacuguucuggauuuuggccaucuaauaagugugaagugacauaucguuauuuuaauuaacuuuugccuguugacauaugauauggaucaucuuuaaauuguuuuuuauuuuuuugagacaaggucuuacucugucacccaggcuagagugcaguguagcaugaucauggcucacugcagccucgaacucccuagccugaauugaugcuccugcuucagccucccagguagcugggacuauaggcacaugccaccaugcccagcuaacuuuuguauuuuuuuguagagaugggguuucaccauguugcccaggcugguguagcaucuuuucauaugguuauuuuuuuuaucuacauauccucuuuggagaggugucuguuaagauuuuuggccuccuucccccuuuuaaaauuggguguuucuguucuuauuguugaauuuuaagaguuguuuguauauuuuggagaacaguccuuuaucagauguuuuuugcaaauauuuuucuccauuccguggcuuaucuucuaauucuuuugauaguguguuucacagaucagaaacauuuaauuuuaaugaaguccagcuuaucaauucuucccuuuguggaucauaacuuagucauaucuaaaaccaguugacuuguaguuuuugguuugucugucccuccuccuuuuuucuuucacuguaaacacagacacacaugggugggcauguauauggauauauaauguauagcccccugauaaauaguaccaaacuaucuguacuauucugccccuuaccucuuuccuuaacaguguguccuagacaucacuccucagcaauauauggauagaaucuucauuccuuuuuuacaguugcauaauaauuaauguauguggcuguguaauuguucauacugcaagucccuacugauggacauuuggguugauuuucaucauuuuuugcuucauaaauaaugccauauauuuguguguguguauauguguguguuuaaaaccagaguaauguuggaauaaaguagguuuauuaauucaaagaguaaaugcauguauauuuuucuccaacauuuuauaaugaaauuucaaacauaugguacauugaaagacuucuaccauaaauaccuuauaccaaacaccuagauacuaucuaaugguagcauccauuuacuugcuuucauccaucccuucuauauuaacccauuuuauuuuugauggauuucaggguaaauugcagauaucuguauucucuccaaauacuucagcacacguauuacugagaguuuaauauuugaacagauuuuuuuucuuuuggcauaaaauuuguguaccaugaaauaugaaaauuguaaguauacaguugaauuugaugaauguguauaucucaguaaucuaaagcccuaaugagauguggaauacuaaucagcccagcaaguucucuuacaccucuucuuaguuaauccuugacccugcauuuuuagagguaaucacuguucuugucaugcuuuguuugacauugauuuacaagggauuuugaauguguuuuaaaguaauguguugaauuuguuuccuaagggacaauagagaaaaauucuuuuuuugguguauguguguaggaaauuugcuugagagaugugccacuauuaaaacuuguuuccuuuuuuggucuggauuucaguuacuuacaugacauauucuaauguuuuucuuuuccguaauuccacaagcaccccugccacuuuggaacagaacuacauagucugugagcugcagcaaaaaauaagugugcuguauuccuuuuugagaagccaucugaagaagaagagcauuguauuuuuuuccaguugcaaagagguauuggcuguuuauuuugcuuucugaacguauguugaaugucccuuuugaaauggcaaaucaauuagacaaauuauuauauuguacgagaaguacagugcuagguguggugagggaucuuucguguccuuguugcaaaggaauccguggcugagacuuucaacuccacaaggacagaaacugugucuuuucuuagguauuauguuaagugcuaacaauacuggaaauguaguccucaauaaauauuaguagaaugaauaauuguuauccaagcuaagcagaggucuuuauaaucugauaccucccuuacccuccaagaauaugggaaugaauauaccauuuauuuccaugccguauaucuuuguuuaugcugaucugucuggaaugcccucccugcaucucuucaucuaaaucuggggaaauacuuacuuugaggcuaaguucaaauguuaugccugaaagucccuuucugacacucccuuuuuaaagaaucaguuguucccuccccuaaccuucugaaguguuuuguuuauaucuuaguuaauaaacacuucuugaacacuagcccugugcuaggaauaaagaauaaggauuucagagaugucuaagagaacuuugucuccucucuuaaggagaagggacuacggucuuugugcaugugugcgugcgugugccucuucuccuguacuauauuucagauucccaaugacuuaauagggaauguaguagaucaauucuagauuuacagcuuuugcaauaacuuuccaugauaaauauguagauggguuucucucuagcuuaugggaaguuaaguggugaucugaugcuguugucuacugaaccuuauuuuaccauguaaagaaugacuucagccuuggugcgguggcucacgccuguaaucccagcacuuuaagaggcugagguaggaggauugcuugagucuagaaguuuaagaccagcuugggcaagauggcgacacccugucuuuaaaaaaaaaaaaaagacuucaguuuuucaaggaccgauuuuagauuuucaaagcuuccagucuccugggagcauuccucaaggcaacuuggaaguguauccugagcaguagccaacaacaaaacaauaaacuucacaucuccuaaagaagaguuaguugguuuuggcaucuaggugcuaggaaaugauucugaaaguucuauuuaaaguucuguuuaaaguuucuacucuuuagaguaggagauggcaucaaagguggccuuggcauaguugcccaggguggcaaugcagccucuuggucgagguauagcaauugucaauacccaccaucagcagcagcuucuugggcauggggcugagaugauaccagugccuccugagguggggauaagucucaccagcacagagagggucugucacccugcaagggcuggugagcuugccgaucuuguuccccaaguagccucuuggcacaaggacaauggagagcuuggccaggauaauggcuccucaaauggcaguggcuaccuccuuggagcaccugauacccguaucaguguggccauuguaguccccaguggcaacaugccuugaauccagugcguuggccagugugggccacuuuugcgccauguaaucuuugaaaccucauucuugagagaugcccccaggaaaaugucaaggaccucagacuccuugaugggcaggagaagagauagaucuccuccagggacuuggucuucauguccuucaccaagcagcacagcuuugugacuggcauccaccccuuggcuuugccucaguggccuugguugcaggugcuauugcugaagccuccaucgaagccucugugguuuccaauuccuugucccguggacccuuccgcugcaccagcaucaucugccauuugauguuuucuuggagaagcuguuuuuacaucuuuacgaaagaaaggccuaaguccagcuaucucugauacuugccugauauauugucccagaaucagaaccucccuggcaguagcaaauugcauuugagaaagugaauggcuagugauuggguaacaagcaauucacuugguuucccauucuuuacugucagcaaaauugaagagagacuuuaauggggucuuucucuuuaauugagcgacuggaucaccaaaaauuauuuggaauaauccauuaugacuuuuggccuauuuuauaggagcucagaauuaaacuuccuuugaguuuguuuuauuuaugugaacagauuuuaacccccauauuagagaaaauaaaauaaugcugaacucuuuucagucuaguaauccauaguauccauuuauggguacaaaaagagaaccagaacaauuagcucuauauagucccacacauugagauauauuuacaauguuuuuauuuaugucuaacaguuuuuuaaaucaaaucccaacauauuucuugguuugaucaguucuguauuacuaauuauuuuaauaauugcugagucugagaggaaaguucagucagccuauggccacaggaaauuaaaauaaguuuuuucuuuuguagaaaaugaguuaugauaacaucaauaaaaggcuuucaagcuucaaacuuaagaugcaauucugugacguuaggaaauagaaaugugaauuaaaggagggaaggaaauuaaauugcuugugauuaaauaagaguuucuuuacuuuuuuuacuugguuggaauuggguaucacauugcucugcuguugagacucugugggauacguugauaagagaaaagcuuuauugcugccaucugccauaagcaaacuuauucuucuguugaugccccagguccaguaucuguaccgaguguuuugccggcuacguccugguguuucuauccuugcacuccauggucgacagcagcaaaugagaagaauggaagucuauaaugaguuuguccguaagagagcugcaguacucuuugcuacugauauugcagccaggggucuggguaagaaaacuuccuaucaugaaauuucugugauugugugaaauguaauuugcuuauaaaguauauuuugggaaaucugauagacucaaacacuuggguuucuuuucuuauuuuguaagagaaaaguaaguaguaaauugguagcaguugacuaacauuaaggauguaucagugaaaauuuccacaguauuugcaucuuuuuuacuauuucaugauaaucacaccauagaauccugaggaaccuacaaaaucaaaggggguuaaaaguuuaaagauaugaaaacaauucccauuucuuugaaaauuggaaacuuguuuauagauacugaacucauuuaacaagaaaaaucagugaaguccauguuuucaucauucuaauuuuuaucugauaaauaacuacauuuagcguaguuaaauuuauuuucaaaaccugcuuuguugauuauacaacuccuggcuuugugggaaugggacggggauggacguaacuagagaggaaaacuagacuuaggaacaaagggugagaauaaauaggugauaauuugaauccuucagucacuuaauuuuauuguauuguuaauuacagcaaauuugaagcauaaacaaaagcugaauauguuuaaucuacccucauauacccagcuuuaacaauuaucuuuuucauaauccucccccugucccucuuggaguacucuaaagcauaucucagaugccauauuuauuaguauaggcuggaguacaguagcaugaucauagcucacuacagccucgaucuaccaggcucaagugauacucccaccucagcuuccccagcagcugggacuacaggcaugcgccaugccugacuaguuuuuauuuuacuuaauuuuuuauuaugcuuuaaguucugggguacauguacagauugugcagguuuguuacauagguauacaugugccauggugguuugcugcauccaucaacccgucaucuacauuagguauuucuccuaaugcuaucccuccccuagucccccaccuccagacaggccccagugugugauguuccucucccuguguccacucuucaacucccacuuaugagugagaacaugcaguguuuggguuucuguucccguugguuugcugagaaugaugguuuccagcuuuguccauguccccauuagaaguggugcuuucggguuauuaaauauuaggguauuucacuguuuguccgacacaaagcaaucugucucuuccgugucagauacgaaguaaucuucauauucaaacagucauuaauuuuaguucauuuugucaagagaaauguuuacuaucucuugguucaugcaauuaauuuuauuuuuaauagaguucauagaugauauccaucaguuugaugugaugaaaaguccuggcaagcaauauuuuaagauaaaaauagugcagcagggcagaucuugcaaccaguuucuuaacuucacaucccuucucuguagauuucccggccgugaauuggguucuucaguuugauuguccugaggaugccaacacauauauucacagagcagguagaacugccagguagguguacugacuaauuucuuuucuuuugcuacuaucuaaauaacaaagcaugcuuuuccaacugcagauaaacgaagaaaggaaucagguaagugagugcugguuuggcauuuuguggugugaguugacagcuacuguaaaucauuauggcuaagacuugauuagugcugcaaaaaauccauaaaaaucuuauuuuaguuuguuuaaacuuucuuguacuuuacuuuucagcaaaacugcucauugaaagucaucucauugaauccuaaugaccugucaguuaggucuaggacugcaguaguccucacuuauccucagggguuauguuccaaggucccaguggaugccugaaaucucaguaccaaacccaauauaugcuauguuuuuucagucuaguaacugagacagcuaaguaacaaguggguggggucuuaagcgugcauaugcuggacaaagggaugauucacauugugggcaggacacagugggauggugugacauuuuaucaggcuacucagaagggugagcaauuuaaaacuuaugaauuguuuauuucuggaauuuuccauuuaauauauuuaauauuuuuugggccuugguugacuggggguaacugaaaccacagaaagcgaaaccacagauagaggggggacuacuuacuguauuauuaaaucccuauuuucaggugaggaaacugaaucuuugagcaguuaaacaauuuguucaaagauccacagagccaggauuugaacccaggcagucuggcuuaucuagucuagaucuugugcucuuaccuucuaaaguauaggcuaauaagaggcuaagugauuuggaaucauagauaucucuuuuuccuuucuuccuaguucaggaaacagagacauugcugaagaccacucccuaucucuccuucuuccuauacuccccacuuccucccaaaaguauccuauguuugcucaagagguaugaggaacugucuagaaaagaauguaguaggcugggcaugguggcucaugccuguaaucccagcccuuugggaggccgaggugggcggaucacgaggucaggaguucaagaccagccugagcaacauggugaaacccugucucuacuacaaauacaaaaaaaucagccaggagugguggugugcgccuguagucucagcuccuugggaggcugaggcaggagaaucacgugaacccgggaggcggagguugcagugagccgagaucgcaccacugcauuccagccugggcgacagagugaugcucugucucaaaaacaacaaaacaaaacaaauaaaaaaaaaccauaguaaagucagucauuuggaauuaaguggcauagaaagguauaugaaugaaucaaaaaggauuacacaaucugucauugcuguuaagcuguagcagcaaagcugggagguauacauucuugguggaauuguaaaugguuaacauuuuucuggauagcauaugguaauacuuauuaacaaccuuacaguucuuguuuuugucuuaguaauuccacauccagaaauggaucuuaagaaaauagagagcugaauaaaguuucaauguacauuugucuugcugauguuuguaguguuuaagaauuggaauuuauuaugaucuuuagauuaugauuaugguuagccacagauggacuauuuauucaguuuuacauuuuugcucuguuuucuuucucaucaaaacuggaugauuggguauuuaucauauggauuccaggauuggucuaacuggaccaaugguugcuuccaauuucaugccacaaacucuucucaaaacuuucccagggaugugaggaucuuuaggcccgagcacagacuguccuguuuggcaggcuugcuuuaccaccugcccuguguccacuucagcaaguggccccaaguaugaaaguguacgcuaucccuugcuuaccuaggaaguccccuuggcguuuaguucuuuuagauuucuauacauuuauauuuuuuggguagcuuugaagaaaauuuuuuuguuuuuguuuuuauguggucacuuuuuguuucagcugaagugaagguuuuuaugucuuuuuauagccuagcaagaaauagaucuucuuaaaauucuauuuaauuuucauaagauguuugaauguaugaguguuuaaguguuuuuuuuuuuuguuuuuuuugauugauucauguuuauccugugggccaucuuuaaacgugguuuauaauaaaaaugcacucaaauuaaaugugcuucuuuugaccagcaugaaagaagggagagaacaguauaauaaugaaagacuauuuaaaaauaggauuuaugaauuaguggguucaaaaauaagucuuuuaauugcaauuaaugauguaguuuuaaacaagcaaugcaguuaggauuagguuuuguauaugauacuguacauuuagacaaacuuguuuuuagaacuuucuuucuucuuggaacuaacuaaaaugggacauggguagaauaguugccuguucuccauuuuuaugaggggguagauggugccucauuggucuuuaauguauugaguacaugguuuuuguuuuguucuguuuuguuuuuuuugagacagagugucgcucugucacccaggcuggagugcaguggcacaaucucagcucacugcaaccuccgccucccggguucaagugauucuccugccucagccucccaaguagcugggacuauaggcgcgugccaccacaccugccuaauuuuuguauuuuuaguagagauggcguuucaccauguuggccagguugguuuugaacuccugaccucaagugauccgcccgccucagccucccaaaguguugggauuacaggugugagccacagugcccggcgaguaccuguuuugauugucauucauagugaguauuuuggaaagucaucaguggugguugguggaaugaccuucuccacuguuauucuccucaguaaauguguaguuguguaaauuuuuacauguaccugugcacauaucugcauucugugcuccugugggccucuggauaggcaggguuggauaugguaucucacaagugcauugggccagggguguaggcgcuuuuuauuuuuauuuuuucuuuuccuuuucgauaucuuuaauauaguguauucuuuaaugugauuauuuucauauguauuacauucuuuuuagaugugccagugguauugauggggacagggcagacugauucauaaauagaauacauuuagcaguaaaauucucccuauaugaagauuauuggacaugucaauauaaaucaggaaaagauucuagaggggggaauauuucaagguucuugguuccuagagaaguuguugaaaauuuuauguaguugaacaugccguggugaacauuaaauugggucuuaaugacugaggagaugaagaggaguuagaacaacaucacauuauugugucugaagagagagaauacuaaucugaaaaaaauguuuuaauguaauuuuuaguauggucguuaacuuuuaaagcacaagccuguuugaccuuuuguaaccaauuaaaaguauuuuuacuugacuauuuuagauguauaguauguggaaagguuuagcauauauaaugcuuuuuuuuuuuuuuuuuucuggcaguuuaaaacuugccaauaaugggcuuaaagauaauuagaaaguuuugugggccaugagacugaauaauugaauugaauaaaggcuaaauuaaaauuagaaucuaauuaaaauccuguguauuuggcuguaauuaagaccaaguugccagauaguguuugcuuuugcaauugaacuauaauauaucgauauaggaaaacaaauucauuagcaaaauagcuaagauuuggggaaucuuuuuuucuuuccauauuuuagcuaaaaaagugauuuggguacuuuugucuugaaguaccuaauucuguauuaauuaauuuuaccuuucuaaauuccuuuugaucuauagcaguugagaaauuucccuguauuuuccuuaaccagcacaccccuuuuaacaaaaugaucuccuuuagagauaagugaggccagguauaugaauauaguuuuauaaugcucuauccugugauacauucugucacuuuaaaaagcaauucucuuuagggcuuauaguucuuuugguacaaaaccaagcucuuccaguuuuuauaaaaauguccaguugaaaguagaaaauauuugggaauggaaaauagacaucagauauucucaacuuuaaaaaauguuuuuauuuggggaggguaggggaggguuguggguagaagaugggcauuuauauauaacuauuuuuuucccccagaauaguagaagauaaaauaauuucagcaauauucuaauuuagccuuaugugccuggcuacauuuuguggcgcucagaaauucuguaacauaaggagcagaaugugauuccacuaggggacagcagaggccaaaccuuagcauugcacacucacuggcagcagcuuagaucuuagaaaagaggaagauggccacuaguuaaaaucuguaauaacuucugaagaguucauggcugguugugggagaauacugguacuuuauggaauagcuaaugagaauuuuuuaauagugucuuuaauugguuugugaauugaaauaauaaaaguaaaaagacaguuuucaugagcauuaacuuuccaaggcuuaccauguguaccuuagauauaagauaggagcaaucuuuguuagugaaaaugauuucuuuaauuccuuuagcuuacauuugugaaggucugcagucugcuccucguagauaguggcugaugcuucuuuacgugaccugcuuuuguugguaucuaugauuuaaagguugcauaaaaggucacagcaaauuuauuuugcaucuugaagcaaugaggagcugggggagaguauagccaguauggcuguaggaguagauaaggagggcugauauuucuuaggagucuauuucccagguacccuugggaguauuucuuaggagucuguuucccaggcaccccuuaggaauaggggugcccccacuuuauucuccugucuagucaauacagcaggcacaguguuccuucuaaaacauaagucggauuauaucacuccucugauggcauaccauuucacucagagugaaagccaaugacccccugggccuaaacuauucauccguuuccccccaguuugcuaguauucuccccuuguucucuaugcuccguacuggucuugcuguuucuuuuaugugccaggcgugcuuuugcccguagggccuuuauacuggugcugucucuuuucugcuggaaugcauuuuccucaaguauccacauggcugucuuccucacccuccccaaccacuccuuuuaacccugcuugacauuccuuucuccaaaguccuuuaucaccuucaaauauacuggaguauuuacuuaguauauuuuuacauugcuuucaccuugauuguaaguuccauaaaggcagcaauguuugucuaguauauugauguacccuaagugcuuagaacaggaccugacauguaguagacuacauuugagauagugauucagacucaugaaucagaucuuaccuaauauguuaauuauuuauuguuguauaacaaauugacccauggcuuggugguuuaaagcaauaaccauuuauuaucgcagcaaccauuuaucuuguagcuucugugggucagguacccagugugguucaucuggguccucuggcucucagucuaucacaaggcuguaaugaaggugucagaugguacuuuaagguucagcuaggguugcauucauucucagauuuauucacaugguuguuuccagauucauuuccuccucugcuguuggucagaggcaucucucaguuccuuuucaucuggucuucuucacaggauagccacaacaugguaacugaccucaucagagagggcaaaugacagcugagggagagaaagaugaagcaguaaugucuuucaugaccuagacuuggaagucacaguccaucuuuccuguaacauccugggguugcaugucaguucuguuccuuguagggggacuacacaagggugucaauaccaggaggugcagauuauugggaguuguuuuauaagcugccuaccacacccaacgucaaauuuuaccucugauuucaaggauaaaaacaauccugagguagaagugaaacaagaagaggugugggaucuccacuauagcucccugguuauuuucuugccaaauuagggcaugcucuggcccagguuaacauaggagacucuaaauaguguguggcuuagauggacacuugcauagauggacuauuuguauacucgguuacaaagcccaccagagaaacauacuuucaaauccauaaauugugaacaaccauggugcauccuauuaaaagccucucauaggugaggacucucaccuagcaaauaccauguuuguuucccuggagaucugucauuaauauguuuucuaggagauuugaccauaucacuuuuauugggguggagggagcgcagggcauccucuucccuaccucccaccccuguaccacacaaagaacgaauggacugugguuuagccuuuugcuucccaaacucaauaaauauuuguaugaauaaacucauuuagcccauagaacaacucaugaaagagguucucauauuaggaaacucuuucucagagacuuugagguagauuaugucgaugauuucucaguuuaguaaguaccaggccugggauuuaugcuuagaucuuucugacucuagaacucauucuugccagugugcccugauccagcuguuuacaucuaauggauuacaucuaauagcgcagaccugcagcucccaugcagggcuucuagaaugcaugagagccaguuacugggagaagaaagguagaugucuucaaauuuguugacauuuguggucaugaagacgaacuaguauaugcauuuucuuucuuuggacuaggagagauagacauccuguaguuguuccaucacugcuuuuagaaagucaggaaucuuagguuugaauuggacuuugucacuaaugaccguguacccuuggacaagucuuuaacuucucuaagccucaguuucuucucugguaaaaugggguuaauuguaucuaacucuuauuuccuggaaguauaauuuuagguagcaguaccacuuugauuugcgguuucuuuuuauucuuaauguguuacaauuuaccuuuuuuuuuuuuaauucuuuucaggggacaaaguugauagaauuuaaugauuucuacccuuucucugugaaccccauaaauccuuguucuuagucagugcuagaagcuuuccaugcaauacguauuagccagcuugguuucucucuaauuacuuacagugaacuucauuugucacuguugggccugacaugguauaccuguuuguuauuugagaucuuaaggugcagaugacuuucuuuuccccagaauauuuccaaaccuguucuuuuuuccuuuuuuaaaucuaguauagaaucgucagacauuccauaagucagagauacccuuuuucuuggaauaagcucuccuuuguaccauguugugcaggaggaacagaacaguuggacucagaucccuuauggcugucuuucugcaccugcauaacagacugcacuguucucccccagugacaugaaaucuuggggaugguugucauagguaaggcugagguauagggagaauagaaggagauacagggcgggaaaaagagaggacugugcgauaguagagcguaaccaacaaaugucucccuuucuccacuucuugauuauuguauugugagcagugacuagcauaucaguagucagaguuguagaguuuuagauccuaaagggacauaaaucagucaauuguauaauguagaaauaagaaaauguaguaaauagugauuuauuuuaucuaaaguuauacagcuaauagcuaauaguacaacaggacuagaacccaguucuuuugacucuaaaucugguguuuuuucuuucuucuucuucucuuuuuuuuuuuuuuuuuuuuuuuuugugacugagugucugugacucugucgcccagaguggagugcaguggcgcgaucuuggcucacugcaaccucugccucccggguucaagugauucucuugucucagccuccugaguaguuggaacuacagggugcgccaccauaccuggcuaauuuuuguacuuuuagcagagacgggguuuugccauguuggccagacuggucucaaacuccugaccucaggugauccacccgccuggaucccaaagugcugggguuacaggcgugaaccacugcgccuggccaaguuuggaguuuuaucugcugaaacagcuucuaguguucacucaccaaauauuuguugugcauguuuuagggacacaugacacaugacacaugcccucaaauuuaauaagauaaggacauauacugauauugguaguauuaggauguauguuaaauaagguaagagugaaacaaaagauauaggucuuaaaaacauaguuuuuuuaaaaaacuuauuuuuaauaacuuguaguacaaaaauaaugcuuacuaacuguacagauucuagacaauaaugacaaaacaauuaaaaucaccuaaaauccaccacuuagaaauguuuuuuucguguaugucugcauauauuuuuucuaguuacaaaaaugggauuguucuaaauaaacuuuuuguaaccuaacuuguaacauggagaaccaggcuaagagaacugaggguggcuaggcaguugugaauagcguaucacagaccaugguaggacaauagugggaaggaugaaugagcaaaguuuaagggacaauuaaagacccaacuagaauggaguugauggguuggagaaucugaauuugagugguagaaggcaaauuauugcuagaauggcagggcuuuuuuccugccucuggcucuaguuuguuugaagguuauuucaguggaagaauuaacugguacacccaagccaauggacuggauuccuauuuuaacuagaaauacuagugagcugcaggauguggagauaagcuuucugauaucagcuagacaaucaugaccaaucuguugaguauucuuguuucuggagggaauucugguauaacugaaaaagugguggauuuagagguuuaaagucucugauauuaguaaccagcugauuuuaggccaaccucuugggcucucagaaauacuauuuuguauugcuacuuccuacugguugcuugcuuuuaagaucugcaaguuuauauauuaauacaaaaaauguuuuucauaaauuuggaagagcugcauaaauuaaauauaguauugauauugauggcaaaaaugaaauuuuguuucagaugcuuguuaucgggcggcuagacucuguuaaaauaguucaucauggugacuaguuaauaauacuguauuguauucuugaaaaaugcugagaguggauguuaaauguucucaccacaaaaaugauaacucugugagguaaugcauauuuuaauuagcuagacuuaacuauuccacaauguguguauacuaagacacaauguguauacucuaagauaucauguuguacaugauaaauauaauuuaucgauuugaaauaaauauguuuugaaaacaaaucugucuaaauauagaauuuuaaaguguagaucuuuuuuuuugagguggagucucacucugucuccaggcuggagugcaguggcgcgaucucugcucacugcaaccucugccucccaggugcaaacaauucuccugccuuggccucucgaguagcugggacuacagccgugugccaccacucccagcuaaguuuuguauuuuuaguagagacaggguuucaccauguuggccaggauggucucgaucucuugaccucaugauccaccugccucggccucccaaagugcugggauuacaggccugagccaccgcgcuuggccuaaaguguagaucuuuugaagaacacuuauuucuuauauguuuagccuugggccuugaauauugcuuuugaaaucuaaaagcuugcucauggguaaauagacuuuguucuugcaagcauuuuuuaaaaaagugaaauguucuuaugccuucuuuuaaaaagugcuuuuauucuagaauaaaagcuuacuggggaacuuuugguauuagcgugugggagauaacuugugguuuauguuuuagggaaaagauguguguaauguaaaauagguaaaauggccaguaaucuuuuuaaugggugcuugccuuauggauuugacuuugggcauuuuccauuuuccauugggagucuuuuucuucuaaaauuccacuguuacuauuugucuuaaccuuguguagccuucuauauauauucuguuagcuguggcuuuaaaagguuugaucaugggcccuuugugacuuuaguccugacucauccucccaggugcucccugggaaugaguagaugagauggacagaggugugacuagccuuauuauuccuuucuaggagucaguuggaacaugagagaacauugagugaaugccuuuuuggucuccuagguucucuuacucuuugccaaaguucuugcccuauguagauuugugggccuauuuauuucaucuugccaucuaugaacuugaauauagaguauuaaaaggauugacuguugccuagcccucagcucacuguucucuguccuuaugguuccaaacagaauaagccuuucuacuucugaagguaauucgcuuaaccucaagagucuggcugccucaagggcguuuuggaaguguacugcuuaggagucagcauuaacugauuccuguccucuuuggaccugcaaucuuuccuugguggagugugagagcuucagaaguuacgacaucucuccauuaucuugucugcucagugugucaccucacugcuucaugugcuagugaaugcugccuucauacaugguuuggucccauacugcuuaggggucugcuuuaaauucauaauuuuguuagugaacgaagaugaagaucuuugagucauauuauuuuguguuaaaauacuaugaggaagguauuugguauuagucuuucaguucuaaaacagauaauuggugaaaguaguaaauuguauguucagccucccucuguccccugucuguugacuagaaaaagcaaguaggugugaagaagaugaaaguauccacuggacucucaaauggugccuuaucccauggaaaacucgacuaccccaucuauaucccuuccccuaaugucggacaaauuccuaauuauucuuuaggucuuaguuuagauguugguuucuccaggcagugccaccucucaguaugucaaagccaguuuuuccuuccagcauuugaugauaaaauucuacuuacauauuggugguauucaaucucuguaugcagagacauucuggggccucuaaaagcaggcucuaauguaccuuucuagcaaucuuuccugcuguuuguguacgcuggcuucaguggaauuucucuuuuucuuauucacucuuuaauacauuuuccuuguauuuucuggcuuccacucccuuguucaugccauucuccuccuuuguaguaccuuauucucuucacuacuuuagaugcuaaugacuuccggcugcauggaugguuuaguccaauacugccuagggggacagcuuuaaacuuguauuucuuuuccaucuucaaggcccaccugaaauuucauuucauauucuaugacauguuuuuguuuuucucuggcuaacccugaguggccucuuuuccuuucugaguugguguuuauugcccaugguuguccuuuagcaccuacuuauuuacuguuuugugacuguucucuugacuguuuuacuuguguguuuguuuuuucuaguuaacaggaacauuagaucacuggagacagggauuuucaucuucuguuucuuuauguucuuuacaguucaugcccacccaccacaaaguuucucaguaaaaaguuuauuugcuucucacauuuuauaguaugaauccuggugagagugcuuugagauuuuuucuucuuuuuauuuaaaaaauuucuccaaguauccguuguguucucuguuuuacugcuuguauguaauggcugacauuaagguauugggaaaaucuguaugcaaguagcacaagaagcuuaguaacuacaggaugucuuguggcccaugucaguacaaauuucugaagaugcagcaggaaauaagauuuuacuaggugagggaagagaaguaacauggauuggaggcaagcauuuuacuugaacaguucuauuucuuucuuuuuuuuuugagacggaaucuugcucuguugcccaggcuggagugcaguggcaugaucucagcucacugcaaccuccaucuccuggguugaagcaauucuccuaccucagccucccuaguagcugagauuacaggcaccugccaccaugcccagcuaauuuuugcauuuuuaguagagacaggguuucaccacguuggccacacugaucucaaacuccugaccucggguuauucacccgccucggccucccaaagugcuggaauuacaugcaugagccaccgcacccggccgaacagaucuauuucuuauaacuaaugcuucagaacaauuuuacuuccaagguguaaauaaaauccccaggaagaggaauugauuuuuuuuuaaaaaaaguauauauugggugcuguauuuauucaaagauuaacuuuauuaugauccucuaguggcuugagugagaaauugucuccuuguuauauggguagagagcuauuuaagaaaaucucuuuaauugauuucuuucuuagaauuuagaucaucaucuguggaacagccuaaaagucacugggaaugauaacuagugaugaaaaugauaugagguguucagagcccuaguuuucuguuaucagagauuaaaagccagucucugacauuuaugguuagacaaaaaugguuuccauguuuaccuaugcaucacucuguuaaaauguaaaaugcagauugcauugauguguuaaagauuuuguuucuuuuuguuuagguacaaagaggauggugaagcuuugcuaauuuugcuacccucagaaaaagcuauggugcagcagcuucuucagaagaaaguaccugugaaggaaaucaaguaagagcuacuuguugucuuuauguuuuuaggaaaaugagggcaugaaauuguuugcuuaauuaugugcaccuaauuugccccuuccccuaauuuauucaacugccugguuugacuuuuauaaaaaggcucuuuuuagaacaguuuuagguucacaggaaaauugagaggaagauagauuucucauauaccccauuccccaaacaugcacagccucugccauuaucaacgucccccaccagaauacaucugcuacaauugaugaaccuauguugauguuauucaccaagguccauaguuuacacuaggguucauucuuggugguguccauucugugugcuugcacaaauguguaaugaugcauaccuaccauuuuaauaucauauggcaguuuucacugcucuaaaaauccugugcucugccuauuuauuccccuccccucccccugaaccucugacaacuacugaucuuuuuacugucucuauaguuuuauuuccagaaugucauauauuauaguuggaauuauacgguaccuagccuuuucauauuggcuucuuucacuuaguaguaugcauuuaaguuuccuccaugucuuuucauggcuucauaguacauuuccuuuuaguacugaauaacauuucauugucuggacgcaacaguuuuuauucaccuacugaaggagauuuuuuuguuaguuuuguuuugaccuuguuuauauaaccagcuauagccugguuauaaaaaggacagauuuguauugauuuuaugcaaauaaccacauugccauaaaggcuaguaaguugucugaauucugaggggucagggagaauaaggugcuauauaaagaaugucauuuauagguuacuaaauagaggguuaaagauagaucaagaagagaaaagaucuuuucauucccuuaauaaaaauauguuaaaccacaucaguaauauuaaaaccaaaaagcuacaauuagauucuucucagcaguucccuuaauccuacuuaagucuuauaacuaguggauguuggauuaacguucagcuuucaaaggucugaaggacaucuuaauugcuuccaagcuuuggcaguuauuaguaaaccugcuauaaacauccaugugaagguuuuuguguagaccuaaguuuucaacuccuuuggauaaauauuaccaaggagcuugauugcugggucagaagguaagaauauguuucauuuuguaagaagcugccaaacugucuuccaaaguggcuacaccauuuugaauuccugccagcaauuaaugagaguuccuguugcuccacauucuugccagcauuuguagauauucuuuaucaaggugaggaaauuguccucuauuccuaguuuacugaguuaaaaaaaaaaaaaaaaaagaucaugaguggauauuggauuuuguuaaaaaaaauuuuuuuuuuaaaaucugaugagaucaugugauuuuuuuuuuuucuuuuuuagccuggugaugugauggaguacauuaaggucuuuuuuuuuuuuuuuuggaauguuaaaccagccuugcauuccugggauaauucucacuugguuaugauguauaaugauuuuuauaucuuguuggauucaaugugcuaauauuuuguuagauuuauaccuaaauguuucauuuuugggagugcuaauaauguaaaugguauuguuuuuaguuucaaauuccauuuauuuauugcugguaaauugguguucauaguauuuuuuuuuuuuuugagacagagucuugcucugucguucaggcuagagugcagucuugcaaucuuggcucacuggaaccucuaccuccuggguucaggcaauucucaugccucagccucccaagaagcuagaauuacaggcaugugccaccaugccuggcuaaauuuuguauuuuuaguagagauggggucuugccauguuggccaggcuggucucgaacuccuggccucaaacaaucugccugccuuggccucccaaauuuguucauaguagucuuuuuauccuuuugaugucuguggguuuuguggugauguucccuuuuucauuugugauaaaaacaggaaagugauuagcuuuuguauauuaaucuucaaucuuguagucuugcuaugauugcuuauuagucuagaaguuucuuuguccauucuuuucgauuuccuauauagaugaucauggaucugugaacaaagccaguuuuauuucuuucccaaucgguaugccuuuuauuuccuuuucuugucuuauugcauuaauuaggacuucuagaaugauguuggacagcaguggugagaggggacaucauugcuuuuuuccugaucuuagcgggagagcuuccaguuucucaccaugaaguaugauauuagcaguagguuuuuuguauuuguugaggacuugcaucuaucauuaugagugauauuggucuguaguuuuuucuccccuguaguggccucauagaaugaguuaggaaguauucccucugacucugucuucugaaagagauuauaggaaauuggcauuucuuucuuaaauguuugguagaauuuaugggcgagcccauccgggcuuggugauuucuguuuuggaagguuaugaauuauugauucaauuuuuuuaauagauaguagccuauugagaguguuuauuucuuguaagaguuuggcagauuuugucauucaaggaauugguccauuucaucuagguuaucaaauaugugggcauagagguguucauaaucuuuuuauccuuuuuauguccaugggauuuguaaugauauuccuucuuucauuucuaauaauaacuuguauccuuuuguuuucuuaguaugguuauaggcuuaugacuuuuuuuaguuguuuauuuuuuucaaagaaccagcucuugguuuaauuuuuuccccccuauugauuuccuguuuucaauuucagucauuucuacucuaguucuuauuuauucugcuugcuuuugauuuaauuuaccccuuuucuguuucccaaguuggaacuguagaugauugauuuuuagguacuuucuuucuaauacagucauauguugcuuaaugaugggaauaagugugagcaauggaucauuaauuuuaggcuauaugguauagccuauugcauuuaggcugcaaaccuuuauagcaugaauacuguacaugcuguacacugaauacugugggcaauugaacacaaugguagguauuuguguaucuaagcaugucuaaacauagaaaaggcacaguaaaaauacaguauaaaagauaaaaagcauaccugcauagggcacuuaccacagugcuugcaggacuggaaguugcucugggugucagugaguggugcaugaaugugaagaguuagcacauuacuguauacaaguguagacuugguaaacacuguacacguaggcuacacuaaacuuuuuuucuucaguaaccuuagcuugcuguaacuuuuuuuguuuuauaaacuuucagcuucuugauucuuuuguaauuacacuuagcuuaaaacccacauuauacagcuacacaaaaauauuuucuuuauaucuuuacucuacaagcuuuuuuugguuaaaaauauuuguuuucccuuaaaacuuuuuuuuuuuuaaauggagccuaggccuacacagggucaggaucauuaauaucacugucuuucauuuucacaucgucccacuagaaggccuucaggggcaguaacaugcauggagcugucaucauuuaugauaacaaugccuccuucuuuaguacuuccugagggaccugccugaggguguuuuuauaaguagaaggaaaauacuguaaaauaaaaaguauggugaauaaaucaguaauaguuguuuaucauuuucaaguauuauguaccauaccuaacuguaagugccugucagugcaguguguuugccuacaccagcaucaccauaaacacaugaguaauguauugcccuauaguguuaugauggcugcgacaucacuaggugauagaaauuuuucagcuucacuagcacacugcagccucagucuccuaggccuaagugauccucccgaguagccugcgccaccaugccugguuaauuuguuuuauuguuaguagagacaaggucucacuauguugcugaggcagaucuugaacuccugagcucaagcaguccuccugccuuggccucccaaagugcuagaauuacaggugugagccauugcuccuggcugucauuacagucuuaugagaccacuguuguauaugcaguccaucacugacugacacaucauuauguggcccaugacuguauaugcauucagugcuauaaauuucccucuaaguacugcuuuuguugcauuccacaaaguuugcuaaguuauuuucauuuuuauuuaauucaagagaaauuuuaaaguauuuugauuuuguuuugacuuguguuauucagagguguguuuaaucuccauguauuuuagaauuuuccaguuaccuuucugcuauuucuauguuauguuaugacagaguuuugaucugucgcccaggcuggagugcaguggcacgaucucggcucacuacaaccuccaccuccuggguucaagcaauucuccugccucagccuccugaguagcugggauuacagacacgugccgccaugccuggcuaauuuuuguauuuuuaguagacgugggguuucgccauguuggccaggcugguuuugaacucccgaccccaggugaucugcccuccucggccucccaaaguacugagauuacaggugugagccauugugccuggccucuguuauuucuaguuuaauuccauuguggucugaaagcagauauuguaugauuuauauuauuuuaauuuuguuaagauguguuuuauggcccagaauguguuuuauuuuggugaauguuccaugugagcuugagaagauguguauuauguuguuggauaaaguagucucuagauggcuguuguguccaguugauugaugguauuguugaguucaacuauguucuuacugacuuucugccugcuggauuugucuauuccugauaguaggguguugaagucucuaauuauaacaguggauucaucuuucugguugcaauucuaucaguauuugccucacauaguuugaugcuguauuguuaggagccuauacguuaaggauuguugccuuuuuggagaauugacuucuuuaucauuaugucaugccauuuaucccugauaaguuuauugcuuggaagucugcucugucugacauuaguauagcuauuuuugcuuucuuuugauuaguguuagcaugauauauuuuuuaucaaaccacuuucauuaauuuaugugucuuuauauugaaaguugguuuauuguagacaacauacaguugggucuuguuuuuugauccacucugacaacaucucuuuuaauugaugcauuuaggcuauugauguugaaagugauuuuugauauaguuggaugaauaucuaauguauucguuacuguuuuuuguuaguugccccuguuauucuuacuuuugucuccucucuuucagccucuugugauucugagcauuuuaugacuguuuucucuccuuagcauaccaguuuuuuuuuucuuuuucacuuuuuuuagugauugcucuaauguuuuugcaaguaauccaaagcccauuuugaaauaaugacauaaugcuacagcacuucacagguagugugaguaccuuauaacguaauucugauuucucccucgugucccuuauaucauugaugucauucauuucacuuauguaaagcauacauaagcguauauacauaagauauauacauaaacauacauaauuaaacacgcuggggcuauuaauuugaaaaaacuuagauuaagaauaagaaaaauuuuauuuuaccaucauuuauuccuuugaugugcucuuccuuuguuaugaagaucugaguuucucacuuacguuuuuuuuuuucucucuaaagaacuuuuaaacauauuuugcaaggcaauucuacuggcaauaaguuuugucaauuuuuguuugucugaaaaaguguuucucuuucacuuuugaaggauaauuuugugggauacagaguuccaggcuggugguuuuucucucuccacacuuuaaauauuucauuucacucucuccuugcuugcauggugucugagaaaucagguguaauuccugucuuuguuccucuauagaugaggugccccccguccacuucuuucaggauuaaaaaaauauuuaauuuucuguaguuugacagugauaugccuagguauagucucagucugucuuuuucugucucucccucucgcuugggcauuuguccugcuuggagcuuucugagcucuuggaucugugguuuggugucugacaugaguuugggggaaauucugagucauuacuguuugaagcauugcuucuguuucuguucucuuucugauauucagaaagaacaucauguguauguucacuuuuuguaguuguuccauaguccuugaaguucuguuguguuguuuucagucagguuuggaaguuuuuaucaaguucagagauucuucccucagcuguguccaaucuaguaaugaacccaucaaagguauuaguaauauguguuacaguucuuuuuguucucucgcauuucuuuucgguucuuucuuaggauuuccaucuuauuauguugcucaucugugcaugcugccuguuuuaucuauuagaaucccuagcauaugagucacuguuaguuuaaauuacauuucuggccuaaugcuuccaacaucccugccaugucugguuaugaugcuugcucugucucuucaaauuauguuuuuugcuuuuaguaugucuuguaauguuuuucaugauagauacgauguaccagguauuauaaaaagaauugcuguaaauaggccuuuagugauguuagugcuguggugguaaggugugagagggugggggcugugaggaaagcauucuuaagaccuauaguaggucucagucuuuuugugagccuaugccuccggacugugaacuuuacaaauucuuuucagucucugccuucccaucaccccaacuuaagugggaaaggauggcuagaguugggcauuucccuccccucaggucaguuaggcucagauaaaacccuaagaggcuugacuuucauuaacaaggcccacccucaggagaaacuaguuaagaacagagugcucaggcauauuucaaaaugguucauuuuccccuuguuuugcugaaagcaugagggaauuuuucugauauuuacugugagaacuugguugagcuccuggaguaaaacucaugaguguggggcugccuuaugaauggguccuccuggaguuuuuauuucucagacuuguccacauugaggcuccagcagguuuuaucaauuacaguugagggucucucacccaggcacugccucccccaguuguuucugcucaugacucagcucaaguaagcugugaucccuguacucaccucucucuuuccuguguugggacugugguuuguccuguguuguccaucuuuaucauggauaaaagaagaguuuuaaauuuuuuuuuccaaucuguucagcuuuuuacuuauuguuaugauggagugaugacuuacaagcuccauccauagggaacuggauaucagaagucugacucuuuuuuuuuuuuuuuuaaagucuuaaacggccuuuucugaagacuauuaguggagaacaugagauggagaacuuguuaacuucaggaagcacugaugauugaaagaaugaaaucucuuggauggaauuacuuuugggguugucuauccauuucagagaguugugaucuccugucacuaaggauguguacauucagcaucagugggauccaucagaaucuuacuuguauuggcgcuguugaaacacccuggcuugauuugccuaaaaauaauuuggagagugguuagauuuggggaggagaguugaggauguagaagagacaaaacuggcugugacuugguaauuguugaggcugagugaaagucucuaacuuuucuuuuguauauuuugaaauuuuuuauaauaaaaauaaguaaaaacaaucucaccuaccaccaccuaucaccauucuggcuuugcagaaacaacgugguucagccuaaaaucagagaaacaaugaggucucuuuugugaagccuagaccucuuuaaaauuuuuuuuuucuuucccuguagcuuaucugggcagaguuagauaucaucucuguuauaguaugccuaauuucuaaauaaggaaaucacuacaaucuuuggcuacuuguuuauuacuugaaauugauuuuaugauauuugacugaaacagaaacauuuauaaaaaugacauuagggcuaggcaugguggcucacaccuguaacucagcacuuugggaauccaaggcagaaggauugcuugaggccaggaguuccagaccagccugggcaaaacagugagaccaugucucugcaaaagaaaaagcaaacaacagacuagccgugcauguuggugcaagccuguaguccuagcuacuugagaagcugagaugggggagggucacuugaguccagggguucaagguuacagugagcuaugauugcaccacuacacuccagccucacugagggagcggggugagaccucuuaaaaaaauuagauuuaauuuauuccauuucauauagaauggaucucucaugggagacuacuuucuaucuguugaguuaaguagccaaugcuaacugugguguuaauccaaguauuucacucagcaugggauguuuggagaaagugucugacaugucauuucuuucuccuguguuauucauaguagguaagagugucaaacuuaugucuaguuuaauuuccgucuaaucugauucauagaugagaaauaguuauacauuuaaaaauacugaggaaaauaggaaaaugcugcuuacuauuuuuagucuccaaauuugagauaucuuauuuuaaccuuuaucuuuuuguuacaaagaaucaauccagaaaaacuuauagauguccagaaaaaauuggaaucuauuuuagcucaagaucaagauuuaaaagaaagagcucaaaggguaagucauuuuucaguuggauacuuucauugacuggaaaaacaguaaaguuuaucauuuucugcuacuucuagguugcauguuuaugcuucagauauucaagcaguguaauuugcugacagauaagucuagcuuauuuuuuuuuuugagauggagucucacucuguagcccuagcuggagugcaguggcaugaucucagcucacuacaaccucugucucccaggcucaagugauucuugugccucagccucccggguagcugggacuacaggugugcgccacuaccacaccuggcuaauuuuuuuguauuguaguagagacaggguuuucuccauguugcccagaguggucuugaacuccugagcucaggugaacugccuuggccuccaaaaguucugggauuacaggcgugagccacuacgccuggccagucuagcuuauucuuuaaaauuuugaaaaauauuuuuuauauauauggauugggaaaaaucaucguaaguuuuuucaaagacauauggaaaauccucucaaaugugauuuuuuggaugcacaguggccugauuucuaauacuugauaacauuauuaaguuuuuauuucuuuuguaaaauugcuauaacuccugauuguacuuucuugacugugagauuaauaucuuccuacauuagauuaaauuucuagaaagcauagaacugcagccaaauuaucuuuaggaaugagauuuuaacuuacguuuaugacuuguuguuccccaauuacuuuucuggacuuaaagaucuugauuagcaaauacauaaagaagucaauauuuaguuuuauuuuucuuaauugauaaauuauauuucugguauguaacauguuuugaaacaaauauacauuguguaauugcuaaaugaagcuaacuagcauagguauuaccucacauacuuguggugagaaaucuauuuuaguuaaacuuuuuuuuuuuuaaaguuuuuagaauauuccacaguagauucuucgguaaaagaugugaaauuauuuuucauuaugcuuuccaaucuuucuaaucuuugaauuaacagauauuugaguucuuaucauuuucaccuguccuuuauugccauuuauugcauuuacaagaucuuugcaucucccauagcauaucagcaaugagccagagaguagggauucagagguuggauucuauuucagcagauagaugaggugggaggaagaauauaaagaagaguuauagaaaggucacccuaagucgauaggguagccugagcagaaaaacauucaauaguuaggguuuuauguaaugguuuugaaacuguuauuccuggcaaagaaguaaguuuuuuuguuuguuuguuuuugauacgcaguuucgcuuuuauuauccaggcuggagugcaauggcgugaucuuggcucaucgcaaccuccgccucccggguucaggugauucuccugcuucagccucccgaguagcugggauuacaggcaugcgccaccacacccggccaauuuuuuguauuuuuaguagagauaggguuucaccauguuggccaggcuggucucaaaacuccuggccucaagugauccgcuugccuuggccucccaaagugcugguauuacaagcgugaaccaccacgcccagccagaaguaaguuuuauauaaagaagagaucuuaaauuuuuugcuaacuuauuuuauauuuuagcaaauuaucauuggugugcuuagaauaacauuaaugaugaggcuaaaauuuaagugcuuacugugugccagguacuuaguuaugacaaaacuguuuuacaugcguuguuaccuaaucuuccagacaaccagugagguaggugguauugauuugacuguacaaauggguaaaugcuagcuugaaaauuaaaaaaugucuuggauggcugguugggguggcucaugccuauaaucccagcacuuugggaggcugagguggguggaucacuugaggcugggaguuugagaccaaccaggccaacagggugaaacccugucucuacuaaaaacaaugacaaaaaaauuagcugggugugguggugcaugccuguaaugccagcuacuuggguggcugaggcaugagaauuccuugaacccuggaagcagagguuauagugagccaagauugugccauugcacugcagcuggccuacagagcgaggcucugucucaaaaaaaaaaaaaaauugucuagaguaacauaguuauuaaguggaagaccugagacugaacuccaggucuagcuuucuugagaucuacuguguuauaucaggagaaauuaauuccaaaauaugagagcaucaaaugguaagcuauaccaaguuggacuucuauaagcucacuuuaccugagaaccuuuucauuaaaggaucuuugaacaaaugguuaauauucauuuuucuuaaaaaugaauaggcaugcaaacauguacauuuuuuuucuagcaaacauccuucaaacuugcaguugaaaccuaggagcuuuggaaguaguacacacauuuaaaaauauuagauuaauuuugguaugucaugacuuacugcaugccuaagaggucauucaguuaucuaucagaaaauaugaaacauuggaaagauguuuuuucacugguuugugcauacaacggaugagccuuccagaacacugauuauagaaaaguguguugaaauaaaugaugugauuuauugguugucacgcaugguuuagcagaauggccaacuguguugccagcagcagcaagcuaucuaguuucauagaagugauuuucuagguuuugauuauaaucuggauagaacaaaagugauaagcaacugaggugauugcuuguggaugauuguaggggaaaaaauuauuuuuaaacuggugccauucauuguuuuuuaugccuauggagacagaaaaugguuuggagauuaguuggguagaaaggauuaguguaaagcuagauaaaacaugaaguuuaggaaguaugcaaacaggaacuaaauauacuuuacaaaagucaacuuaaaaaauuaccuagaugaguuuuguuaucuguguauuugacaaacugauaaaggaucaggacccuguuuauauucugguuuguguaacucuaguaugaagauaguuuuuuuuuuuuuuuuuuuuaacagaaacaaaauauuccaaguuaaugaugaauuacuugaaaucauaaaaaagaaaagcuuuagcaauaaaguuuuuccugaaaugguuuuauuaaaucucaauauguaaaauuuuauuuaauugaaaaccuuaucuuuugauacaauaauacaaaauauuaucaauaacuagcauuuguuguuacuauauuccagaaaauaugcuagguaucuacaugcauucuucuaauuuuauucucauaacacucuaaguagaagguaauguaucccuuuuuugauagaugaggauacugacauguagagaaacaagaaauuugcucagugaguaagaguuuaagcuuugaauagauuccaaaucuauauuauuccaaagccuauauuuuccccaugguguaccuuauuguaauggaauuauacugacuuuuagaguagccuuuuggaaagaagauauucuggguuagguuggcuugaaaccaaaugcaaaguuuuuuucuaauauuacaguucuaaaagguagguuuucaugugugcauggaauggagauauacugaacuauuucgugguuuuucaguacuauugaauuuaucccauuggcuaauuuucuuauauuuuggucuaaacucauuuuuaauuucuauuauauuguacuuuucaaccucuuaauuuacaguguuucgucuccuauguacgaucuguauaucugaugaaggauaaagaaguauuugaugugagcaaguuaccuauaccugaauaugcccuguaaguauucauaauauaguuguaauagugaauccucaagguuagagggaauuaauuaauuaauuuagagauggggucuugcuauguugcccaggcugucucaaaccccugugcuccagcaguccacccaccucaacuuccugaaguguuaggacuacaggcguaagccaccacacccggccagagagaauuuguuugaaaccugguucucugagauucuuaguuuaagccacucugccuuacguuaaaagaaucuguuuguuaaagauucucaguggaaaagaugaaauugacuuggcagaaaauuaguucaguguucaguucuuguuaaucagggagcaguuuauuauuuguaaguauaaauuccuuaaagugacauuggccauuuccuauaguuugaucuuaaaggagacagagagcaaccaauaagcauucuuugaaaucuuuaagugucuauaguuuucucguucucugaaacccuugccuggauuaccauagacauuuuaugcuuugaaugugagccucuuugcugauucuucuuauguuagguuguuuucuucaauugcuuacugccugaauauuccuccugucuugguguuucuuacagguacucauaguuacuauggcaagaugcuccuuuuuaguaacugagguuacuauuguaugaaacagaauggcugguuuuguuuuggcuuaguauuugagggauuuuuugcgggggaggagacagggucuuauucugucacccaggccauagugcaguggugugaucauggcucacugcauccuugaccucccaggcuuaggugauccucucaucucagccuccugaguagcugggacuacaggugcaugcuaccauggcuggcuaguuuuuuuguaauuuuuguagagauaggguuucgccauguugcccaggcugguuucaaacuccugggcucaagugauccccccaccucagccuuccaaagugcuggcauuacaggugugagccacugugccuggccggguuuuuuuuuuuuuuuuaaaccuuuugaccuauaaagaaggaauguuuauucuucagugggcucuuacugugggagugguaaaaacauuggcacaaucuuauagaagcaccuuugagauaaucauacuuugaauaucagcaugaaauuucccagacuauggugaaauaugugauuacaaggcaaggucuguauguuuggcuugcucuuaggaauuugagugccuuuaccuuuaaacugagucuaacuacaacauauaucuaagugagcugucguuuucuauucucuguuagauuguauguuuaccauaacagguaauaugucaguuauuacauuuuugaaccuuuuaaauugcuuuauagcaguguagggcugcugacuuuccauuuaagugacagauggaaagccacaugccauggauaacauguuguuguuugcucauauguuuaaauaccaguuccuaguuuuauuauuucugaauaugauccauggcuuagguuauuaguggacuuuuggcucccuguuaauuuuuaucaugguuuucugauuugaccuaccuugauauuagcagauaggaaaggcacaggucuuuaacacuguaggccauauuuaggggaccauuuguugcaauagauuccaguaaauuuuaucuauugguaguugaugacuuuugcuuuuugugaugcuuagagaaggcagaaaauuaacguugagaacaaauuuuaguauaguugaguuugguauuuuaauuuuuuuagauauuuagcuauguuguuuccuugagguauguaauuuccuuuagaagccuuugauaccuaaagcagugcuguguauguaagauauauuaaagguuuuaaaauuuuacuaaagaaacauguuuugaauaccuaauaugugcaggucauuguacuagauguuaaauuguagauguauaagauguacugcugccuucaauaaacucaguuuugguagcugagagagacauaaaaauguaagugcaauacauugagugaaauucucuggaugaguuugugauccuaacccuaacaguggugauggugaugacaucaaguucucauuaguucccuauaugccaggcacuaguuuuaacagcauuacaucugucaacuaauuuauucuuacaacaacccugugagguagguacucuuagcaucccguuuugcaaaugggaaagcuccgguauggaaagauuaaaucauauucguaagaucucacagcuaguaaguggcagccagauuuugaaccccagcagucuuauuucugaauccaugcuucucagcauuacaucucucaguuucuuugaaccaugucagauaggaaaagagcaguggguccauguuaugauguuacuguuuauucagagcaauccuugauaaaaucuaagauuuuauuucccuucgaucauugagaacuuaaugaagcuauuagcuuugauccaagcugggaaagacaugauaauaaauugaauauugaucauugauggagaaaacaauauuuuuuaauuucuuuuuuugguguuugguuuauaaaauccauuuuuauagcaaugauugugccauauucucuuuuaggaagggagauggggaccacauuccaguucuuucucuguagagaacuguuuuguccuuucauggucaugucuucucugguuuauuuaguacuuaacauuuuaugagguacucucauguaguuaguuaauuggauccuuacagcaacugugaguuaggccuggcagguacuguuauccccauguuauaaggaagcugaagcugagaggguugaauuggaaauuggcaggucuaguacuugaacuguuaucuuguuucugguccagugcucuuuaucuuauuccauguuacccucuuaaagaaaaaauagugucuaaaauguuuucugacagguguugaguguauuuugccuuacuuuuuggaucaacuaaccuguuaguauugaguuguaucucacaggaacauuuucuuuaaaaaagcucuaggaaucucugcucuugagaaacucuucuaugacaccuauaaacauaucaucaguguugagaugacuguuuucacguuuuuccauauuuaaggucucuuggucuugcuguggcaccacgcguaagauuucuucagaaaaugcagaaacaacccaccaaagaauugguaaggagccaagccgauaaaguaauugagccaagggcucccucccucaccaaugacgaaguggaagaauuuagagccuacuucaaugagaaaauguccauccuucaaaaagguggaaaaagacucgaagggacagagcacagacaggauaaugauacugguaaugaagaacaggaagaagaagaagacgaugaagaagaaauggaagagaaacuggcaaaagcaaaaggaucucaagccccaucucuuccuaacaccagugaggcacagaagaucaaggaaguuccuacacaguucuuggacagagaugaggaggaagaagaugcugauuucuugaaggugaagcggcauaauguguuuggauuggaccuuaaagacgagaaaacauuacagguaaguuuacucccaguggagggucuucuauuacauugucuuacuaugugcuuauuguugccuuuuggggacugagagaaagugaaaacuaagaaacuuagacuggguuucuuugcaaugaacucuuccuccuuucccccauacuuaaacacagaauaagugccaaugaauuuucauauuuuucauaacuuugggagcucuaagagguuaacaacuuuaaucuuauuuacugguuuucugaugcuguguuuuaaaaguugccaaaguccugauuaagucucaaaggaaggcaaugaaguuuuuugguuuauggcaugaggauccuucguuaaaauucuuaagauacugcuuucugauugauuaaauuauaaggaacaguuguaauuauuuaaauauaaguuuuacucuuagugcgacauuuguuuaugggaaccaagccagugucuuaaauagaaauugaacaguucuuuuuuaaaggcuacuuaugaauguuuaugaaaaguuuuccuguaaauccuuuguuucuccguagccaucuucuaggaggaacaaaagaaauaauccauuuagauaaagcacuuguuuucuaggaugcuuuuguaggugcacaguaaauguguuuccccuucucccuuauuccccuuccuacuucauaugccuuuauucuugaucaucuuuuuaaaagggaauugaauaaaaaaugaagcuugauucuuacucuuuauacaauguugaauaaaauuucaagauucacaguaggaaauacauaauagauuuugacugugaaacuuagaagaguguuucuuuaaguaacuaaaaauuaaaaaaaaaaccuagaaaaugugcuuauugaacacuuaauauguguuauguguuagucauuuucugaacauuaucucauuuagugcuugaaauaaaggucguuacuacuaucucauuauacaggugacggaaaaaaaauaacuguggcacagaagcaauauaguacuguagugaggcacacagguaguaaauggcaaagcuggaauuugaacauagguguucugacuuuaauauuuaugcucuuguccaauaauccuguacugucucauccugcuucaaauuagaucauuuuaagucuguaguuaagacucauuuuaucagcaaaguaaauacaagaaguuagauuuucguuuuaaauaauuuagccacuguauuaacuauuauguauaucacuuucuaagaaucaugaacauaaccaaagcuucaaauuaagaugagaaggaaugauauaguuuuauaauaccaugaauuguucacguaaguaggacaugugucuaaguacuaauagcucaucuggcauuugaaaaauguauauagcaaaacaacuuuuuaagcuuuuaaaaaaguuuuacucuaugucaguuaucuaaaucaaucuaacucuuuaauauauacaguuugaguuuuggcaaauguaugguguuguguaauuaccacaauuaagaauagaacagcgucaucaccccaaaacauuucuuauucccuuugcaauugcuuuacccuucacucaaccucuggcaaccacugaucugauuucuaccccuguaguguugcauuuuucagaaugauauauaaauaggauaauacaguauuuagucuuuugugucuagcuucuuucauuuagcuuaacguuauugcaugcaucaguaguuuguuccuuuuaauugcugaguaaguauuucauuggauggauguagguuuucuuaagcuuuaaauuggcauugguuguuuccauuuuuuggugauuaugacaaaagucauuauaaacauauacauuuuuauguagauaauuuucucauuucuuggggaaacgagugggguuauuuucuaggaauaggguuacugggaacauauguuaaggguauauuuaacuuugagaaacuccccaguuguuuuccaaaucagcucuuccaauuuguguucuugccagcaguguauagaguucgaguugcaucccaucgugucagcacaugguauugucagucuuuuaauuuuagccauucuaguaggcauguagugauacccuacugcaguuuuaauuugcauuucccuaaugacugaacaucucuacaugugcuuauuugccauucauauaucuucuuuggugaaaugucuucaagucuuuugucucucuuuugaaauuguguugccuuaguaaguucuacgaguucuuuguauauucugaauacauauccuuaaucagauauauuuugcuaauacuuucucccaaucuauggcuuguuuuuauuuugagugucuggcaaagagcagguaucuuaaauuuugaagucugauuucaaucacauuuuagguaauuuauauaugugucguaucugauaaaucugugauugacccaaagucacagauuuucuccuauguucucguccagagguuuuauaguuuuagcacuuacaauuugggcuaggauccucuucaccuuaauuuuuguauauaaugcuaaguaagggucaagguacacuuuuuuuugcauauggguauccaguugauccaguaccauuuguuuggaaaaaacuaugcuuuuuccauugaauuaccuugacucuuugaaagucaguugacuuucaaagauacgucuguccuuucaccaauaacaccaaucuugauuaguguagcuuuauacuaagucuuaaaucagaucuuugagucugucaacugauauauauuuucuuaaaauugcuuugguuauuuuuggaccauggcauuuucauguaagguuuugaaucagcuaguuacuucguauaaaaagcuugccgaugacuucauugagguugcauugaaucuguaaaucuaacuggagagaauugacaucauaacaauaccuuuuuauuuaggccuucuuuagugucuuuuuagcauugcuuuauaacuuuaagcacauguaaugugcacauauuuuguuagagucaucucuuacuauuugauauuuuuuaaugcuaucauaaaugguauuuuuaaaauuucaauuuccaauuauuuguugccaguauauagaaauaguuuguuuuuuguagacugaucauucuaaacugaccuguuaguucuuguggcuuuuugggaguuucuugggauuuucuuuuguaacugauuaugagguuugugaaugaggaugguuucauuucuuccuuuuucaucuguggaccauauauuucuuuuuucuuucuuuuucuuuugcuugauuuuaccgaguaggaucuguggaauagaaguggugagaguagauauugcuguguuguuccugaucuuacugagggggaagcauucagucuuuuaccauuacaucugauguuagcuguaaguuuuuuuuguaaaugccuaugaguuugagaagcuuccaucuauuccuagcuggcuuaguguuuuuaugauaaaaugaauugugacuugugucagaugcuuuuucuguaaacauuaaggugaugacguggugguuuuuagccuguugauuaugguguauugauuucccccugcuacauguugaaucaaauuuaaauuccuuugaaaaacuccauuuaagcaagauuucuuuauauuuauauuauaggauucuauuugcuaauauuuucguuaaggaucuuucuguuguugugagggauauugguuugcaguuuucuuuuuuugcgaugacuugacugggaauaugacacauuuugaaagcuuuuuauauguuuugccagcauagaggucauguugaucguugcccuacuagcgucuguauuguuugaaucucuuuuugauuccaauaugaauauuaauaauuuauaucaauauuaacaguuauuuagaaaguuaugauuucuuucuuaauuuguguauauauugcuuacacauauuuuucccuguuaugauauuagucucuuuccuguugauucguaagauguccucaaacaguaaaguuauugucucuggcuuuuaacuuugcuuugugucccuugucacacacaguuguucauuucccugccuucucuacuuuauuccaaauuccuugaaauguugucuuuuguuuacucaaguaaaaauacucagaauuuuauugccauaugaauaaauucagaauuguauucucacuuuaaacaguaggguucuugauuuuauuuucuauuuuagaaaucaauuaauagcuaauuuaaaaaaauccauuacacccacaaucaaaacaguaaaaauucacauucuguuuuuuuuaaaauguuaacuacuaagguacaauguccuuaccuaacgucagugucuaaguuuucuuguuuggaccguuuuauacuuucaaguauagauucacauucacuuaggaaugacuaagucuuuuuagucauuccuagaaaggacacauagaaaauacaugugaagagaucaucaacuauuucauccuucaacuuuagcguuccuauuugaacaacuacauuuucauuuuaugcugugacaagggcaugguuaaagaugagugaaaacaugauccuuauggguacauuuuaguaaaugcaaauuuuauuaaguugggggaaaaaaguccuagaaaaaugaaaaaagaaaaaaaaaacccagaaagcacacacaguauacaagcccauuugaaaauuauuuuuaaauucaacagacaugaaauuacuuuggcaaauugcuguaaaaauuuaaaugcucauucuaagaaaacaacaacaacaagcccuuuuccuaacuuagguuccuuuccucucaguccugcucagacuuaguguuucucacauccagggcaccagagaugauguucuuccaagguugagugcucuguucuugaggggcagggcgggggacucugcaagagugguuuugagaaaaauuuccuguaaaauacccuuuuacccagauuauaaaaugcuuauuuuugguggaaaaucucuaguaaaacacagaaaaucacaaauaaaaauaaaaauaaccuguaauuucaccaccuagagauaacaacugucuuuguuuuuuuaaguauacauacacauuuguucuuuuuuuuuuuuuuuuuuuuuuuuuuuagaaauagggucucgcucugucacacaggcuagaaggcaguggcaugauuguggcucacuguacccccaaacucccaggcccaagcgauucuucugcccuagccuccugaguagcuaggacuucagguguaugcuaccaugccuggguaauuuuuaaaaauuuuuuuguagagguggguucuuucuguguuccccaggauggucucaaacucuuggccucaagugauccucucaccuuggccuaccaaagugcugagcugacaggcaguaagccgcugugcccugcucauauacccauuuuuaaauaagugagaugcuccuagguauauauauuuccccaugucauuaaagugucuucgcaaauauuuuuaugguugccuaauaugccauuaaccuuuauuuaaccauucuccugcuguuggauacuuagguuaauauccuuuuuuugaaucuccguuuaaagaguucuacuaauuggcagguuucuucucuccuucacuuucacuacucucaccagcauaacauggaacugauucuacaguucgaaaaugcaagauaggaaucuucuccuuaucucauguaaacacuuacuuuauaguaauuguuucaaaaauuuuacccccaaaugauuaccgagcuuacacauauuagggcauaagaugaccuaggucucuuuggguuaucgacaggguucuaagagggccccagugacacuacguaauaccuccuuaugccgcucuuauugaaggagggucacaaauuccuccagaccauauucagaucugcucaucuccauccagagagguuuuagcacaucacagcuugcuccuggccugauaaacuaucagucccugaggagugauugaauaacccacauuucaguaacuaccauaaaauaugauucugcauccacucaguggcaucgucucacaagugccuuugaugcagggagcagccucugcuugugacagugcagcucgacugagcaaauauccuuuucucagagugaaaaaaacaaaacaaggaagaacaaaagaaauuguugcaggccuuuuuuuuuuuccuccauuaaacauaugaugccugacuggauuuucuacuuuguacuuaauaacucacuuguuaauacuauacaucaggccaggcauaguggcccacaccuguaaucccucugaggugggaggaccacuugagcccagaaguccagggcuacagcaagccacgacacuccagccugagcaacagagagagacccugucucuaaaacaaacaacacaaugcacgucguuaauguacaccagagaggagauuuggucugcaaauucuuuaaugauaucucuugugaccauuagaauaccuucccaacuacuaguaagcugaugaaucauuuugaacaucuggaaacauucuucuaaaguuuguuuuuuucccuugucaaucacaguuuugucugaucguggauucuggauccauuaguucuaauggaucaauucaagugggcaugaaguuccacuuuggcaauucagaguaaaagcuuaccuuccauggcugaugcucuucugccuccauuauaauuuuaccaggaaaacaauagucccucuccacucuuauucuugguaugaacaauaggauguauuucagucaguaaauucugugguucugaauuuccuucagauugcuuuacuucuaaacauuucgaaaagauuagcuguauguguagcucuggguucagcuucaccucuuagagauuucucaaccacuaggaccuagacagguuuucccuuaugacugaaagucucguagaaaagugacaacucgggcuccccuaacacacaucucagugguagggagcugucuuccugggaaaacauaauccagggcuaucaaacaaaaggaaaauauugucuuacugaucaguguguuuucagggccugguacaaugacuagugcaaauuucacaaauauuuugugaaugagggagugaauuaacugaauuucuuauuccuucacuuugguuuuguuugcugugaguuauauagaacucauagguaggguuuauuuuuggaaaaccuguauuuugugaaguucaccucaugacuuacagugguucaaaagguauuguugaacuuccuauaaaugugagcauaaaaaacuuacuugacucuaaaugauauacuuauguaggccgagcuuuauaauuuaauuuggauaguaagugguaguaucuaauuauaguguuguaaaauucgguuuacuaagacuacauuugcauuauacuauaagaaguucuaucuuuaaaguacacacguaccugcauguuuuuuuuuuuuuacuguaauaaauuuaaaguauuaugucaugucuguugaauaugaggaacauuuuggggcaguugauaggauuuuugaugcuaaacaaggaauguuuugcuguuucuuccuguacauucccuaguacugugcacaaacaguagaguugaauuucgugguucuccaguugaaauagaaaggcuaauugccguuucuuuuuuuuuuuuuugagacggagucucgcugugucacccaggcuggagugcaguggccgaucuuggcucacugaaaccucugccucccaggcucaagugauuauccugccucagccucccgaguagcugagauuacaggcacgugccaccacacccagcuaauuuuuguauuuuuaguagagacgggguuucaccauguuggccaggcuggucucaaacuccugaccucaggucauccaccugccucagccucucaaagugcuaggauuacaggugucagccaccaugcccagcccuuuuuugaacuaccucaccuagucuuaacuucaccuguuaccuacuuucgaauuuuaaaaauuaauacuuauuuucacucguguuaauaucuuuugauucuucuccauguuuuuaagcaauugguuuugaaugugacccugcaaccgugaucucaauuggguuucuuuuuuuuuuuuuugagacagagucucucucugucacccagauuggagugcaauggugucaucauggcucgcugcagccucgaccuuaugggcugaagugaucuugaauugcuggacucaaaccauccuccugccucagccucccaaaguucugggauuauagguauaaaucacugcacccauccuggcuuuccauuuuauccuuuacuuuugcauuucauauuuuaguguuguaugcauccaucagucacuggaggcugcuuuuuuccuuuauuaccuauuuuuaaggauagacgagauauagaaaaaucaaaucauacauaaaaugggaauaauacuaucauuugcacauauaaaugaguauauucccugugggaagacuaagcacuuuuccagacacugcugacuuuguugaaauuuuuguugcucauguuuuagaauugucuuuguagacaccauaccagacacagaagggaacuggcuuuguuacuuauaacuuauccucuuuaucuugauuaucuuuuuuucccuuucuugucucucuggaaaaagaagauuuguacaagaaccaaauugaaacuuggagccaguaggaacccauuggauuguagauuuuauggaauaugucuaauaaucauaucauuauaauuaagaccauaauuauuuggcauuuuaccauauacugaacacuuucugcauaaguucucauuuuuccuuaugacaagaaagguagcuauuaaaauuucggaggaggaaaggaaggcuuuuaagugacuuguccaaggucacaguggugaaguuagcaguuaaaccuauuugugaugcuaagucacauuuucuuucucugcugucgugccuaccauuauuuguguguaguuugcuuucuguaauuggguaaugucaguguaauugacaguauuguaaauaauuuugggcuacucauugugugcgcacacuuggaguauaaaaugaauguuugccuuuagacuucggcguaaauggagacgagagguacugagugccaggugcaagcaaggccuucuggaaugcugccuugucacaauccuuuucuguuugacgagaucgaugcagugaaggacaacaagauuuucuuagcaguggagaagugccacgagugaugaagcaauaagacaugugcaggagagagcgcagguguagugaucaggcacaaaggcaguaagagauggcugguugaccucccaccauagggaagaaccuuguuuuggcuaauugucuuguuggguguucagaaaguugaccuccagggagacaguguuagauaagagcaugaacauacaauuaaaaugauuaaauuaaaauuuauuuuuggaacacuuauuuccuuaaaugugagaaugaaaucucuaagcauaugcuuucuuuucuuuuucaguuuaaaccuuuuuagaaaugagacuggguagauuccauuuuagcucaacaaauguccuuuuaaagcuuucuuaaaaguaaacauaggucaguuuuaauuaagauuugaaugauacccauagauuauucauuguaccuuagaguugauuccagauccuguuuacauugauuuaguccuacuuuuuuuuuuuuuuuuaguagcuuuuucuuuuuuuaguacuguaagaacucacuguugguguuaaaacacagauuagcuaacuuugaagcuuauaaguauacucuuauaaaaagauuccaaguuccaaaucaagauucuccuaugugggagcuaggauguuucugccucuugucucuucacuuuuucucuuucucucuuuuucccuccuuucagcagcaguuaccuaacggaugccagggacuguguuagguacuuagugacuuuuaggaacuuggacuaaguauuuguaaaauaaguacuggaaaaugauuaacaucuaucaauuuuuuuauaacuuaccaugcacuuugacuaucauaucucacuuauuuaaauucuuaccacagccuuguguaguguuguugucauguuacaaguucagacacaggcuuugacagguucacuuacuuccuugccuaauguugcauaguuagugaagcgcuagcacuggagucuguacuuaggccccucugacuugccucgguaugauugugcuugcuuugauucccgucauuucuacauuuagugguggcuuuuaguguuccauuuucacuucccacuuacacugccauucugcccccagauucuuauuaccucauucuuggcucggggggauaagcuucauaauugguucucguuguucuucugagucaucuuccugugaaccuuggucaaauuaguauuuuuuuucaagugguuuaccuuccaugcuacccuuaaguucacccuugcaguuggguuuuguaagcuagccccuauccuauuguccugcgagaccauucuucccaguuuccacuuaaacagugaaggauuccuuccuggauuauuuucuucccacuccagcauuucacaucuuucaagaugcagugcuuaucuugucucuucuuugaagccaucccuuacuucuucaacccacugaccucuggauuccaauggucuauuuugcuaguauuuuuuucuuuuucuugacauuucauaauguagccacaugucucuuaauuuuuaucucuuccauaccuggugauuuguguucaggggccuuauguaauguucaguugacuuaaacagaaggaagaacucuaaagucaagacuacuguacuccgaauuuuugcuaccaugaagugaaacaaugguagcaugaucucagauguugccagcugaaauaguuugguauauaugcucauuugucuuauaggugucuuuucuguuuuuuggcauccugugcuuaauucuuuuuuuguaaucuaagcuuuguuccaauucaaaaggaguuguuauuguguaacaugaagcuuagaugcauauauugaguugcuuuauguauuuuuuuuccuauuugaguuugguaugcagaugacuuccugaggauguaaauuuucaguggaaagcuuaaagcugguuuuggcaugauguuuauucuguaacaugcugaaucauuauaucaaauauugagucguuuuccuuuaucuccuucuuuuauacaauauucaauauuuauaacaucugcuaacuacugaauuuuuaaaucuacuuuugugguugaaguuuaaacagcuacuuuuacaggccguauuuaucuuuauuuuaagguaguuacacagguaaugaaagaaaugugaaauaggacaggcuguucuugaaggucaugugaauugcccuuugaacuuguuauaugauuagaaauaaggaguuuucaaauucauaaacaagugcuuguuuauauggcucuaacaaauauaauuguacaacacugcuaauauggcagauuaguuuccagaaaugcuguucauaagaccacuuuuuaagucucuaagcaguguguguaucuguaccugaacuuguuaaugggaggacugucuuugugauggcacuggauucaacuuucacauuucuuuucaacacuuuuaaauuguccaagcaaauuuuuguuuugacuuuguucuuuucaaugcauauuuugaaacacgguuucaaguccaaggcaacaucugaggcuagugccaucuguuggugacaguuagaauuaaaucacuuuugcuuugaugcgaagcuuuguucuuuaccaugaaaguguacauuuuaggugaaaugccggcuuauuaagugaagacuucaugaaguuuuuagaaaaauuuauucagcaaauauuugaacaccugcugugugcuaggcauugagagcuguuagcaaaaccaacaguauucccugugcauuaaugggugggauggacaaaaaaugaauaugugugcuaugguaggggcaagaugaagcaguguaagggggauauagaauucagggaagguggguggcaugcugcaauuucagauagaaugaucagagguggucaccauggaggguguauaaggcacucuucuguuguugcuggaucaugaacuuuagagguuuuaagcauugaaaauauuauuguuccuccucccccauagguaauuugaaaugaaaacaguaugaaacuugaaaauaguaagaaaguccugaaguuauuuucuccaugauggcuacuucacugcuuuuguugaaauaaauuauuucaagaacauuaaaaaaaaaaaguauuccagcuuuacugguucucugagcauauguguaagcugccaguugguuuauugaacacugagagcuaggcacucuagggggaaugugaagauaauucagaccuucuuugaaccuugcacuagcagguugauugguuagagcaguggcacuucaguaaauuaagugggaacagggaugucugcauauuaagaaaugccuauuguuuagugaaagugaaguauaaguauaaacuuacuuauaaaauaaguguaagauuagcauacagauuucaugaugauuuaaaucuuaagucuuuaggacaguguuucucaagccgucuuugcugaaggguuaauguuguaauuuugaagcaaucacaaaccaaugacuuuguaaaauauauuaaaguuaaaauaugagaaaaaugaaccccucuuugcuucccuaguucuuuuuuuuuuuuuuuuuaaccuuuuugcuucuuccuuugucucccucuagguuggauuauuuuaucuuuuaauaauaaaaccucauucuguauucuucuguuuguuucuucuguuuauauggccauaaaauuauacaguguugugguguguuuuugcaugugugaguguguguauucguaacauagugaauguuuaauggaaauacacuguuugucacugaauacguuuugcaguuuaucacccuuucuaugccucuuggguuaucauggaugggcgggauuuggccuuauaagugauaccaccgaaguugaaaugugaggguuccuugauucuuuuugguauugggcucuguuaugguuugaaugcaucuccuccaaaauuugaauguugucaguggaauaguauuaagagguuggggccuuaagaggugauuaggucaugagggcaccuuccuccuuaaugggaucaagacccuuauaaaaaggcuucuuguaguguucuuccagcuugcucuucugccaugugaggacacaguuuuuccuucuugcccucugccuucugccaugugaggaugcagcaagaaggcucauaccagaugucaaaugcuggugcccuggucuuggacuucccagccuccagaacuuugaaaaauuucucuucuuuauaaauuacacuguuccagguauuuuguuauagcagcacaaagcagacuaagacaaguucucuaguugaauuguccacccuauaccccuaaagggaaggaagauuaagaagaagaauuaauauauaggcuucuguaggcacauugucuauauaaugaaguguguaguaagaugaaugucuuugaaucagguagcacuucuugcuuuuuuuucagcauucucugcagcaucuuucacauguuaggcacuuaaugcuuguuuguagcauggaguccauuucuucaaaugagccucuuccaaggcauucauugacaacacuuucaucccuaguaucaaaauaauaaaauguaguucuuccucaacacauuaugaucagaaacaucuaugauuuuuguuuuaauaaaccaaauuuuuaaaacuuauuuuucaagccaggaguguuuugccauaggacaaaaaaguuuaucucuauuaagcagguagcagaucaucaaucucuggaaauuuuuuccccuccagaaggcuguugcuguuuuuuauuucuuuuauucuuuuagcuugccugcuggcuguuagaauagaggugacagacggucuugauauacuguugggcagagaaucugcugguuuuuauuuggcauaacaaaugauugaaaacagugauguuuuguuacaguucuaauaaggccgacaugguagugauucuuagggugcauaaauucuaggcucuagaaaaaagugccuuaguaaacugggcacuguaaaugucccuggacuauauaagaagaaauuucuuggcauuaaugugcaugagauagauaucacuuauugcagcuuuuggaaaagugcauaaaggaugaagcuaauauuuucagcgaugaucugucuuggagccguuuuccuuccuguuggucuauucucucuccaccucuuucauugcuagacucagugaaucaauuucucagugacaaccaugauaaggcaugccuacaccuaauaauucucacccaaguuuguuuuuaaaauuaaaauggccuauuuccuauuauaucuuugggugauaacgauuagaauaauucuuccaccugcgugcauuuucauaugcacugauuuuugucaugggaagaaacaaagcagaggaauguuuucuuccuugcugugauaccuaauuuuggaagguacacuaauuucaaaauguuugauaugggaaaugguugcauauuccaaaaacacuuagcacgaccuugcuaaauaaugcucucuccugugguuuggaucagcauuguuuuguuuucuuugcaucuuuugaucuaucugaacugucuucugcuugcagauauauucauaaaauaggauuuugcaaauugaagaguagguaaauuacuauuaaagcgcuguauuuguacucccuacucaaaucuucugagacugaacuuuuuuuuuuuuuaaaggaaucuaugaaaaucuggcuuucagcgagucuuauuuucuuuuuacuguuuccucuuaagaguuuuuuaaguuggcugaauuuacucuacuuacucauauguguuuuaguagcuauugagccauuuuauuuaauagcuugaauaaacuauugguuauugaaucuuuuuagaaauacuuauuucuaauccccucucuuuccuaaaaaggagggaagaagagauauuuuauuauccaagaauaugcuaucaauauccuggagcccaccuaucuaguuuccagugugucaacuagcaccagcuuagcuaaccagacuuacagugaguuuguaauuacaugauuagguauggcauacccaguuacuccuucuuuucucugccuaccccaagccccauuagcucuguuuuaugacagaaauuucagauuucuuuggcuuuucugauucauuuacugacgaaagagacuuuuucuagguuucaagaauuaugaagagucugagauucuacccuacuugcagguuaacguauuagccugccauacuuucuuauguugcuggacaacucauggcacagcaggcaguaugagcuugaaguuugcauugacuccccugccccucaagucccacaggggccacauggagacaggccuggguuggugcuguccacagaguggguuuguguccuagguguaaaagcucaagcuuaggagaccccuauuguuauuaagacugcuagcaaaccuggacaacuuucgccccugagggagaaguuaucuuuauucuggucaggaaacaacucugcccccccagggagacacuuucugucucuccuaaggcuguaugcuauccagacauccauaaaaucguguggacaaguugcugacacaagauguacagaaacaugagauguccauggaugauggcuucccaaaguuagguaguagcaaaaaguagaacucugaauuuuucuguuuuugucggcuucucccaaacgagaaaaguuacuuuaaaugaugaacaugaauuccagagagacacagauuccuccaugugaaagccauugcuuuuguuuuguuugauaagacccuaaauuagugggcaguuagcuuuucuggggcuaaguauuccaaagugugcuuucugagcaaucugugcuuacugcuguuagagcacucagcauacugcugucauaccuguuuuucccacuauacuguauacuuuuaugaagguaaggaauauauauuauucauuuuuggguuaccucucagguuugccugucauuauaauacauucuuaauagcuggcuguugaguguaaugagugaauaaaucauuagaagcuuuuccauucaaaucugguuguucuuuuaucuuugcuuauucagauucuuuaccccaauuugagaguguaccgucugguagaaaaaguaucaggaauauaaaggauuaguaaauauuaguuuucugaauggguugaucuuagauagaauccuguguuaguuuugaaaagcugggucagaugccgagugaguaucuugugugaaaucauuccuaaaccuaaauuaauccacccgucaucccuuucuuaucagauugcuuugaucucuaggaccaguuuucuuuguaugguccucucauauuaucuuaaauuuuagauuuuaggguuuuguuguuguuguuguuuguuuucgugagaaguuuuggcuacccaccuuuuuuuuuuuuuuuugaaaaaauuuggguuuagugguauaugugcagauuuguuauauagguaaauugcaugucauggggguuugguguacagauuauuucaucaccaggugauaagcauaguaccugauagguaguuuuuugacccucacucaccuuccugucucuacccucaaguaggccccugugucucuuguugccuucagauccauauguacucaauguuuaacuugcacuuauaagugagaacaugugguauuugguuuucuguuccuuuguuaguuugcuuaggauaauggccuuuagcuccauccauguugcuacaaaggacaugauuucacuauuauuuuuuauggcugcauaguauuccgauguguguacauaccacauuuucuuuauccagucugccauugaugagcauuuagguugauuccaugucuuugcuauugugaauagugccacagugaacauacguauacaugugucuuuaggcuagaauauuuauauuccuuuggguauauacccaauaaugggauugcuggguugaaugguaauucugauuugaguucuuugagaaaucaccaaacugcuuuccacaguggcugaacuaauuuacauucccaccagcaguauauaagugcucccuuuucaccacaacuuugccagugucuguuauuuuuuuuuacauuuuaaucuccauuuugacugugugagaugcuaucuuauugugguuuugauuugcauuucucuaaugauuagggauguugagcauuuuuucauaugcuuuuuggcuauguaugucuuuuugaaaagugucuggucauguccuuugcccacuuuguaacggaguugauuuuugcuugucgauuuaaguuccuuauaaauucugaauauuagacauuuguuggaugcauggcuuguuaauauuuugguuaucugccaggguuuuuauaguuucagguuuuacauuuaagucauuaaucuaucuugaguugauuucucuuuauggugugagaaaggggguccaguucaaucuuuugcauauggcuagccaguuaucucaguaccauuuauugaauagagaauccuucccccauugguuguuuuuguugacuuuaucgaagaucagaugguuguagguguguggccuuauuuuugggcucucuauucuguuccaugagccuaugcaucuguuuugguacuaguaccaugcuguuuugguuacuguagccuuguaguauaguuugauguugggugaugugaugccuccuacuucauucuuuuugcuuaggauugccuugucuauuugggcuauuuuuuugguuccauaugaauuuuaaagucauuuuuuuucuaauucuguuaagaauauuauugguuguuagauaggaauagcauugaaucuguaaauuguuuugggcaguauggccauuuuaauguugauuguuccuaucuguggggauagaauguuuuuccauuuguuuguguccucucugaucucuuuggccaguguucuguauuucucuuuggggagaucuuccaccuuccugguuagcuguauuccuagguauuuuauuuuugugguuguuuuggacgggauugcauucuugauuugauccucagcuuggauauugcugguguauaggaaugcugcuaguuuuuauagauugauuuuuguauccugaaacuuuguugaaguuuaucagaucaaggagcuuuuggacagagacuaugggauuuccuagguguagaaucaugucaucugcaaacagggauaguuugacuuccugucuuccuauuugggugccuuuuauucuuucucuugacugauugcuuuggccaggacuucaaagagcuagaaagaucucaaauuaauaaccuagucaucacaacuagaaaaacaaaaccaagagcaaaccaaccccaaagcuagaagaagaagacaaaaaguaaaauuagagcagaacugaaggacauugagacacacaaaaaaacaugcaggcugguugcagugucuccugccuguaaucucagcacuuugggaggccaagguggguggaucgccugagaucaggaguucaaaacuaggcuggccaaaaguggugaaacccuguuucuacuaaaaauacaaaaauuagcugggugugguggugugugccuauaaucucagcuacucgggagacugaggcaggagaauugcuugaaucugggagguggagguugcagugagcagagauggcgccacuguaccccagccugggcaacaaagugagacucugucucaaaaacaaaacaaaacaaaaaaaaaacccugggcaugguggcucaugccuguaaucccagcacuuugggaggccaaggcaggcagaucaugaggugaggaguucgagaccagccugaccaacauggugaaacccugucucuacuaaaaauaaaaaaucagcuggguguggugacgugcaccugucaucucagcuacucaggaggcugaggcaggagaaucgcuugaaccugggagguggagguugcagugagcuaagaucgcgccauugcaugccagccugggcaacagagugagacuccauuucaaaaagaacaacaacaacaacaagaaacaaaagaucaauaaauccagggguugcuuuuuuugaaagaacuagauugauagacugcuagcuagacuaauaaaaaggagagaagauacaaauaaacacaaucagaaaugacagaacauuaccacugacccuacagagauacaaaaaacccuuagacuguuauguacaccucuaugcgcacaaacuggaaaaccuagaagaaauggauaaauuccuggaaacauacaaccuccugggauugaaccaggaagaaacugaaucccugaagagaccaauaaugaguucugaaacugaaucaguaauaaaaagucuaccaaccagaaaaagcccaguaccagacgaauucacagccaaauucuaguagaugaagaaaaguuguuaccauucuuacugaaacuauuccaaaaaauugaggagaagggaccuccuccugaauucaugaggccaguaucauccugauaccaaaagcugguugagacacaacaaaaagaaaacuucaggucaauauccuugaugaacauagaugcaaaaauccucaacaauauacuagcaaacugaauccaguggcacauccaaaagcagaucugccacaaucaaguaggcuuuaucccugggauacaagguugguucaacauaugcaaaucaauaaauguuauccaucguauaaucagaacuaaaagcaaaaaccacaugauuaucccaauauauucagaaaaggcuuucaguaaaauuuaacaucucuucauguuaaaaacccucuaacuaggcauugaaggaauaaacgucaaaauaauaagagcaagcuaugaaaaacccacuacugacaucauacugaauggacaaaagcuggacacauuccccuuaaacuggaauaagacaaggaugcccucucucaccacuuguauucagcauacuaguggaaguuccaccuucuuuuaaauaugguuggaaaaauuaacuuauuguauugaacuauuaguaauuuuauuuuagagugaguucaccauagagaucaguaagaucucagugcugucccagugcuguuccgcacuuaaguuuuggaccuaaguguuuauaugguuuugaguaggguaagauaaagggugugcgugcuaauuaccauugccagaagacuuugcaagaccuuuuucuauggcuguguacuucuucagcuugaaaauaaccuugguagagggaguggcaaauggaagcaggugucccauuuucagugccagcgcaagugcuccuaaacacacacaugcugcuugaacccuuuguccccauaauugagaaucuuggagaagcaauauaaaaacugccagguaauacuuauguuccuuuugagacauuuaaauaaauuuaguaaucaaaauuauauaguuauuuuuaaccagaaaugaaaguaggcuuuuuggcaggccuauguguucacaucugugcuggguuuauauguucuugccaacaguguacuuagugguauaacagagaaaaaugauucauaagcuuuuucaaauucagaccuacgacucauuuauacuuauauucccauuaauaucguuaguaugaauggcuuuauauaguuuucuaggacucccucauuguaaguugagagagaggguagucucgucauaggaagcauuucuuugaugguauccauauauugaguugcauacauuguaugaaauguaaagccuuagcagaugccuaaaaaugguuauuuaaugaggccauuuaugucccucguuucucagguuggaagauucugcuggacuacuuagaaccccaacuuuauucauagucuguugagaucucuguuaaaaaacaaaaaacaacaauccacagccacuucagggacucauuuauucuuccagugaaaaguccauaguguacagaccccaaagucuacugaugaaauaauuaaaaauacuauugagccuuuaugcagaguggguuagccugaguauuugggaguguuaguugaccuuaaauacccucugccauguccccucuuaacccucaauaguuaaccaaguauucuuuuacucacuuauuauggauauauuacugucccaaauaugaaaaaguuagacuugucagccuucaauaaacuuacauagugacacaggacauuuauguggaaauguuaagugaaaugauacaagauagcaguguaagaaagacaauguaaacuauuuaccugcaguaauaaaauauuuuuaauuuggccuagaacuuugaacuuuggggcuagaaucuuggaagaucuuucuggaguaguggagauuugguaagugucuaaggcuguguuagaugugauaggugaagaaagagggaaagaggauauaagagcacagaguguguuguggccaaucaauuuuggaaggguagaagagcucuauaggaaauagcaagggcuaaugaaacaagugaaggaaaauuacuuuuuccuucccccuucccccuucccccuucccccuucccccuucccuuccuuuccuucuuccuccccucccccuccccuuccccuuccucuuccccuucucccuucuccuuccacucacuccccuuucuucccuuccucccuccccuccccuccccuuccuucccuuucguuuccuuccuuccuuuccuuuccuucccuuucucuuucccuuccuucuuuaccuuccuuuccuuccuuuccuuccgucuuacucugucacccaggcuggagugcaguggcgagaucauggcucacugcagccuugaccuccucagucucaggugauccucccaaguagcugggacuauaggugcuugccaccauggucagcuaauuuuuguauuuuuuggcagagaugggguuucaccauguugcccaggcuggucucaaacuccuaggcagaagcaauucgccuuggccuuccaaaguguuaagauuacaggcaugagccaccacaucuggcuggaaaauuucuauuuuacguuuuaauguuauccaguguuacuacugugaccacuuacuuagugccauuuaaauauaaaucugaugaugaccuuaaguaaaugaaaguuaauacagauccaucuuaaagcaugacuucuaaaagugagucuuccuuucuauaauucucugaagucuuaaauauaaacauuuuaacuagcuuuaauaguuugaauuuuuauuggcaagaugaaaguagauuauucagauauugaagucuucuagaccuugaggaccugauaugacauaggguuagauauguugaaaauuagugcaucauguuauuccauuguuuuucuuuuagugugucuuguuccuuuugauaauagcuuuuuugagauguaauuucuaucauacaauuuagucauuuaaaguauguaauuuaauaguuuguaguauguucacaaacuuguucagccauuaccaugaucaguauuagaauguuuuuuaucacuuccaaaaagaacucuacacccuuuaagcuauuaccucauaauccucuauuccuuucagacauaaauaaccacuaaucuauuuucugucuguauaauuuacuuauucuagacguaaguaaauaaugagggcuaaugaaacaagugaaggaaauucacuuguuuucuuccauuuccuucagacauaaguaagcacuggucuauuuucucuauauauagauuuacuuauucuggacauuuccuaaggaaugacuucaaauggaaucacaguaagugucuuuuguaacuggauucuuucacuuaguauguuuuuuuuuuuaagugucauguuguugcauauaucaguauugcauuucuuuuuagggcuaaauaauauuccauuguauggauauaucacuuuuguuuauccauucaucaguuaauggacauuuggauuguuuccaucuuuuuggcaauugugaauaaugcugcuacaaacauugauguacaaauuccucaguggacauaauuauucauuucuuuuggguauauacaccuagaagugcaguugcugggucaaaugguaaaacuugaacuguaugccuauauuuuagaagaacuaucagacuguuuuccaagguggcagcaccauuuuacauuucccaccagcaguguaugaguguuccaauucuuccacauccucacugucacucauuaucugucucuuugauuacagccaucucacuagauaggaaauaguaucuuuaugguucugauuugccuuucccugaugaucaauaagggccuuauucucauguuguuuguggguuguuggguauagaaagcaucagccuuaaagauaacaauaccucuuagcuugguuugcuauagaaauguuuugggggaagguaacgcaaggggcuaugaggauaagacuugaaucuugaagaaaagaacuuagccaagaauuguaguuauaagggcuuuuuagcaaggggauaguguaaacaaagaaaggcuugcagauagaaauguguaugucacauuguaagaagugacuggguagaauugaacauguauguaaaggggucugaacauauauauauaagagaauagcugaauuugaaugugcauugugcuagauuaagaggcccaguauaugaauuugagcuugacaguaaaaacagggaucacuuaaaaaauuauuuuuuguuuagugugguuauauauacaauaauuuaagguagacuaguuuggucaauauguaaauuaaggauagcagauagguguccuacaacaugcuuaacugaucaguugguagugauacccuggagcuucuauauuaaaaagaaugagacauucaguuuggcucaguuggccagagugcagugauugauuaaugagguccacuuuuagcaugggauggaagaguuuugacaugaucauugcuuauuuuccauuucuguaggguaggcugaggugauagcagugaauguaagaaacauggagagaagaguuaaugccuuaguauuuucagacuacugauugugggagcaaaauauggcuucucccuugacagucccuuuaauuucuguggaacuuguuuacuuaccuguauacugcugauuucucuggccuaauccccauuguuuuaugccuccuauuacuuccuagucuauccuuuggauuguuaaauuagugcccuaucugaucuucuuucucaaauccauccuccaacauaguuacuggaauagucuuauuuaaauaaacauuuaaccacuacuauuaaugaccuuccucuugcuggaaacauuaugacccuaaaguuaccgauucaugaaguuguucuuguuaguaccauguuuaucaaacuuuuuauagauccuugucuuccuagguacaguaugucagauagagacagacacauacauauacaguaggagugaaaaaaaaauugucuguguaggggcuuuugauaugguaaaauaagcuaauagacugaugugcgugcaaaaaauaauuauaaacuuuggacacaguauaaaaucuaaguacucuagagugugagcaaaacuaagcagauuuuagaagggacuugaaacuuacaagaaaaaacuggcacaggguggauuuucuguuuuagcagccuguccuaaggaugggccacagccacaggguggaaggcuccuacagaaaguaugcagucuuucuggucuggggaacacagagauacgaagcuagggcaaucaugucugucagagaaugagcggagacuucugaacgagagagagcgccagaggaggcuagcuccaaauuauuacaggggacuuuaacucuccuuugucagcaaaugauagaacaauuagauaagaaaucaauagacauugagacauugaagaucuggacaacacugucaaccauccuggccaaaauguuauuguagagcaccauauccaacaauugcagaauauucauucguuaguucacgugguauauucauaaugcaccauauacugggucaugaaauaaggguugaagacagaauguacugauuacaaccgaauuaaaauagaaaucaguaagacaucuagggagaccccaaauauugggaaauuaaggucugaagauaguguucuugcuaauuaccuguuuuugaucagcucuuguacucauuuauuuaauuuuuuuuuuaagaaguggagucuugugcugucacuugggcuagaguacaguggcaugaucauagcucacugcagccaugaacuccugagcucaagugauccuccugccucaaccucccaggcagcugggacuauagguacacacuaucaugccugccuaauguuuuuaaauguuuuaauuuacuauuuuuaaauuuuaaaacuuuucuuuuuuuuaauccuccugccuuggccuccaaagugccaagauuacaggcaugagccaccacgccuggccuaaacucauuuuuaaauacuggggcaguagaauacagaguggguuggauaugaauuacugacaaccauaaauaucuagacaaccaugucucucucucucucucucuuucucucucucucucucuauauauauauuauauauaguuucuugaugaucucaaucuccugaccuccugaucugcccgccucggccucccaagcugcugggauuacaggcgugaaucaucgugccuggccguaugucuagauuuuugaaggcaucucuauuuuugaaggcuagaguggugauagaaauaaaaauucaucauuacgcuccaugugugaaacagggauuugguucaggguacuauaauucucccaaauagauguuuauacuguuauugauggaaauguuuuucaaggaguaggguaguacuaacauuuauuucacuauucaagguuauuagcuuacugacaagaugguauguuuuaucaggucuaaauuuaaaguucuuuugauacuuaaaggucaaggagcugaucguuuuuuguuacacuuaaagaaaucauauaacuuuccuauuaaacacuucccuuaauugcuuggcuuucucuacugacgcuucuuagaggugucauugcugugaguuuuucuguaaaugucaauaaauauagcaucuguaagacagaaguuggaugaaucacauuuaauguguaaaauuugucaaugaaguugaguaauuugucgugaaagaagucauaucaaaauuaaguauuuaaugaucauuuaaagcgugcagaauuuuaacuagcuguuuauuuugauuuaaguagaauuauuugcaaacauuauuaaaauggccauuuaucgucuuguugcaaagcuuuuaagaaacuuagguaaaacaaguguuuauagcuguauuuuacugaaauuuuacauguaauuuuuuggcacuucuaguaugaugagcaauacuauaaguacucuguaaaaaugauuuuugucuugggcuuguaauuuccuuuucuaaggaagaaaaugauuagaaucaaguaugaucaaagcuaaaauuaaauugcaaaaucuguauaaaguacagcuguugcuuugaauguugugguuguccuuugagcuggugcugcaaggaaaaaaaugaauguuacaguuaauggaaaugagaagccauuuuaagauucuguuauaaaagauuucauuugagaaacugguuguuggagagugucauuguuuucuucuuugggaaacaaucaggaaagcuaaccucaaagguuuuuuauuuuaguauguuuagcaguuagugaugcuauaguacccacuaccagcuuauuuaguacuaaauaggcaggugugauuuaaacugaaagacaguuauauaguugacuuaaacugaagauucacuugccaaaugucauaauaggaagauaaugggaaauaugaaucuuaaguuaucuucuaacuaguuauuagguuauugaacuacucacacaauuaugcuguaaaucaauuucccuuuuguacagaaguucccccaacucucuuucacucucacccucuuccucuugucacagacccccuucagcagucugauaaugucuauggggcccuucuuagaguaauguuucuaauguguaauauauacauuggauuaguugguaccacauuuauagacuucucccaccugacuuuaauauauuaacugcagauuaagagguuuuguuaugguacgaauugaauuagauagacuuuucuuauauauaugaauuucauauauauuuuauaucuauauuguauauuuaacuuuuuucuuuuuuuuugagacagggucucacuguuaccuaggcuagaguacaguggcacaguuauagcucacugaagccucaaacuccugggcucaagugguccuuccacuucagccuccugaguagcuagaacuaaauacaugugcaucaccacaccugguuacuuuuuuuuuuuuuuuuuuuuuuuuuuuuuuuuuuuuuuagagaugggcuuucacuauguugcccaugcuagucuccaacugcuggcuucaagcgacccuccugccuuggccucccaaaaugcugggauuagagcauaagccucaacuccuggccccuaauuauguuuuaaauuuccauaaaauagaguacuuuuuauuuuguugcuuuuuauuccuaguaucucuagcauuguauuuugaucagauagaugcucagaagaguuuaacauauucacugucugguauaaaugucucaaaauuuauaaguaaauauguaaguaaaccuaucacaggccauguacuuuaacauaaaaaauucaggguuuggggauaguguagguauagguaucuaaagaaucacaauaaguuauaaagcaaauaauuuuuacuuuauuuacaagauuuuguuauaaucaaaugaaacuuuccaugaguuuggaaucaaagacuaauuagaagaguccaucuaauucaguuccuuccauaacaaaagcucuuaaucugcaguuaauauauuaugaaagucaagugggagggguccauaaaugugauaccaucuaauccaauguauaauccaauguauauuuuaugcauuuacaacauuacucugagaagaggccuguagacauuaucagacugccgaagggggccuaugacaagaggaagaggcugagagugaaagagagugaguuaggggaaacguguguacaaaagggaaguugauuuacagcauaauugugugaguaguucgauaaccuaauaacuaguuaguagaaaacuuaagauucacaucucccauuaucuuucuguuauuacauuuggcaagucaaucuucaguuuaagucgacuguauaacugucuuucagucuaaaucacaccugcuuauuuaguacuaaguaagcugguaguggguguuacuggggccacuggaaggcuuuaaagagguuaagaaaccagugaaaauacaguuuugagccgagaugggaauuagcaauauuuuacuccaaagcuagaguucucuccaccauaucagccaggucuuaguauaugguuaaguuuccaauaaguguuauucauuuuugguucuagagcucucucuccaugggguagguggagaaggaagacaucucagaauuauauggguugugaagaauggggcaugugguaagaacaagguacugacgucgugaaguuacgucuugaggauggucaugguaguuugaacacagauacuggcuuuucuguggaaguguuagagcauuugugagggguccuccaaguuuaaucugagguuaaaccuaccggguuccucuugcuucugaugcuuaacacaaguuagagaaaacaaaugguguccuagugcaucugucaguguaugcaguguuuuggguugcuacuuucauuuuuugguguucuuuucacuuucuuuccugugggaugaauuggguggagguggcucacugaguaauucaaguagagccuugauuaaauucacaacugucaccugauagcaagaacaugcaauaguauuuuaucugauaacaagugaugcaugcuuugcaucacuauuauggauccaucuuuguguacuuauggaugucuguucugaguagguagcugaugaaugucaugaaucaguuggaacaauuuuguuguucuggucuaacagccagauugccacaugccaugugguaguaauuuauuguggaauaaucacagugguauuuauuugaggugguuuguauuugucauauucauauuacauauacuuugaaaguuggauuuuuccaauaccaaaccauaaacguagccuaauauuuuugccauugugaacaccuuagauuuuaacaccuuaggagauaaaggaauauaaagugauuugauuuuauauuccucggagauuaaauuccuaggagauuugaugcuagauuucgagccacugcuauacagugaaugucauuugagcuucauuuuucuccuuuggagccugacauguaauaugugcuaaauaaauauuugcugaauugaauucugcuagccaagcuauaauguuggaaaauguaccacucuuugucauaaauuggaaaugugcuuuguauauaugaccagugacuauuaggagucuuuauuucagaagggagaacucuauaaugcauaaaauuucugcaaaccaaauguguguuuaauuguuuucuacagaugaacuaacagcaagacugagugcucauuaaaaauuuaugucuuaauccuaaggcacaaaccuuacauaauuacuugaaugcuuauccuugguuggauaaaaacuacuuaaaaauaaccacuguuuugugauuucacauuugcuuaguuuuagauuaaaauaaauaacaguccuuuuaaaauaaagauuguuuauaaacauacagacaaaucuacagaaugcagucauccauuccaauguagauaaauguuuaccaaaggaagcaacagcaugguacauauuauguacguauguugcuuacaaggauuaaugaaacaaaaaauuuugauaagcauuaaagauacucucaaauggccguucucccucuguccaucguguuuucauggguuacacauuuuauauaucaugaauggaaaagauucucuguucacgaauuccugguucagaacaaaauaggaaacuaaaguaagcauuuacgacauacaguucuugugguguauuuuuguuugauaauugaaaagcaucacgaaaaauugcaaguauuggacacaauggcaaauaagcaaaaguauucugaaaugaaucuagaaauuuuuuuagugaaguuuuauauuacaugagugaguuucauuuuuaauuugguguuacucugagccacgugguacuugcuuuaguaguauuuauaggcuuaaucaauuuaaaauuucuuaggcuuuucuugagaugccuuaggaaugugaagugcugaauacagggucggguguguauauauaaaguaacauauauuacauuuauuauuggcugucuuuucccuuuaaaaaagugaauccaagauauuaauuuccugauuuaucuuuugcauuuaguguugacaucaccucauucauuaaagaauuuguuucuaacaguuuugaugcugauuuauguugcaacaaaguaauaggcuuucuauaauggccuguuuucuguucagauuugauucugcuguguugucggaagugaaucguuuagcugaaugauucauuuaacagaaucauuuacuguuucuaguauacaguauagauuccaaaggccuagccuuuaauaugagcuucgcuugcccuccgucugaguugucuaaguagcaugaauuauuuccccaucaguguccucauaguauuuauucauuaauauguuugagggcagugcuuaauuuuuaagguuuauguugauagugucaaguuuagaaucuacugccauaaucgaguuuucagguggaaugagguuaauccauugggguuuaggaagaaaauauuagaacuuguuuuuauuuaauccuucauauuuuucuguguauacuugauuuuauguauacucacauucauuuauuauaaauaaaguauacauugggugcauauuuaaaauguuccuaugaaaagauguaagugauuaaaagcacuuggaaaugaaauagaugaguaagggucaaaacuagaguauagccuuagguauaugagaggaagaaugguaauucaagacacacuguacaucuagaaucuaugggugauagaaggaacaaaaaagauucuguuuucuuguucauaacuuuaguuagccugggaaaucuaugagaacggagagcaaaccuuauucacuauucuaucccuugugcuuaacuggaugggcaaccaggagcauaacaguuaaaaaccagaaagucagaacaucagaaaagguuggauuuucagacugauacauuuacaucuguuuaauuugaauaugcuagcucaagugagcucucuuauauuuccugccuucacuauuugaggaaaucugauuuuguuggcugaaugucaugaccccugacccugacacaacagaugcugucgauggggaauaaaugugggacaggaaugauuguaggcuguguaguaauuaugguacaaacugcugugguuuuguaagaccuguucuuggcaggagauguugcuuuccuuggggacuuagaaaaaccuagagguguccaugagagccacaaagagagaacgugcucuuaaucaacacuaaagcaaugcauucugauaacacaagcaagaacacaaauccuuccugcuaauaaaagcauuugcccuggagaaaauccuugaaguuacuuuuuauagcugcaugauuuuuucucuaacuuaugagagucaugaauuuuauuguguacucaaacuuuuaaaauaucuuuuugguuaugauuuggcaaaguaggccccugagacaaaucuggccuauugccuguguuguaaauaaaguuuuauuggaacacagacauacucauuuguuuaggguugcuuucaggcuacaaccacaggauugaguaguugugauagaccaugugggccauaaagccuaaaauauugaacugucuagcccuuuauagaagaaaaauuguguaccucugaggcuuuugagcuugcagauauuuuauggaugguucuuucucuuuucccaguuagaugauuuucagaugauuacauggagaagcuuacuuuuaugagacaauauagugaaaugguucacaacguuggcucuggaguaaaacuuagaguucaaaccuugccucagccauuuguaaacuguguaacuugggaaauauuacuucuuacuuuaguuuuccucuucuggaaaauaagacuaauaauaguacuagcucaaaaaguuguucugagaguuaaagugaaguguuuaaugcauaacagaugcucaacaauuaaauauuagguguuauaacuugagccuuuuucuuucucucucucucucuuucuuccucccccuucccucuuucccucuuucccucuuucccucuuuuucucuuuuuguaaaggaaaagguaaaaggaaauauuccaaagucaugugucaugucagcagcugaaucuuuccuuaugcuuagcuucuggcuauacugauuguguuagugcugcuacaguugucuuuuuaaaagauguuuguugaaaccauaggaauguuaguuugcaguaaacuuuaucuaaugugauuuguguugguaaauuuguauuuauuuuucauacguugauuuagugaaauucaacuugagguugucauuagauugcuuaugguguccuguaugauucuuauauggaaaagaauuuacuagugcugugagaccacauacauuuggaugucaagcucacggagaucaaauggcauucuuggguuuaaucagauugcaaacacaauggaguuuauaguugccuagagaauaaggccacugaauagaucagagcuaaauuuaaauugacccucuauuuucacucaaguuaauuuacuccacuuagcuauuuauuuagcuuuuagguugcuccaugcauuuggauuugucuguugauuuaagauauuguggacuuuaccugaucuuugguuuauauacuacuaaccuaguaacuuuguuucuguaaugucuuugugggucagcuguuaaagcugaaagugugcuagagcuguguauaauuuuccgcagauuuuagguuggcuucuuucagaaguccccuucauugcagccucacuaaagcaaauaagguaguguucucauguuucagaauaucugucuguguuccuugaugguucaugaugcccauuaggcuuuuggcuaguccuauggugaauaaaauacaguucuuacguuuuaguaaauuacagucaacaucgagucaugucuuguuaucacauacuuuuggucuuaauugaaggcuaauacauuaugaaguuauuuggguagaauuaucucuuuuauaauuccucagacauccugacacacaaucuuuccugaccugggaaagaucugaaaaacaaaugcaguaaacccagaacagaugauuguagucugagucuguguuaaacuuuucacuuuaauagguucucccuguggagaggacaggggaaggcgcugcugaggaaggcgcuguaaagucucccuucucuccccacaaauaauuccucaaaccaaaucaucaaccugucugcagucuccuucaccucugucuucuuccuuauuuccucucucucugcaagaaauguuuguucucuuuuccaagauucacguugcauuucaaaguuuccgacuuacaaaaacuguuaccaacuuuuguguaucugucuguguaacauaagcuacaccuguuaauuauaauuuuauguaauuauccagcuaaaaauauuuacuguuaaccauauuuuucuaguuuuggagacuauuuaugggauuuggaaacaguugugugcacaugucacacuucuauuuauuaugauaauuuccauacuuaucaagguuccuagguugcaauagcuagaagcacuguggccaggagugcucccaagggauuuccuguaaaagcacaguuaacuuccuuggugucaaccuuaaaaauuaagccaccuuaauaaucaagcuuuuuuccauagucuugugauuacgcuuagaugugacuagacccuucgacuacauuuuuccagaaccacuuguugguuguccucuugaaaacuuuuuucccucugacccuaauuucuuaaccuucugacccuuauaaucuguuuuucucccaguacuuguuuucuggcuuuucccugaccuuugguucauuuucuuacugucugucaaucucagcuaguuacugcuugcuguuuuuacuaucgacucugugaucgaucucuuaaccuuuuccuuuuuuguuuugguuuuaucaguaccuuuaauguaauugcauuccuuucuuuccacuucauugaccuggcaaacuuuaaaccagaauuaauuugacugucagacuucccugugcuuaugcuugggcugccuacugcuacagcaaccucaguugggcgcuucuucuuuuacgccauaguggcagcauugucuucaugguucuuuacccuccuaacuagucaucccccugcucaacuguuucaaauguccuccaagagauguacaauguggcagagacuuagguucauggugauaagugaggggugaagcuauagguuauacuuuuuguauucucaucaccuacuacagguucaugcucaguggguuuucaggguguuugacaaaugcuuauauuauuuauuuuuagaaucuauaccaucucagucuauaagagaucugaaguagcucacaggaaauacauaccaaauagugaaauaaacuuagcaguaaaacuucuggcuuugguaaaacauuaggacaggaggaucuguaucauggagaaaauggaauaauacagggauuguauuaguuuucuguguuugcuguaauacauugcuauacacuuaguggcuuaaagcaacacaaaguuaucuuagaguucuguagguuaguagucuuaaaugaaucucacuggaguaaaagcaacgggucaauaaugcuguuucccuuucugggaggcucuagagguguuacccuuuccuugucuuuuuccagaaaccacccacauuggccucuuucuguaucuucaaagccaacaacagugggucaagugccaaauucuugcaucacaucacucugaucuccccuucugccuccuguuuccacuuuuaaggauccuuuugacuuuugauuacauuggacucaucuggaugauccaggacagucuccuuacuuuaaaguuagcugauuaacugccuuaauucguuuuugccauguaacuauauucacaggaugccaggauuagcauguggacauuuuuuggggucguuuuucuggcuaccacaguaacugaugauaaagcuccauucaguugcucuaguuaagucauaauugugccucuaagcugccuuuaugguggccgaaaggaaaaugggaaguaguccuuguuagcuuuuguaucuaugcuaaugaaaauaccaccuauaguagugcuauuauaguacaauccauaugaucacuucaauuguucuggguucugcacuaguagagguuggcacuaguauggcuaauaaaauaaauuggaaauggauaauuuaauaauuaacccauuuaucucagaugcuauuuaaauuauuuuuaauuauuugauuauaacaacauaaaacuuugcuuaaguuucuuuuacuuauagcugucauauaccuauaugaccaaaacaaaauaacaaagcuaaacaccaauaaacuucaaauaaauagcauuuguuuaugggauggaugauaguuuuuuuaguuggccauguggguacuccacugguuugugugacgauucaguguuccuacucuauuugaacuuacgcuaaccaucgcucauacagcuccagggguguuguuugguauuaguguaguuuucaauacuccacugaacucagaugguagauaugguuguaagguagucaucuauuugaucuagaaugugcauuuagauuuuaagauugucauugaaaugcaaaauuaaaaaguuuuuauagccaacaacucuugagacuucuugacacuacaucuguucuagggcuuuuaaagacucugaacuugacaaaugcuaaaauggcagaauuugauugugugucucauagccccgcaucacuuuuuuuuccauggauaauaucucacgacuagauuuucuaugcauuacuuuaauccaauaacucagaguaggauguggcaguaagauuuuuguuuuaagaugcugccuccccagguauauuuuaucaggaauauuuaguauuauuauaaaauuaccagguaaagagggaauuuuauggccacauguuuuuguguggaauguguuuucuuaccuacuucauuguguugaauuugugaaagaaacgguuuugauaugucuucagaaauugccugcauugauccauguuaaaaaaaaaaaaagaaucucacacuauaagaguuagacauaaauuguguuuguuagugaaggguacuccuaucaauuccuuuguuucucauuuucuuugaauuuggaacauucacuuacaucuuuuccuuuuuguguuuucuguaugguguacguggguugauuccccccccacccuuagcauucaauaugcuuaaguguuauuuuauauauuggauugaauuuuuauggauguuauuugucuuaacaaaauauguaucucuacagaacauuggcauagcuuccuagauuccuugguggguuaguguguauaugagguagcaugguuauggguggccaccugaggacuaaggagaaggcagggaaggacauggaaaugcuaaauucuuuuccacuuucuguauuuuuaagaaugacuacuacaucuaauauguuuacaaaacccaaaccuguucaaacucaugcauguuuucauauuaguuuauaugggaacauucucaacauugauccuucagaauuauguauggucauuuuauuugggcaacuuagggcugccucauuuggugaauaauuuccuuuaaauguauauguaaaugaaauauguuuuuauuuggaaaaauauaagaucauacugggauuuaauguguuuuuauucauguacaacauaacacuguuuuuuuuuuuuuuuuuaaauuggacuucagggccuguauaggaaagacaguuacuuuauccuguuuuuguaucucaauaacuuagagaugagugaccuguugaaguaaaagccuagaguuuagaaaugggaaaauuguuuaugcuguucucaaaaaggaguucuaaguuuguuguuagucauugccacauauuccuuuucugauuggcagggcuguucacuuaaaucuucacugaagugaugugaaaaauuuucaaagguggaagagugaauaaguauaguaauucagucacuaagcacgccuauuggaauucuaacaguguaacaaaauuuaaucuaauauauaauacuuuaaccauagccugcauuuuaaaaauaauacaaauauaagguauaaaaugaaaauaauuuucgaguucucaucacuucugcuuuuauuauggaguguguuauaaucuccaaggaccugguuaguuuucugccuuuucuuuuccuaauggcaacaguacaagcauccaucaaaaaugagaaccagggcaugagcggaucuuuuucaacucaguugauuacucaaagcagggaaguuguaaaggaagccugccucuguuuuaaauguuagaaaaauguuaauauuacuuguguuuuuccuuuuggagaacaguaguagucuagaggcagcgccucuaaauuuuuuuuguguggccuaugaguucguuuuguguggcaguaacuauuugugguccucuuugauucaggacucucuaaauggcuuuuaaagacuuuaaacuucaaaucuuuucuauuacaacauucccuugguuucguaugcaguuacuucuggcuuggugagacaguuuuccuaucauuguguuguccucagugauuauugauuagaacuccuuuguuagcugggcagcucagaaaaacauguggggaucacuguauuacagagacaaggauuguagaaaaagggucaauuauaaauuugaauuuguuuuccuuguaagacauuuaguaucccuaaugaugguguuucuacuccaacuuacauaucuuuuggccucugccauuugggucaccagagaaaguaucuuguaagaaguaaaacuaacugguagcauggagagcuguacuguauacucaauuuccuguaguguacauuauguggaagaccauacguuacugccaugggagauguauuaagaauggaaaauaagguguaguuguaauaaaucauuaaguaaauuuauauaauauuuucuacacuaauauaaauaugaaaaaucaaaguuugaguuacugcccucauuaaaaaugaguacaguugacauuuauuguuuagaccuugaucaaauugcuauuuaagcuucuaaacuuuuaauuucuauugugaucuaauagcugacaggaggagguugaacuagaucucuuaacucccuuccuugcucuaaaauucugaugccuugggguauuuuuauucuuuaugguuugauaugauucccuuguuauugaaugcagugcucaaauacagcauugacaaaacaggcaucuacuagugaggcagaaauagauaagcggccccuauguagguaacauauuugaggaaauuggcaguuauuccucuuggaguuacuuucccacuuaggaccaguguacugucagguaaaugguguggcucauuuauguuuggcuuaugaaaacaaagcacacaccagggacuacaggauaauaaauaaauccuuuuccauuguugauaucacugaaaugaugguaauugggcauuaucaguacagaucagcaacccagguuuaaaaacuaggcaauagagaccaaaaaaccuaagaaggaguuccugaaagcagaacauaaguuacuagucaacuagaaauuaucuucuagaugaagggggaacuugauauugaagguccuaugagacagagguucuccaaacaucuuaauuguguaggcaagguggaucacauuggggcuaaguaaaugauccugauuaaaguuaggggaaugcaaaaguuaagucuagaucauggucucaaaguuuuuucauuuauguaaaaauuauauacauuuuuacccucacauuuauaauauuuuucuuccacauccccauggagagugcuugucuguuuggcugacagugaauacuccuuuccuucuuuccuuucucggacaauaauauuguuuuaagcauuucuuaaaauguugcccauaggcugugcuggcuuuccuucgcuguauguagaacucuuugauucccuuuagucagagugucuuugaauuucccuauuaugccucaaagaaauugcagccacaaagugaugguagaacauauagauccucuucucuuguaacuuguugcuacucccuguucucauugauccuugagcaggcuucacuacagugcauaccuccccacagaggggaagcuggguguccuuggcagaacaggugcucacuuaauagaggcagagaagggucuggugcauuuucuuccucugguugcaauuccuugguggccagaucacacugugcgcuguagcaguaauauugagaaguugauugcuccucuaauggagcaggaugccauugcugucuuaauuucauaggccuuccugaaggucauccucacuugggcuuauuuuuacugucucucucuucuugguuuaauaagaauccauaguaacauaaacauuaaaaaaaccuauccaaaagguauucuauuacuagaaacaauaugccaguaacaaauaagucuaaauaauccaauuaccagguaggagaucuguggccagagauguggggggauacuuaacauuucagaaugcauacuaaguauuuaccguaucaguuagcaccaugcuuuuuccaguauugaauuuacugggcuuccuuuuaaaaugggcuaaaaagcuuuuuauuuuaggaguguuuuauagucauacugugauacaacuaaacucauuugaugaaagaaaaguggacuuucuuaauugaaucuuucaauugaauugugacucauuggauaguagaugcuauuuuaauuggggauuaaguuggagagaauuugauucuguucaaaauuuguguguaauaaaaagcaaagaguuuuuauuacuaauaaacauucuguaucuaguaauaaugcauuaaauaguucaagcuuaacauuuuuguguaaggauagcugauauucaaagggaauaugcuguguucuaacagguuucaaauuacuuacagaaaauacagauugacaaagguuaacaauuccaaauauagagcuuucauuauuuuauuggccaagugaauaaaauaaugagaauuguagaaauaggccauuuguuuuuugagggcaaaacaacuaaaaccuuugguggauuccugaauggaaaaucuuuagaacuuccuuuuacaggcaguauauauuguguuagauagcagcaaaaugaaguuugccuccuucaauuuuauuuuauuuuuuuaaaagcuugcuugcauguaaucguuaaaacauuucauaaaaggaauguaacaucuuccagugaauuuuggguuuagccacauacagcacaugaugaagagugaaagaaauggugacaggugguguuaguuaauuuugauguuggggggaauagcaucuugagguuauuuuuuauaaaauucucuccaaggcacaacacuucuacuguuugcaaaugggccaggugcgguggcucuagccuguaaucccagcacuuugggaggccaaggcagguggaucaccugaggucaggaguuugagaccagccuggccaacauggugaaaccccgucucuacuaaaaauacaaaaaauuaguugaguaugguggcggaugccugugaucccagcuauuagggagguugaggcaggagaauugcuugaacccaggaggcagaggcuacagugagcugagaucgcgccacugcacuccagccuggacgagagcgaaacuccaucucaaggaaaaacaaaacaaaaaugaacagaauagcuacccugauacugugaauauaagcaaucacuauaauuugagauggaaugagguuuagcauggaauguauuucucagcauuacuuucuuugauuuuugucucuuaaaaaccuguaaagauuugagaacugaucauaaaauaacuaauugaauaaaacgacuugaauugucaucuguagugauucuaguguaaauuauggcauaaaauuaaaacuucggaaugaaaaaaccuguucuucaaaaguauguugucuuauuuaaugacaacaugcaaaugaaaacaaauuuacauuuauugcaauuuaaaauuuauuucuuuguuuuaacuaagauauuaacuuuuaugcaagguuucaauagaccuuucuauuaaauaauauacugaagaagccaaauuucuuuauagaccugaaagagaggcagaguaaucuacaguaacauuauuuugccaauucccuaaagcggguuuguacccugacucugagggaacaaauauaacagucuauuauuugcuuaaaauugauggaggugucacagcagugguaguggggcugaauuuacaaaauggacuccuucaguuuauucuaaauccccauucugucccucccuuggauucuuuaaccuauauaaaauuaaucauaguauuugaauagggauaagaaaaagcauuaaacuuaaaguuucacauacuguaguaguuuuagaagauuacuuacagcucuuucagaaacauuacuuaagacuagaugacaagagacuauuaguuuuaagguaaauuaggugcucugucuuuaaguuuggcccagaaaaauauuuguagcccuaguuucacuucagcugccaaaaugcaauaaaauauuucgacugcaguuugagaaauuugacaaccucauauuaaauucaagaguuagccuguauuuaauaugugucaguuuacuucugcauugcaaaauacauggcuaaccaugguguuugacacuugcucaugcacuuuuuaucacaggagcaucacaaaaugauuuuuuaucugcauugaaauaaaugagauuuucuguuaaaccagugcagcaauucaacaaucauuuaguuccucacuguguguuuugcacauuacuuggugaagugagaagguauuaaauggacuagaagauuagguuagguguuacuguaaagaaccuuaaauuguuguugaauuuggacacauuuuaaggaaauuuaaguagcuucucauucauuugaaguauugaaucauaggugccuacaaaauugaaugaccaagguucuccacaguugcauuccuaauugcugcaaagccuuacguaaauguuacugauaguguuuuacuuuuaaaaaugauuuugauuuggguagauuucccauauuauccacaggccucuacauuuauaguucugauuauauuuuccuuuguuuuuguuuuuguauucuuucuccuccacugugauaaccuaaugaaagcauaauuuuuuuguuugcuuuuauaucccucacagaauccagcaguuuuccuuaggaagaaguaaauuaacaugugguuauacaauucauuuuguaucguauccgcuguuacguauucccaguucuuccuuuguaaugucuuaccuguaacuuuguuucugucuuaauugucaucaugagaauaagguagcgcaggauuuuuaaaauucuuuacuucacucaaguacauaccuauguauuuaaacucuuugcccuggugucuuuggagacucuugcuugaaaaccauuguaaaugcuguauucuuuagaucucauauuaucauaaugacuauuaaacauauauagaacacacacuaugugacguguuuguuuucucauuguuacuauuuagauuuggaguaaacuuguauuguaauaacuugggagugaguuuuauuugugguucauaaaauuuuuaacaaaacgauauggaggaaauuguaguuuaaugaauguugugguuuuugagauuaaauuuuaauaagccggggaagugcuaugucauauuaggaagggucaucuauuucaucacaguauuuccugcaccagugccugguacauaguuaacacgccuugaguauuugaaggacugacugagugaaugaguaacugaguaccauuacacaucguugguagaguaauuaacuggcuagacuggugugcagccaucaggacuuuaggugccuuguugguuaaaagcuuucagguuggcuuuaaaaguauggaaaacuuaauuauuuugagaacccuuuuauuacguaauagaugcuaauugaugucuuuuaagugguuguuggggcaagggacucuuccacuuuugggguaccagcuguuucagcucuuauauuggagagucaaaagaaaaagcaguaguaggcacuaagugauguggaccucaucauacauaucgccaauugucuuuagcaucuucauaugauuucagcugccaguaaacaauucaucucuggacuuaucuuacugauuauuggaagucagcauugggauuacuuguuuuauacugagaugcuuuuggagaaaaggcaguauaaaagugcaucugugcuaaggaaauucauuuucuccaaugaaguagaagucagauuucauguuccucugggaccaaacaauaaaacccugucuccuuuccaauuccaauaaagguauucaggcaucguagacuugauaacauguggugaguauaagacguugauuacuaugaagagaggaagguggaaaagauuagacugccuucacugagaucuacuggcagcauuagcaccuacaguggggauaaaggcugucuccucuuaguuuucaguagucaaucccagagagaugugcuuuaugcccuagcaguucacaacugcaaauuucaaacuuuuuaguuuuccuacuuagauucugcuauuuuaucccuuguccuuuacuuaugcuguuaugaauacccuuuacuuagcuuuuuccuugcugaauuaacucaugauuuaguacauuaagaguuguuuuauguguggaacugccuauauaauccuggacauauacaguugacucuugaauaacauagguuugaacugugagaguccacuuaaauguggauuuuguuuuucaauaaaaguaaccccaagugugccugccucuccugccucccuuugcaccuccuccacuucuucugccucugcuacccugagacaguaagaccugcccuucuucuuccuucuguucagccuacucagugugaagacaaccaggaugaagaccuuuauaaugauccacuuccacuugaugaauaguaaguauauuuucucuuccauaugacuuucuuaauaacauuuucuuuucucuagcuuacuuuauuguaagacugugauauauaauacauguaacaaaauauguguuaaucaacaguuuauguuauugauaagacuuccagucaacaguaggcuauuagugguuaaguuuuuggagagucaaaaguuacauguggauuuuugacugccugccugggguggugggaagugaggggagagucagcgccccuaauuccuguguuguucaagggucagcuguguaucugugguuuccaaagugaggagcaggauguuccuuugggaugaaagaaugaauuagauuuuucuaucuauacauuuaucuugagaggagaaaagguuuucucuuguuuauuaguugaguuaacacuggcacuguugugucaugucaaguggacguuuguuauuauauacaauaugagaaguguccugaggaagagugggaguuggugaaacagaagaguuuguaucaguauccugacuuauuuauuggguuucugcauauugcagcauauuuuaauuugucuugcggccugguuaucuuaagcauccaaauuuugugguuaucuuugaugucauaagagcauacuugagguaacuaagucuaagauuaagcaauauuucuaccucauguacaauuuaagacccuuggaacacuauucacuuuuccaauuuaaauguuacuacauuccguauuuugguuuuauuuuuuaaaguacuuccaacauuaguuguuauccucuuccucggauauccuauuuccucgucuuuuuuuuugccccguuuuaaaaauggcauuuugauuuuuaauaugguauuuaaaaauaccauauuuuaguaguuauuucagugagaguauguuuuguuuuuguuuugucugucugaaaauguuuuuguuuugucugucugaaaauguuuuuguuuugcucugaaauguugauuggguaugacaguuaucuuuguuaaucugaagguauuaucccauugucuucuggcaugugcuauagcuuggacuagucuaauugucauucuccugaaguaauuugaauuucugauugcauuuaaaauuuuguauacauagucacugauugggauucauauuuccugugucugaggauucaucucuuucaucagcacuggaaaauuaucaaguuuuuuuuuuuucccuucacgacuucaacuugauauguuuccuuugauuuuguugauguuguauaaucucuuuuucauauuuuuauuccuuuaucugugcuuucuucuguuuaauugcucagauucaucuucuaguucaucucugaugucuuuuucuguaucugauuuaugguuuuaacccaagcauugguguuuaaauuucacugcccauuuuucauugcaauaaguuauauuugguucuuuuucuaaucugcucuuaaaaaaaaguaguaucucauuuuugugauguugauuuauucucuuauaucuuuaguaaauguuaaacuuaguuauuuuguaguauccgucacauaauucuauuaucuaaaugucuuggaaauauaaacucuuguguuuuguguguguugauuuucacaaugauagguuguuuccauuuuuuuguauaauuuuguauuaugaacucauccuuagguugcuucccaccgugggaauuuuguguggucuaguuugaaaacaugucccuccagguccuauuuuauauuugcuuacucuuuuuagucucaauaacccuguaaacucucaaauuauugaggggcuccaaagagcuuuuguuucuguggguuauaccuauugauauuuacuguaucagacauuaacacugagauauuuauucaauacuuguuaauuuaaaauaauaaacucauaacaugcuaacauaaaauaguuaaugaaaaauaacugucucaaaauaaaaaaaauuuagugagaaagugacagcauuaguuuugcaaaucucuuuaacaucuggcugaagaguugaauacagcaggauucuaauaaaagcuucagaguucaaucuguugcaacauguuucuuugaaagguguuaagaaaaucuggccucacacagauugguagugggaaaaggaggaguguuuuuauuuauuuauucauucauucauuuuaauuuuuguggguacguaggugcauauauuugugggguacaugagauguuuugauacaggcauguaaugugaauuuaacacauuauggagaaugggcuaucuagccccugaagcauuuauuuauccuuugaguuacagacaauuugauuauguucuuuaaguuaucuaaaaauaaacaauuacuauucacuauagucacccuauuaugcuaucaaauaguaggucuuauucauucuuucuaaccacuuuuuuuuuguacuauuaugcuaucaaauaguaggucuuauucauucuuucuaaccacuuuuuuuuuguacucauuaaccauccccccuccccccuccccccugcaccaacccccacuacccuucccaaccucugguaaccauccuucuacucucucuguccaugaguucaauuguuuugauuuuuagauccuacuaauaagugagaauaugaaauguuugucuuucugugccuggcuuauuucacuuaacauaauguucuuccaguuccauccauguuguggcaaaugacuggaucucauucuuuuuuaugguucacuaguacuccauugugcauauguaccucauuuuuuuuuuuaauccauucaucuguugauggacacuuagguugcuuccaguguugcaacaaacauugggagugcagaugucucugauauauuuccuuuccuugggguauauacccaacagugggauugcuggaucauaugguagcucuguuuuuaguuuuuuuuuguggaguuuccaaaguguuguccagagugguugugcuaauuuacauucccaccaacaguguaugaggguucccuuuucuccacguccucaccagcauuuguuauugccuguuguuuggauaaaagccauuuuaacuggggugagaugauaaccucauuguaguuuugauuuguauuucucugaugauuagugauguugagcaccuuuucauaugccuguuugccauuugaaugucuucuuuugagaaauaucuauucaacucuuuugcucauauuuugaucagauuauuagauuuuuuuccuauagaguucuuucagcuccgucuauauucugguuauuaauccuuugucagauggguaguuugccaauauuuucucucauucugugggggugucucuuuacuuuauugauuguuuccuuugcugugcagaaguuuuuucuuuuuuuucuuuuuuucuuuuuuuugagauggagucucacucugucacccaggcuggagugcaguggcaugaucucgacucauggaaagccacgccauucuccugcgucagccucccaaguagcugggacuacaggcgccugccaccacguccagcuaauuuuuuuguaucuuuaauagagacaggguuucacuguguuagccaggauggucucgaucuccugaccucgugauccguccgccucagucucacugugcagaagcuuuuuaacuugauggaggguuaugagaaggagacuugguucuggauuagauguuguggggucagugggauggucucuuauuguuuaucuaaaugaguguuguauuucaggagaaaggaauaaauggaggcuauagcuuuaauugguaaagaaguuguagucguucuuguuagcaaggaaagguagauauuugguuauuuuuguuuuuuggacaauguugauauguuugcuuguuuuugucuugauccaucauggucaguagucuugucugauguugauguucuucuaacaggaggacaucaagucuuugcugugagggucaggucuuagcaacaucagggcucugcuaacgguacugguuuuguagcuuuuaggcuguuuuuagcuuguaguuuguccauuguucuugcauguaaagauggugcccaugcaaaaagguuguaguugaucuugugacucaaccucacaaguguuuuuccucaagguaacuauuaaacuucacuaugcagcagaagugcuuuaugcguaguugucacguggucacacaaaauauuaaaaagacuagucgugagaugaauaaugucuccugcaagagauacacccaugaccuaauuaucacaaccuacgaauauuaccuuaauuggaaaaagggucauugcagauauaauuaaaaaucuugagauaaggagauaauuuuggauuagauuaggcaggcucuaaaccuaaugacaagugucaugaugggagagagacacacagggaagacagagacagaaggggagaagacgcagaagaagaggaggaggcagugugaucaugguggcagagauugaagugauguggcuacaaaccaaggaaugucuggagccaccaaaagcugaaagagggaaagaauugguucuccccuaguagccauuggcaaggacuguggcuuuguuagcaacacuuggauuuugggcuucuggcuucuagaacuuaaaauaaaugccgucgaaaggccaugaaguuugugggaauuugcagccuaccggucuguggccuguuaggaaccaggccacacagcagaaggugagcggccaggcgggugagcgggcauuaccgccugagcuccgucucuugucauaucagcagcggcauuagauucucauaggcgcucgaucccuauugugaacugcacaugugagggaucuagguugcacauccuuaugagaaucugaccauccccugucaguggaaaaauugucuuccacaagaauagucccucgugccaaaaagguugggcauuguugguaagguaccaguaguuuaacccacgauugcuuuuguaucauaacugaaaaugucaguaugguaaaauuucgguauuauugugaacauaguuuugaccaugcagacuucuggaaaggguauuugaagaaccugaauagaaagugaagaacuuucuucuuugagacucuggaguacaggauauaguaacuacuuucucacugccaacucagauauaaaauguagcagaguuccuuuuauuaauacauaugauauuuguugaauuagagcuuguuacuuauuguuaugaacuuacgauacuggcauaagugaggaguaagaaugguuucucucaucauuugagugaaaucuacauguaagaguaaaucuuuuaagugacagaaagcaaacucaacccuaacuuuguuuucugcuuacuuagacaauuggcuauugauuuuagagauuuaccugucaagguagcugcacuuacuguugaugucuugucuuuuggugaagucucccuaucuaccuguguucuuuaacugccaugguucucucuuggaaauaauaaauuuuuuuauuuauuguucuauucuucuaccaaaugaugucuaggagauccaugagccuuuucucucccuuuucugcuuccaacuguguguacagaugugugcacaugcacacauacucaaaugcauaaaugcacuuuucacuuaguuaucuaguugucagcucuuccuggaaucugauucuaucauugcacaacuguauugauaaauauugauuuccacagauacuuaaggguuggcauuagucuauuuacagccaaauugaggacaaaauauaguaagggcauuuaauuugcaucuuagaguucccuauaaaaaggaacauaaaacuuacuaauguuuuaaaaaaacucauuuaauugcuuuggaguguaccauagugcugagaagggagacccagcccuugaacugcuaguaggagggugaauaucgggcccagagaagcauaaaagaagaugucuugcuuguauuagaugagauaggaaguacugguucccagagacacaaagaauggugagcuagagagugugucauagcuucaaggcugcauacaugaaaucacuuggugacuagagcaaagugcucuuaugacaaacuucaacaaaaaaagcaaauuauuccuaagcuaguacuguguaagcaguggacaaccagaaagagaaaucaggcuuguugucuuacuuguuaccaguaggaaauguggaauaacugaauuguugcuguauucuguauauaauaaggaaauacguuuugccuugguuuauuguaccuugggaagugagaaucauuuguucauuggccgugugacuaggcuggcaucuugugggcauugcccuuugcaggcacuuagguugcaauuuucuuuacacugcugaguuguuuaccauuguucguccuuuuaacacaguauaccauuuuguuaacaucuguuugcuguuaucuuuuuguccuuggaggcuuaugcuuaaauuauuucuugcauguuuuaaaauuuaucgcuugcuggaggaagcagaguuggguauacucaauacauuauuuuuagcuggaaauaucugccuugauuuagcccuugguuuugaaacauaccugagguauuguuuuuuuuuccuugcaauuccuggaaucuguacuugauuacguuagagaacauuguuuggcauuucuuuuauccccuccaaacuauaggguuaaaagggauaaaaaccuuuuaacccuauagucuuucuuaugcuguauucuguguuuucuccagccaagaagacuuuucagcuguauuuuuuauaguuuguaugauggagaaauauaggcuguuaaauaugcuguuucauaccguucuccgguaugcuuugaggauggauuugggcacacaugcagccucucuccucuccagugaaaaucacauacugcucauuguuaagagauuccugucucugcccuuacugagcuucuaacuugcuggaacaagaagacauaucaauuuauaugacuggguggccggcagcauauugaccuuugguaauuuguaacaacuuuucuuaccagucugugcacuuguugaaaggaaacacuaccaacuaggucuaugagugacagagaccacggugaaacguuuucaaaaccuauucagaauuauacauuugcuuauuuaaaugguugguauugccaaaugcauccuauucugaaagaagugaaauaaaugugaaagcugucuuuagcucauuagugaaaugaaggaaacauugugaauaucaggaugacuugucaugggaaauuaaauugaauugaaaaaauguuaaucucaaauagauuuugcucugcauacugacuuuuuaaaugugucagguuuacauugacagaaagaucuaugaagacuuugaccuucacaaggaaacacacaguuauuugacaauugagugaauguauuaaaaaaaaaugagugauauacccgucuguucaauuugggaguuggugaugagcuaacugaaaagaguggaaaggaagaauuuaugcuaagccuugguaucugagucaaguuauggagaccuaugugucuguuugauuaauugcaucaucucaaagcaaugccuaacuaugcugguuagcucagguagcaugugagaacagggaaugcauugacuuucucacuuugcuuccuaaauacuauuuaaaauuuagauauagcuaugauauuaaaaaaugugacuucagauacuuauucucuauuuuuguuuuuguuacuuucucaauauaaaucugcauauuuuuaguuuuaguacaauaaguuaaauuuuucuuuuuuacauuuugaggcauacuuuacaugcaauauagccacauauuuuaagcaagacccugugcccuuuccagccccauguccuucuacgugacuauuauuucauuuaccauggcuuagcuuugccuguuuaauaacuucguauaaucguacagcauguauuauuuuuaugugugguuuuuuuaguucaacacaguguuuaaaaaauucauuauguuggacguaucaguagguacuucauuuuugaugcuguguuguaucuuguuguuugaauauacagcaauauguuuagcuguucacuuguauauggacauuuggguuauuuccauaucuguugugguuucacccuuaguuuugagaaacacucuucaguccuggaaccuuucugggauuucaguggaaaauccaaagugccaucaaagcucuucuaauuugguggaacucagacuccaaacuuugucuuccuuucagcgagggucagcuaaaaucucuuuucuguucuuucuucgaacuguuauuucuaucugagcuccuuggaguuuugccacuugcacgugcauuucagcugucagccaagaauuuguggaggauuauacagauaucugagguacccuuucuguggcucacucuguuuugggauucuuaauuucuagauuuucugggccuguggugcauguucugacuccuuagacuaauagauaguggcuuucuguuucagugcuagcaguccaagccaaguagaauggcagugaccucagggaaaaaguggguacaguacauagaauuccaagaacggccccucgagauuccauauccuaaucuuuggcaccaauaaauauaauauuauucccaugaguauguuaaauuauuaguugacauuaagaugggggauuauuuuggugggcccaauacucacgugagauccuuuaaaaacuccgaggguuuucuguggcugguggcagaagaggagcucaaauuugaggcauaaggaagauuuggcauguuguugcuggguuauagauggagacuuugugagaagguggucuaaagaaacugagagaagucccuggcugacagccagcaagaaaauggggacuucaguccuacaaccggaaaggaaguaaauuuugccaacaaccugaaugagcuuggaagucaaguuuucuccagagcuuccagguggggacuuggcccagcugacauuuugauuucagacuugugauaacccugagcacagaacuuggccaugcugugccagcuuucugacuuauggaauugugagugaauaaguggauauuaaguggccagguuugugguaauuuguuaugcagcaacagaaaacuaacacaacagggauuuccugcagcaugauuuccuucuuuccuaaggcuguccuucaguuucugccugauuuugcuuauucuguaguccuucaaauaguagauuuauauauucuuuguuggauuuguaauuguugcuaugagaauguuugauauaaauuauccugccauuacuggagcuagaacucagucuccacguaauuugaggguucuuuuuucuuuuucuuuucucuuucuuucuuucuuuuucuuuucuuuugagauagagucuugcucugucacucaggcuggagugcaguggcaccaucucagcucacugcaaccucugccuccuggauucaagcgaaucccagcuucccgaguagcugggauuacaggcgcgugccacugcaucuggauaaguuuuguguuuuuaguagagaagggguuucaccauguuggccaggcuggucucgaacuccugacuucaggugauccacccacuucagccuccugaagugcugggauuacaggugugagccaccaugucuggccaaggguuccuuuuucacuuuaaaauuauuuacaccacuccuauucaacauaguguuggaaguucuggccagggcaaucaggcaagagaaagaaauaaaggguauucaguuaggaaaggaggaagucaaauugucccuguuugcggaugacaugauuguauguuuagaaaaccucaucgucucagcccaaaaucuccuuaagcugauaagcaacuucaggaaagugucaggauacaaaaucagugugcaaaaaucacaagcauuccuauacaccaauaacagacaaacagagagccaaaucaugagugaacucccauucauaauugcuucaaagagaauaaaauaccuaggaauccaacuuacaagggaugcgaaggaccucuucaaggagaacuacaaaccacugcucagcaaaauaaaagaggacacaaacacauggaagaacauugcaugcucauggauaggaagagucaauauugugaagauggccauacugcccaagguaauuuauagauucagugccauccccaucaagcuccaaugacuuucuucacagaauuggaaaaaacuacuuuaaaguucauauggaaccaaaaaagagccugcauugccaagacaauccuaagccaaaagaacaaagcuggaggcaucacgcuaccugacuucaaacuauacuacaaggcuacaguaaccaaaacagcaugguacugguaccaaaacagagauauagaccaauggaacagaacagagcccuuggaaauaauaccacacaucuacaaccaucugaucuuugacaaaccugacaaaaacaagcaauggggaaaggauucucuauuuaauaaauggugcugggaaaacuggcuagccauauguagaaagcugaaacuggaucccuuccuuacaccuuauacaaaaauuaauucaagauggauuaaagacuuaaauauuagaccuaaaaccauaaaaacccuagaagaaaaccuaggcaauacuguucaggccauaggcaugggcaaggacuucaugacuaaaacaccaaaagcaauggcaacaaaugccaaaauugacaaaugggaucuaauuaaacuaaagagcuucugcauagcaaaauaaacuaccaucagagugaacaggcaaccuacagaaugggagaaaguuuuuacaaucuacccaucugacaaagggcuaauauccagaaucuacaaagaacucaaauuuacaagaaaaagucaaccccaucaaaaaaugggcaaaggauaugaacagacacuucucaaaagaagacauuuaugcagccaacagacacaugaaaaaaugcucaucaucacuggccaucagagaaaugcaaaucaaaaccacaaugggauaccaucucacaccaguuagaauggcaaucauuaaaaagucaggaaacaacaggugcuggagagaauguggagaaauaggaacccuuuuacacuguuggugggacuguaaacuaguucaaccauuguggaagacaguguggugauuccucagggaucuagaacuagaaauaccauuugacccagccaucccacuacugggcauauacccaaaggauuauaaaucaugcugcuauaaagacacaugcacacguauguuuauugcagcacuauucacaauagcaaagacuuggacccaacccaaaugucuaucaaugauaaacuggauuaagaaaauguggcacauauacccuauggaauacuaugcagccauaaaaaaggaugaguucauguccuuugcagggacauggaugaagccggaaaccauaauucugagcagauaucacgaggacagaaaaccaaacaccacauguucucacucauaggugggaauugaacaaugagaacacauggacacaggguggggaacaucacacacuggggccugccggggguggugggagggggaaggauagcauuaggagauauaccuaauguaaaugcagcacaccaacguggcacauguauacauauguaacaaaccugcacguugugcacauguacccuagaacuuaaaguaaaauaaaaaaauaaaaaauaauaaaaauaaauaaaauuauuuacaugggcuucauguuaguugcauaacauuucauuguuuuggaguaccauuuuccuaaucuuagcuguuggguuguuucugaauuucgcugcaaaaaaguugcagagagauccuugagagucuguuuuuuggcucuguuguuuuauuuacuuggagguaaacuggagcaaaauuccuggguuaaagggauuagaggaaauaacaaaaccuuuggagugagaugaguuaguauuuuaccuuccguuaugcuacuuaacuguccgugagacuguggcaaguuaaccuauuuuagccucauuuucuccuuaugggaaaggauaagaaaaucuauccuuaaugguugaucaaggauuaaacuauaaaguuuuuagaaagcauuggcaaagagauggacauuuaaugguagaugaggagaugaagauaaggaccauagcuaucgauguguuuugccaccuugcuuuccaaaaauaaaaugccaauuuaugguuggguugcuuucuuugaauagaucuucugaauaacuaaugaaacagagaugaguaugaauagagcacaggacaggguggcugaaguuaaagaggaaggaacagaguuuaauauuuacauaucaguuguugagucagagcuccaaaagauauauaauuauucuuuucucuugaguuugcacaucuaaaggaaauccuuuugagaugacuuuaagaggggugguuuuuggacuuuuuuucuucucugugcuucccuauaggucuagucugucuguuuaggccagaaaacaucuuugcuugguuuguuuccaguuuagcugucauuugaauaauccagaguucuaagaauuuuauacuggagauccuuauccagugcuaauuggauugugauuuuccuaguguaccacauccucuauaaauauacuugucuuugugucccaaaggaugcuauuuuauaacaacacauugaaauaauacuuucucaguauucuacucaagcacuuuauuaauguagaugcuuagguuauauuguuggaaaauguuucuguuauugacaacuugcucuuuuuauuuggaugggauaguaaauaaagguacuuaauuuacauaagccuauuaaaugaaauucucaagaggaaugaauuuuaaaugcagcuuacaauguggugacagcugauucacuuauaaacaagcucguuuaguggaauuggacuaaaugaaaaaacuuuaugcaguaguuuuucuuuuuuuaauuucagcuuuuauuuuagauacaggggauacauguauaugauugcuacauggauguauuggaccuuguagugagcauaguacccaagaggugguuuuucaauccacacccuuuucacuccuuccccuuucuaguagucugcagugucucuuauucccauuuauguccaugugugcucaguguuuagcucccacuuauaagugagaacauguggcauuugguuuucuguuccuguguuaauucauuuaggcuuauggccaccagcuccacccauguugcuguaaaggacaugauuucacucuuuuuuaugguuguauuguauuucaugguguauaugugccauauuuucuuuauccaguacaccauugauggggaccuagguugauuucaugucuuugcuuucaugaauagcauggcauugaacaugugagugcaugugucuuuuugguauaaugaucuauuuuccucuggguaugaacccaguaaugggauugcuggguugaaugguagcucuuauacaguuguuucauaacauaauuguuugugguauaugccaaauaguauucauaauacugaacuauauggagggauuaucuccauuccuaucaaccccuuccuuucucucuucuuaccacagaagguaaaaagaaagagauuuuguuuuguuuuucaaaaucguucuaccaauuaauaguugaaaugccuuuuuaaaagagaaacuaaaaggcugagcuuugguuaucagagguucuaaaaaguguaguuaaaacuguaaaccaaagaaucgcccucucacccccauuguuuguuuccuuucuuggaugaacaauuugcagucuugguuuuguuuuuuuuuucugguagaaauaaaauuagcgagauaaugaauaggacaacugaauugcucuauuuuuaauuucucuuuaaagguguuaaaaaugcuucuucuguaauauuaucaguaaggacuuuguuuccuuuggccauugggaguuaagagcacagccgucagaagagauucuucugggauacuccccucugaccuccacagaaguaaauuuucuccuugaggaggcuacuugcaaauucagcuaaugcagaacaugguguucauuuguuuaaaggcuugcagcccuagggcacagauguaacguaucuguucuuccaauuaauuucugacaagcucaggugaugacuuugauaugucagacuguauaugguauaggccuugguuaccuuagaaaccaucucuuuucuuagguuucugcuuaggaauuguaguucccacaggcaguucugcagaauauuuucagaacugaauuuggaaauggaggacccuguauucuucagagaaaacacagccucaauuucuucuaucaauucauuuagcuaucauccuugaauaucucuggguaugguuagaaucccuaugauagguuuuccucagcugcaguuaaauucuagacuauuucuucaucacuuuagagucugcguucucauuucuccgagaucccuuucugcaugcuucuguucaguacauuuuauuaaucuguuggaaugcaccuuagacaauacucaucuaccauauccuuauagcugcuguuuuuuaauguuaauuuguguaauacuuagcaauuagcuuggcauauccuguggagagaaguaaauauuuuuuuuuuacucacagguacuaucauauucauuccacaaaugaauauguuccuuuuuaucuucccuuuauagugacccuguuugcagugucuaccaaaugacuaaccaguaguaagcuucaaucaaaucaagaguauuuagagugugaggaggauugggagcaagacucuugggaguauacauagaauccaauaagaaagaaggguaggaggaaagucagagagaccaaaucacgaaagaguagucagugguaucaaguuaggcuugacagguuaacuucucugcaauccuuccacuccccucagugcucacugacauggucugaguuuaggucauuucucuauucuucacccacauaugcuuugucuggaauaucuuuucuuucuuugcuuacaauguuaugccuuccuguuaaaccuguaaaacucagauuauucaucgccucuuugaauccguuuccuagugcccacucacuaugauuucucuuugucauguauaggugucuauuacugaacuuaccaaaauauuagaauuguuucugugacuauuucuucuauuagacugugagcuuuuuaaagauaugagacuguuucagucaucuuuauacaucaagugccuaauguagaauuuagcuuuaauggaagcuuaaaaguaaucaagaaagaaauaugaagacuuaaaaugggccauuaguuuuagcaaugagggaauaauugguaaucuuuaccagaagguuuuauucaagugguagagguggagagcuauauugaagagcguugauaaaggaauagaggagaggaugagugggccacaguucaagaaggcuggcuguaaaaggcaggaagguggauaguggaggcuuguagcuggcaggacaggaauauguauauggugcagucuuuuggauguacaaacugggagauaugaacauguuuuauagccuaagugaagaagcccuugaagagaguaggguucaggaggaugugggagggguuaaauccagaguaugggagaaagaugagcuuuuuaauagcaaucuuaaccaugcuuauuuuuauuuuuuauacuuucaacuuuuauuauagauuaaaggguacaugugcagguuuguuacauggcuguauugcaugucugaggcuugggguacaaaugauccugucagauagugagcauaguacccaauaagugcacgccccuuuuccucucucccgcauuuaguaguccccagugucuauuguucucaucguuaugucuguguguauucaacguuuccauucccauuuagaaguaagaauaugccacauuuuguuuucuguucuugcauaaauucgcuuaggauaacggccuccagcucuauccauguugcagcaaaggacagccuaaggcugcguaguauucuguaguguauauguuccacauuuuauuuauccaguucaucauugaagggcaccuagguugacuccauauuuuuacuauugugaauaacacaacauugaauauacaaguacauauauguuuuugauacuguaaauuauuuuccuuugguuauauacccaauagugggauugcugggcugaaugguaguucuguuuuaaguucuuugagauaucuccaaacugcuuuccaaaguggcuaaacuaguuugccuuccuacaaacagcauucccuuuucuuggaagacucuguaacaucuuuuauuuuuuugacuuuuuuaguaaccuccauugugauuggugugagaugguaucucuuugugguuuugauuuacauuuucuuugcccuccugaacacccgcuuguuuuugagacaaggucuugcuuuguugcccagugugaucucagcucacugcagccuugauguccugggcuuaagugauccuccugccuuagccuccagaguagcucuuugcccauuuuuaaauuauauuguuuguuuuuugcuugucguuuuaaguuccuugcagauucuggauauuagacuuuugucaaaugucaaaauaauugcaaauauuuuuucuccgauucuguaggcuguuuacucuguugggaauuucuuuuggugugcagaagcucuuucguuuaauuaggucccguuuaucaauuuuuguuuuuguuacaauugcuuauggggacuuagccacaaauuauuugccaaagccagugucaagcaggguauuuucuagguuaucuucuaggauuuuuauaguuugaggucuuacauuuaaaucaguaauccaucuugaguuaauuuuuguauacaaugagaggaaggguccaguuucauucuucugcauauggcuagccaguuacucugguaucauuuauugaauaaggagcccuuuccccauuguuuauucuugucaauuuuguugaaaaucugaugguuguagguguguggguuuauuucuggguucucuguucuguuccauuggucuauaugucucuuuuguaccaguaccaugcuguuuugaucacuguagccuuacaguauuguuugaaguuggguaaugucaucacaaauggauguuggauuuuaucaaaagguaaauuuucugccucuauugaaaugaucauaugauuuuugcuuuugauucuguuuacauggcgaaucacauuuauugauuuguguauguucaaccaaccuuacaucccaggaauaaagccuguuuuauuguggugagugaacuuuuugaugugcuguuagauuugguuugcugguauuucguugaggauuuuugcuucuauguucaugagaaauauuggcccgaagcuuuuuuguuguuguuguuauuguuguuguuguuguaugucugcuagauuuugguaucaagaugaugcuggguucauagaaugaguuaaggagaagcccuuccuccuugauuuucuuggaauagauucaguaguacugauaucacuuccuuuuuguacaucugauagaauucgggugugaaucccucucgucuggagcucuuuugguuugguggauuuuuaaucagugauucaauuucugaacuugaaaguuguacuuucuuccugguucaaucuugagguuuuguguuuccaggaacuuauccauuuccucuagauuuucuaauuuguguauguaaagguguucauaaucgucuccaaucuuuuauauuucugugggauagguuguaauaucuuugucacuuccgauugugcuuauuuggaucuucuguuuuuuguuguuguuaauugugucucaauuuuauucaauucuuauuugauuuuaauuauuucuucuaccagcuuuagaguugaauuuuuguuuuguuuuguuuuuuaguuccucuaggugugauguuagauucuugagaucuuuccgaccucuugaugaaggcauuuagugcuauaaacuuuccucuuaacaucacuuuagcugccucccaaagauuuuuauaaguugugucucugcuuuuguuaauugcaaagaauuuuuauuucuguccugauuucauuguucauauaaugaacaaugguucauucagaagcagguuguuuaauuucuauguuuuuguguuauuuuugagaaaucuucuuuaucaauuucuguuuuuauugcaccguggucugagaguguguuuggaauuauuucaauuuuuuuuuugaauuuacugaaacuugcuuuaagacucagcaugugguugaucuuugaauauguuacaugugcaccugagaacaauguauauucuaugguuguuagguggaguauucuguagauguuuauuagguucaguuguucaaguaucgaguuuaaguccagaauuuguuaguucucugcuucagugaucugucuaaugcugucagugugguguugaacucucccacuacuauuguguaauaauggcgguguaaguguuuucguaggucaggaagaacuuguuuuauggaucugggugcuccaguguuggguguguauauguuuaggauaguuaagucuucuuguugaauagaacacuuuaucauuauguaaugcccuucuucguucucccugauuguuauugguuuaaagucuguuuuaucugauacaggacuagcuacuccugcucuuuauuuuccauuugcaugauaggucuuuauuuuuacuuucagccuguuugugucauuacaugugagauccaucuauugaaggcaccagacaguugggucuugccuuuuuauccaucuugccauucuaugccuuuuaaguggggagauuuagaacauuuacauucaggauuaguacgauauaugagauuuugauccugucuuuauguuguuggcuguuugcuuuguagaguugguugugcaauugcuuuauauugucugugagcuauugugcuugaguguguuuuagugguagcagguuuuaaacuuuuauuucaauguuuagcacucccuuuaggaccucuuguaaggcuggugugguaaugaauucccucacugcuuaccugucugagaagcauuuuauuuugccuucacuuacaaagcuuagauuggugggauaugagguucuuggcuguaauuuauuuucuuuaagaaugcugaaaauagaccuccaaucucuucuggcuuguaagguuucuucuaagaggucugcugcuaaacugauggcguucccucugcaggugaccugaccuuucucucuagcugccuuucagguuuuuuucuuuugcauugaccguggagaaucugaugacuaugugccuuggaauggucauguuguauaguaucucgcguggguucucuguuuuuucugaauuuauaugucuuccucuagcaggauucgggagauuuucguagaguauauucucaaauacauuuuccaaguugcuuacacucucuccuucucucucaagaaugccaaugagcuguaaacauggucucuucacauaaucccauauuacucagugguguuuuuuuuaauuuuuaauucuuuuuuauuuuugucuggguugauuugagaaauugguccucaagcucugagauucuuuccucagcaugcucuauucugcuguuaauacuuuugauuguaaggggcugggugcgauggcucacaccuguaaucccagcacuuugggaggcugaggugggcggaucaccuggaggucaggaguucaagacuagcuucaccauggagaaaccccgucucuacuaaaaauacaaaguuagcugggcgugguggugcaugccuguaaucucagcuacuugggaggcugaggcaggagaauugcuugaaccugggagguggaggcugcggugagcggagaucgugccauugcacuccagccugggcaacaagagcaaaacuccaucucaaaaaaaaauacuuuugauuguauuaugaaauucuugaaguaaauuuuucccuuccagaagcucaguuugguucuuaaaauggcuauuuugucuuucaagcuucuggauuguuuuacuguauuccuuggauuggguuucaacuuucuccugcaucuugaugcgcuuccuugccauccagauucugaauucuuugucugucauuucauacaucuaaaucugguuaagaaccauuucuggguuuauuuggagauaagggaacacacuggcuuuuugaguugccagaguucuugugcugauucuuucuugugugugagggcuaguggcuaguguuccuuuaaaugugauguaaguuggguauaguuaguuggcuuuguuucuggguguuuacagaggaucaugacucuauacagaaucuuuauuuguagcuagauuuuuuuuuuucuuuuuugagcuggaguuuugcucuugcucccuaggcuggagugcaaugaugugaucucggcucauugcaagcuccaucucccagauucaagcauuucuccugccucagcccccugagaagcugggauuacagguaugcgccaccacgccuggcuaauuuuuguauuuuuaguagagaugggguuucuccauguuggucaggcuggucucgaacucccgaccucaggugauccccccaccuuggucucccaaacugcugggaugacaggcguaagccauggagcccagcccuguagcuagauuuuuaaaaguuuucacugguguuguauacuggcaaaauguuuuggugguguauuuugggcugcaauccaguagguggugcuucagaauguuggucagcagauaggcucuuacuuagccacacaacucuuuuguacuuugguucuuuuguauuuugguucuguugguaguuagugucuguguuggugggagagagagaugaccccuucaccugguccacuccuaggccaugaaggagcccuguccagucacuggcuccaugcccacauuuccuuuguuagauguucugguccccggggcucucucaggcaggggcagauaggccguacccucucugggcuggcccuguugagugagacacaccccacuccccugcuggucugugagcccaggcaucagagguuagauuuugaugugacaagcuguccucauuccuuugagaccaaaggaaguucuaaauaauugacuuagaauugaaucugggugcagaaucccuuaaaucagguacuuccuguucuugucacaccuucaaucagagccagagaugaauaguuugcccuagcagcagaggauugguggcaguggcuuuuacuauguuuaaguauagaauugaugagcgggacaaguaggagaugucgucaccuauuuguuucauuuugguuuuuggaaauguccuuauuuauuucagacuaaucuaucuaggaaacagaucuuuaaaaacucgugaaagaugugugcauaagauuauuguauauacucugcaucauucaguuucaaagaaaagucugcagcuaucuugagaggcaauugaguagguaccugauaccugccuaucuguccauauucaaaauuagacauauuuuauaaguuguggaaaauuauuugcauaugcaguaaagugacaucauucuugucuggcucauguaaaauuggcuuguccuuugucagcagaaugacugaaguucuacuucuuguuuauaaagccaaacuuguaucucaaaaauuguauugccagggauaacauguaggaugcuuuucacugcagguaacagaaaacacgaccauagguggcuuaaagaaccaggaaaacuuuguuacuuacaugaugagaaaccuggaugaaaggaaauucuagggccgauuaacucaauaacauugucaagaucaagguuuuauccaucuuucugcucugacaaucuuaguuccucauugauuuggcuuuuguccucagacuuguccccucuugauuaaaagacccuguaacuccgaaccaauuaaaucagaauagcuggggagggggaccaggcauuagucuuuuaaaagcuuccaggugguuuuauugugcaaguagcuaggauugggaacacugaguuacaucaauuaagagccacucagggguuuauaaaucuaaccccccuaaagcacauggucauuugguaaccaaauaaaucaguucuuuuagcaaguaauaagggugagaaauucaaccauagauguccgcccuacuccagaugauguaagguuuuuaaaaauuucgcuuauucuuugacuucauguauguucacuaucauuacuuaaaaaagaacuauguaagugguuucuacccccucacuuuagaggcaaaucucuggauaggcaguuuuauuaacccaaugaacuacaaagagaauauuuugggcaagaaggaagcagagguauuaaagcauacuuuucagucauuuuaugugcagauaaauaacaauauuuaagguaaauauaaucuauauugccuuuucucagguggauuguagccaacucuuuaucaaaauugauucccuucuucacaaauuguaucaaauaugcucucuguuguggcuuucuccucucguuuucuguuuucaaaugcauucucccuuaacuaacaugugccaaaaagaauauaaugucccucuugaacuuugucucauuuaauggcaucaccuuguuccagaggauguagguguacucagaugcaugcauuuguggccaagacauuucugucauacuuagagucucuggcuguuuuucacuucagugcacagaauuugugccacuucauggucucucuuuuuguuuuuuuuuuugacucuuaaaauuuaccuuaagguaccucccacccacacacacuuucagucucuuuuuuaguuuauccccaacagugcuucuggaguuauccaaaaauauagaugagauccuguugucuucacauugcccuaaugguucccauuuaucuacagaauaaaaauccaaugugguugguugucuuuacuaagauagcgagaaaaauauuucccaucucacacauucuacuuuauaaugugguuuugauauucuucccacaacgagguggagucugugucccucuacuagaauauggacaggcuugugauaaugguggaagagauacuagugugacuuccuagacugagucauaaaaagugucuuggcuucugccuguacaucuuggcaugcucauuucggggccacagcuaccaugcugugggaaaaagcccaccaauaccuuagccuguagccuuugcuaagcuucuagcugacagccagcauccguguaccugccaaaugggugaucugagaaguggauccuucaguuucccugcccucgcagcugaugcuguguggauuauggagaugagccaucccugucaaguccugccuacauuagaaagucauggggggaaaagugaucauuuguauucaaagugauuauuuguauucagagcaucuuuuuucuuuuuaaaaucaguuuuagugagcuauaagguauguauaauacauucacuaauuuuaaguauacaauucauugaguuuuaacaaauguuugugguguuuuuucauacugccacauuuaaauuuuguugauuuucaucauuucauagaguucucuuguauaccuuccaauuuaguucugucaccauccucagccccuggcaacugacagaaagcuaaugugcuuucugucccaauaguuuugccuuuuccagaauggaaaccuuguuucucuacuaguuuugggcuaguguaaauaaacuugcuaugaagauucauguauaugucuuguggauguagguuuucauuucuuuugaguaaaugcuauaggagugggauuuaguuauaugauaguuaguguuuaaauuuuuaagaaacuaccaaacuguuuuucaaaguggcugugacugcguauuugacuuugccagcaguguaugauaguucuaguuguucuucaucauugcaagcucuugguauugucauuuaaaaaaauauaguuauucgaguggcuacaaaggcuuaucucauugguguuuuaauuugcauauuucugugacuaaugguguugacauccuucaugcguuuaccuuuuauauaucauuuuugaaguuucuauucaaaucuuccauuuaaaaauggguuguuuaucuuucuaauacuuaguuuuaagauucuugacuauauuuggguauaaauucuguaucauauagauuguaaaguucuuggauucuguggguugucuuuuuacuugccugaugguguccuuugaagcacaaaguuuuuaauuuugauggaaauccaguuuaucaaguuuucuuuuacaguuuauaugcauuauguucuuuuaaaaacuuuaccuuaacaaggucacaaagguuuuuguccuuuguucugcgcgcuuucuaauuuuuagcucuuggauuuaggcauaugauccauuuugauuuuaaguuuguauauggcaugagugaaguuucaaaguucauuuguuuguaaaauagauaucagauuguuuuagcaacauuuauugaaaagacugucuuuuccucauucaauuaucuugguaccuuuagaaauaaguuuaucauauucauaugaauacauuucucuuucuggaguguauauccuauuccuuugauuaucuguccuuaugccaauauucucuugauuacuguagcuuuauaaucagucuugaaaucaauggaugcccuuuaacuuuuggucuuuuuuucaaaguuuuucuggcuauucuagguucuuuucacguccguauauauuuuguaauaagccuuuaauuacuaugaaaagauugcuagaauucuuggggaauuacuaauauugaucaauuuguuggcaucuugagaauauuguuuucugauccuauauuuccauucauuugggugguuuuaaaaguuuuucaaagcagugcuuauuaguuguuuucauuguaugugucuuguacagaguuuguuaaauuuaugugguagccaguaggauucaauuauuaaagaaaacucaaaagauccaaaaugacaaugucuagaaaucgaugaccugauguaggaaaaggaugcaauacagcaacaggauuagagcauuaaagauaugcgucguaggcaaaggcuuccuaauagcaaggggucuagagggacugagcaugaccucuaauuacucucucuguuggccaugaggcacccuuuuucucucaggugacacuccacugauaugugcacagaaccugggagugcaaaauggaaucaaagcugggacucauuauauccuguugaccaaauaggcuuauucuuucacauaaugagucccagugguacagcccucugguagauuucaaugagaccagaugcaaaucagcaaaucucacuguuaucaguaaacauuaccgacaagcugguacaaacugcccuaaaacuugccuuggauguauuaguacaaagcaacacuauuaaggaguauauuucaugacuugacccaggggucuagugccaaguagguacaccuuuaccucaacaaaaacauuucagguaaauuucaggcgugcuggaauuaacucauauuuuucauccuauuauaaaugguguuuuaaaaaacauauauuuccaacugugaauugcuuuuauauggaaauaaaaacaugauuuguguguacugaccuuguaucuugugaccuauuuugaaauauacaauacauucuuguuaauuauaguaacccuacucugcuaucaaacauuagaacuuacuucuucuaacuguauguuugaguuauuccuucuaucuaaccguauguuuguacccauuaaccaaccucucuuuaucucccucucuccucacagacacccuucccagcugucucugguaccuaucauucuauuuuuuaccuccaugagauaaauguuuuuuuuuuuuuacucccaugugagugagaacaugggauauuugucuuucugugccuaguuuaugccacuuaacauaaugaccuccaguuccauccacguuucugcaaaugacaugauuucauuuuuuuaaugacugaauaguacuaauaauuccauuguguauagcacauauucuucauccauucaucccuugauggauacuuagauugauuccauaucucugcuauugugaauagugcuugcugcaauaaacacuggagugcacacuucccuuugauaaacuaauugcuuuuucuuuggaugaauaccuacuagugggauugcuggaucauauggcaguucuauuuuuaguuuuuuuuuuugagagaucuccauacuaguuuuaguagcuuuuuuguagguuuuuaaagaauuuucacauugacaguuauguaaucuuugaauaaggauacuuuuuugucauccuuaccaaucucuaugccuuuuguuucuuuuucuugcccuauugcacuaaaaccucuaauacaauguugacuagaaauagcaacagccuuuuuuucucaucuuagagauaaaguauugaguaucucaguguuacauaggauguuaccucuagaguuuuggagguguccuuuaucaaguugaauaaguuccauuuccuucuguucaguuuuuuuuuuuaaucacaaaugggucuugaauuuugucaaaugccuuuuuuacauuauuaagacaauccuuuauuuuugguggggaguuuguuaacgugguuaaugguguuuauugguuuuugaauguuaaaccaacuuuucuuuccuggcauguaccccucuugaccaugagucuuuuuauauguagcuugguucacuuugcagauauuuuaaggacuucuacaccuauguuugcgaaaccuguuccccuauaguuuuuucucucucucucucuuuuuuuuuuuugagacaggagcucacucuguugcccaggcuggagugcaguggcaccauuucggcucaccuguaaccuccgccucccggguucaagugauucuccugccuuagccuccccaauagcugggauuacaggcaugugccacugugccuggcuaauuuuuguauuuuuaguagaggugggguuucaccauguuggucaggcuggucuugaacuccuggccucaugugauccgcacaccuuggccugccaaagugcuaggauuuacaggugugagccaccacaccuggccuaguuuucucuuuuuuuauaaugucuuuuucugguuuuguucuugguaauguuugacucagaaugauuugggagguauuucugcuucuguguuuuacaaaaguuaguguagcagcauuuuuuuuucuccaaauugucugggccuggaaauuuuuuuuuuuuuuuuuaugggaggguuuuuauuuuuauuuuauuauacuuuaaguucuaggguacaugugcacaacaugcacauauguauacaugugccauauuguguguacauauguauauguacauauguaugcaugugccauguuggugugcugcacccuuuaacucaucauuuacauuagguauauuuccuaaugcuaucucuccccccuccccccaccccacaacaggccccagggugugauguugcccacccuguguccaaguguucucauuguucaguucccaccuaugagugagaacaugaaguguuugguuuucugucuuugcaauaguuugcucagaaugauggcuuccagcuucauccaugucccuacaaaggacaugaacucauccuuuuuuauggcugcauaguauuccaugguguauaugugccacauuuucuuaauccagucucucauugauggacauuuggguugguuccaagucuuugcuauugugaauagugccucaauaaacacguguggugcaugugucuuuauaguagcaugauuuauaauccuuuggguauauacccaguaaugggauggcugggucaaaugguaauucuaguucuagauccuugaggaaucuccacacugucuuccacaauggucgaacuaguuuacacuugugggaggguuuuuaaauaacaaauugauuuuuuuuucuaauaaguauagaaguguucaguuucuuuuuaaacaacauucagcaguuuauaccuuucaauaaauuuguucauuccaucuaaaucaccaaauuuguugauaggaagcuguuaauaguauuucuuuaauguuccuuuaaugccuguaugauccguugugauucucucucucucuuucucucucucucacacuugugauauugcuaauugucuuuguugucuuucuuccugauucaggagaaaagacaucaguuuuacugacguuucauagagccaauuguggguucauugguuuucuguguuacauuuuuguuccgugaugacaaaacucuuguguucuaguugauuguauacuucuguuuuauccuuucaucuuccagcaaacauaugcuuuuggggacagauuuauuauuuuucuuccacugagucuugaauuaaauuguacucaguaaugguggaugaaggucuuggaaacugccauaaguugauuuauucuuaugucuaucacaaauagaauucgauagcuaaaaugacauagaaagauuuuuauuaucugggaugacagacuugccuuuuuaaucuaaaaacugucuuuauaauguuguauaaauauuugaacuuuauucacauucuuaauauacuugaaauuaauucuggucucauuuccuuugguauguaaagagagaauagccuuuuuaaugcaugcuauuguuugaauguguccuccaaaguuauuguguuggaaacuugaucccugauguggagggagggguuggaggugggaccuuuaagagguguuucagcgaugggggcacugccgucaugaauggauuaaugcuacuguugugugaguggguuuccuaaaaaaggacaaguuuggccucuucuugcucucuguuucguaugugugaugccuuucacgguguuauaaugcagcaagaaggcccucaucagauguuggcaccuugaucuuguacuucccagucucuggaagugugaggaaauaaacuucuguuguuguuguuguucuuauucuucucccucuucuaauuuuuuuuuuuuuuagacaagaucuugcucugucgccaggcuggagugcaguggcacgaucuuggcucacugcagccucugccuccuggguugaagcaauucuccugccucagccuccugaguagcugagacuacaggugcaugccagcaugcccagcuaauuuuuguauuuuuaguagagacgagguuucaccauguuggccaggauggucuucaucucuugaccucaugauccgucugccucggccucccaaaguguugggauuacaggcgugagccaccgcgcccagccuaaacuuuuguucuuuauacauuagucugugguauucaauuacggcagcgcaaaauggaguaaaacaauauuugcaucugauuuagggcauucuuuuaaccuuacugcaacucuuccucccaagcugcaguagagaugaaugcaaaggaauccacacuaagauauaacaaaauagauaaaugauuuauauuacaaaaagaccgacuccaggagauagagcucuauuuaguaaagagggcuuaccuaguacauucagcauaugaccagaguuauaauuucauuuacaaaucuuucagaauugcaucuaucauauaauuuguaaggagagccaugucuuuaucacagcagcuaaauuuccagggaguguaaauacuucuauugugcuuggccaacagcaaguaacacaacagugguuauuugcugaccuuuucaaauguuucccagaugaggaaagguauaaauaaauaaaacaauucuuugauuucugacgaauggccuggggacugaagagcaguaagcugggccucauucugcaccuuguacaguuuguugccccuuuauuugcuuguucagccauuccucaguaaugaucccaagggagcagagugcaggcugcauccuuccucuuacccaugguagaaaccgcagucuccucuucgaacucaaacuuuuaauucucuuguuucuuuccauuuuucuaaaacugucacuugacucccuauuuucugcucucacuuccauuuauuuucauauauugcguacacaguaaucuuccuuaaucagcauuuugauuguaucauuuugccccuaaacguucaauacuuacagaagaaaggacucuaaaugccuagucuucaauaaacauucuuuugguuuuaucuucuuggggcaugugcucauccucaguuauucaccauuucggucucaaugaauuuuucugaucuuuucuguuaaguuuuguaaaacacauguaauauaaaauuuaccuucuuaaccaucuuuaaguguaugauucuauagguaaauauauucauauuguuguacaaccaaucuccagaaauuuuucgucuugcaaaacugcaacucuauaccuuuuaaacaguaacucuguaauuccugguuuucuccucccaucaguccuuggcagccaccauucugcuuucuguuucuaugaauuuggcuacucuagauaccacauauaaaauggaaugguacaguauuugucuuuuugugacuggcuuguuucacuuagcaucguguucucccucuuguagcauguaucagaauuucuucccuuuuuaagguugaauaucaaaucuuguacgagcgguuuuguuuguuuuuauuuuuuguuuuuaagggaagaggguugaggauguuaguguauuuggugucugagaaggauuacuacagguugcagggugggguaggggagaaaagauuuuggggcuucuuaaguuuuaacuuugcauagugauucaguaacuuauuuuuggaaucuuuuuuuuuuccuuuacagucuuugugguaucuaucuuuucauugaaagccuguggaaacuguaauguaaauauuguuugaaauccugauaacccagacaauaugaaaaauguaucuuuuuggaguucuguuaauuauugauagaaaugugaaugacaaaguuuacuuugauuauuuaaugaaacuuuuuuaauguaauaaaguucaggcucuaauuuggauagaauauuuauuuuucuauuuacugagugguagauaugauagucugcugaaaggguuaggucuuggcuuuugugaucucaaccauccaaagaaguucuuuaggagaacucugaucacuucacaucuacaaaguguucuccuuuuuccuaaaugugaauuccgaaguccuuagcaugcuuuaugaucugauucaaaacuaaauuucuuauucucccuuucaccagauucugguucacucgucacucacuuucaccccucccugcauccccaucaaaugacugagaauuuuccagauguggcauuuauauuuuggccuuguccuaacauaacaaacaaucucucuuccugugauaccauauucuuguuucuuuguaucgaguggaauuucacuaguugauugcagccuuugucugccaggguucuucaucugaaccucacucagacaaugauuauuugagugacuguuuucuuaguuuucccaagguugguacaugaauguuaacauucuagauguggaagaaguuaauucaugaccuucaaugguugcuuuagggcauuaaguguucauuuucuugcagacuucccauugagaaaggucuagucugaguuuguuuccuucuuuugaccuugcgcagauuucauccuccucuggaauguuuguuuuauuguuauuacuuguuuguauuaucagcuuuuccaccagacugggcaucuggagaacuuugucuuauuuauucuuacaucccaggauucagcaccaugccugaaacagaguugauguucaguaaaucuuaguggaauagauuauguugacuuccuaaaacuaguucagcaugacauaguucuaguuguucauuucccuuuuuuuguuguuguuaagagauggagucugucucucucuguuacccaggcugaagcgcaguggcaccaucauagcucacugcagccuccaaagcucacuauagccuccaauuccugggcuuaagugauucucccacuucagccucccgagcagcugggauuacaggcaugcgcgccacugcucccagcuucaauuccuuuccuuacuuauuuuuacauuuauguucuuccuuaaaaugaacaucuugaccgagcgcgguggcucacucuuguaaucccagcacuuugggaggccgagacaggcggaucacgaggucaggagauugagaccauggugaaacccugucuuuacuaaaaauacaaaaaaaaaaaaaaaaaaaauuagccaggcaugguggcgggugccuguagucccagcuacuugggaggcugagucaggagaauggcaucaacccgggaggcagagcuugcagugagccgagaucgcgccacugcucuccagccugggcgacagagcgagacucuuucaaaaaaaaaaaaaaaaaaaagaacaucuuaacauauacugccuuguucuccauuuggcuaugaaucuaucacacuccagcacuuguuucuuguuaccugugugggugcuuuaccugccuagaauagaguuaaagcuccuaaugacaaccuauugguaugaacuuuuggaaccuccagugccacauuuauaagaaaucaaaaucuuguugaucaauugacaaucaauaugggaaacuauuguuucccaucaauaugugagauuaugcuuuugcuuaauuuuauugggcacaaauauuguugaacaauuuauuugaauaguauguuguugccuuuauagauauccauuuccacuuucuuaguugaugauuuuucacucuacauuaugauuuucacuuauccuuugaguguuugaucuacaaaugauugcuugcccaggugaugaagaauuuucuuguauuccuaucuuuccaguauguagagauggaaaugcauauugguuguuguuuauuaucugccauuuugucaaguauuaauauaugcuuaaauucacaaagagguaacucuuugaguuggcagaaccagacuacucagauacaauugccucauucucagacucgggaagacgaggauagugcaucuuguccucauagaagaggcccuguaguuagaaugugugcuuuggaguguuagaauggguauucugaaugcaagaauaugauuguuucaguuuugucaagaaaaugcuuaacuggacuguguauucuaacaauauuagaauauaacaaaaaaaucuaucauuauauguccuuaccugccuaaccugugacgagaaaugacagguuugauauuuuguaaacugccauagaaucagcuaguaguuuucuauucuguuggcuugucuuucuccccuccuuaaugcuugagauaaguguacuuuuugaguauguuuuggaaacguguuuucaaaguucucaacuuaugaaauguuaaacuauuccaagguuguaaguagcuugucauguguaaagaaaagucugcaagaugagaggucagaagaccugugaauccugacacuacacuaugugcuauauccugaucauaagcaaauuuccuaaccucuuacagcccccaauuccuuccuacuuucuuuucaccacuuuauaaugcaucuauccccagaaagcaaugaccccuuccccuguucuucauaaagaauuugaggaugguuuuaugugcuagacacugugcuaaauaaaaacuaguaaauaguaaaguuagaauucaaauccagguuuguuuuuuuuuuaaacaccgaaaucuaugcucuuaaccaauguauauacuaucagcuacuaacugucuuucaccacaauuaaugguagaaugauuaucuugaguaucuucuuuagggauaacuauuaauucaaaggaagcuccuuuuuaaaauacaacauuggaaaaagaaaaauauagaaauucucaacauagcacuguucuaguaagccuauuuguaauuuuuuuuaaaaaaguggggggagggagaaggaaggggagagaaagugagugggguguguguguguguguguguguguguuuguguguaugucuuguggcugaucagguggaacccaucacuacuuuguccagaaaacucaggaguauguguggguaggucuggaacaggauguacagguugacuaaacguuauccaauaugcaugggaccagaagugcuuuggguuuuggauuuuuuuuuauuuuggaauauuugcauuauauuuaccaguucagcauccaaaauccaaaaaucugaaaucugaaaugcaucagugagcauuuccuucaaguaucaugcagauuuuggagacuuuuggauuugggauuugggaugcuuaaccuucaauagugaguuuauguaacuuaaaauguacuaaauccaacaaaaacugacugaaaauaugucaggugguuggaauuuuucuuugaagcaaucauuuauguuuuuauuagucuuuuguuuaugcauaagaaaggugaggcgucuaaugucuuugacaaaauuuaugguugcaauagagcagccuauuauuuucccucagauacgugccauuucucucuucugguucuaucauguuuacaauaaguugcuguucuuuuguaauuuucugaaacuuuuuucucugagacuguguuaucuaaaacaaacccuaccaaaacaaaaaaguuucccagagugaguuguuuccauugcauggaaaaagacagguguguacucuuauuuuuuucugugugcuuugugaaaauccccccucccuccuauuaacauagugaauuuuugaaugagaauguccuaaugcaugauaucuguuucaugaauuuaucuuuguagauuugaccaaaaccaauuuuauauguggaaaguaaauuuaauuauaccaauccccuagacuuggguguagauacaacucuuaagaacuaucaguccaagcaaucuauaaaacuaaauguuugcagccaccauuuucuaaauccaauguaggaaaaaggaaaaagcauaguuuccagagaaggcaauuggaauugaauguauccugcagaccuuauacucuacgauuacacauacaugcugucuccagcagcuuuuguuuugcuuuuggcugcuuauuucacaguuucuuuuuuucuuacuuuucaaauuaaugauucuuugccagcagcauucuugcaauauaucagacuugauucaauauugcaagcucucugcuaccuuucuuacucggucauuuccacccaggugaauaauauuaccuaguagcaauuuuuuuuuuuuuuuaaagaaccuuggaaccuuuaagaaucuuuguuuuucaggccagccacggcggcucacgccuguaauccaagcacuuugggaggccgaggugggcggaucaccugcggucgugaguuugagaccagccugaccaacacggagaaaccccaucucuacuaaaaauaaaaaaauuagccgagcgugauggcacaugccuguaaucccagcuacuccggaggcucaggcaggagaauugcuugaacccaggaggcagagguugcggugagcugagaucacaccauugcccucuagccugggcaacaagagcgaaaaaaaaaaaaaaaaaaaagaaaaaaaucuuuguuuuuccugaucuuugcuguuuuucuucauuauaucucugagacauacauauguaaaucuaauuaaucuauugaauucaugugaaauauacuuaaaguguaauuuuauguccuuuuuuuagauaaguaaauuucagauacuacuuuuagcagaacacauuuuuuaauguguugguuauaaagugaucuguagguaaaggaaucugaaaaagcaaaugcucauguguuagaaaugaguaccuuuaguugccucuggacuguuuucuuuuugcuauccuaugaggguuacaugaaacaaucccauuccuuugacauuuccucacuuuuggguucucucaucccuuuuagaguaaggcacugcugauuaggccuguuuccagggcaauuucuugcugcucucuuauuuuuaguuuugcuuguuuuguuaucauagguuugaaauguaaguaagcggcucagaaugaccugguucuuguagcuaauucaguaagcauuuauugagggcauuguacaucaguccaacaaagaaagaacacaucaaacuagagagcaguuccaagucaacuuacugguaaccuguuguauaaaaaguuacuacaaggccaggcauguuggcuggugccuguaauacuagcacuuugagaggccgaggagggaggauugcuugagcguaggggcuugcagucagccuggucaacauauugaaaccccaucuguacaaaacaauaaaaaaaauuugccagguaugaugguguguguguguggucccacuuaguuugggaggcugaggugagaugaucucuugagcuugggagguugaggcugcauugagccgauugcacaacugcauuccagccugggugacagagugagacccugucucaaaaaaaaaaaaaaaaaaaacccuccaaaagaaguugccacaaaauuuucaacugaaaacacguguuuauuaucucuuguuuucuuuggaucagaagucugggcacagcuuagcugggaucucugcucagggucucauaaggcugcaauuaaguguuggccaguuugcuuucccaucuaggagcuugacuggagcagaauccacuuucaagcucauucauauuauuggcagaaugcauuucuuuugacagcuguaugaccgaagccuucacuuuuugcuggcuguuggcuggaggccaccuccuauggacuaaauggccccugcaccaauucuuauguugaagcccuaaucuucaauaugauggaauguggaagaggggccuuuaggagguauuauauauuaaucagcuuuccauauaauguugcuuaaucaugggagugacaucuagucaucaugaccauauucuguuuauuagaaaauaguuauaagugcugcccacacugaggcugaggggauuacacaagggcauuagcacaaggaggcaggauccugggggcugggcaucaccucagggucauucucccacaggcaagauggaaauaaauggaugguaaauaaaccucaagugauuacaaaugguauauuuuauugcuuauauauuguguucaugccaggacuagauuaaacaguauguugcagcaugacugcuauuucgacuggacuguguacaugccaagaaugaggucuaucucaugagacuaagcaguuucggugcccugccacucugugaggcagaaccacauauguuugagccuccacacuggaagccagaacuuucuucaccacuauucauuaagauuuucauaaaauuauucauauaguugcuuuuguuuaaaguagcaagugguacaaagauaaauuucugguuagaauaaaagucucaauaaaagaauaagcauauacagaagauaauuauuuuuucagauuuguauguuauuagcaacaucuuauauuuucagauuucucaauaaguuuaacuucaauuuguuaagacuguuagcuuauuuccauugaacauuuucauuuuuuauuuuuccuccugcuuuuaauacuaggccuuguguuacauugcugaguugauaucacaaauuuaaugaccuagaggagugaucuuuuuggaucacuuuuuggauauagguuaaaaucagagauaacaaauuucuuggggucuugcuucuacauccuucauuuguugaugucaguaugaacaacaauugauagaugcuuuaauuuuaaagauuucuggguuaaauuuacuuauauucuugaaauaaauguacuuauuuaauaaugaaagaagaaaaacuuugauacucagauauuuuuugaauguuaaguuuuuauaauaaacuauaaucuuucuaaaaauuguuuacacauuuuaaacuuuuuuuaaaauuuauuuuauuuuauuuuuuuugagauggaguuucgcucuuguugccuaggcuagagugcaauggcaugaucucggcucacugcaaccuacgccuccuggguucaagcauuucuccugccucagccuccugaguagcuggaauuacaggcguccaccaccacgcccggcuaguuuuuuuuauuuuuaguagagacggggucucuccauguuggcuaggcuggucucgaacuccuggccucaggugaucccuccgccuuggccucccagagugcugggauuauaggcgugagccaccgugccuggccuaaacuuuucuauuaagagcaauaaaaacaacaaaaagugggauggaaggggcuuuaacagauacgucuuuucccuuagaaguauguuugauacugugauagagacaugagagugugguguguauggcgaacuuuaugauacucuguuugguauguaggauauccauacaaucguucagguagugaacgacauugagcuuuuauuaugugccagacccucugcuauagagccagagaaugacaguaauccauacaguagucaucaaggccauguuagcugcagagccacaaauaguaaacaaguaaguaaauuagguaaaucacaguacagugagcacugugaaggaaauaagcagugugcuguaacuaagaaaaccgugguggggaggauccuuuaaaugugguggccagcaagggccucucucagagggcgcguuggaucugaggccugaagacugggaaggaaccagcugaagacuagggaggagcuagccaucuaagagguggggaagaauucuaaauagaggggggacugugugaaggccuuacagugggagagaaauugguaugaucuagcaauagaaggccgauaugaagagauuagagacagugaugagugguacaagaugagguuggagagguaagcaguggucaggcuaugugccuaugauaaggaauuuguguuuuauucuaauuugggaagccauugaaggauucugaacagguuaaagaugugaucuuggucuguuuacccuggcugcuguuggggauaagagaagcagauguccuagguuaggcaagcaauagcuuggacuggggugcuggauauuguggauguaacagaaauauauuucugagauagaauugauaggauuuccuaaugaauuagagauagaugaugagggaaagagaggaauccaguaugccuccuaaguuuuguaccugagccugggaauuaaagauuuguagaguuuaguggaagucauugaaguggaaaagguuggcugggggcaaaccucaugaagaguuuggguuuuauugcuuagugacaggcaaacauaagaaaggauguuauggguucaaauuuauauuuuaaacugugacugguagcaaugucaagccaggugagagagacucgaggaagagaaaccaguuuagacaguacugcaguacucuuuuuguauugguuaagaaggauugauuugagacugaugcuggggguggguugugaggggaaguuuugagagauaagaaaaugaauugacuagauguggugacaaugccucacgugugauagaugucuaauaaauaugugaaugaaaguagcagacuguggugaacagaaaaaucauaucaggauauuuguggagaagauaguguguuccauuuuuugguaagguugacaugccuucuaggccucuaggugaaaaugcuugguaggcaccuggacuuuucugggucuggaacacuagagaguguuugggauuugagagucaucuguguagguaauaggugaggucauauaaaaauaucuucuacuaaaguagaauguaggacgagaaggcuggaaauaguaccuucugaaauacaaaauacaggguuuucaguaggaauaguaugaaggaaaagagauggauccauaguuacuggcaagguggaagguaaauuagaaaagugucacguucugaaaaccccauggaugaagcauugaggcacagugcgaagcuguagauacgucagguaacacaguuucacucacaaauagccuuaugauguauccgcaugugugugaguauggugaaaggcuaauuucauagagucaugagaagaaauuuuaaucaguuugagugagugaggggagaaaacuauuuuuacaaaacgcuuaguuaaaaugggaaggagaaagcauagcaagagaaauguuucaaugaugggaauuugcggaguuuuuuuuacaaauuuuuuuuccaguaacuauuguugaaaaccauguguugggggauacuuugagaauguaauauguagacuaccuguauaauuugaccucuaagucaaaaaaugcugagcaguuuaggauugauuuuuuuuggggguggggggaaauauuggaugauaguagcuuuuauacauuuauuuauggauuuguuuauguuagaauaauaccuacuuuuaggaugauuagacauaguuugggcuaccagaucagagcaauuuuaaguaccauaaagauguuggccuuugagauccuuuagccacauuguagaaauaggggugaaauuuccugucgugggaguauguaaauccaguuuugcaaaccagaaaauaagugaucaguaguccuuaagguuguuuccaucuuuguuugauaucccagugauaauguacuauuuggcaaagcaacaggcuacauuuugaaaaagauuuacucaucuacccagccagccauccugucagccaugcucaugucucucagcagcaaaggauuugagguggcccaccuuuaaaaaaaaaaguaacaaaauggcaaaaaugugaaaagugaaaaucugguauagggaaaauauauuuuauugaaugugaaggcaagggaaagcauguaugcacacacaaagaacguccaugugcuugcaauuagggcauguacguaguuuuuauaauugaacauaguauuuagaaguuugucuguaguauugaugucuauauugaaaaggaaugcaaagguuuugacuucauucuaacuguaauaguggaaaauaacuuuuuuuuuuucaggaaaugcuaguuuuuacuagcacugaucuuaaaauaauuauuuggggcaacuuugagugauauauugguugaucuauuaaaacaauggagaauacaaacucuuauauaaccauuaacacccgcuucaauuguccaagcauucacucaaacauuuaguaggccacuguacugacucaguagaguaguggggaucagaaaccguaucgcaguggauugagaggugaauaagauguuaaaaugcgagacauuuuggguagacuuucagagguaguuuggcuuggaugauaagguaauaaagggaaugugguguuagggacuccgcccccuuccuccauguguguugguugacuuuuugagcauacguauccuuacagugaaaacaggaaacagagaacaagcugcucuguaaagcguuucugcaagugugaaacacucccaauuucaguggcaucaucuuuggguaagaaagagaagggaaggaacaaaauuaaaggauaggagugaauaccaauaaaggugaagguaagaauggaagaguggagucugggggagcuaucucucaauuugcuugauucauucagaaaauaucgagcuaccugcucauaccaggccguauguaagggcuggagacacagacgugaugaagucugccuucauggaacucacauucuaaugcauguauccuccacaguauuaugagccacuggauagcaguucuuauguagcagugucugguauggugcuuggcauacauaguagucauccaaaaaaugaauuaacaaaucucuuuugcaucuguguguucuacccuuuuggcuuagucucaucuuugguauagcaggcaugucaaaaauugauagaguuuuauacaccaauaaugaacuuugaagaagcgguaauaaacauguuuaaaaaagcuaccaucaacauuauccugcaacccuucuuuuauaugugguuacuguuagagguuuuugcagcucagaauauauuguuucuuaggucauucauaaauguuugaguguucuucauguggaaaguacuugucugggagcgugaguuaaguaaggccgaguuccaucugaauagauggacaauuucacuacaaguauaauauaauaaguguucaaaauuguaugggcauggagaaggagauaguuaggacugguuauuuguuuuccuuccuaaucgauaaacaucuguuguauuuguaaugcaguggaacuugcaaauuguguuagccugaacucugggccccaggggaggggcggguaaagaugauuaguuuuuacaguauuccuuucgaaccuauuggguuuuuuuuaauuagguguuauuugaucuuauuauguuucaugagagcagugaugacaaucuguguggagaagaauaggagaugcugcacccaauuguauuuauagauuauaaauuugguuuggaggacuagggugugugugugugagagagagaaagaugcggggaagagguugacaaguagugacaguguugagaguggugcgaaauuuauuuacaaccuacugauuggguucacauuucuaaaaugagguugcuggauuaaaucgacaagcuucauccaaaguauaaauguuuauguuucaacggaaccugugguuugcuucggauuagucccccaagucagugauaagugcaugugugcacacacaaacacacacacaacuagaaauccugggaauuuuaacuaucuuuuucuccaaaaaaacccagaaaacucguugaacauaauguuauaaccuuagagagaguuguuuaaaagugagcacccagcauguugccuuuuuggugaguaggaaagaaucuuccaaacucaccaccaacccguuucgcaccuccccuagauacacaccacacaaucaccauucuucuuugcuauauacuuuuucucauaguacuuaaacauucuuaucauuuuuccuugucuaucuccaguggaauauaaacucuccaagggagauguuuguuuuguuuaccuuccuuagugaucccuguaggagaucacuagauucuguugaaucaaucauagcuggccacuugauacacugugugaguauauauugacuaucauuuuuuacucagcaguguacccaguacaguguguguguauacuggggaugacuuuauuggcuuuggcuguauauacauucaaucaucaccuuauggagauaaaugguauguauaaaaauuaggaaaugugacaagaccuguaaaguuaagggcuaaauuauaugguaggaauugguccaaggucagcauauuggaaugggcaaaaaauggcuucaugaaauaggugaaacuugaacuagacuucuaaaaggaucauggggcacagguaaggaaggauacuccaggaaaacagccuucaugauaccuccucucugaacuuucugucaucuuaauuccaucucucaggauuuauuuuugaaaaggaaacaaauuaaaaaguuauucaccauccucugccaugaucuggcauauagcacauaauuaaauauuauuuuuuaauguaacuauuuguauaauaucuuuuuuucaaaaaaaaucagaaaacuuguugaacauaauguuauaaccuuagacagauuuguuuaaaaguggucauccaacaugcuugccuuuucacggaguaggaaagaaucuuccaaacucugacuguggcucuauguccaguuauauuuugucauuaacugccuaccaguuucccauugcuuaauacucuagaaaugacaagugauucuauugaauuuugguuaguugggucaaauagaucaaaggacaauuauaaaagggaaacacaggaaaggggaauuaauuauaaauaugggggggggaagagagcugaauaauuaggcaugauaggcauuaauuauuguuagacauuuguuauauguauugcaguuauacuuauguggaagaucuugaucuuuuuuuguuaauguucacuugaauuuuuuuuauccugguacaguuagauauaagcaaguuacuguguuccugauuuucuucuaggaaaaguauugauaacuuugcuuuugauagccugcaaccagucugcucauuaauuuccauauagcuguuguuagagacuuugcccagcaaacuaaaugcuauuuguggaauagacaacaaaaucaauaacuaagacauuuuuggaaaaucuaguuaacuucuuggauuuguuaaacaaauccugaauacacugaauacuaugccuuugaaauaagcuuaauuuuugccacacagcaccagugaaucuugcuacaauugauauauguaguaaguuaauuaacugccuuuguuuucaguugacuuuuuucguucugaauuuuuuuuaaugguauuauaucucucaaaaacguacaauugaaggagaguauuaguauuucauagauuucugaucaaacaauuagauaugucaccucucugccugcacuaauuuauaaauauauuuaagcuauaauaguaaacacugaauugcaauuuuguacuucuuagauauuauuacucuuuaucaacuuaugcauguucuucuguaacuguugacuugauugauuauagcaugugcuaaaagauguaaaauggagauuucugaaauuguaauaauaaaaaagccauaaaaaaaugccaucagcuggcugcgguggcucaugccuguaaucccagcucuuugggaggcugagguggguggaucacgugaaguccagaguuugagaccagccuggccaacauggugaaaccccguuuuuacugaaacuacaagaauuagccgggcaugguggcacaugucuguaaucccagcuacucaggaggcugaggcaggagagucucuugaacccaguagguggagguugcagugagcagagauggugccacugcacuccagccuggaugacagagugacuccaucuuaaaaaaaaaaaaaagaacaaacauuuacuuuuaugaacagauuuguaccaaguuguuccuaaauugguacagaauucaugaugcauguuuuugaaaacagaaacaaauacuauuuguacuuucuuucugauguugaaaaaauuuaagagcacauauuucuuuaagaaaaauaccuauagaauaaauuccuagaagugaaauaacuaagucaaaggguacguaaauuuugaauuucaguagauauuguaaauugcacuaauucacauuucuacucauaauaucugaugccacuuuuucugcaaacacagcaucuuuucaaauacuuuaucuuugcugguuaggaaggaauucguaucuuagugaaguuuaccuuuacaugucuuauuuuaugagugagcuauuuauauuggcucuucugggaacuguccaauugggcugaugaucuuaauuuucuuacucuuuuuauucacucucucuauugggaaaauuuaucuuuugcuuccaaccugaugacaugcaaauaacuugauuuuguuuuguuugucuuuuguuuuucagauugucauuuguuuugggucauauuuuuaaaccuuuuauauuggugaauuugccaguuuugucuuuuauggguucuaaauuucauguuaaaguugaacagggccuucacuacucuaauguuauaaaagaauaaacccugggagaauucuaguacuuuuaugguuuaauauuuugcgucuaagcuuuugauucauuuggaauucuguugcaagaugugaaguguggauccagcuuuauuuuguucuauauaacuacccaauuauuccaauauugcucauuagucaaucuuuucuacugauuuaaccugucaccuuuaucugaaaaccuuauguauuuugggucuguuuuuggucuuucuguuucauugaucuguauauguuuguuuauaauguuuaaauauauuagaguguuacuuauuauuucuugucagaguuuucugaaauucugaacuuaaacuguuuuuauguuuauuucuugacuuggagauaucugguggugucaauuugggcaauccacuguaaggguuuauuuuauucuggaauuuuuuugucuccuucucccuauccuuuaccuuccacccaaagcuuuauuaggaaguauaggguaauauguauuccagaaagguuacauuucucuaguuacucagauggcauagacauaggcuaagagaugguaggucuuuguauuguaaaugaaacauggccuugucuaguuuuaauuuuuuagauaaagauuauuugcagucuaaagggugaauuuuucuuccccuuucucagucucuauuuguaaccaugccauuuuuuucauuuuuaauuaacauaauuugugaaauguugauuuuugcuuuagguccuaaaucaaaugugauuauuaguuuauagcuuuacaacguaauaagccccagguguagggaauucacucucagcucugaucuccagcaguuuuggaugacaagccaucacaccacuaucuguaccuuuuuuaugcaucauagauuaccauaggagacugaaugcaauaaaaauguaaaaugcuuuguauaaaaaugaauauagcaucagagauuuccugcuucauacaaucuugagcuuaaaaucuugaaucuuagaguaacaaaaaaaaaccucucaaacuuuuggaaugacucuaucuucaaauaucacuuuaaaaagaaaaaugauccuucguaauuaaguuaaugaucauuagggggaagauuauaauacaucaauauauuuguuauaggaauaagugaaaucagcuaauauuuaucugaauauccacaauuuacccauguuuagugccauugauuaaauaaucuagugaauuauaaaucccaagaaacugacaguuuaaugauauagucucugggagcauagaugagggcucauugcccagcuuguuagagaugaggcagaaaagcggaaucaggaaagacuuauguuaucgacaucagagcuaaucuggaaguauaaguaggaauguucuuuauuuuaaaauuuuuaucagcaauucuuaucuuaugaauaauaaauguugccauucauuuacucuucugcugaaaauuugaaaaauaaauacauaacaaagaaaacaaaaaucaagcauauuccuguuauauacuuugauguaacauuaccuuuugguuuauauacuccugggucuuuuuucccuauguacacaaacauacagacuccuuuucccaauacauuuuaaguuacagagcagacaugauauuaugauuuguggccuuuuuuucuuuuuuuuuaaauuaucaauacuagggaaagcugucaagugaguaaauacagucaucccuuggcauaugcaggggguugguuccaaaucugugcacacucaaguucugcaguccagucagugcugagaaacugauguaagugaaagguugaccuucuguauacacagguuuuauauccugcagauuccguaugauuugguuugaaacaaucuguguauaaguggacccucaaaagucaaaaccauauuguucaagggucaacuguguacuuguauaaugucauaauuaagagcuuaaauuuaaugcuaucaugugucccauuuguauaaauggauauauaacauucuauucagagaacccuuauuaaaaugcuuuggauuucuuuugauuuuuuuucuaauaaacacagugauaagaauucuuuauaauccuuaaauuucuggaaaauguaaaaauugaugacuagauauucauucuaguauuuuaaaguaacccauuauauagcuaaauuuuagacucaauaacacuagauugaaaucuggaccuucaucaugaaagucagaggaugaggaagagaauuccuugaaugaguaacuuaaacaguuuucacugccucaccuuaaguuuucuuuugaaucuauucaggucagguuuuugucccugccaaucuguugaaacuuuucuugcuauggucuggaacaguucccauuuugcuaaacucaaggaugaacaucuuaacacuccuagcaacuuuuuuuuuuuuuggaauugcccucuucccuuagcuuuuggcaugccauacuauuccuggauuuguuccagcuuucacugguuguucuuucuugguugucuuugcugguuccuccuccuuuucccaucuuuaaaugaugggggaauacccccaaggcuuugccuuauauucuaaucuccaucuacguaugcucccuaggcaaauuuaguaagaccuuuucuuuaaaacucauaugcuaaugaauccaaauauauguccugagccuguucuacuauuguaaacuucuuuuaacuaguuguuuaauaucucuuggauauuuaauaccauuuauucagucacuucggacucagaccaagaacccgugaguuuucucuaaaucuuuuaucucccagaucuaccccuuuaaggagucuuguguacuucaaaauauauccagacucuaccacauuguucacuuacugcccuaauucaaacccucuaucuuguguguagaccaauaaaaauagccuuuuuuuuuuuuuuugagagggagucucucucuggcgcccaggcuggaguacaguggcacgaucuuggcucacugcaacgucugccucccagguucaagugauuuuccugccucagccucccaaguaguggagauuacaggugcccaccaccaggcccggcuaauuuuuguguuuuuuaguagagacagaguuucaccauguuggccaggcuggucuugaacuccugaccucaggugauccgcucucuuuggcuucccaaagugcugggauuacaggugugagccaccacacccggccaauaaaauaaccuucuaguugguuuucuuuuucacuuuccuugcuccuauuaaaucuucauagcaggcaacccccaccuuccaaaguaaacaagauuaugucauguaucuuggucaaaacuugcacaguaaaguccucacuuaacaucauaaauggauuacuggaaacuuugacuuuaagaaaaauggcauucuuuaugccuuaggaacugaacucuuguuuguaucaauuagccuauggcaaaauugguuuuguuauauaguaguuguuucacuuaaauuugcaguuuccaagaacuuaucaacauaaacaguguuaagugaggacuugcuguauucuuucuuucauauucaggguaaaaucuaccuccugacucuguccugugaggccuuacauaauccagaaucuucuugugugacuuuuucucuuauugccuuccacccugcucacucuaguccagucauccugaauuuuuuguuucuugaaaacaacaaacucauuuccauuuaugugccuuugcacuacuguuuucuccaccuauaacucuuuauguagaucauugcaugaguuccuccuucuuuucuuuuagaucuuugcaccuucuucagaaaggccuuuccuauuuuucuaaaauuguuaccuucugcccaguuacucccuagccccuuacucaccuuugucucuaacacuuaaaaacuccuugacauacgugcauauuugucuccucacuagaaugcaaacucuacuguaccccaggugccuagaauguuacuuacaguaugguagauagccaguguuuguugaauaaaugaccgagcuucuuuauucuuuguaguucguauuuuaucccuccuaauccuacaagaaauuugaaguaggcuuaaaaagugcuuuuaaauauauuaaaauagaaaacaggagggcaugcaaaguacagauagaauaggaaugacugaugggaaacuuaauaugcggcucauacaagguuuuacauaguucuuaaauguggaucaggcauuugccucugaagucuugacugugaaaacaaaaagaacaccuugucuauaaggagacaacaugcugcuacuuuggagaagcacagcuuuucuuauuucaacaacuguccugugaaacgcaaaauagugaauuuuauacagcaguguuuuaauaccugucuuuaaaguaaacugaagaaacaacgccacgauauagcucaaggaaagcaacucuguggaaacugauuagauauucacacacauuccuauuuccuccugucagcguucccugcccucaccaguggacaugcaugcuucugaguaagguagagcguauuacaacaccauuaucaaggugaaggucuuuucuagugacagaacagugagaggcaguuuguucauuauuccuaaaaugugaggcucauuccaaagcagguugaaaauuaacuguauagugugcuuuugucaaaugaggcuuccuggaguuucucaaauagcugaccauaguaacuauugugaucaggcuauucuuugguaguuuguggucuuuuuauaggaaguuuugacauuuagcaucuuagauuuggaauuagccaaauuaugggugaguuucauaacauaacuccaggaaucuuaauagaauaguagaguauuaauugcauuuaauagaaaauuuuagucaacucaaccuguuuacuucauuugauugaaguugaauguauucaaaauuaguugaagaaaaucuuuuauuaguaucauaauuaaguuauuuaauguuucauuuauuagugagucaacugaaucuuuuaaauuauuguacgguacaaauaaccaaagugcuuggagaagaaacagucuagaauaugcugugaaugguaccgguuaggaauaacauacuaacuuggaaaugaccacacugaaugccaaagauugauuuuauguuccaauguacccuuuuuuggggggacuuaucacuuuuagucuuguaucucagacauucuuuugguguacuagagaauauauuugggagauggauggcaauuauuuugcaucuuguuaguaucuguuuaagaaauucucaaaguuuaccauuguugguguaauuauucuauuuuccuaacuuaacguugaugguuugggguucuguuggugggaaaaguggcuuggcaguauggugcaauguuuuugcaacacuugagaggagauuguuuucauagaguuuuugcucuuccuuguuccuucccuucuugugacuuuguuuucaaauugccuuuuuuucaucacuguaacugucuuagcucuguacagcugcccuuuuccaugucuguuuuguuauauacaugcuaucuuuuggcccagaguuaucacugaagcuugucacagaacucuuauuaccuuuccuguuuuuucuccccagcuuuauuuuaccucuacuuguaauuacuauugucuuuuuccuagaguaacagaagaaaaugcaauuugucuuuacuuucaguaccagcauagcccucuugaggguaauauuagaacuugaagaaaacauuuagauuagcauuuugaccaauauaaauugccuauuucauuuggaaaugacacauuuuuucgaaaaaguaaaaacaguuuuccguugauauaauuauuuuuaaaauauacaagaaaaacaggaauaggugucccaguacaacauguuuuauuuagugaauuuucugucaaaggguuuguucaaguagaaaccauaugccuauuucuuuuuuucuuuuuuuuugagacggagucuuucucugucacccaggcuggagugcaauggugcaaucucagcucacuauaaccuccgccucccagguucaagcgauucuccugccucagccucccaaguagcugggauuacaggugccugccaccacgcccagcugaucuuuguauuuuuaguagagacgagguuucaccauguuggucaggcuggucucgaacuccugaccucaggugauccacccgccucggccucccaaagugcuggagauuacaggcaugagccaccgcgcccagccccauacgccuauuucugagggagauuguaggguccaacauuuagagaguagacuuaaucuuccuacaagcaauguuccuaaaguuuauuucaaucaguggaauuguggaggccugagaagaguacagcuucaaagcucaagaagauaaauuuugauguuugauaaaccugaguuuagagcaugcuucuguccuuuuuagcugaauaauuauuucaucaucuguaaaaugcaggcaguuccucaaaagggugguugugccgaguaaaugaaauauaaaacaucuagcgugguguuuggcacauggcaucuguuauuaacuacucuucacuaaauucugaaagguuuagauuugucagguaggucccaucuggauuggcacuugucaucagagauccagagaaauuccacaaugacauauggcauggauuaaggaauacacuuuguugggaaaagggaauauuuacaaagccaggaucagguaggggaaggaauugauuucucugucucccucuuauuccacauaggagguucucagaguuuugccagucugcuagacacagcauagauuuucauuccacuugagauaucccuuccguuacuauucucccuucuuuuagaauaaguggccggucaaauguaucaguguguaaucauacaaacuacuagggaaccagacauuauaguuguggaugccugcagucaucugagaaauuaagccgucaggcacguggagacuuugagguucaugggaaguuaggucugccuugcuaagggaggaagccaugguccugucagaaguugagcaugguuucagacucuuuugcugggaaagacgaugggaaugguuccagcucauggucuaggcugcccacagugacucccgguguuuucagacaggucugcuucucacaucacgcuuuauugccuagggccugugaaucaguuuucccaacaaauaagugucaaguuaaaugugaaauauguuuauuucuaugcuauuuaagcaaacugauaucagaauaaguaacaguagaaugcaugucagagucuuugaguguuacucucaaagaaaauugaucuugauuagcccaagcucaacuuaguuccacaaauaauuauugauuuguuuaagcgugauguaugugcuugcucaaggaauuagaagaugaguaugacaaagcucauucccucagggaguugaguguuucagagggaugaaguaaaagaagauuuuaaaacuacaaguagaguguaagaaguaucacgagaaacaucaacaaagggcugaggauagaaggugauaagucucaaguaucucaagauauucagcagugaaucuuaacauaaauuugcuuuuaggggaagaauuucaagcauauugauaggucuuaaauuuucuagucucucugggauaguaggaaggagaaugauuuuuaaaaaguugauuauguagcauggaguuuggggacuaguaaaaauuuuauugaaauuauuugggaauuguuuuacaguuguuuuuaguggagguuguauuucugaaaauauugcauuuuagugugaugauuuacuaaagaaguagcagggacuuauucuaagguaggagauagaaaaacuaauaaguaaaaaucugcuagcaacuuuaaauggcugucaaacuuuuuuuaaugauuaagugcuaaugggggcagauggaaauuguaaagcagugcagagcauugagguauagaguuuuuuucugucaguugcucuacuuuugaaagagaagaaauuagaggucaaauuuagucauuucuaugguccuuuuaugaacguaagaaagcgcuuuuuuaaaaaaaugugagaauuguuaaauaaucuuuauuugauauuacacauaaaccacccuaaaaugccuuucaguaaguaaaaggaaccauuuuagauaaaaggaaucuaauuagauuggcauaguuaaggccaaaaauauaaaguagacauugccaccuuaucuucaacucuugccuuuaagaggcaagugaacaugaaacacggaugaaucuugcuugguucugagacagugugaaggaauuucaccaguauuucaauauauucacauaaccaguuauauaaaucuaaaaauaaaaccaauuuccauuaaguuuuaagauggcauucaccaucuuugugaaaaguugaugaaaucgaaucauaucuuuagaaggaguaaacaguguuagcauuuacugaauuggaauugcuauuaaaauucaaaaaaacaaacauauucaucuaaccacaggccagucuuaguuuuaaaaucaggacugcccaacaaaauauucugucauucauugaugaucugaauucugguauaugagaucuauuaaauuaugguacacauaaaaaagucaugagacauuucuguuuuguaauaaauaaggcaguggccaguuauuacugaugaguagcguuuuugagauuagcuaucaagucugcccuuucugccuucuucuuaaugcuggcaaagaucauuuuuguuccagggauguucuucuugggagucuccaaauagugcaucaguguauccuuuccccaggugaugccuuuguucuuauuggugucuguguaagaguauccaacggccucaccugucuccugccuggagagacuauggagauuaggcccagucuugugcuggccucccuuuugcauuguguggcacugggcacacuucugaacaaaaaucuucuugccuuucucagcaacacccauauuuaauucucuuccaucacuggugcuacgaagguucccucucugaagcuggaugucccgcucuuuugaaaauuacacuucuaaaaaugaauuccuucaaggauucuuuucauuuuaaagagaacauuugcugucaauccacucuucucauuuuaugaggucucucagcauugcuuaggaaaauuaugauucacagaggaaggucuagcacuaagauguuuccauuggagauacuauuauauauugcuucucggcuauuuggcuaagaugaaauauaagauagauauggugucaagguaggagcacagacuagguuuuuggaggguuuggaguuccagcccugacuuugcugauacugucuaugugaucucgaaauugucucuugacuuugggagugaguaggugauguuucucuaggugauccuggaggguccuuuuacccuuccaaguucuguaauaauuccaguguuuuuuuaaaaucaccacuauauggcuuugcacaccacaguuuuacaaaugguauguauaagaauauccaauuuugaauaauauuggacaucauccuggcacauuuugucgaaacguaguacacauaggcuagccuuugacuuuucauuugguacuuucugcuuagcuaauauuuauauacaagguagaacuuggaaacuuuacugcacaugguaguuguaaacguagcuugguugugguagugaugcuuguuucacuuucuguuaacauacagcccauguauguauugggauuuaauaauguaagccauuauagaaaaaugucggauguaacagugaucuccucuugggcggcuaaguggacagcuuuaacaucucuuaaaugucuuaaaauauugugucaaaaaugguacaaaaaaugguaaccagguaccaaacccaguuugaauuuagcauauaucuuucuuccauuauuguaguucuuugugaaggcuuuaaaucauagagagauucucucucuaugcacaugcauguguguguuuuuguuugcuuguaaaaauuggugguucacugaauagcuaguguuauauggcauuuguuuguuuagacuuuaaucaugaaugaauuuacagaaacucugcuuuaagccgcacuaaccaggcugucaaguaauuugcuuuucuuauagguauuggagccaacuguggaauucucagucaaauguacaaugaaacaucuugaauguuauuuugaugcucucccauuuuguucaaacaaauucugauuaaaucuagcuacuggcacauucuugcugagucucugguaucacuuggaaggaagguaguagagguguggaucgcugagauacuccccuaagagaaguauaucauagugucguauuguuugaaauaguuucgugauuucugucccaggauuuuuuuuugaaacagggucuugcucugugucccaggcuggagugcaauggcgcaaucuuggcucacugcaaccucugccugccagguucaagcgauucuccugccucagccuccccaguagcugggauugcaggugcucaccaccacgcauggcuaauuuuugugucuuuaguagagaugggguuucacuauguuggccaggcucaucucgaacucgugaccucaagcgauccaccuaccuuggccucgcaaaguggcaugagccaccgcaccuguccugggacuuuuaacuuagcucauuaucaccuuguugccuccccuaugugaucaguuucccuuaacccuguuagccaaaugaccaugugacacaaguuaucuuuacuuuuaauguuacugcuuuuuauuuuuuauuuuuauuuuuuugcuauguagcauauaaaauuucugaguucuagaagaauuccaaaagcuguagagaugagaaauugauauagccaauuuggacacaaguuaaaaaugaaaucaauacugucauuuuuuuggaaaucuaaaaagagagggaaaaauguaucaggcaccguuucucuaaauugcuuccagcugcuugcuuccuaauauagaaauauuuauuaaaaguagcagguuaaaaauuggauuccuacagcaaaauaugagugguuucauaauuuuguuaaacagcaggaaauaacugagauuuuugucacuauaguggcuuuguuuuuuucgagggucaugguguagagcaaauacauauuucccagccaggcgaacagaacaguaaauggccugaacaauuuaaacaaaccaaggaaaauguccuaagguaguaaauagggaauuaugggauuuucccuuaacuauuguaacacuauaaauguucaaagagguagaaggaaccauuuaagacaauaaauaaaugaacaugaucauaaaacuuaguugggaaugaggcuuaaguaaggaaaauggcaugaaaagaaagucagauagggguugggugaagaacagaaauuuacauguuaucuagacuaauugcaggcacagugaaagauuuaaauaauuauuaggccaaaaugcuauaaagaggugucuuaaaauuaagaaacuuauguuaauucuaacaagaaauugaggaaaggaagacaaauauguuguagguguuggaaugagggcuugagggaaugcauaucuggaaaaugagggaaacaguggaggggaauagaaacuguguaggggauauauaugaaaguuguuuuucuuaagauauuuaauuaaggugacagguacgcaugcucgggaaguuaaaaagcaauuucuggaaaguguuccaaguuaaaccugaaggaggcaccagaaauccugaaggaggaauguagcaaucaaaaacauuguguagaauguucguauuggcaguaucaauagagguuuugccuuaugguccuccuuaaccagaaggaaguuugaacacagcugagaucacugcauaucuauguaguauuggucugggguggggaagaaacaagcaagacauaaucauccauucucauucauguucaccuauuaagaucacuuaaaaaugaaucaugguuauuucauaguaaauaguugucauuguugcucaauauaucauuguauucauugaccauuuucaucacauuauagauuaggauuacaauuuauaaacuacaaggaaaauaguagugcauggccuuauuaaucauacagaaaaaagauuaacauuuacugguaguuugugucuuaauauaauaaggacuaaucaagccuugacaaaugaguaacuuugauaggaaauguaggcagucaucugucggacuuuggaauaaauaugaauuaucuauaugauauacacauuuggaaggguuucuaaaugauuuucuagauauaauucaugaagugucaagauaaagagucaaguauuucauaaaaauuaauuucauaauagcugugauucuuaucagaagagaauuaggguuggggucuuauaguuugaaauaguacauuuaguauuuaaaaagguuuuuugaugcgaaaacaauuauuuuuaaaaugaagcuauguauaaagucugaaaaucuuuuuuuuaaauugguacauuuauuaaaaacauagacuaauggucuuaugcuuaaaugucuuugugguugugugcugacuuucauccaguguaacuaagggacuguucacaaauacacucuggauagaaguauaauaauaaacagaaauggcugucauagagacauaguuccguuacaauuaauacuugccagaaaauggagcuugacauuguuuacuauuauacuaacauucacaaaaggccggauaucacaggcauaagggcacaccaugaccaugagacauccuuucauacuucccaaauaguuuuauauuuuagcuauggaccucaguuaccagagccaaacuuguucuuaacaaguagaauuuuuauguccauucagucgaagagugucuuacaccuuucugggucucuuuauuugcagauaggaguagaaacuguaaccaacuucuucgcaucuugcagucacaugugaugcccaauuuucauaugcugcccaauuagcggugacuugcagcagggccacaaagaugaggaaguucuguauggaggugaucacauccgcaugcaucuuccauuuuguguccucuggguccaaccucauugagaggcccuugauccagaacacugaagcucuaauucauuggcuuucagcugccaugcucugcucucugaaaaucuuucuuaaugggucauggauuuaaaguugaaaaaaagcuaugggaguuucucaaauuagcaauucucaaacauucuuaaauuaauagaaauucgaaaggcaaauauugagucaaauuaugaugcuacaaucuucuaaggcaguuugagcagaaaugaaacuaugcauuguagaauaugaacagggucaaauacuuugaaguuauguaacuuugaacaaacugcuaaauuaaucuaagcuuuaguuuucuaauuaaaaauuuguaggaacaagauuugacucacaauuguucugaacauuaaaugagguaguccauauguaguuuauucacuaauucuucuuucaaucauuauugaauauuuccuauauacuagccuaucugucauacauuggggauacagauagaauaaaaauugucuuaacucucaugggaguuacagucuauuaggaaaaagcacagaaguaaacaagugauuacaauagggcuuacuauaauggggaugagagugaaugcagagucuguguaacaggcuaauguaauagccauugacucaagaaauuacaguaacagaguugggugguggaggcagaucugauuuucauuuuucucuuaauuuacgcauucccaaacuuaugcauauggucaagguuuacuauagugugcuuucuauuaaaccuuuaaacauaagauugguaaauauggauauuuuuuagaagaaaaauccuacgagacuucuuaaacgauuauaaauuauuuccauaauucauaauuuauaagcguuguuuccuauaauuuuaguugauuucuauugugggccuuuaauccuccuuguaucuauuguacccuucccuugcauugcccacccugcuccccauccuccagccgaaacuucuucuccuuuagucuuguguaauuuuaggacuguugcuauagccgguauguuugucuuagcaaauuaauacuuguguaggaauucugaaaagacaaacuuuguuccuguaauaacauuuuaaguugaugccauauuuucauuggcucuuaaauuuuaaaauuucaucuuuauuugugguagaagacacauaacauaaaaucuacuauuuuaaccauuuuaaaaugugcaguucaguaguguuaagugcauucacauugauguacaaccaaucuccagaacuuuucauuuuucagaucugaaacucuauacuuguuaugugggucuuaauuuuaagacuacaguucuuacaaaaauuucacaaacauaauauauuugcuacuugcugggggugguauuaaguuuauuauuuguuuuuaauuuuuuuuuauuucaacagguuuuuggugaacaggcaguguuuauuuacaugaauagguucuuuaguggugccuucugagauucugguguacccaucacugaacaguguacacuguacccaauguguagucuucucccuugccauccccaacccuuucccccgagucuccaaaguccaauguauaauucuuaggccuuuguguccuuauaaguuagcucucacauaugagugagaacauuugauguuugguuuuccauuacugacuuacuuuacuuagaauaauaaucuccaguuccauccagguugcugugaaugccauuauuucauuccuuuuuacggcugaauaguauuccauuucuuuauccacauuuucuuuuuuuuuguuuguuuuuuguuuuuugagaccgaaaaaaauauuuuucauuuuucagaucugaaacucuauaccuguuaggugggucuuaauuuuaagacuacaguuuaauuuuaagacuauagcuccgucgcccaggcuggagugcaguggcacaauccuggcucacugcaaccucugccucugggcucaagcaauucucuugucucagccuccugaguagcugggacuacaggugccugucacuaugccuggcuaauuuuuguauuuuuaguagagacgagguuucaccuuguuggucaggcuggucuugaacucccgacgucaggugauccaccugccuuggccucccaaagugcugggauuauaggugugagccacugcagccucccaaagugcugggauuacaggcaugagccacugugccuggccuauccacauuucuuuauccacucauugauugaugggcguuuggguugguuccauauuuuugcaguugcaaauugugcugcuauaagcaugaguaugcaaguaccuuuuucauauaaugacuucuuuuccucuggguagauaccuaauagugggaugucuggaucaaaaguacaucaaauggaucuacuuuuaauucuuuaaggaaucuccacacuguuuucuguagugguuguacuaguuuacauucccaccaacacuguaaaaguguucucuuuucacugcauccaugccaacaucuauuauuuuuuauuuuuugauuauggccauugcugcaggagugaggugguauugcauugugguuuugauuuggauuucucugauaacuagugaugcugagcauuuuuccacaugcuuauuggccauuuguaugucuucuuuugagaauuagcuauucauguccuuaacuuuuugauggaauuuuuuuuucuugccgauuuguuugaauucuuuguagauucuggauauuaggcuuuguuagauguauagauugugaagauuuucucccacucuguggguugucuguuaacucugcugauuucuuuugcugugcagaagcuuuuuagcuuuaauuaagucccaucuauuuaucuuuguuuuugcugcauuugcuuuugguuggucauaaagucuuugccuaagccaagucuagaaggguuuuuccgauguuaucuucuagaaucuuuaugguuucagaucguauuuaagucuuugauccaucuugaguugauuuuuguguaaggugagagaugaggauccaguuucauucuccuacauguggcuugccaguuauaccagcacuauuugucgaauagugugugcuuuccucacuuuauguuuguuaucuuuguaagcacuuggcuuuauuucuggguucucuauucuguuuaauuggucuaugugccuauuuuuauaccaguaccaugcuguuuuggugaauauggccuuauaguauaguuugaaguuggauaaugugaugccuccagaccuguucuuuuuacuuagucuugcucuggccacacaggaucguuuuugguuccauauuaauuucaggauuguuuuuucuaguuccaugaagaauuauggugguauuuugaugggaguugcauugaauuuguagauugcuuuugacaguauggucauuuaaaaauauugauucuacccauuuaugggcaugggauauguuuccauuugugucaucugugauuucuuucagcagcaguguuuuguaguuuuccuugugguuuuucacauccuuguuuagguauauuucuaaguauuuuacguuuuuuugcagcuauucugaaagagguugaguucuugauuugauucucagcuuggucacuguugguguauagcagugcuacuuuaauuuuguauccugaaaguuugcugaauucauuuaccgguucugggagcuuuuuggaugagucuuuaguguuuucuaguuauacaaucauaucaucagcaaacagcgacaguuugauuuacucuuuacugauuugguuucccuuuauuucuuucucuugucucauugcucuggcuaagacuucuaguacuguguugaauagaagugguaaaagugggcauccuugucuuguuccaguucucagggggggaaugcuuucaacuuucuauguuuaguauaauguuaguuguggguuuguuguagauggcuuuuauuacauagauuggcuaugucccuucuuugcuaacugugcuuaggauuuucaucauaaaggggugauggauuuugucaaaugcuuuuucugcaucuauugagauaaucaugugauuuuuguuuuugauucuauuuauaguuuauuacaaaaagauuuuguagauggcuuuaaaacaaaauaucaaauaguguguucuuaauuuauaccauaaaguuagagaauauuugaauuacuguaauucauuugauuuagggugacugaggcauuauacuuugauagcagcugggcuugcuuuuucuuuuuuaaaucauaaacaaguucuauuagaguuugguuauuuagccaauagaaauguguauaguuaaauauguuuggacuuuggggaaacaguguuuaucaaucuuaagaaauacucuuaucgggcugggcaugguggcuuacgccuguaaucccagcacuuugggagucugagguggguggaucacgaggucaagagauugagaccauccuggccaacauggugaaaccccaucucuacaaaaaauauaaaaauuagccaggcgugguggcaggcaccuguagucccagcuauucgugaggcugaggcaggagaaucgcuugaacccaggaagcggagguugcagugagcugagaucgagccacugcacucuucccuggcgccacugcaccccagccuggugacagagcgagacugucucaaaaaaaaaaaaaaaaaaaaaaaagaaaugcucuuaucuuucauaggaguggcuucagcuauaauagguaaucuuaaagauuuucuccaguguugacucuucuuuauuuuguugguuuacuucacuuuuagauaaaaugguuuucauuauaaauuauuaguuggcccaaaugggagcuacuuuaaggaaacauaaaaaucugauuucuuuggacugucuuuaauucuaacuuuuauuuuccugugauuuuugcuuuucauuuaaaauaucauuuuuuaacaauaguuuuauuuucuuuuguaggauauguaguaguaaugcuuauauuaguuuuuuucauugauuauauuuugaauuuucuuguagccaauguuagcuaacaugguccuuaugauaagaaccauuauugguuuugugacuggugguggcagcaguucuuuuaucuuccagauuauuuccaguaacuuucuacaccuaucauaggacacugagagugacuaccaauuuuguauuuuaugauacuuuccuuuuagcuuuuuaaagucuagcauacguguuguagaagaggugcaaauagaaaugaaagucauauuuugauguuuuacauauugucagcuaaucuuucauuguauuucuuagggcugcuauaaauuucauucuuguaccaauaauacaaaaucuugucaaaaaauauaacuccuaucuaauaauagauauauuuuauauuuuuuguuaaugaauugaaguauaaaaaguaauaacacucuauuucuuguccaagagucauuuuuuuaaaaauucuaaaaaaguaaaaucugcacuuuaagaaguuaaauuuaguuuuuaaaaaucuucuaguuggaaaacuaaaguuugguacacacccagaaaacauuuacuaaaauugauuacauaaauuaaaaacuucaucuucacaaaaaccaaaucauagcgaaauaacaagauuaccuuguauggcaaaagucuaaauauaaauaaugagauguggaaaacuacugaagcauuguuaacaaaugaagagauuucacaacuugauaaauuaaaugccaggaauucauuagaaauacuggcagauaauacaaauggugcauagaaaaauaaugccuuugaaaagauguucugucauacguaaaauaauacaacugcaacuuaaaacuuccccgagguacucuguuucaccuaguugauuggcaacauaaagccuaauaauauacuuagcugcagaugcaguaaaucaauuccuuauaaaucuuuggugggaauauaaguuuguauaacuuugggaggauuauuuggaaauauauuucaaaauuuaacuauacauacucuuugagcacuuucacuuuuagaaacuuaaccuggauauauaaaagcacauguguaugaauagauauaaucaaggcuuuuaauugcuggagguaacucuuuuaguaacuucauguuuuuccuguguacuugaauaugaauggaaucucucuggaaggauacagaagcugcuaacagcaccugauccuuaggagagaaaccgagguugcugaagaggacaugaaaaacaaccuuuuaacuuaaguacaauuuacagaauacaugugcauguauuaccugcuaaaguuaauauuaaaaagaaugacguggaacuaagacucucuugucagccauguguaaaauacaccaucaguggacagcacagguguuuagcacaucacugaugugcuggugaugccacaguguguuagcguuugccacucaauucaaacaucucucccucaaaaggaaguuccuugacaugcucuucucaccccugacuaccuaggacagucauauucauuuauucuguguauuuuuucuaagauuauauauauaauuaauguuuuguucuaguuguuucauaucuuuuuccauagauagaguugggcucugugaaggcugggaguccaccccucuugcacugcugcguccucacuauguaguaugaugccuuggauggcgcugacauuugcagcaucuuugaaugagugaagaauaauucuagaguaucagacaaagccagagccuaacaggaaaauaugauaagccucuucucacccaugugggcauuucuguuccuucuaacaguggcuucccuaaaacaaauaaaaaguuuuacuucuucaggggggcaggacacagaacucuuucagaaaccaauauaaaccauaaaaggcagagaugcaaauaccucuacauuuugucauguaauuuuaguggcuucauggauuucccuaaagcucuucaacuugaccaccucacuuaaggauccacucugcaggauuguuuuuuuugaccuuuauuccacugacaauuuuugguuucauuuuucugauuuuucccccuucuuucuagacugggcuauuguguuuuaugaacauuuucaaauguacagaaaaguaguaagaaguauacuuuuggacacccaaacgcccaacauuccaccauucauauucuacaguuaaccuuuuacuguauuucucucugucuuucuuugcuuuuuugaaacaguaucuugcucuuugauccaagcuagauugcaguggagugaucacagcucacuguagucuugaccuccugggcugaagugauccucccaccucagccucuugaguagcuaagacuacaggccugugccaccaagccuggcuaauuuuuuuuuuuuuuuuuuuaauuuuuaguagagacugagugucaccaaguugcccaggcuggucgugaacuccugggcccaagagauucuccugccuuggccuccccaaaugcugguuacaggcaugaggcaccuaccuaccauauuuucuuuaucacauaacuauccaucuaucucuccauccuuuuuuauuuagugcauuugaguaaguugccaauaucauuacacuuuccuccauauacuucagcuuguauggcauuaacuacaguucaauauuguuuauaggacucuuuuuugagacagaaauuuauauacaaugaaaugcacaaaucuuacauguaacauuugaugaauuuugacaaauacauacaccuguguaacucaaacuuaucaagaucuagaccacugccaugaccccagaagguuuacucauguucuuuccuaguacuuuuuguuuacugguuuaugugauuauaauuuacuauguuacauuuauauuacagugaucccuuaaguuuauacugucugaucagcauugcuucugucuuuagaugaggucugauggagauccaagguccuuaagaauuguccuagccagaucgagaccauccuggcuaacacagugaaacccugucucuacuaaaaauacaaaaaaauuagccgggcgugguggcgggcgccuguagucccagcuacuccggaggcugaggcaggagaaugaugugaacccgggagguggagcuugcagugagccgagaucgcgccacugcacuccagccugggcgacugagcaagacuccaucucaaaaaaaaaaaaaaaaaaaaaagaauugucuuagcccuaaaacaauuaagauguaguaggagucaguaacaaagucaccagcccuggugguuguguugaugguggucucuaagccuuugugaggaaaaggagguguaggaauacugacgaggcugacagaagugggggucuuauuaaucccuuguguucacaggggucauacagguuauuuuuuaggugaacagguuuacugccacuguauuuuuuuccauuuuagauguuuuaccaccgcacagcuuacucaguuacucucugaagugagauaaggaaaugaggauuauaguaacugaggaagaacaauagucacacaucuuagaauaagcauagugguggagagaggguaggcacagcaguuuagagccuuuugccaccaguuggugauauuuguggagucacggaccccugggagguggaggaaguggagaauguccagugggaagaagaaaucuaaaacuuaaucuguugucguagaagucuugugauguguauauagugauuauauuaccggaaggagggccuugagugaguuguccagguucuuggcauuuugaacaaagaauuggacaaaacgcacaaaauaacaaaugaaugaaacacaggaaagaagcagcgaaagcaauaauuuauuaaggcuagaaagcacuccacaggguggaagugggcucgagccaguggcucaagggcccguuacaaaguuuucuggguuuuaaguacuucuuuugaggugccuaucaguuagcccuuaucuggaugaaggauuugguccgugccuaauuaaaggcugaggugaauuggcacccugugcagaugaagggauagucccugcuuggccaauccaggguacuuuuccuuuccauuugaggcguggugggggguggggggauuguagggagaguagccuuugaucguuuguuacuccauguugggagauggggguuuuccuuugguuuagcuuuaggaaguuucagaaaguuuguguuaauuggccuuacgguccccgcccccagacccagguguuuuccuuuugauccagguuuaggaaguagcagaauuggucucagguucccugccuccagaccuugguguuuuucuugauucagcaggaauuagccuuaaguuuccugccuccagacccuauucuccagccucaauuauagcauauuaaaugucucugauauaauaaaaguuaccucagaggcaauuaaucuuuucauuagcuuuauauggguuggagaugguaguaacuucuuaaauaugacauaauuuguggucugagaaauaaauguaacuagauacuauagcuuucauguugaaucggaaauacaaagucaguguuuuaguaauacccacauaguacaaccaucauugucaaaacaacuuucuuguaguuaaaucauaauauuauugcagaugcacuagcuauuuucauaaccgugaccauuaucuaaaaauauaauacauugauaacuuggcacaagucuuuauaguagguuuguuauuuuuaauugcauggugguuuuuuugcuuauuuauuuauugagacagagucuuguucuuuugccuaggcuggagugcacuggcacaaucucaggucacugcaaccuccgccugucagguuuaagcgauugucaugccucagccuccugaguagcugggauuacaggggugcgccacuaugcccagcuaauuuuuuuauauuuuuaguagauucgggguuuugcuguguuggcugggcuggucucgaacuccugaccucaagugauccaucugccucugccugccaaagugcugggauuauaggugugauucaccacacccggccuuggugguuuauuuuuaagcauuuauguauucaucauuguuaauaucuccuuauuaaaugauuugcucuuuuuuguguguacuuacuaccauaauguaacaguugugaccaaugcgcugcuucccaaagcuucugguaauuauagauaaauguucuagauuggucccuccucucuuuuccuugugugauucccuaugguacagaguuaaaaaucaaucaacuagggagacugcagucggguauuuugcaaaguaagccuuuaugcaguuggcuugaucucucuauguagcacaaaaucaauguauaaaagugguauuugagauuuauugaauacuuuuucauauguuuuacauuuacuuuuuaauccucccaauaacuguaugagguagauaccauugguguccucaacuuacaacuaaacccagagguuagguaaugguaacuaaucucauauagcuuauuagugauagagcuugugcucaaauacauuuuccuaacuacuacaccaaagacuucuuauucugucuaauggaagcugcauuggguuaaguaccaccaauaguaauacuagcuguaauuugaggaggauaauccaaauccucagaccuggguuaugucuugucacuuucucaucaaagcagguuaugcuaugaccucuuccaacccccuaucucagggggucugcucaccauucacuuagcauaaguaagcaguggcuuugaauuuuuaguaucuugcuguagugguuuuagguugugagcuagguccuaaucaguacuuccuguuaaguguuuucugcaucucaccuuuggauacagcuuuuuuuuuuuuuuuuuuuuuuuuuuuuuuuuuuuaggcaaagccuugcucuguccucaggcugagguggaauggugugaucuucacucacugcagccuccaccuccuggguucaagcaauuccccugccucagccuccugaguagcugggauuacaggcgcccgccaccacacccagcuaauuuuuuuauuuuuaguagagaugggguuucaccauguuggccaggcuggucucgaacucaugaccucaggugauccaccugccuuggccuaccaaaguguugggauuacaggcgugagccaccaugcucggccuggacacaguuuaauugucauuggauauuuuacuguguuccuaugguaaauuacuauaauuggaagaggaauguugcaacguugcaaacaauguauggcaaucauuuugcuuuccaaguauacauuuuccuacucuaaaaacuuaaguuugcaacugcacauuuuaagauauguaugaaauuuugacuggaagauagcuuuauuuaucuuaugcccauuuauuauauuauguaauuuuuaguccuuaaauauuaucaaauagcacaguucuaguaauagagaaaauguaaacguuauugguuuacuagcccuccuauuaaugcuuaaacucuuuuagguuuugggaggaguucuuaguuaauaagucaaauaauguuauuccuggacaguguuuucaaugcuucucauuagccaaugaguaauaaauguacccaguuuugagaaguauauugccagaguuggauuguuaauauaaagcaaccauuuuccuaaucaucuguguuuuuuguauguucucacacagaagaaagaaccuucuaaauccagcaucaagaaaaaaaugaccaaaguugcagaagcaaaaaaaguaaugaagagaaauuuuaaagugaauaagaagauaacauuuacugaugaaggggagguaagauucuagaaguguuucauuucugaggugcauuuggaguauuagaagagaucgacucucucuuacuuagcacucauuaaugauagaguaaauguuucucuacagcaugcugggccauuccuuucacuguuacuguaggcuguacaucagcucuacugcugugaacaaggaugccuuacugccaauaagccgagauacuucuugguaauacugacacagaguugguuuugaacuuucuagauuauguuuuuauagauaagguuuucucuucaugguauugaacauuauguucuauggaacagacaugagaaugcuaauacaucuacuugccacagcuucuuuugcuucacucagaaaagcuucugcuuugcacuuccucaauuuuaaaugcuguacuugcauauaucuugcuggacuggcuaugggagggaauucucugcuuuauaaaguagucucagacacagaggugccuuguuuaaauucaccuuucccuuagccguauuguaaauacauacccauaguauagggaagggauuaccacucacagguuacucaugaaaguucaugcuauuauguaacaguugucuucauuuuaaaaugaugaaauagauccaguaugucaagugacuuaccuaaggagugguuacaguagguagggucuuuugaauaucaucucauggccucauucucaccagcgcagguuuuccugacuauccucauauuagcacagagcaccuuaccuccaucauagccucauuucucucacccugccucacuuuucuugacagcacuuacuuugugacuucagucuauauuugacuauugucaguuucuuccacuccacuucuucuugagaggaagguauuuuguugauuuuguuuacuauucuguccccagcaccuagaaagguaccuaacauaauaagcccucacaaaaauuuauugauugaaugaaacaucuauuucaauaaaauaacagcuuuucauauuaacuaauguagcacaucauauauuucaucaucauuaacauaaagacugcuuaagcagccucuccaguggaguaugauuccuuuuaauuuuggaguuaaaguuuuggauguuauuuugggauguauaaaucagacgaaaagucacaaaaucgugugccauucaaaggugguggaaguugaagaggaagcguaucuaaaugacagauaaugagucuuuaugaaguuacgaaaaagaggucagcaccugagaaacagacuaaacuagaauagucauaugacaucugauguucacuguaaaaugagaugagugcuguugguguaaugagguuccuuaguaugcuacuaaguuuaacugcauaaauuauaccaauuagcuccaaaaugaauguaaauccucaacuauaaaauguuucaauguguacuuagugcuaauaggaaauguuuguggcugugagccauccugaaacuucugacuuaaagcucugaaagaaaugccacuauauauauuuuucuagcccauagaaggauaaacuuuuugcccucugauugcaguggggaugaggaguccaaguaacaugauauucauauuguuaaaacugaucccucgcauugccucuuuagggucagugacugcuagcauggcugcucagugauauuuaucaaccccauugguugcuaaaaguugaggcuccauaggaaucucaucuugaagaaugguuaugguggccacagagugagagaggagacauuaauaccugcgaugugugugcuugcaguuuccauuugcuggcagguuaauuagcagucuuucaaaacaaugguaguuauuuaaaucuuucuggcaacuaauuauuagauaaaacaagaguuauuguugucugaauugucuauagaguuuugugguguuagacuuagaaauuacugagucaaauaaaccucuguuuuucuggaagggacacagauauccagagauuaauuuauuucgcauuacauaguaaugaaaaagccaggacauuuagacagguccccucauuagcagaucagugccccaucuucuaggucaccuuguuccuuacccuaaacuguauguguaaaauauguggauuugagcaagccugugaaacccaaacugauuuucuccuuuucaguuaguuauuucagucauuauguaauguuaguugguaugugauucauugauccauuuugagcaccuguuuaauaugugccagauacuauguugggcuccaaggauaaaugaacaagacauacaacugcccucaaggagauuaauucuaguaagagaaacaggaacauaaaacaacgcagugcaaugaacuuugugugacaguaacacacuggguaccauggaagcccaaaggagguacagccuguguccuacucagcccgacuccuacugugugcagauaauuuugagcugaguuguguggagaauaggauacuaagaaugcuguuuggaaagaugcuggagcaucucuauuuugugacugccuucucuuccaaauuauuuggugaaauuuucuuuuaauccuguucucauuggguauggcaguguuacuuuacucugacuagggcagucucuucuauggcuugaaguugauuagaagauuaaauaauacagauuagauuguaaggcagaaaauggguaucugcaccuuuucagaaucaucagacaaaaugaagugucuuucugggguauucccuacuuccuguugacacugaccuuuuuuuuaccuguaguugguucagcaguggccacaaaugcagaaaucugccaucaaggaugcugaggaagaugaugacacaggugguaucaacuuacauaaagcaaaggaaagacuucaggaagaggacaaauuugacaaagaagaauauaggaaaaaaauuaaggcaaagcaucggguaagcuuuccaucuugaauucauacugaguaaaauuuagugucccgaaguauaucuaaauauucauuagcuauucauuaauaaguguauuauuuucuucauuguuuucucugacacuucuuuuucuguggcuacucuuuuuucuguuuauuuguuccuuugcugggggagucuguauauugacucguuucugagaaugccacuuaaaucugucuuuggucugaggugaucuaaauaauauuaguggauuuguuguuauuauuacaguuuuuauuuugagauaauugugguuucacuuguaguugauagagauaucccaagcucuccauuucaauaauuuugucauuacuggaauguuuuauauaaaacuaugcaguauguagcuuuuuggaauuggcuuuuuucacucagcauuauucuauggagacagagccaaguugugugcaucagugcuuuguuccuuuuauuacuaaguaaugucccaucguauggauguacugagguuuguuucaccauucaaccauuggaaaagauugaugguguuuccagauucaacuuaauaaauuuccauaucaauuacuugauaauacauuaaauuuauuauauuaaaauuggagacuuuguaaaacuucuauaaaaauaagcaugugcccuuguggucuugaacuuggcaguuuucuguuauccuugauauaguggucacacaugauauuguuauaccauuauacuacuuaauucccuagaagugaacauuucacuagauaaaaaaaugaauuaaugaaauaaagcagauugacauuuuuuaaagaacuuucuuuagcgugcuuuugauacagugauuucagggugacacagugagaaacaccugagaaacacugcuauauaauauuaaauuuuguauuaagaacaaaauaccuuuggaugugaacauuguuaaguacauucugagaaggauucuuagagcuuuucacuccuauuugaccuuucauggaccaguacacacuuuuuuauaaaaauagaacagcaauucucauuucuuuauuuuaauauuugaugcagcuucagaguagcauuugaugaaaaaguagauauuggagauagcuuuagggauggaaaaugaauguugagaaaagcauuccaaaaauauggagaacagaugaaccugaaacguacugguuguaauuguuggauauuuauguuaaugagagaacuaagcauuucuugcauugcugcucuuagugcagcaauuaaauugaaauuugauauuagcaauuuguuaaaaucuuuaauauuaagaguaucaggagcuugucauguuucagcuugcaaucuacuuagaguauuuauccaggggacaacugggcaagaauguacugcauuucuaaguuguagccagcaguaaaagaaauaugaaggauuuacauaaaauaauguucacccucuuccccuuccuugccaucucuuuucucccauguggaaguuguuacuauauccaugucauugaauauuguucuggaaaccuuuagaaaguuaauuucaaauuggcaaauuguacuuguuuuauacaguguuaauguuugcuaggcucugccauaggcugugaacauagaauauuuaaaauaugugggugcugcugagugggugcaguaguuugcaccuguaguucuggcuacuuaagaggcugaggcaggaggauaacuugagucuaggaacuugaggcaguagugugcuauaacugcaccugugaauagccacucauuaauaaaaggcaauauagcaagauucugucucuuuaaaaaacaaaaacaagaaaaaacuaacauauguacgugggucccuccaucuucaggaagauuauaauuaagucuuaguuaacuggauaugcuguuacugcacaaaagcugcuugcacauccuuuuuuuuuuuuuuuuuacauaaaauguuuuggaaugaauaauauauucacauggcucaaaaaucaagauaaaaaaauugcacauuggcugggcgcgguggcucacaccuguaaucccagcacuuugggaggcugaggugaguggaucacgaggucaggaguucaagaccagccugaccaacauagugaaaccccaucuacuaaaaauacaaaaauuagcugugcaugguggcacacaccuguaaucccagcuacucaggaggcugaggcaggagaauugcuugaaccugggagguggagguugcagugagccgaggucgugccacugcacuccagccugggcaacaggagugagacuccaucgaaaaaaaaaaaaauugcacauugagaauucaugcuucugccuauaucugucugucuuauucauaccuacacccuuauagcuaacuacuuuuaauuuuaaacauguccuuucacuuucuuuaugcagauagaaauaaauaggaauacauauuuuuucuucuuuucuuauaugaaagguguaucguugugcacuuuuccauuuucgcuuagcuuugagcuuguaaaugauuuucuuugcaucauuauuagaacacagcaugugauuuuuuagacugucuccaugacuaucucauagcaagguugaacagaacaguuuugggcugacgaaguugugagagaaaucacuugaacuuuacauauagcugguuuugaaaccaguacuucugugacuacaagagucacaguauuuuuuuuuuuaaagugacaacuuucuauuuuaaggaaaauagguguauucugcacaagacauaccuuccaaauaggauuuugaaaaucuuaccuggaaaaaaagcacaaagaaacaaagaaauaauuagaauaguuuucucuauucgacugauauaaauguuaccugacacaugauugauuuuauaguauuuucauugguaaacacacauauguauuuguguguauuagagaaaacuuugcagucgugaguacuguagcauuagcauguuuacuacaauagcauacauaaggcacaaauaugggcacucaaaucauuuaugcaccaagcugucauagaguggauuucuacccaggaaauaaggaauguuuucuuaaguggcacaucuucacaugugggaaagugaagcagugauguuuguugggaagaauacugugcuguacuguggaauaaccuguacuugaguccucaguguggaauuaguagguuggugaaaaaguaauuacaguuuguacccaguccaguuuggauuacuagucacugacugggacuuugcuuuccuaaucugaaaaauuagggaguaggagugggacuuagugccagaugucagugagauccucuggcuccauagaucuaguuaagacaugggaauaaaaucauccuuaacuguuuggaaaauaaaauuuugauuuguaauuuuuuucucccugacaagucagguugcuugcuuuacuugaugaaaagaguuucuuccugccgggcacgguggcucacgccuguaaucccagcacuuugggaggccgaggugggcagaucacaaggucaggagaucgagaccauccuggcuaacacagugaaaccccaucucuacuaaaaaaauacagaaaaaaaaccaaaauuagccagucgugauggcgggcgccuguagucccagcuacuccggaggcugaggcaggagaauggcaugaacccgggaggcggagcuugcagugagccgagaucgcgccacuguacuccagccugggcgacagagccagacucugucucaaaaacaaacaaacaaacaaacaaacaaacaaagacuuucuucuuuacuuauuuccaguaacuuuuaaaacuuuacuuuaaaaacuaaauauauuauuaauccugcacaaauuacuuugcuuuaauuaauugcuuuacuugaacacauuguugguuuuugaagucacauuuuuuuccuaacugaguauacuacuacuauaaugacaauucuuaguucuuuuaguguaggguuuugccuugggcaaauauaauucuguuucccuuugaggcugucacucauaauuuuguuacuucuaugaaaguauauugagaagaacuguauguccccaaagaauauugaaaauacugacaacagggucuaggggaagcuuuacuucaggaagacagaaaaaggugacgaaacuuuugacccaaaguugugaauaagggaugugccugaaugaauuuugcauaugaaaaaaaaacuucguaaaaccuaucacaugcuucuguauuugacacauuucuuuuaauguauauuaauuguaaaagauuuuguaagccuuggcauuuuuuuucagcauguucaaaauauuuuauuauauauuugguuuaaaggauaggauauuuaauauguaagugaauuuagucuuaaugauucuguuuggaaguaguuguuugcucuugcguuuaaaaguugacagccuugaaucauagcuuugcaugugcacucauucuuaguauaguaggauucaacuacucauuuuguccuacuuguuuuucccucauacuauuacaccugucuuugaaucacauuuuucaucuaccaaguucugaaagcuauauaauuucuaaugugauucaaguaaaucuuugucuuaaagauuuagaaaacugaauuauaacaauuuuuuacauuuauuguuuauuuuaaaauuuuauguuaucuuuaauugacacauaauaauuguauguaugggguacaaugagauaugucauuacauguauauguugugcaauaaucaaaucaggcuaauuaacauaaccaucacuucaaauauuuaucauuacuuuguggugagaacauuuaaaauccauucuuuuagcuauuuugaaguauauaauacauuauuauuaacauggucaccaagcugugcaauagaucaucagaacuuauuccuccugucugauggaaacuuuauacacuauaaccaacaucuucccuuugcccaucuccccugcaagccuuccacccaguccuuugguaaccaccauucuacgcucuacuucugugagcucuuacgaagucugcuucuaugaacuggauuccacagauaagugagauuguguauuauuuaccccucugccuggcuuauuucacucugcuaaaugucuucuuguugcaaaugauggaauucuguauuuuccuuaaggcugaauaguauuccauuguacauauauaugcuacauuuauuuaauccauuguuuguugaugggcacuucaguuuuuccacaucuugacuauugugaauaacguugcaauaaacaugagagugcagacaucuauuugacauacgaauuucaauucccuuauauauaagagaucuaaagguucuaacugguuuagaguacaaaccagaccagaccagaccagaccagaccagaccauauaguuuaauggcaucacugggaguagaacucaagcugccugcuugccaaaauucauagcugcuacucuggacuucagguauccuucuguaacugcuuuggaucauuuagcagcuuuaguugcucuucaugaguugucguuguagccuuuaagcaccgcuuucuuaugagaccaccccagccuucagcuuugucuggcacuuauagguagcugugcuuaaauaggucuguuauuuuuauuuucucuuuagaaccucuggaaucaaucauuggaaauaaaaauacagcaaaagcuguaacauuugcauaugaaaccauuaguaaacuaguaaacuguaaagacaaaaugccacucuuacauacaagcaauguguuuucuaauaauucagucagaacuguugaaagauaggccauggauccuauuuuugaaugauuuuuacuucaauggagugaaaaucugcucuguguugugucaucauucuuaguucugaaagaugacuuguacugaaggugauaauauuugcuaucacagcugagaauagagaaaaacaauucauuaugaagcucuuucauucccuugaaauucgagugcuuuaucuauaucggauuaugaauuuagauaacauaaacaugucaagauguggcucuggacuacuuccagagaugguacagcauuacucuagguuccauuuacuaccagcaugaacauuagaaaguuaagaaagaauuaaaggaagacuuuagaaaaucuaucuuguuuuauuguuguugacacauaauuaaguuggcauggaauccagaugacuuaaccauaaauuuuugugauaguuaagaaagagggaaacuguaaucaggcaucugaggaauaguagccacaagaauauuaacaaguaacacuugcuuaacuggacccugcaguaaguuuacauguaucgucauauuauaugcuaauaauuaacuucugaaaucagugagcuagcaucauuuuuacagauuacaaaacuaagacuuagaagggucaaguaauguguccagaacccugcagcuugcaaacagcagcccugggacucuuaccccaaggucuuuguuacucuuuaaacuuuaugcuuuuuaacuauucagcuguguugcuaccuauuucaagccaucagacguucuuuuacaggaggguaacucugaagcagugaauuaaaacguggaggaugaucacaagaguaaaggguuuugaagaacagaugacaaauaauggagauuuuucauguuuccagaacaaggucauugaucucuaauaaauuaagaauaaauuaaauguugugguuaguaguauaguuuaagacuccauacuaauaccacuuauuccugaauguucauugcauagcuagauauguacauauacuagugccagaauccauuuuuccauagcuauggccauuuaagagucuaaaguaagagccagagacuggucuggcucacaugguccuuaaugaaauuuuacuaagaucagaagugucaucuugaggacaagggacucaguaucuggugccuaauucugaaauggauguugugaaugaagcuuauuuauaugagaggauaaaagauccuuuucaugacaacccuuuuuccuucuaguuucagcccuucuacugucacaaccagguuuauuauuaaaauggaagccaaccuguugcuauagaacauuugccuaucauuuggagaugucugccuggggaggugucuguucuuacucucaugagcuuauaacaucuagugacauuuagcucaauaucuugguguuugggcucucuuuauauccagcaucgaaaaugagacaaguauucagaauuacauaaaucugaucuauuuucaugcuuccuuuuggggauuuuuuuaaaaaccauaugguguuggagagguggguugguuauuagguugauggugaguagguagagauugggguugaggagcagggagcaguuuggugccaguggaaucagggagucugauaggauuaaguuauaaacugcaaagggcaauggucuauaucucuuuugcccauuauauguaugcagagccuaccauguggcucgguaaauauucaaaggauuuaacuagugaaucaguguuuccacaucaauuuguuuuucucauucuuuguauccuuguuauaguuguuacagauuuauacauagaaguccacuuuuuaaugucguucaagcaaaacucuguaaaauagguaacagauuggagaaccuuguuguguuaaguuccugggaaggauuuagguuuacuggaauuuuguucuuggagggcaggggauaucuuugggacuuaaccauucucaugaucuuucucuugcuuacuuuuguuaagccaguuuucuuuuuugaaaaauagguuauucuaacacugaaguaaagaugcauguccccuucuuccuuaugugauagcuggggagucaauuccuuaccaaacugacacaguugccugagaaucacgcaaaggaauauacuuucauaaccucccaaaaaugagucuuauuuucaaauuacaaauuuucaaguaucacccuagaaugaaaaaguuuaaauuaguagucaugacugcucaugaaauucauguuucaugguaguuucuuuucuggaagcuaaggaccuauagugugugagaauccaaaagaaguauaauaucuauaaagguaguauuuuauaccuugaaauuugauuuucuguuuuucugucccuugugaauuugauuuucauuauugaauuucgugcuccccuuauacuuaaucauuuguagcauggcagaacuaaagauaacauuuugccuucuuuuuuuguagcauaaaauaguuuuugguaccaguauguccucaaaaauaaaauaggaaaaauaaagcauuuaaggcauuugagccacaccuaauuaaaaggggaggaggacuucaauuacugaaucuaauaagauucacuuauacuuuucuccugaaguaauuguacuccagccuuuuaucuuuguuuugucauaugucauaaaccgucuuuagaaaauuauuuuuuuccuacucccacaaagaauauauucauuuucuaacuuuugaauuaugauaaaucuacuuccaguucuuucgcuucugucuugauguuuacucuuggcucuuuucagaguacuaauaaagcuuuuucagauaagaaagaaacguuuucuaaugauucacuucaaauuauuuucuuuuaguuucacucaguauuaaaaguuugucauuagugcauuuguuucaugucuugguaacauucacuucauguuguaaaagucuuuggaugucucuuguccgucugaaaauuuugguagaaaauuuaaaagggaaaauuaucucauuugcaugcacauguaaauucugauagccaauuuaaagcugaaauuuaaaauaucuuuuaaugacuauaaugaauuaauauuggaauucaguaaaaguagaaaauuguccauuuuuuucugcugugauuaaaaugacuaaauggaaaaccccagcaugguuauguuugcuuuaguagaaaggauuuuucugaugugaauaugucgaaguuauucuuugcaacuuugaagugccauuuucagacacugauguguuggaggaagaucaguuguugaauaauuacaacaaaaauuugcauggcuuuuaaauauggucaauuaucuguuucuucugcacagaagacuggcaaaauuaauugaguaauguuguaaaaugcugucagaaaaaaaaaugcuaucaggaugaaaagaccuguaugguagcagauuauaaugaugaaagaauuggcaacauuugucuaaaacauauugauacggauacaaauacuauguacgaaccuacaaagugaagucaauguuccaguggaggaguaugaaguguaguggugugcuagauuugagagagugaggacuucggcuccccaggcccaguuuagucccaaguccaucacuuacuaugugugacaucaggcaaguuacuuaguuacuuugaucuuccauuuuucaucuauagaaugggaauaguaauaccuuuauaaguucuguuacauagauuuaaaaagauaaccaaauuguuauaugaaaugcauagcacauuguugauacuuaauaauucugaacuacuucuguugguaagaaaauaacaguaaugugcuaauggacaaagaaauuuuuaugaaaguacaauuuuauuccucucuguaguuccuugauauauagcuauagucuuaauguaagcaacaaaacacucaaaagucauugugaucuucguagaauaacauaaaauauaguuauauuccauuuuagugucuaacacaggaaaacugcauggggggugggguggaaagagaagggagauaaagcuacaaauacauguauccacaagcuaaagccagcucaaaugaaguguuaguuaugaucaguuauaucauauuuuuucuuuaaucuuguuuugcuucuuucauauauuuuguagucugcuaauccucaaaaucaguaauuggugccaacuuaauuuaggcacagauuguuuagaaacugccauccauuaacuuauuuuuccccaaaaguuggggaagcauugagauuauuuuaauuucguggcagaacgucucuuauaaucucauuagagaaccaauucagggauaaaguuugauaaucacuauugcauuaauuggcugcuugcuaaaauaauacuaguuauuauuuucuucuguuuuuaaagucacaucuguuaauguuuaaccccugaauguuaacauuuuuauuuuuauuagaauguaucgcaaaaagcacuagauuuggcacaugaagacccggguuugagaucagucauuuucuaaagaagcucuuugauaauaagcaagccaaaagcuuucugaguuuuucuuuuuucuccuuuccauuuccuuccauugaacuuguuucuagaaauuccaaguaaucucuagaaugugucucuuguauaauuguacauuauguuuuaccuguccuguuaguguguguuuuauuugaaagucaguacuaaccauugcauagccagaguaagugauauagaacugggauuugauuccagaucugucugacacauucuuaaugauucaugaauacuugugccaaucccauaguaguagucaguaaauauuuguugaaaaaugaaugucauauauuaguuagcuuuaggaaauaaaacuguaaugaauguguagucuguuuuauaccuaauuauaugcugcuaauuuuucuccucuuccuugucuccaggagaaaagacugaaagaaagggaagccagaagagaagccaacaagagacaagcaaagguaaggguuuauauacauuuauuuuuccaagcucuauuaagguagaauggacaaaagcauuuuauauuuuggcaagaacaaugcuuauaauguuaaaauggaauuuaaauccucuucuuuucaacauggauuuuauauauuauuuguauaucaugauauuccaauuggauucaagcccauguggccuucuauucacuuucuuguauuccucuggugcaggacgaaaaaucccuaagauaauuuguuacugggcuuggccccauuuacuccaccacuuuuuuccauauauuuugcaucuauuaaauacaaaaggcaguugacucugugggccaggccugauaggauuuucaucuguaucaucuucagguagacagccugugugaacccaaccucauaacagguaacucugaaagcaucaguucagcucuuagaaucuaggagaaaagcauucuguaucucccacuuuuacuauauucuguaacagauacuuuucagcaaauacauauguacaguuuuccucaaguauguauguacaauuauaaacacuguccaugugcagccaugauuuuuaucuaauguguuugucacugagaaguguucagcuucugcauucugagaacauuuaguagaaaugauuuccuagaacuagggcccaauaacauaugucauuucucaugcuguaucucauugugcuguuucugacuagccaugauuucuucuuggcaguuagcaaagcuccaacucccuugaggaagccuauaauauucuucgucauuuuuuuuccaugcuggccauagcacuuaagagagcaagucagagaugauaacucaugcuauaguucugaagugggaagcaauuauuuaauacugaauauaagcagaaaagacugcuuauauuaaauauaagcaguauuaaauaucacucugucuucaaaggugcccaaaaacgagagcuccagugugugcagccugacugcuaaauaagguggaggcuucugcauaugcuuuaacgugcaggcgugaaacaccauggcagaaccaccacuagaucucagaggcuguagugggaaagauuuaaauuuaacaagaaaaucuuaaaucuaauaaaagcauuugauauuuaugaauauugcauguucagcauaaaauaagcccauuuuauuucacuaagaagcucucauuucugcauauauaaauguaaaaugaaagauauaaucuagagccaaagaaagcccuguuacuguauuuccuuuguguuuauucaugcauauuuguauauauauuacuaaauaugguuuauuuuuuauacuuauugaugguguaugcucgauuuuuuuuuuucauaaugguuuaagcuguaagaaguugcuaucacccuugagcuauccuccuggaaaccucuucuuuuauucccccauaaauugguguguauauuugguuuuaauacugugucugcuggggaaaugaaaaaaugauaaaguugucacaaucaggcauuuucacuggggguugaucucugaagugaacuccuuaugccaaacucuuccuuccauuucccacuccccuucuguguuuguccuguguguuuguuuccugacaucuaaaaaaggaggaagauuuuucuugucaagggaaggucucauuucuauguaaccacuaagcaucggacuaagaacagaaagaagagcugacauggcuuugcagcucagccaggagcuuuaaauagacagaggcuguguuuuauuauugcucugaauaguuuagcuaccuccauuucacagcccuuuucugagugcucagagaugguagcccuuuuguaagagugauauuaccagagggaucaguggcuggucugcagccaggacucaaacauuccucaagacacugaggacugccugcagugacagguucaggcugacugacagagcccaaggaaugagcucaaaccaaccuuuugcacccaacuuccuuucaaaugaaagugacagggguugaaggcucucauggcuuuugagguaccuuuuggaagcagacccagaagagauuauuuggaaacacuugguaaaggggugauggcacaaauuucugugauauguaaggagaaauauuauguaaauuaucagguuucucucagugcaugugcuuuaaaugacagaugugacuuaguuuuugaguaaacuuugucuucucguugauccucuuauguaaaccuaaucauuguguuacuuaggauauugccuucugaaucacuuuagucagauuccagguagagcuucccuuugaucccugaaccuacaagcuauccagaagauauuuuaauggucaaagaaggugguacuugcagacuuaauuuaccaggaaauguagucauagcuguuuauagcuauuuuaagcaaucacugcauagaaacugaaaguguaagaaagggaggacucacguagcugucuuucuaccuuguuuuguguuucaugcagcaaacaucauuuuauuauacaaggaaggauauaaaggacacaguauuuuuuuuuuaauuuuggggaaagugcuugaaugaaguuucauggaauuaucuuuauuucccagaaaagagaaaacuuaaugauaaugugaauuuucaauuuuagaaaugaaucuucucuggcauauugaaaguacuucuaagaaaaauugcuuuaaagugugaguaggauaaacuaaaguuggaauggaccucucaggaaucugauaugacuuuuuguuaaaagauagaucuaaguucugccuaguuauauuaugugcagaauugggaauggaagauaaauacgaagcugaaacuguuacgaagguuugcuggguaccuaauagugguuugggaaauauaggucuuuuggguaucaaaacuuucuuuagcagagaaguacuugaauugcacaauagaauuguuuuuacuuuagcuaacaagaugucguauauucuuaugaccuacagauuuuaaacuaagaucuagaaaaauacuuguagcaaugaucaauagaccacauugcuuuuugaguucagguagguuacauaauccuggaauacagcuuuaccucauuaucuagcuaaauuuccuuuugcuuugagggucacaagugcuaguaggaaucccuggucgcuggaaugauuuuguauaaauguaaggaaaaggaacaacagugcugaaacuugaggaaauagauccucagcaauaucucacuacugugcugcuuuugaaaagaaagugugauuuuuauuuauuuauuuauuuuuuaagauggagucucgcucugucaccgaggcuggagugcagugacgcgaucuuggcccacugcaaccuccgccucccagguucaagcgauucuccugccucagccucccgaguagcugggacuacacgcaugugccaccacgcccagcuaauuuuuuguauuuuuaguagagacagaguuucacugcauuagccaggauggucuugaucuccugaccccgugauccacccuccucggccucccaaagugcugggauuauggaugugagccacugcaacuggccaaaaguaugauuuauuaaacaaaagucugaggcugaugaaauugaacacugacuaugaaggaacaaagaguaggaaagagcucaaacacuuaaaauaguuaaaaguugcuuugacuauauuaaaaaugaugauuauaguucguauuuuuaagguguggggaaaauaugucauacauuuugagguugaaguuuuauagauguacauuuucacuuguuuuuauuuuuugguuuguacuguguuuuuauuuauacuuaacaaauagugguuuuagguaauaguuucuugaauaccuaagguaaucucuguacaacagaaaaguaguguugaaguuagagcucucagaauaggaggucugaagaaguaguaguuaauuaauuuuaaaacucuaggccgggcaugguggcucaugcguguaaucccagcacuuugggaggccgagauggguggaucaccugcggugagggguucaagaccagccuggccaacauggcaaaacccugucucuacuaaaaauacagaaauuagccaggcauggugguacccgucuauaaucccagcauacucgggagggugaggcagaagaaucacuuuaaccugggagguggaggcugcagugagccgagauuacgccacugcaguccagccugggugacagagcgagacucugucucaaacaaaacaaacaaacaaaaaaaaccaccaaaaaaaacaaaaaacaaaaaacaaaacaaaaaaaaaaccuuaaaaaacuaauggacuugagagaugcccuggacugacuuuuuaaucuacuggucuucaaugacuuuuucucugacucaacaguaguuucauaaagcaaagcuaacuuuauucauuugauauuuuguucuuccuacuuuuuuggugcuaaaauauccuuucauuuaugaaauaauacugauaauuuuuuaaaaagucuuauuauuugacaaaguaaaaacccauuucaccacuuuaaaaucuuuuuugagcuuuuucugauccaugaaauugaagagcgaguguggcagccacugaucuacuccaaugguuuucaguauuauauugagugaccuauggacucuccucuccaccccccaccacccccgcgugagaauauuauuugggcaaggcucuaggguuccauuuaguccucauccagaccagcucaacuuuauuuuccucuuuacauuuugaacuuccagggaauauuuuauuugaaauauuguuuuccuuaaauguauacauacauagcuacauagcuaauacuuuuaaaguacccaaauaaguuagggcugaaagcaagugaaugacuugccuaaugucauagcuucuuugguggcagaacugguauaugcccccagguuuccugaaucuucauucccuguuauuguuuauuguccuaugcccuuucuguauguugcuuuuuuuucuuuuucuauguaaaaacaaaucgcauccaugauacaugaucuaacgacuagucauggaaaauuacuaauagcaaauaccuuuaguaaggaaagaacucugggcugagaucuagaaggcaggcuaugucuuaaaguuucuggguggcuggggacaagccauuuaucuuucugggccuguucucagcauguguaaaagguuaccccuuucaugaagauuuuucugacucucucacauauuaugggcuccugcuuuuggaacuacucccgugguccccugucuagagcaccgccaauaauuacagugcugaugugguugcacuucucucucucuuuggcucuggcucuuguuuuccuuugugugccuaucucucaucacagugcuuuguuggcugagggcaggcuuucuggcucacaguuggccaucuccucgcaaacagugcugaggucacucauauuaugauuucuuauuuuguagacaaggaaauugaagcuuaggaaguugaaguaacuuucccaauaacauacagcuaggaaauggcagagccaggaugcaaaucugcuuuauaugacgcugaagcguugacucuuaagcauuaggccauaggucauuuccgagguagucaagaauauucaauuugagagucuuaaaaacugaagcagaaguugcaaguaaauauuucuucuccugaaauugcuuuccuuauccacaauuaguucucuuuuauagguggcugcauugagaaacagaauauuaagaagcagaacagaaccauaggcggauacagaauauugugcaucuccuauuaguuacuauaaaaucucacuggaaucccagcagcuuaauuuuuucuuacaaaugaaaaauuaggaaacauuuaccauuauuuccagcccaggaagaccuguuaaacauaccauauucucauaucuucuugauuuuuaaauuuuauacauguuuucccucugccuaggauaucuucuccuucauugcuuuuuccucugaacuguuuccguuuugaagccuuuucugccuccuucaggccgacucaugacguucuuccuuucuggaccaccggacuucguguacauuauucugccguguuacuuggugauugucucucaucacuagacuauaaacuccuugagagcagcagcugaguuuuuuucauggauggcacauaauaaaugcucuguagauauuugaaucagugaaaugcaacuauauucauucuuaaaguuaacacuuuacauguuaaugcuaugucaguuauaagauccuugaggucuagcaccggggccugcagaauacagugaauuuccauucugccagacuggauguaucuaacacacucagcccuuuccaaguuccuacuucccuucuaccccaucuuguguuaaacaaauccgugaauuuguauuaagaugauagauucuuaauauuaaaacaauguaguaaacucuguaggcaaucagaaucccauuagaauccuucacgcaugccuuauuugcgaagaauuuaauaaauucuuaaaggaugaguuguccuaagaugugcauauugauuuugccuuucuuccuucuuuuuaucuaacuucgagcuccucaaguugcauauggaaaacuugaguguaugguacuguaugggugguaaaagggauacucuaggguaauuugauauguugauuuucaccuugccugucagcuuuggaacugaaugcccauggaaguugugacuucauucugugaugcaguuccuugcucauaaauauuuguugauugaccaaaaaaguggauccugcuaaaaugucuucauuggcaguaucauggugaauguugcauuugaugccauugaacgugaguagccugaauaauugugaccuuauucaaaugugguuagauuguaggagagcuagcacucagauccaggucggauugcacuccuugacucugaccacugaugacucugcaguggguguuaaggaugaucuuaaaccuguucagggcagccauuaacucugagaauaagaggaaauuuuucaggaaacaagucaaaccuuuuacacuuggaguauuagaccagauuaauuuaaggcagaauuuuaaugacuaugucagaauguguuuauucuaauacuucuuagagaauuaauguuugguguuagagucagaauacuguuucuuuuauuaaacuugcaaaauguacuaaccagauaaaacuugaggaaaacagauuccuaauaaauuugaguaagguguaaaaaaaaagggcuguguguguacauaucccuuuguuuauguuguagaaaauaguuguauuauuaaguggucugauagucuguucaguuggguggucauuuagauccuuuccaaugaaacagccuaaacaguaaauaaauccaggugaugcccuuuauacuucaucaugguugauucagcuuaggugaaguuagagauaauuugacauuuauaugcuugaguuagggauuuauaggcacaucuagcagaacaaauuaacuguauuugaaucauuguggucaguuucauuauguggcugagucuguguuauuccagugguuacaugcucuacuuuguagagaacugugccuguggguauguguggaugugaccaucgugauuguggagacugauacuuaggaucauuugccuauauuuuuguauguauuagcauucauuaauggucuaaaugaugguuauucuuuugacuguuaguagucauuacuggcuguuguaagauuauaccaucauaauuucugauauaguauacaaaagucucuaaguugaaaaaaacauguagauucuuuccuccuuucuucuucuucuuguuuuguuucauaacucagaauccuguugcuuaugugaagaaaaagaggcagggcuagagaacuauuauaagacuugauuuuaguaauucucagccuaugguacaagaaucuguguggguuuuccauguuauuacuaggaaauucuaaaauucucagcauugacuauacagugaauaaguuaucuauaccauacauauauauuaucauagcuuaaaaguauguaaaggcuauauuaagauuaacaaaauaugaacuuauuuguuuugcuaaauucagaguacuuuuuugucuuguauuuucuuaaaugacauauaccacuguagaauuaucaucuuguaaauaguuugauguuaaacgucuuccuauacugaaaaagauugagaacacugccauaugguauguaagcagaaacagccauacuccuaacacuuagucaaaauugaagacagucagucguagggaggaagaaaagaggaggaagauggggaggaggaagccacuauuuuuuuuuucuuuuuucuuuuuuuugugagacagucucacuucaucacccaggcuggagugcaguggugcgaccucagcuuacugcaaccuccgccucccagacugaagugauucuugugccuuacccucccaaguagcugggacuacaggcacacgccaccuugcccagcuaauuuuucuauuuuuaguagagacagaguuuugcaauguuggccaggguggucuuaaacuccugaccucaagugaucugcccaccuuggccuaucaaaguacugggauugcaggcaucagccacugugcccggccgccacuauuucuuaaaaggaagggaaggcuccauuuccuccauaucuuaaaggagaaaaaaagccagugggaaaaggaaauaacagagauggaacacagaaaaagaacagacguaaguuuccuacugugcuaguugauacuacugagugucaacuugauuggauugaaggauacaaaguauugauccugggugugucugugaggguguuaccaagagagauuaacauuugagucagugggcuagggaaggcaaauucacccuuaaucuaguaggcgcaaucuaaucagcugccagcgaauauaaagcaggcagaaaaauguguaaaggagagacuggccuagccucccaggcuacaucucucucccuugcuggaugcuuccugcccagauaaauuaccuguugugacugcccuggacgugccugccuaccagacaccugaucuugcaagaccauuauuaaagucucacauuugcuguucuuugcaccucuaaguccauucuuggcguuuggacgggugaguguguuucucacagcagcacuaaguaucacugucagagacuagaaauaaccugaauuguaggguagauaaauuguggcauagucauaugaugaaauguuauauaugaaggaauuacugcuacauccaauaaugggcaaauuuugaaaacaugauauugagcaaaagaugccagacagaagaguaaauacuaugauacucuauuuacauaaagguuuuuuuguaaaagcaaaacuaauauuuucgguuagaguuuaccuuugaggaaaaaagggagucauuacugggaaggagugugaagggggcuccuggagaacuugagaguguucuaauuucuuaaacugggugguaguuacaugggguguauuuacuuugugaaaacucaucaagcuauaagccuaugguuugugcaguuuuuuggagguaugccauacuucaauuaaagcucaggaguuugagaccagccugggcaacaugguuaaacccugucucuacuaaaaaauacaaaagaaauuagcugggcauugcggugcaugccuguagucccagcuacuugggaaggcugaggcaggagaauugcuugaacucgggaggcggagguugcagugagcaaagauugcaccaccgcacuccagccaaaaaaucucucucucucucccuuucaucaaucuaaucaacaaggucucacucuguugcccagguugugguguaguggcacuaucauagcucacuguaaccuugaccgccugagcucaagcaguccucccgccuuagccuccugaguagcgaggacuacgagaauguaccaccaaaucuggcuaauuuucuauuuuuauuuuugauagaaacaggaucucucuauguugacuaggcuggucaugaacuucuggcaccaagugauccucccgccucagccucccaaugugcugggauuacaggcaugagacaaugagccuggccaaagauuacuuuuaaaaaaugaugcggguagacgagaucucuuuauaugcuuucagccuagauauuuuaaucuguagauucagaaauaaaagauauuauggauaacucuuguaauucuagaagcauuaggagccuuagucccuggagucauucauauuuuaugaaagcuaugaaagacaauuaauaauuuauguuauucaaauacacauuucuuuuaaaauccccuuguuccaagaagugugauguuuuaccuccuaaaacuuacaaaacaauuuccucuaaaugagaaaaugagcuuuauuuugacucugguguaaauuaaaaugaagaaauuguauuuuuuaaauaaggaggagcguagucgucauucugcuguucagagacauuuaaccuccuccccaccccagugaguuuuaguuucuacuauaaacuuaugaggugguuugguggccuuggaauguuguggagaucucuacucuucaugcuaucugauaggacacuaagagcuauugaauuggcauuuauuuagaauaaaggaacacaagggugaugaaagggacauuggucugagugaucauuauaugugacuacuguaacuuuauaaauugaaauagaugaauaguaacugaccauagaaauucagaaacauacaaagcuugaaagaucaucuaauaaagaagugacuaucuucccaugaggaggcauauucauuugacuuaccucauucuuaccauagauucugguuauuuauuuauuuuuccaugcgcaucuuaugugaauuaaauauuuauuuauuuccuuucaccaucuacagucuaaagguacuuagccucuguaacguaccuggacugugucugguccaguacuaagaguuuacgaucuuauuaagggggaaguaggcacuuuuuguuaauguagccucauuuuuaucuuuacuugaggaaauaaaucuuuuaugauuccagauaaaauguuaaacuuggaaaaugcugcagaaaugguauauacgugaucuaaaaguucuuuuaucaagaauucuaucauuuaucuucuuuggauuaugagaugauuacuguuagaauuaagugcaguuguuuuauuuuaccuaucuugauuuucagcuauguacauuaguuuucccccuuacuacagauacauuugauuuuuauuucauaaaauuaucucauuuccuucaguuggaaaugauauauauucucaagcucauccauuuauuuauauuagcacagcuuucuuuggaaaguauauuaucggaaggcuucagccucauuuaauugcuuuuaacaugaguugugcaugucugaauucuaaacacaacugcuauugaucccagccuccuggcauccauccaacccuaagauuuuugccccacucaguagagcuaguacaugauguuuuugugguugguacuuugaggagaacagaaagugagagaagaaaaaaaauauuguccucucuaagcaaaagagaaaaaugagaguggaugggucuguaaguccauauugugaguucaucaguaaugcuagaucagauuuugggcuucaguucauucagccuuuaucauuuacugccagguuguuagagcucuccuaaaagagcauuagauuugaaaaauacgagguccaaauucaguucuugccaguaagcuuuggaauccaaggcagucauguuuccuccgagccucaguuuccucuuuagaauaacaguagugguguugccugcauugccaaccuuccaggguucuugugaagauaauacauguguuagggcuuugugaacuaugaaucacauuaaaaaaugugagccaugauuaauuagcauuaguauacguugccuuuuuaggcagguucguucucagauacuuaggauuuaaccagugguucaaucgcggcuggaaaucacugaaagaugucucaaaaugcccauaucuagcuuccuccauccuuacccuucucccaucagaaucauugggguaggggacuuacuuacauguguucaugcaguauauauguauaauuaugauacuacuacugccccauuaagaaccaguggucuauauccauauauagaauaaacuuuauauauauagaauagauagaauaaacuuuauauguauagaauauguagaauaaacuucuauacuuuuuuggugacagggucuuacucuguugcccaggcuggaguacaguggcgugaucuuggcucacugcagccuugacuucccaguccucaagcgauucuccugccucagccuccugaguagcuggaaccacaccuggauaauuuuguuuauuuuuuuguagagaugaggucuuccuguguugcccaggcuggucucgaacuccuggacucacgugauccucucaccucagccuuccaaaguacugggauuacaggugugagccaccgugccuggcaacuuuuauacuucuuacaacccugaggugcuaggccuuuuccacuuuugguuuggcuacacccccauggcagaauguauacuagaagauaugaggguaaauguaagcccagucucuuaaauuaguuacaaacucagcaugcccaaacucuaguugucuuucagugugccugauugcagucagucugucaccuguuguucuuagccugaccccuuuucaacaccaucuaaaaccaaugcugggauauaagggcaucagaauaugagagguauguugccaagagccuuguaaaacacaaggagcagcaggauuugguuucuccuugacggguauaccuguaaauccuguuguguguucagcucaguguuggaggaaggagagagugcuucgagugaucacacugggagagaguggcccugguguguuagguggaaccauugcugacuuagaggguccgacagccugggacccugauuucucauccuggugauagcaguagaucacuguguggccuugagcaaauaucuuaacuaugcugcuugaaguguccaggacuauauauccuguggggccucuuuuagcucuacaauucugauuucuguuuuucaggagccgaugaacuauuaucugucauuuuuauaugcuuucuaaccuucccauguaauauuuuugaggugugucacuuauucuguauaguauguuugccagugguugaaauacagcaggagacuaaccauuucgguagaaaggauuugacuggccuccuuggggcuuuuggaaggcgucagauuugggagggucuuaucagguuuuuuuuacuggcacacaagaagaauaacaggagcuggagaaauuggugaaucauagaggaucucgaauaccaaguugaagauuugggcugacucaggagagugugggggaugcagcgagauuuugagggggaaugaagcauaagugguaggaugauccuagaaggauucauuuguuuacucuacgcauauuucuugagugcccuacuauguguuaccccucauaaugccaugauagaauuaaccugcucuaaggaacccacagucuaguggaggaaauuuguaaguagugcaauauaauuaauaccaugauagagaaguuuugggaguugucuacauauguaaugauugaauccaaagaaaaaaaauaauaaaaugucuauuugguauuuuccaugugucggguaguauucuaagugcuaauuccauggggaguuuaaguaauguauuuuaaguguacaaacuucagcucuugaaguuguagguaauaauguuauucccauuuaacagaagaagaaauuuuaguauagaagguugcauaccugcuuguguguaguggauucagaauuccauuuugguaguuggacucuggagagugaaugagagaaagagccaggucacaaauccuggggaacagcaacaguuaaggaacaggcagaugaaaagcagcuaggaaaacugguauauuuuucagggaaguaugaaaagggaauuuaaaggaggacuuggacaggagugccaaaugccacaaggagaugaaguagguugagaggauucggcaaugagaguauuauuuuuauguuaauaggaucaauuuuguuugcacugugugguuuaauggggcgggcuggagcagcuuggaaggucacuuuggagaccauuucaguaguugagauauuaaguccugggcaggacuguggauaggugaaaagggcauuuuauucaagaaguauaccuguaagauaccaguaacugaauggaacauggagauauuaggagagaugagccaaagaucacccuaagguuuccaaaacuuggcauauaucaugugcugacuacuuuaggaagaacuaagaucuguaauagaggacaauuuuuaauagcugccaguauugaacuauugcauaccauauacugugcuaaggcaugucauuuaguccucacauguagguauuaucaauacauuuugacagaugagggaccuggggcuuaaguaaauuaaauguacucaaggacugacauuuaguaagugacuccaaaaucuuaacauuuagcuucuguucuguaaggcaggucaguaaaagauaaaauaauggacauaauuauagaagcaccacuuaugacugguauaaagaacaguucagaaguuggagagauuauuuuugacuuguaggauucacaaaagaaagcaucccggggagggcauuugagucaggcccugaagcaucaaucaagaugaguguuugugaaaguucuuucauaauaaugaaccguggaaauauuauaauaacaauaaguggggucaaaugugcuagguugacaucaaacaaaaggaaacauuaagucacagguuauuaccagcagaauuuuaccuggaaaguagagauucuuaaaguggagcaguacaaguuaaaauagaggguuuugaauauuaauaauuauaauaaguaguuugagcuauauauaguaagcaguagucacugaagaguugagagaaguaggaaugugugcuuauguacccagcucauguuuaaguauuuuugcauaugcauuuauuuaguaguuugaguagaaaguuugaacuuugaagaguaagccagagcuucauuugacacucuaccuugggaaauguugguuguucaauuuaggccaauaauuuuuaaaauugagaucuagucucauccaugauaaaauaccacacuguuuugaaaauuagcuaccauagucaagaaccuggaagugaacaaaaugcuucugucagucaacauagaagucaugacaccuguguguauggaguacauucauucugccucugagcaaggcccacacccauacacacuaauuuucauuuuagucauuccuaacuaacaugguuuugugaguuauaacacugcggaagauaaauagcaaauuagaacauguagucuguuaaaggccagucccuuaucagaaagugaugaaacaugauaauggacagcaaggaaaauguauaggaaaauuauuaacaaaacagauaucaugacuuuaaaacacaguggcaggggcacagagcccccagaaaucucucuggacccagagggcacuacuuuauuauaacacugauaguuauaaugcuuuuccucagacaucaaggaaauaauaacuuauaaucugucuucaggcagcccuccauauauggucugacuuaaagaucucuuucauuugaaugguagcuugaggaaacuccuaguuuucuagauauuguagcuuugcauauacugaaccagguucauuuuucuuuugccugcaguucuuaagacuacugacuauauuucuuuaccuugucauagagguuugcaguuaggaagaaggggcagaaaaaaauuuuggggggccucaugucauuuaauaccuaauaacaaaggacuuucauagcagcauugugaaauacuguuuguguuaucuccauuuuucagaugaggaaaggagacucaaaguuuagguagaagggcauucugggugcaaggaacauuaucaguauggcuggaugauugaagaccaugaagguauggcuguggaagagugaggaguucaguguagggauuucuacuuuuuuuuuuuuuggccuacacuuuagaguaagaaauacauuuuccaucccuucccgcuaacauguacauacaacauuaaaagaaaaauuucacaaaaugauaacuuaccuuauuauuugccacaugcucagaauuuuccauuucauucuauuuucuuuuuauaaaaugauggucacaauccacugauggcuucaugauacacugaguugauacucuaaugaguuugauggcacuggucuaauguuaguugaaaguggauuauuuuauggagaggcaaagcuaaagggguauguugugguuauauuccaaauguuuuccuaugccaauguucucugauaugggcaacaaaaguccuugaauuugugucgguugcuaacauaacuaugucuuuguggcagugcuguaauaugacaauaauacccuaucagagcucccuagcaguuugugaauaacuuucacguauguuauuuaauucauuacccauaauaaccuugagaugaagguaagaggagcuuucuauugaguuuauacagaugaaaaaacugaggguuaaagagguaaauccccuagccacaauuaagaauuaagcuuuuuuuuuuuuuuuuccugacugcuugacagugaguaggagaaaaagcuaagguaaacucuccuuuuugaaagucugggcaggaaauaaugauaaggauggacauggaagcgggagaaguuagaugaagaauuaaaggaaaacccaaauaauggcuugaugaauuuacuuguauauuaaaagccaugcacacaauucuaaacucugguucuuucauuuuuaaacccguuguuuuuuuuuuuguuuguuuguuuguuuuaguuaucuuguaaaauuccagcccauuuaccuggcaaggccagggcauaagauugccauuaugcucugucauggcuuaugcucguuuucaucacucaucuucucuuugaaaggagcugaauugagaaagcauuuuucauuguuuaacguugaaaucuaaaaauacugauauuugaacuucagaaacauauuugaaauaagacaugucagcaggucuuuugucaauugugaauuguuacagaugugacugagucuuccauuuugaugcagauuauucugcauuuuuauugauaagcuuucauuaacauuuuauuuugggggaauuucuuacccuucuaaaauucauuaaaugcauaagucuugcuguaaauuucagucugagcagacuguggauuauucauguuuacaaguaaacuucaaaaucuuuuuuuugacaagcaaaguuugauauguucaaacuuuuaugagucaguauaucgauacugacucaaaauaaugcuuucugcaauguguucauuuuuuaagauuuuaacugaaauuuuggcaguagagauuuuuacuuucauuauagaaaauuaugguaaaauguggauaugaauuaggagaaggcugaaauggaagaacuucauucuuucacuugcucaggagaaacccuagagauagccuucacuucuuucauucuuauacuccaccacaauuuauuaguaaauccuauuugacuuuaucuuaaaaguagaugagaaaauuuggugaaguccauauaacaucuggaguuuaguuaauaguaauauaccaguguugguuucuugguugggagaaauggacuauaaaauuacaauaggagaaaucugcguaagggguauaugggaauucuguacuaucuuugaaaguuucuuguaaaucuacaguuauuuaaaaauaaaaacuuuauuaaaaauagauccagaguuuaaccacuuuuuaacacuccugcuaucccuaucauccaagucaccauaaucuguaacaugaauuacuaauuguaacagucuucuaacuagucugcuagucuucuuucucuuauccucccacucuucuauccccaguuuauucugaauuauaguggccagaaugagccuuuaaaaguaagucgcauauuauaauucuguucagacccccauccuuuaagaguuucccugucuacuuugucacaaaagcuacaaaguucacaugugaucuagcuuccagcuccuucucuggucuuauuucccacuguucugucacuaacucucuuaacuuuagacugucuaauuacuccucaaaugcacuaagcagauucuggccuucgcucuugguaucaccacauagcuaugugauuuguuuccuuacugucuccagauuucugcuaaaacauaacuuuacuagagaagcauucacugauuuccugaugcaaaauagcaaccuccucuuauccuguauucucuuaccuugauauauuuuucuccauaguacuucucucuaccaggcaauauauaaauacauacuaguuuguuguugcuuguuuuuacugucacuagaaugggaaacucagaacagggacuuuguucuguucacugcugaaucaccagugccuagaccgauacgaacaaacaguagguacugaguauuuaucgagugaaagaagcaguaacucuuuaauacaguuucuuguuuucacugugacacuuccaaaauagugucaaaauugaagaauuauagcauauuguuuauugaaaggcauaauaacucuagggauguuucagaauccuuucagaggcagaacaguaaaacaaaauaaagagggggagggcuagaaagcaauguuacuggacccagauagauauuagcacacauggacaaucucuaauuauacacuuuguguccaaguucauauguaaacuggagcauuuuuuuuuucuccauagaaaagauguucuauacugugguugauuuccauuaucacuuaggcugcccauguaccauacaagcaugacacuuaggugagugaaagggguugcagugacuaauuguaccaaaacaacuguccugggcaaacccagguaugaucacuuuaauuauaacucaaagaugccuucagcuucuaugggaaagggcauccugcccucugcugggggcuuggaacucuggaacacauaagcuccugcugguagaaaaaucugaauuauaauguaaugccucauugcauuugauucauccccuuuucuuuccagcauacucuacuggucacccuagcagugagaaaagaaagaaauaucuuuuccuuccacugcucuagaauuaaaaacaaauuucagcucugcuuccuuuguacccauccauuugcccacaccccaacuccauccuccuccuuaccagucccacgaauuuaagaaauugagcuuugggcugggcgcguuggcucacgccucaaucccagcacuuuggcaggccgagguggguguaucaccugagguaggggguucugagaccagccugaccaacauggagaaaccccaucucuacuaaaaauacaaaacuagccgggaguggugucacaugccuguaaugccagauacucgggaggcugaggcaggagaaucgcuugaaccguggagguggagguuguggugagccaaguucaugccauugcacuccagccugggccacaagagcgaaauucugccucaaaaaaaaaaaauuaagcuuugauagggugaaugccuccaccuuguuuauguauaaaggaguuucagugaguuacaaagaaauuuaaguuaacaaaugauugcauugcuaguagcaauuuacaaaaaugacauucauugcgacauucugaauuugccuuaugaguuaacuaucuugcaguaaucuugauucuuacuuuuguucuguauguuuuuaaacucaucuucucaguuguuucuguggauaccaaacaaugguacaauauuauaucaagauaaaucacaaauacauagaagagauugaugacuaauuguauucaaagucaauuuuacauaauuaauuuuccauuaagucguuauuugcauugaauauccuuuaagaucauuguguucuaucuuccugucuauaaaacaagcauuuucuuuacuauguuuggcuauuucagagaaaagcaaauugauacaagcauaaaauacuuaagaaaacagcccucauucccuugaaauuagcacuuauguaaguuuguguagggggguggaaggaugcggguguaguuuauaaaaaguauuuuaaguuccacaaaaucagggauacuuugagauaauauucuccccagguuuagacagcuuugguuugcaaaacaaacuuguuuuaacagcaaaaauaggaguccauuuugguucagugugcuagcuucucaacugacuuuuauuauuucuggcacuaguaucauuuguuucuuuuagaagaguuuguaagugaauuguggcacccagugggauguguguuuguguuugaauuugugaaaauauuugauaauauuucucuauagcaguguuuuuuggugcagauacaaauauguuuucuuaaaaauauggaugcuaauuuccguucccccccccucccauuucccuuucucucacggucauucucuuucccuuccauucuuucacuuucccacuccucccaccucuucugcucucaucuuauaaagacuucugaaaacuaggaauuacccucguuaaauaugggcuguguugugacuugagaucaggagccacugcucaggaggaggccuggaauaaaaucugugaguguuuauagaauaaacaucaugggcauaauucauauuuaaaucauccugagugcucacacaauuguguaugacugucacaugaaucagugcaagaucagcaaauuuugcauugucaucuuguguuaggguaauaugguauuuaaauuuggacuaaguggcccuuuuauuagaguaaaaaauugagucaugguauauuguuuuuccagguggguagacaaggaugucuuaauugucugaaggucaaguuugagaaaaacuugacauuuuguccauaaguaggaugauauuuaucaaaaaugaguauguugccucuguccccuugggaacaaaaguuacaaucuauucucuuucuuccuuuucacugucagcuuuagaucuacagacguguuaugccugauaguucagagaaagauguuuuugaaugacuaaacaaccccuuuauuauaugaguaagccauuauaggauuguuuuccccuccuaaucugugguuaucuuugucuuguaacauuguucugccugucccaagcaagaaaccuuuuauccuuccgagaacaccuucuuuuggacaaauucuuuugugguuugcaucuucucuuuuuuccuuauaaagaaucucaaauuucuuucauaaaaccucuucccagagagguuaaaugacugauuguccaagaaggagaauucagacuuaaggcccucugacauacauguacacugucuaggcauuuuguuugaaccagaacaucccucaaauguuuuauuugcaauacaaagcuacuuaugagaaaguuuagaugucauuauaguuuuuuuacagcacagacuguaaaucaccaaucccaaguaaauuacucuauuaaucuuucauucuucuagguauuggacuaaauuggaucaaacaguacaugaacuuguuucauucaaauaauugcaaagagucuauuucuguuagguguugucgcuaaccaaguagcuaccuacuugaccuaagggaagaugcauucuauuuaaucugcaagauugccgugagucagaagguauauugcuuuguguuauguuuucacaaaaguagaaaaaacaauaauucugcaguguuuuacagccacaggauaugcaguaaaaucagugguucaccaaagaugacuggacuuacgggaaaaaaaauaccgugugugaugaugauuaaaaguugcuuaaaauaaauuuuuuuugaaaaguugcuuaguggaaaaauugcaugacaauuagaacuguugagaaacagaaugagcccccucaugagggaagugugcugcacacucucucuacuuuagaugccauucucauugaagcaagggauuucuccccuuaguggaagcuugggugaaacagaucccaaggccuuucaagacacucagaagcucauaauucuguugauuacucuacauuggaaaguaaucagaagcagaaaacaacauauuauuuagcagagaguuauccguuagcaugacaguuacuuuuuaaccauuuuuauuuuauuaauuuuuuuuuuuuuaaguugagguauugcuuuguugcccagucuguucuugaacuucuggccuuaagccauccucccaccucagucucccaaaaugcugggacuacaagugacaguugcuuuuagagugggugcucugagauauuugaagguccuugagaauaguuguaucucuuuaguagcucuaaaaccuuucuaaccuccuaacaaauccagccuuacuugacaucucaaaagcucauuucagccagacuuguuuuuuuuuaaacugucaaugccagaauaacgggguuugaauuagugaaaugcugcauuacuucagcugaguuccuuuauuggugaaaaagaggcucuggaaucagaaugucuggguuugaauucuugugccaguuauuuaaacccuuagagcaauuuccccauuuauauaaugaagguaaaaauaguaccuauuucauagcacuguuugggggauuaaaugaaguaacgcauguaaagguaccacagcuaaaguuaaacaaccaauaaaaugggauuauggagccaggaagagguuuugccuauuucaagaaaacccuaacccaagaaaccauagaaccauaaaguuucuaugaagccugcguuacuguguaugacauuuuaauucugauuuaaaggaaaagagacuggcugcguuuagucaaucuaagcugguugucugacacacacauuuccaaaguucuaauacauguauuuuuuaaauuagacuuguuguaucuuagcucuuuaucucuauugagaacuuaaugagucaugauuugaaagugcagauccugguaggaaccagaagguuugaugggucacaagcuugugaaaaauugcagguacuucuaaucccauuuuuagaacucccuguagccuuuuuuucugucauuauagaagaacaguuucagggguuguaaacuuagaagggucucucagcaagagauuuguuguugaaucuuuaagcucucaucagaaugccuuuuguggcugcugauguguuaagugcaaagaugaagaguagugccuguaauguacuaauguucauccacaacaaaugaccagguguccaggagagcaguuagaaaaagagaggaucuuuguuuccacagaaagaaucuaaagcuaacaucuaauauaauaacuaaggucugcguuggcuuuccaguucaugaagcacuuucacguuucgcgguccuguugauuagcuucuuacuacugcccuuuauaaggaggugguuaccguugcacuagcaggaacuggagauacucagugagguuggaaaggccaaauaaugaaacuccgggaaguaucuguggguuucacuguuuucauacagaugaugccuagcuuauaagacugugggaaccuaacuuagagugacuaaggucguuauguacacuagagcaugugauguucuuccagguuugcacgugaagaaaauagaaccuuggagaauauuauauguucuccgagaauguuagguugaaucuuugaaaaguauuagguugaaucuuuaagaaauauuaggucgaaucuuuaaaacauuacugauaauugacuauuucuugauaaaaacaguaauaucacaugauagguugaaucuaauaacuauuuguguauuucugauuugguguugauuuuugugauuugacucuuagaggauagucuuuuuuucacucauuuuuagguccauugggauuaccuuccucuuaccauguuauauaugacauuuguuauuuucugucaucaaaugaggagacagaaggucagacagcuuaagugacucgucuaaaguuguacauaaguuauguaccaggaaaaaccucagacuucaaaccuuuuuucccucuaugccacaucagcagacaaaauggcgaggggccuuuggagccaugagguaugaggaacaguuacagaggaacuauggauauuuaauuaauuuggcucagaaaauacuuaggaagggaaacauugacuuuugagacacauagaccuggauuaaaacccaguguauugacuaguucugugaucuugaacaaguuucuuaaacucucugagccuaaguuuuuuccuuuguaaaguggagcuauauuaguaccucaacucuaaauuuacuaagaaguaagugagauaacacuugugcaucaccuguuaguacacggcacuuacagacuuguccacaaauuauuucccucucuuaccacgcuuuucuagaagagagaaaucacauccuuuuuuugauuaucuuagaagucauaucaaagaccagcauauggguguuaaaaugugguagcuuuccuugaaguuuuuagagagauuuuaguguugucuugccacuacuacuaguaguguccagauaaaagucaaaaaccuccccuauaaaggagauucuugguuugauagugguuaguccagcugaccucccaaaccuuuacuacuucuuggguucuuugaagaaauggcuagaaacacagagaacaaaaggccaaagcuuggcauguugucuucauaaacaaucaaaaauauucuggaaaauucaaaacucugaauauauagcccccauugugaaaagcaaaaauggaugaaauccucguugucuuguggcuguuuuuauagacuauauuuaacuuuucaaaagaauguuuucagauuaaagcuugguacaaacuugaauauaaauuuaugugguugcuucauauuuaugauucuuugaaagucaucagcaccauuugucuuuuauuuuccaugaucuagacauuauucugggaaaguaaaacaucuaguaaguuguguauauuuauaguucuuuaaauuuauguaauacuuuugguuauagacagcacgaguggaaucucauuuuaacgaccaaaugagauuccagaaguguuauauccaaaucucaaucacacuuagaagccuauuguuacagcauaguugcuguaaagaacuucauugaauuucuaaaauauuuguacaaaucaagcuuguguuagauauuuauuguguuaccaauaacagagcgaugucgguuaugcaugauggauuuggaggaugcggggugccuuuugaagauaauuuacacugucuacauuugauauguaaaagaucuauauuuccuaaucuaaacuuguggaucugaguagauacagacuucacuaugggaauccuguggaaggcacuuaaauagcucccuggcuuggagaauuuugucuugguaaggagaggguagaaacgcacaguucccauuugcuuugccauuuguuguagcuuuccaaaucuggcagaguuuaucucaucauuugaagugaaacagucuaggcugaggaaaauaaguuuacaucaagaaggcuuauuaaggcacagcuggauggggcuagcaaaugugucuuuuuccuuuucuuuaucuugcuucuguuuguaccuuagugauuucuuuuucccucccuccuuccuuuucuuucagacgaaggaagacauuuaaaggaaagguuuuuuuacaucuacuuauuugaaaauaauuuucaugacaaaauaccaaauuugacugucauugaauguuauacaaagauaggcauauuggauuuauauacaggacaagauauuucaguguaaugacuuuccauuuccaaauauggaaagguuuuuaaaaagaaaagauagauuggaccaaaauuuuuguuuguucauguguuucucccuggaagaaaaggcaacucagcugagaugcacugaaguauccucuugugaagaacgaguugccucagugaacuggagauuacaugucaaaaguuuauuuguggauauagauguguaccacaccaucacuacagcaacagaaaguuuucgugucuuuuuucaccuauuuuuuguggccagcuacuguuauuuccacugaauuaugauuuuuauauugguuuucuuuucuuguuuucuuucccuaauguggcaauuuaauuuuccuuuugaaauuaaauuaugauuauuuaaaaaauaauucuccuuguuuuugccacaauaacccaucaagucuuaugacaaagacuuccuauaauguuucacuugguucuuucuuuuuuugacauguuaucaugggauucucuauauuaaagacuucuuagauuuauuccagcaugaacugcuguggugaauacuugccuuccuuugucauuugguugccaaggccauauguuagugcaaagaacuugugcauuagagauuaacauaguuguuuuuuuuuucucaguuugaaaacuuacuauguaugugaacuuagaaagauuauuuaacugcucaacuguaauuuaguggccuaugguagugaauagccacuaaaugcaacugaaauacuuuugcuuucguuagcuuccauaguguuccacauuuggcacuaacuagaauugaggauagaacacuuuuuuuuuaccguggaaauuuucuaagucuuuuuuuguuuuguuuuggagacggagucuugcucugucgccaggcuggagugcaguggcgcgaucucggcucacugcaaccuccgccucccagguucaagcgauucccgugucagccuuccagguagcugggacuacaggugcacgccaccacacccggcuaauuuuuuguaauuuaguagagaccggguuucaccauguuggccaggaugaucucgaucuucugaccucgugaucugccugccucggccucccaaagugcugagauuacaggcaugagccaucacauccggccgaaauuuucuaagucuucuaaacauuuggauucauuauuguguagauaauaagauuagcuguauucuuacaaagauaaacagguagcuuccuauuuauauaaauaguguauacuauaguuuagauccuucuucaaauuucuguagugaaauuaauauagguauaauauaauuuuccuaaaaugguaauuucuacauugcucccacugauaaaauauaauggauaagauuugcagcagauuugggagcacuuaguaacacaugguuaugguauuuggccuggcuauuuugauacagaggcaauguugaaggccccaaaagacaaagguccuuuauuucaccuguucuuauuaucaaguuacuucaauaaguaaccuuggcccuaaucugaugacucucaccagcucuggaugggugacauuagaaauagaauaagagugcuaucugugcacaaaauuuuacuaauaaaaaaugaauuauacauucuaaugggguuauuaugacauggcuucuuuaaacaagccuugucagaaugucccuuauuaccagguggccauaucaaaauguucuguugcuucuuaaaccuaucaagaccagguuuuuauagauauuacugcauauuuuuucagcuuuaagacaugauguuaaaaaaaauugcuaguaacuaaaggcaauuuccuaacuuuuggauccuugaagacuaguuuugaauaacacuccauuugacaaaauacuuucuuagcauuuguauuggucaguuuaggcugucauaaaaauauacuucagacuggauggcuuaaauaacacauuuauuuucucagaguuuuguaagccagaaguccaaguucaaggugcugucaagauugguuucugaggaggacucuguuucacccucuuacuguguucugacauggccuuuccuuugugcuugugcagugggggguguagaaugauacugaucuggugugucuuccucuucuucuaaguguacuaaaccuauuggauuaggguccuacccuuauaaccuuauuaucuguuuuaaaggcccugucuccaaauacagccacauuggggguuagggcuucaauaaguuaauuugguggugggaguugggggacagaaaauuuaauccauaacagcauugccuuauguguuggauauguaaaaauuaauuagacaucaucuuaaucucugaagggcccacuuucuagcucagaagcccgcuguguaaacagauuaucagaguauaaucugguaaauaugauagcagauauauucaaaugacagucucauuuuagcuggguauugaaaaaaauuguaggaguugauguguacaaggaaaacguaggcacuucggcaaaaggaaguaacaucguauacccuaggguugcucuguagcuaacagggaaccucaaggagcauuuaaacaggaaaguaacauaauccgggucauuuggcccagacuugagacagauguggaauuuccuauuuccuuaaguauguaaucaaagcuauuauuaccaagugguacuuaaagcuguauuucuagaaaagcuuucuucugugcuauuuugaagucuugcugcuauugaccaugaauuuuuuauuuuguagccuaaggcauuuuuacauuguucucucuuuugacugaccugaaaaaagccuuauuuuuauaaguaccacauauuuauagacagacucuuaugcaucuuuuugcuuucucugaaccaaaccauacguauuguuuaaaacuucuccuuaaucauuuuuaaaauacucuuuaaaccguuucuuaaugcgucacaugcauugugagcacaaaauuuuacaguauuaaaaaggauucaguauuuuauccucuagaaaccuuuguaaauagucaaaagcuuguagcuuaaugguaauauucccccuccccuccaagauggggaggcuguuaaguuuuaugacugcccuccauaggaugauugccuuugugcaaguuuuucucauagaucuacuuagugauguggaaguccuggauguaaauuaaagaugaguaagcacagugugaucauaauggcaagccugcuauuugagguaaagcaaucugggaaaauaagccuuauaaaacaaggucugucuauuucauaacaggauuauaguuuggagaguguuaauccuuucaauucaguaauauauagaugguucccaacuuaaagaugguuugacuuagaauuuucugacuuuaugauggugugaaagugauccacauucaguagaagccaugcuuugaguacccauacaacccuucuguuuuucacuuucaguauucagugaauuacaugagcuauucaacacucuauuauaaaauaggcuuuauguuagaugauuucgcucaaugauaggcuaaugaaagcauucugcacauguuuaggguagggugggcuaaguaugauguuugguagguuagauguguuaaaugcauuuucaauuugugauagguuuaucaggaugcaaccccuuuguaagucaaggaguaucuguauacaguaguccuuuugugauaauaagggacauauuuuagauaaauagucuauauagaguuccuaaauguaauuuaauuaaaaaaauuuuuuuugccaccacucuauauggugcugaccaauguugcuuuaucuuaugguagaauauccuucaagagcaaaccaguaggagaucccuaacaaauaguugaauugucaggucuaaauacuuuuguauuuuuaaacucuguuuacuuccuauuggagaagugaauagcaucaggguugcuuuaccaugagguaauuaugaacuguggggaaaaaagaaaauuagaaaagcaucccauccuccauaaaauagauuagauaaucacuccaaguaacuuaagaguucucugaagucauuuucuugcuuuccuauaccauaaaaccuacaugaaaugguguuuguucaaaauaugcccccacaccuuuacaucugggaacaggcagaagcauucacauuuucugugcucauuugaaaagauaacucucgacgccagggcauuccauucauguuauaauccuagacugcuuuauucaugcuuuaauuccacaucugucucagaaauggaggcagugguuagaaaagauugagcaccuagucaaugaauguugggcugaaaugagcucagcaaucuguuugacuaaagaagacucguguuuaauuccaccuugugaagaaacauguuuuaaaaccccauaacaacuucauggugacaucuauaauguaagcaguuaauccucuauuguguagauaauaagguaauuugaaacaugcucuuaaguuguuauauguaaauagagagucaaauuuauuuauuuucauugauggaugggaagugagacuuaacaaguuucuugucuguguuaacuuuuguuucuauuucuguuaguacuuuaggaaauuacagagaagugcguuucaguaaugugcaaaaaugcucuuggaagaaaggacauuaaacuauacacgauacuaugcuuuuugcuuuugcugggccaaugauaugaccuugagcaaaucauuuaaaaucucugggucuucaacauuuccucauuuauucuuaaaauguugcguccauauccaaaguucuguuauucaauaaugucuuuguccauucguuccucuuuuuugcuccuaucauuucaaauaaugauuaucauuaaaaucauuaaguauuggcuuuaaaggagcaggaaagggauauguuacgggguuuuuccccccucucuugacaugcuuucucugcuuaaggacacuuuguacuaauuuucacuaaaacuugagaugagagacuugacugguguuauuuagguggcaaacuggcagaaccagaucuagaacccacuuccugguucguccuauauucaguagaccauauuaccuaugaugauugcuuuugaaguuauauuaaaaaaaucacugacagaaucucugaaauuacuacugagaaaacaguaguaauucaagauauuauuuuuuguuauaucauauucuuuccugcaucugugccuuuccaucuguuaccacgaaugaaucgucccaacugcaguuuaaggccagccucucuauuugguugcuggaucccauccucucguuucuccuuggggauuuuguuccaggauuauaccaugucucuuuuguauuagcaauuucuccgucuuuaccagaucuucuuauuaguaugcaaacauguuaucucucuaauaaggggggaagucucuuucuagagucugcauucauccucaguuuugucacauugauuucccuuuauaguaaaaugccacagaauucuguaugcuguuauuaccacuuccucaucucucaucucuucaggcuacuuacucagcauguuauaccuccacuugaccaaaaccugucuuuucacaaucagcagcaacuucugucuuaucaaauacaguggucaauucugucuuuauuuuacuggaccucucagccuuugacacaguugucuguucucuccuugaagcccuucuucaguaaacuucaggauauaaaguucuccugauuuuuccauuuaccucccugggaacucuuuuuccaucuucuuuccuaacuucucuucuacuuccagacuugaaguuguuggaaugcuucugagcuuaguccuuggacuucuuuuccucucugucuucacuugcuccuggaugaucucauccauuuucagccuuuaaauaucuuuccaauguugaugaacccuaaauuucuaucucuagcugugaccucucuccugagccccugguucauauauuuaacugccuacuuaauauuuccacuugggugucuauuaggcauuucaaauuuaucacaacuagacaaauuuuuuauuuacauaucuucauccugauuucugcuaaaucaguaccucuccaagucuucuccaucaugguauaugccaucauuacucaccagguugauuaggcacaaaccuuccuuuaacauaccaggcacauggcuaccucugggccuucacacuugaugaucccuauucuagaaagcuuguucucccccagucuacauauggaccauccgcacucugccugcuucccuccucccuccuucguuucucaccuucugccucuuccccuccucccguaacuauugauggcuaccuaccaauuaccugcuaauuaauauuuuuccagccuugauguaggucucugucuucauucaucucugcucuuucugcccuucuguaacucagaagucacagcacuggaucguaucucagcuuuuauccuacucuacauucuccucuuuuaugaaacucuucuuccuugguuucucuaacucucuauccccacccauuucagaauuauugaucuuauugguucaguuaucuaauguuuuguuuucucuuuugcugcuugagaauuaaauaaaguuugccaucacaguucuuuacuucuuauuguacuuuucaaagauuuucccccuuaacuucaguuaugaucucuucagagcugacuuccaagucuuaugaauggagccccaccuuucuuuugagucuuucucaacuucuacacacgaauguuuugauaagcuucacacauuaaacauauuuauaauaugacucauuuuuccucuacagguggucuuuccaucaugauuuugugaaauuuaaugaaauuaccaaaaacacgaaucaagcuuuuuugagucuucccccucccucccuuuuuauguccaaauuccauuuacagacauucuaaucuccacugcuuuaguuuaauacucuuugucacauuguuuguuuuuguuguuguugguuucauuuguuuguuaaugugacuaaugacaguaagcuuccaaauggccuucaguguaucuuaaugcccccaugucacuaccaguuuuuucucaaacucauaucuaaucuugucauucuccugguaccucuaguagcuccucauugcacagugaauacaauacauguaaccucacagugugguaucauaggccuuccgugauuccaucuccauucauugucacuuuuuuuuuuuuuuuuuugagauggagucucgcacucucacccaggcuggaguguaguggcgugaucucagcucacugcaaccucugccuccuggguucaagcaauucuccugccucagacucucgaguagcugggauuacaggugcccgccagcacgccugguuaauuuuuguauuuuuaguagggacaggguuucggguuucacaggguuucaccacguuggccaggcuggucuagaauuccugaccuugggugauccacccuccucugccucccaaagugcugggauuacaggugugagccacugcguccggcccauuuucacaauuuuaauggcucauuaaauuuccccugccucugcccccauuuucccauacucugcuuugcagguaguaagauaaaaugcuuuuuaauugaguuaaaacuaacagcauggaaaaauuuagggauguacaugauaacaaguguaauacucccaaggauaaccucuggggccaaaauuuaagaauaaucaggcaauucagcuaagucacuuugagguagaaaaucuucuauuuauuacacauagagguguagagaauuaagggaaaagauuuuacugggaaacugagacuugagcugauccauaaaggaauaauuggauuuggacaugucaagggaagaaggcaaaauucaagugaagauacagcagugggaauagcuuucagugaacuaaaaauuaauuuacccauguauaauaccagguuuuuggcauuuuauuuugagaaggggaggggauaaggggaaggguauaugauucauucuccucugauaucugcauaccacuuguuggcuucuguaggugggaaguagcauuuguuaauuucuuguauuugccaggcgcugugaaagauauuuaagccucagaacucuaaaaagcagguuguuaaauccccauuugcagaugagaagauaaauucagaaagcuuagguaaaauacauaaagcaguaccagagcuaggguucaaacucagagcuuuuagcucuacagucugucuucuuccucugaaaaauuaugugcaaaugcauuuuuuuccauaggucauugucaguggccugugaaaauucauucuucauaccagauuuuuggauaauagaauguaaaaagccuccuauacccccuggaaaucugaguucuucuaaaaggccuuuugaauuuugccguugaaaauccauccucauuugaaugcugccuguaucauugcuuuacuuaucagucaaauucaggauauaagauaccagaaacaaaguagcuuuuauuuauuuggaaugaaacaaaucaaaaccacuagacaggagauaagaaagauguuucuucaagacaaacaagcauuuuucaguuauuuaaccaccaaguuaaguuugaaucuguguucuugugucguuguuuuccagcaaacauuauuccaugagucauauaaaacuaaucucauucaugacugaucucacccauugcuaaucucauucaaaacugguuucaucaggcgaaaauucaugugcuauucuggacauuuguagguuauccauuacuuuuaugaccauuguuuuaguguaaugaaacauuacuguauuuugucuucugggcugccuuagucaccauccuucucuauucuuccucaacuaaauauguaacucuuggaaaaugguauauuauaugaaaacacuagaaauggaauaauuaacuccuuauuuccauguuguagaguuuggaaauaccuacaaauuagaauauuuuuaauagagaaaaggaaaauugggguguuuaucuauaauuucaaucuucugaaugggaauacuuuauugccauguuguacguggcccauuuagguaucauguaauauuuuccuuuauccaaugugauagucaaggcuauuaauaauagaauagagauaauuaauugauauuuagaaauaaguaccuauuuccaaaacagaaaaguaagcauucuuuuuuuaaaaaaccuuagaaauacuuuuuucuuuuauauuugucuguauguagaaaauuaguugcuugggaaagaguuguuuuuauuuuugcuuuguucuaguucugucauuuuuuuuucuuaaaaaaaaagaaaaaacugugguacagcaaguuuguuaacgcucugagcagauugcuagugaauucucuugauguaagaauaaacccacacuaaccggaaacucauagucugcuuaaaaaaaaaaaaacaaaccagaaacaccacugguuagaaauacagcuuuuggccagaugcaguggcucauuccuauaauuccagcucuuugggaggccaaggcgggugguucacuugaugacaggaguuccagaccagccuggucaacauggugaaaccuccucucuacuaaaaauacaaaaaauuagcugguugugguagugggugccuguagucccagcuaguccucaggaagacugagacaggaaaaucgcuuaaaccugggcaguagagauugcggugagccgcgaucacaccacucuccagccugggugacagagcaagacucucugaaaaaaagaaaaaaaaagaaaaaagaaaagaaauacagcuuuuuucccccccacuuucuaguuacuaaauugcccuugguuuuuauaguguuuucaaucagaggaaauggguauuacuugucugagauaguguucuuaaugcuuaugagccguauuuuuuagguuagaugauucauggauuuuaauagccugccagucacuucauagacaagucuucuuaggagaggaauaaugacuauaaugaaaauaaagauaucaaaccauuuauauuauuuuucuggaggccauaaaccauaaaaaaaaccucucuguauugaaugucaaauuaaauuugaauaagggguggcaauacuauucuaacaugaauuuauugguagcaugucugcacauaccauggguggcuccaauuaucuuaauacuuauacuuguucaauauauauuccccccuuccauuagcauuguaguuauguuggccaaagaguccccuaaacuucuuucuuuacuauacagaagcccaaugaugaucuaaguaaguaaaauauacucucuucugguuguaaaggucauaugccauuugcuuccuauagucagauauaguuguuaauauuacuugucuugacuauuucuauauauucccugccuaacuucucugcgcacacagacuccugaaagacuguacagcuguaccuguauuuuugacuagggauuaugcugcagaauaccuauguccuuuccuaauuggaugagauuggcuuaaacuaaagcauuuuacuaaggaugcugcauggaugugcugcugcacugguaauagacuagacgugggauauacauauugaugugucugacaagauuuaucaaauucuaucguuuaaaaaaaaaaaaccacuuuuuuugaaagcuaaccaauagacccugguguucaucuccaugguugaaaucuauuuuucugcacuacaagguaguaugauuuagugauaagaacauaguuuguagcuagaagacuugauucuaguccagaccuugcccuuuuaccaacagcauggccaagguauuuaauaucugagcccuaguuuccuuuuuuauaaaauagaaauaaaggcccaucaaauagguuuguuugagaauuaagggucaguuuagugaaagugcuuuguaaacuguauugauuauacagaugucagaauucuuauuucaggaucuuacaguguuuccagguuaucuuuuucagcuuuuauuauuacauaauuuguagaugucauaaucacaggagaauaaagcugaaaucuguagugauucauaacacauauugcuucuuucaucuaaaauuuuaauguccccaaauuuuaacuuaauugacaauuccaguuccuuauguuugaauaauggaaauuuuauuuuauuuaugaccuagaaguacugucacuguauaaaacucuagugagggauucccacaauggaugaaagguauuauucuuuuaaacauuauucuuuuuuuguugauauuuaagguuuuugaaauuuuaaauaauaaaaccuuuaaaacuaauugaaaagguacaaaauaaaauuaucaucuguguucccacuaauaucaaauguuaacuuuuuuuugcuucagauuacuuuuuauuaaggaaacaaaauauuacugaaaaaaacuuuugccaaaguacggaugaccauaauaaaugucaaauucuguagcucacauuguaaguugaauuacagcaauauauggagaaacuuuaaaagguuauuuaaucauagaauagccauuuaccugugugcuuuuaugguugcuaugagacaaguagaccagaauuacaaagcaaacucacaauuuuagaagacagagccaagaaugaaaaacaagcaugagaaugagaaaauguuuuugcuuugaaguuuggcuugaauagccacaucauaaguauaaaugauuguucuggcacuuugaagcauuauaaagaaaaugcaaugcaacauaccaauucuuuaauaguuuucaauacuuaaacagguuaaggaauuucauuucuuuuguagcagagauucaaaaaauguguguugaauauccuuauaaagauaaaaaagcauauagaacuugauauaggaccagauaauacggaauaaaccaacagaucuuggguauuuguuaugguauagaugcauggauugccuuagucaaaggcuuucccugagaauuucacuauucugaguauuugguaguuuuacugugucuccuauaaggauaaaugcagguucauagaaaugucuuagauaaucauuaucgauuguaaaaaugaggaaaaaauaugaaauauggaacccacauucugugccuauacgauaauagccuauaaguaggcuauuaguugaggaauucaucuaugauaagcuguagcucccaaccguagcugagagagagacuucugcucucuaguuacuucuugggaauaacaaauggugucuguguaguaggauuuaucagugguauguugcaaaugcccucggcuauuccuauuccagagccgcuacuuugcucucaaguccucugaguguuaccugguuccuguagugcugcagcauccucuuuuucccccauugcuucaacaugguacuugcugcuagaaugaguuuuucaaaugccacuuaaaaaaaaaaaaaaggccucuacccugcauagggguagguucagaaacccguggagagcuccucauucauuaaacuacuuuuuucaacguaauaugaucuuacccuacaauccugccagaaauuuacuuguuuauuacacugaguucuauuccacagagaauugggggagcaugugagaacauuuauaauaaaauaauggguaaauauauuuagaaaugagggaggaaccguggaaauacugacauaaagagcugaagguugagacuaaggaagaaaucccaccuguacaugccaugccuguagcagcugagguuaagguuuagcucugaacugcuagaugugaccugauuuucugcuuccccucccagcaggcuucugcucuagugcaugcagccuuucucccugcucucccucuguguucgagaccauuuuugugugugucuacugacuaucuuuccaucuaccacuuaguuuuuaaauuuugucucaaauccacguccugccucuuaugaagcccuuguggaacuccuuugaccgcuauagcaguuacacugacugugcagcaauguggggucuucauuaagcauuuuggugacaggaauuauguuuuaggccagcauucucaaaaagauuuuaagcauuuugaggaauuuuuacauuuuuaaaaaacuaaucuuuugguuuuuccuucauucucaucauccugcagugguuccugugcucccaacuuucuuccagacccuugaaagaucauguuucacucuccuccugagcccuucacaggcgcugugcagggcugagguuauaaccuagccaaugaaaucaugauuggcuggcagauaauuaagucugucuauccaguugacucuuacaugugcagaaagcauuuaugaaugaacaacacauucuuucaauaauuagaacuuuccaucguggaccuucucaaauuauauaugacucuguggauaacuuagccaauaugcaaagaaaaagaagacuucucaaaaaaguguuccaauucugcacuuucuugccucaaaguauaauuguaaaucaguccccaccauaaugccguuacucuugacauuauauuacauauugugguucaggaaugaaucucaagucagcacgaacccgguccucuaaaguaugcuacacguauaaaauuggcugucugaucacccauuguugucauaauuuacacucaggauugugcuaguugaauuugugagcagcaggcauggagccagaauucuccagaacacuuuguggggagggcaccgggaagagugaagagcuaacaggguaguauaaaaaucccccuaaaauuagcaaagaugaguuucucagaccuaacagcaguauccucaauuuguuaguauuaucgauagcuucuuaaugucuccaaccagaaaacugagagaccuggaaagccugcacauggaucugggaauaugcugcauugucuuaugcuuuauguaguagucagaacagguguugcuguaguucggauauuugacccuucaauccucauguugaaauuugaucgcccccgaguguuggaagugaggccuagugggagguguuugggucuugggaguggaucccucaugaaaggcuuggugccauccuggugguaacgagugaauucugaguucuugcucuauuaguugucaagagagcuggugaaaagagcuggcaccucccucccucuuucucuggccuccucucuuaccauguaaucucugcacaagcuugauccccuuccccucuggaggcggucugaggcucucaccagaugcccagucuuccagccaacagaauugugaaccaaauaaaccauuuuucuuuagaaguuacccagucugaacuauuccuuuauagcaucacaaacggacuaagacauaugauuucauauccuuugccauuaauauuuuuaaccucauuuguugauguuuuucuucauuugcauuauccuguaguaaugcccgugcaaucagcguuuuuaaagacauaccugaaauaauuauccuacauauauauuauuaauuugaaaauaugugaguacuauuauuaauagaacuagugaaaaauauauuuaaaaagggguuucuaaauucauaauaguuuuugucauuguauauguucucagauaacaaguacaauuaucauuugggaugagauggggauugacgaaucuauaccauucuuuuaaugaugaaggaaguucuuauuucuaaaagguuaauaaccuuggacucagaauuuaguccaaguuuccuuagcauguguacaacuggcccuuacuauuauucucaccuauccuucacuguugcucuacuaaacaaccccuguuccuuccugccucuccaucuuucccuuugcccuguaaguuccaacucauccuuaagacuguuuagaaucuuauaugugaaaucuucacaguccucuugauuuauuuuguguguauguguaugcuaauauaguagcucuauuaacagguauuuuacucuauagaagucuuucaucuacugacauauagcagaugaucaauaaauacuugcugaagaaaggaaggaaaagaugaagugcacaugacaguucauuaacauguauaguagcuucuuaauauagugauaguuuaggauugauuugaagauuauucauaucauugacuugguagugcagauuuuggaugguaagggauauuugguuaaauugucuuuuguggaaugaauuuuguauuaacuuuauuaaaaauaauuuuauauuaaaacccaaagauuuggguucuagcucuacuaccguauuuuucuacuaauccuauaauuuucuuaucuguaaaaugugaaauucuaacagauuuucauucauucauguuuucauucauuaaauaugugcuagacauuguuauuguuaauuuuuaaauguuaacccauaaauaaugauauuguuccuucucauaauuaugcaccauguuuguguuuuccuuauagcaguuuauuuuccuuauuuuuuuggagggaaaaaauuaccuuaaaaaaaaaacugcacgaaauaaacugucuuucaaauaugucaucgccagagauuguagucucaaauauuuaucuuuaaauaauuacauauggauaggugauuuaaucuuagucuagcagcucaaugauguauggaaauucuuuuugucagucccaccgggggagcauugauugcuaaacagaauauuggggacugauaugcaagauuagguauuucuuuucuccagagaaaguaauagaaaauagaaauuucaugcaaauguaugcaguggauaguuaguuaugauucccaaguauucaucuacccaaaguaaaugucuccugugcaaacaaaauauuuucuuugauuuugucaugcugaauggaaaacugauuauauuaaauguuccccuaucgaaguccacuuguaaaugacugcagcaaacuguaaagggauggaauagagaauuucagcacuugaagguuuucacugcacaaaugaauuuuaugaaaaucuaaugaucagauguuaauuaugaacuaguuaauugguuuucuugauuaaaaaagaaaggugagagcaugagaauaauacacuuugcauguuuuagcaguggagauaguagauuggcacuuaguuuucagauaacaggaagacuaagaauuagguaauagugcaauugaaauaccuuuaugcauucucauugucuuuaaggugaaggugguaaagauguaggaaauugauaguuacuaaaacguucauccuuucuaauacacuugagauggagauucuucagcagaauauuaaaagauguguuuauacacuuuaaagugaguuaucagucuuuuuccugauuauaagccauugcuuguuaugugcuacagaucaugacuaauuuuaauguguaauucggaugaauuaaaugugaaaguagaagccuaaagugaauaauggagcagauuuaagaaaauuaucauggcauaucuuagagccauuucuuuaauuuuuguaaacacaaacuuaauucuucuguugccgaagugucaugggaaaauaacaaagucaauagaauucaaaaugcaaaacguuaaaaaugguauuuugcucauaugggcauacucuuuuguguucuuuuguaaaauacuuugucauaaaaaauuaaagccuucaguaaaggacaacuaugugacuuuuuaauaaaauaguuauuaugaaauuuugagggcacucgggcauuuuauaacucauucucauuuuugaagaggaaaaacguccuuuacuacuggaaagaguauuauaagugauugcuuuuuucccuuuuuuuuaaaacggaaauuucucacauaaccuagguagaaacuuuuguaggaaauuggauuuguaguuggcauuugcucuguucuauauuuuagaucauaacuacuuuggacaauuucaaaauaaaaagauggaauuuuaggcaacuuguaauuuaaguucagccagguuugaaauaucugcugugauuuauagagacaagcuuugaccuggcuaauuaacaaaagcgcauacuagggccaaucuuacaaaugcuuggacaguaaaauuaacuccguuuuaaaagguguagguauucucuuaaacucuucaggaaacuuugccagagcauuacauaucaucacugaauaagugauuuuuuuuuuugcuuguacuuaaggugugauuuguuucuucugaguuauuaguucccuuguguuauauccaagucuccuuuggguauaaacucagucaaaaaaaaagcucauuagucucuuauuaagugaucuuuuccuaaacucugaguguuauuuccuagcagguauuaaggauucacuaguuuuccuuuuguugcauauuauaucaugacuagaucccaauuuaguuuucagaccauaaaggacuuauauuucuauauuucaguaauacauaucaauauugauuuuaacgucuuauaaaauuaauaccuucucuauaucuuuacugggauuuuugaaagauguaacuaauaauacaaguuuacuuaauaauauuguuguagcacuagucuuuaguaauugucaccaaaaauauuugaggaauuuuaacccaaaauucaguaguucugauuaauacagagcuaguagcagaggaaagaucacaaguccuauuuuaauagcguagaugcccagauaccaaccacauaugaggcuucuguuccaauuguccugcuuucagaaaauucaggaaaguguuuucagacuaaugaaaaguuaucagccugcugcccagaauacuaaauuguuuucuuccuuuguggugauaguuugugauuugaaauaaaccauuuaugccaaaaagaaaguuauaucaacuuccucuuuguggcaauucacuauuuaccaagcaggacuggaauguuuguauacaucgugccacccaaauguaaucguucagaggaagugacucagaacuuuaagaugcaaauuaauugaaagugacuuuaguaggagauccacuuugccgugacuguauuauccaucuuagaucauaggcguaagaauuguuacuuacauacaucuacuaugaauuguuauagagcaauucuuguuaguuauuuauauauucuaaagaguacugacaauggacaccgauacauuuaaaagcaaaacaaaugaacaagcaugcuugugaauccaacguggcagaucucuguagccccuuaaugguauuuagaacuggugauuuuuuuaaagcauuaguccuucacauauuuuuuuuuuucuuccugccaaugcguguuuuaacuguacucucuaggcuuauuguggaaggaauugguuuaggcacauuuucugugguguguuauugugagugauaauaaaugcauauacugguaucuguuuaguugccagucuccuuuagcucaggaugcuaacccauacauguuuuagauuuggaaguugucugauugguacuguauuauaaaacaaucuagaguuuauuguagcaagagcauuccugguuuuuagcagaauauucacugaguucuguuugaaaucauaaucauucuguaacugauacauauuuagaggaauucaagccaguuugguauuauacaucuguccucauaucuuaguugcuucucugauaggaaggaaagguaauuuuuauugagugccuuccuuguacugaaugcuugguacacauauaauccuuacaugauagugacauugucuggccuugacuagaagacuaagaaacuaaguguuucaguugacuggggggaaaaaaaaucccuguagagaaauaggauccaaaagagaaaaaguagaaagacuuuuuuuuuuuuaagaaaaaaaugauaauccaaauaucagcuuuuaauuaagcugacuuuugaccauagagcucuuucaaaaacuuuuuaaaaaauuucuuauuacacuuuagcugagagaaacagcuaacauuccuggcuuuuuaacuucuuuaaacugaagguaccuuccaagugacucaacaccaaaaacaauaaaccuuuuaugacuuaaccaaggaagcacaaauuaucuccaaagaggcggaaagcaggccuuacaagauccaggaccacccccaaagacaguucaaagaaagcaaaguuugacuagcugcaagcaggggacaacccauguuuuugcuuggcaauauucucuagggucucagcuucccagcugacucuccacacaaaggccugacaacugugugccccauggauggaugauuaaaggagacagugagauaggaaaucaaaagcuguccauggaagggaaaaagaucaauaacaaauggguacccaaaaaguugagucacacaaauaucaaacccauuuuaaaaauaaauguuucuuuuuucuuuccccuuuuguguuaaaggauuuacgucuccaagggacuaguuccuuggcagggaaucaaacuucuaggccgccaaggugagaguguggaauuuuaacugcuagacuacaagauggaguggcguucuuugcaaaucccgcaggggacccgaggcagguaguuugaacguacaaaggauuuuaacuuuguuuuaaaucugauuucugcuuuuuuuuuuuaagagacagucuaaggcuagccaugacacuaauauaugucuuucuuucaguuugauccucccauaaauacaaauaaggcaacugcugauaaugugaguucuccggagucuuuuucaaauacagaagucuuuuuaauucaaaggaaccaucuuccagccacugacaauuaggauuuccaaugguguauuauucuaguaucaacucaauccaauaagccucuucauggaaagcccaugaaguaauuuucuagguuucgaauaaaauuuuaccguauaagcaaaagcuguuccuagagaggguauagaagagauaguucccaugauccuccaaaaaguucacuccccgaaauaggcuaagaaagaaaaaaacucuuguugccacagaagucaaggauaacauuuguauauacagugccuccaguaucccacaaauuugugagggggcugcccaucacagacccauuaauccaugacacuggguaggcccaccuaggauuggacuuucccaggacuaaccagacaaaaagaaucgagccuuuuugucuggacuaaccagacaaaaagaaugacaaaagcccgcuauggaugggacuuaagacaaacucuccugaggucuuggcauauucagaacaaagaguaggcugcuuaauauguuacaugucucggaguucccagucuuuucaggcuggccaccagacaugaccgaaaaaucauguccccuagaggguggaaaccaagagcagguauuccuguuuggucacaaagcaagcucucaaggauguaaaauaagaugagagggacgcuuuauaacaaaugacacagaaagacagagacagcugaaaagcuauuugugggaggaaaaggaucagacaauaugaauauucauguugaaaauacaccagaauuucuacacccaagucaagucauaccaauaauuuucucccauuaaucaaaauuuuggagaaaaaaaaaaaaaaaacaagcgagauuucuaccauccacucaaccagauuccauauacagagacugggagccugacugguaagaaauacuuacacucuugcuagcuugucaggcucuagguucacuugaauguggcguccagaagagcagaggggcuuugguauccugcucacagugucaaaagaguaggggcaaauagagaacuuccccuuugccuucugaagguuuguugaaagucagcugacaaaagguagauuaauagaagaaauggcaugccaguuuauuaauguacacacauuugcaugggagucauacaaaauaugaacuguguguguuaaucucuucaagcaagccaccagaaauccuaguauuuucaaaugugcauugaacacaagaaaguucagaauuucagcugcaacuucgugucucugcguuaucucucaaucucuauuuuauucucacuuucucacuuuucaacugccuguaguuucugaucauauaaaugcacuggucuauaucaaucccuuuucucugcaguaguucuggaacuaucuuuauuggguuuuuuuuuucuccuccccccaaccccccguguuaaguuauaaauuacuuugauuuuuccaaguggcauuucuuaacauuauaauccugggaugaaauuuaugaugccugaagacagauuuuaaaaccaauuacagagaucucaagaguguauugaauaugcuuguucccauacuuuugcauuucaaaauaaacaggaaaagagggagauauaugguguugccaccuguuuauauuuucacauuagaaacacuucaaagcaugcacagcuaccuuuuuuuuuuuuuguaaaaagaaaauaaaauagaaaaagauaauagaauacaaggaagugcuuucauaugauaguugguaccuuugugucaccauaaagacaugcacagcaauauuagaauuauuuugucauccuaaacuuuaccuuuaccuggugauacaguuugaauauauguccccaccacaucucauauugaauuguaauccccaauguuggaggugggggcagaugggagguguuugggucacaggggcagauuccucauggcuuggugcuguccucgcaauagugagugaguucucaugagaccuggcuguuuaaaaauguguaguaccgugucaggugcuguggcugacgccuguaaucccagcacuuuggaaggcugagauggguugaucaccuaaggucaggaguucgagagcagccugaccaacauggugaaaccucaucucuacuaaauacaaaaaauuagcugggcaugguggcacaugccuguaaucccagcuacuugggaggcugaggcaagagaaucgcuugacccaggaggcggagguugcagugagcuuaaaaugcgucacugcacuccagccuggacagcaagagcaaaacucugucucaaaaaaaaaaaaagugugguucuuccguccuccccucgcuccuguucuugccaugugagacacuggcucucccuuugccuuccacugcgauuguaagcuuccugagaccucacuagugugaugcuucuuguauagccugcagaauugugagccaauuaaaccucuuuucuuauaaauuaccuggucucagguauuucuuuauagcaauacaagaauggucuaauacaccuggcuaaaauaauggcuuccuacuacagauauuuugacuacugagaaauccaaagauauaucagcucagaauuccagguccaguccaccuuucuaaaauacuuaaaguccucugcuuuccuucugcuaacacaaacaauggcuacugcugucacugacugagugccugcauuagccaagcuuaguauaagacacuuuauuuucucauuaggcuuuagagucauuaguuaguuauuaauaccauuuuauuccagauaaugaaucucugguacagugagguugauuuaccuaaaguugcacaaccggaaugguggacccaagauuuagcagaaguaacuaccacugcccuguauauucuucccauacaugcccaaguuugccccauacagucaucagguuagcaguggaauuguaccugguugggagacucugugggaguuaauaauccugcuucccaagcuguauccucuggcaagggacugucucugcucgaaagaagggugacuugguaccuuuacuaguuauguuuccaguaucuaccuuguaugugccuacacaguucaugucuugugucuucguuuaugcuguaccaucaccuaauugcccuccucaucaccucuacauguuccauuccucauuuacccugagcguaagugaaauggcaucuccuucaugaagucuuucuuaauaucugccaccaccaccaccuugucccaguaccagaucuagccuucuguuggccuagccucccuagcauuguaauuaugucauuuccccuguagaacauaugucacugccuccuucguuuuagaauaauacaugccccuguguuauugacuguuuuugucuggaagcacuuuuagagcauggaacauauuugguuuuucuuuguauuccccaaagucccuuaccaugcguacaucaugcauaguaagcacucaguaaauacuuguugcgugaauuuuuugcacaagcuaaucguaguccuagauuucuaaaccaagugagacaauaagcccauuguucuuucuaagauuuauguuaaaagauauuugugugauuuaaaguuuagcuuccauauguguagcuaacuuuucauuauagaauuuauuaccaagucuaaaacugugagcaguauauaugagccuacguacgucuucugagacauuuuacccugcauccuagaguacagauuuuuuaguuuugugaacauucugggguuauguuggaaugcgucuauaaauaaagacuucagaaagcaucccuuugcuccaaauaaacugcaagcucauaaacaugcuguagucuuaaauauuuuacuugcuaauaagcaacuucucuauaagaaauuuuuccucuguggcucuuuucagaauuauaaacaagaggaaagauaggccagccagcacaaauaucugaaaggcacaaauauuucauuaggaauaaccaaaauguuuuaccaccuaucuagggauuuugauaucuaggguauuaaaaaaagucauuauggaaauguauuaaauaucuuaaaauauacuagguaauguuggauucugaaagaacuagagcaaaacugucugugggcauuuaugaaauaaugaucuuaagcagccaguagaacuuguggauaacuucauuaauauuugacagaauaaugaaaggacuguauuguucuuuguguagaaagaugauacucagacauaaaaucagauuuucuuagugucagauuucuuagucuguccuaauucuucucuuaaguucuguuacucacaugaccaguuuucaugagacucgugucaggaauagagucucuaacaaagaauuuacuggggguugauugacacacagggcucuaacucaugaaauguuucuuuugaggccacagaauauaucuaaacagcagcauaaaucaagaguucaaggugugcaguaaugcuuguggccagaggcuuagggcacaaaacuucaugccuacaagcuauguuugagcauuaacaauaacuggacccagaauccugagcuaacauaccuuuggauuucuuaagagugaaguugguucuucaugacauaaugagaagaggguggacuuuggagucaaacguacugggauuucuucccagcucuauaaacuaugucauugagaaaguuauuuggccccuuuaaaucucaguuuucaaaucugaauuuauguaaugggaauauuaacacuuucuaugguuguagccuuuacccuguuguaagcuaaaaaguuaaggauuuuuuuucucucauugaauauucacuuuguuaacuuuaagugaguauaauuucuuuaaaccucucuggcaacgaugggauuugaaauugggagguguuccugaauguauugagucuuugcuugaguuuuuuagcugauguuaagaugcuaucucuucuuccuuuccuuucuaauuuuucucuuauuguguaacuagauugaccauuucagagaaauuaaagagaauuuuuacauuauuaaauaauccuuuccauuuguuaaguagaauguaaaaaaauuugcaccuuuacauuaaaaaucaaaauaaccuuaaauuuuuuuauuuuuuaaauagugauaauuuacguacuguaaaauuaaagauugcuuuggaaaacaggcagucuucaaaaaguuagucauagaguuaccauacaacccagcaacuacaaucccagcuguauaccaagagaauugaauacauguccacaggaaaacuugacccugcagacccuuuugaagaaacagaauucuguggcuuuuaauauucauaauguugugcaaccaccagcaccacuaucuaauuucagaacauuuugacacccccaaaaggaaccuaguacccuuuagcuccauuuaauucccuuucccccucauccuuggcaacuacuaaucuaccuucugucuccaugaucugucuauucuagacauuccauauaaguggauucaugcaauaugugguccuuugcgaugggcuucuuucaccuaacauaaugauuucaaggcuccuccauguuguagcauauaccaggacuucauuucuuuucauugaugguacauuuggcuuuccauaucugugagucccucauccauggauucaaacagacaugaaugaaaaauaguugaaaaaaauugcaucuguacugaacaugcacagacauuuucuugucauuauuuccuaaacaauacaguguaagaacuguuuacauagcccuuauaaaauauuauauuagguauuauaaguaaucuagagacgacuuaaaguauaugggaggauaugcauagguuauaugcauauaucauuucauaucagggacuucagcacccaugguuuuuguuugauucuaaccaaccauggauacugagggaugaccauaaaggguucuggaaccaagcccccacagauaccaagagacaauuuuauuccaucguauggguagcccacauuuuauuuaucuaguuaccauuuauaggacauuuauguuguuuccacuuucugacuguuauaaauaaugcugcuaugaacguuuaugugcagguuuuucuguggauauguauuaaguucucuuggguauauaccuaggauuguaguugcuguguugcaugauaacuuuaugauuaauuuuuugaagauuuccuauuuuccaaagcaaacugcucuuuaauuuuaagguccuuguuuuauuccacuguccuugagucauugguauuauaauauugggaaguggaagggagagaaaaaaaauuuuuuuuacucugauuuuucuuuuuauaaauggacauuuuauuuaaaaccagugaguuggaaaugacccuauucuauuagagcagggagucagagcagggugguuucaacagaagcgacugaggccucuuuacaaaaugcuaaaggaaaacaauaguuuuugguuggaaaccaaaauguucauucagugacauuccauucagugguaucaaggugacauuuuuuuuggcaagauacucugucaugguuuguaauuuuuacauuuguaggaauguuuuccccacuauuuaguguuucugccuuuuugaaugcacaugguuaauggauuuucacauucuacuggauucauucauaugcauuugucaaaaccugaauucauucaauucauuucugauuuuaaauugcuguuuauuuuucaccaaagaugagccaguuuuaguaccugcaaagaguaguuuuucaauagcucacugagagaaauggacuggguuccuacuuggagaagugaugauaaauugauggaacaaaccaugaagaauguaguaaaucaaacaugcacaugacugaaaacccaucuccucuguuuauuucucugaagauagaucucaacuaguuccgucaggguuuuuuuuuuuuccccugagauaugacaguuuuggccaaagauugaaaauguagccaugugccagagagauauaugagccuacuaacuccauggcuauuuuaugaauuauugaaauguuacucuuacccuuaaaaaauguugcauuugugcuuuuauucuguuuuucugcuucugagcagccuaagacuugcauaugucaccaggcagcugaaaccuaaaacauguucaaggcuuucagggaugaaugaccuuaaagcucaggauagucuaauuugagaccuauguucuuauuaucaguucagccccgagcaguaguaacugggaguugcgggcugcccguggacucuuugaaaguuauggcucugcucuccccacaaaauguguuauguauauuuacuuuauauuuuucauauuguuucagggguuuuguggcuuccaggaaccccagguuaagaacuccuaaucuaaagcucuccugaaccuguuauaauagauuccauacaaagaucuuuuagaguuuuaaaaaaauuucaucucuuuaauuucaaagauauuauuuauuauaagguacuauuagauuguuuaagggggggggggguugaaauccugugauccagucccaccaccugaaguuuccucuauauauguuuuuuauaguacgucuuuauauucuacuaacucacugugaacacuuuuaaaugucauuaaaauauuauaugggggaguccuuuuuuuucaauuuacauacaguacaauucacuguuugugguucacuucuauggguuuugacaaaugcauagugauguauccaucguaaucaaagaugcaguguaguuucaucaccucaaaaaugcccucuugcugccuccuccugaucuauuuuuuguagcgaugugugccuuuucuggaauuucuuaucaaugaagucaucucauauguagccuuuggggucuggcuuuuuuggguuuagcaaggugcauuugagauucauccacuguauuaggcuguuguugcauuacuauaaaaaaauaccugagacuugguaauuggcucaugguucugcaggcuauacaggaagcauaguggcaucugcuucuggggaggccucaagaagcuuccagucauggcagaaggcauggagcagaaguaagagaaguggggugaagugacacauacuucuaaaccaccagauaucgcaaagacaguaccaaggggaugguacuaaaccauucaugagaaaucuacccugugauauccgauuaccucccacaggcuccaccuccagcauuggggauuacaauucaacaugagguuugaguggggacacagauccaaaucauaucauccauguuuuuguauauauuaauccuuuuuuuauugaguaauauuuuagucaucaaacuauuuacuauuaauaccugguuuaccauguaguacuuuuauuuaccuuccucaaaaacuguggugcauucuaacauugauacuccuuugagccuuaaucauuuauuuaguuucaauuauguuauuuuguguauaauauuuuauauuuuucuaguaugauacacugcuuccuuagaugauguaaauauuucacauuucugcuuauguuagaauuuagagaaagcaggagggguccuugaggauaugacugccaaacugcuggaaugucuuuucccagugugcacacauggguugaugauaaauguuaguacaggcaccaucacaugcauugcucuuccagugcucauaacagccuugaaugguagaugucaguguucagauuacacugaugaggaaacagaagcuuccugaguucauggccuaaggacacacaacuagccauuaguggaucagaagucaaauuagugucuugugacucaucuccuauuagaguguuuauuauuguaagaaaaauagugaacuggacuuggaauuuuucuuuuacuuaauaucuuauuuaguguaauauuucucagaaaagacaagaaauaaagaugaucaauaagaugcaccauuauuuaauagggcguuaugaaauuguagcaucaucaguauccuguugggcucugugaaauauucauauauuaagaaagcaagugaguaagcaauuuaggaagaagaaugaauuuugugcaaagcagccuuagaagaaaucucauuuugcuaaaagucuuaagguuaaaaugcugaaucagaguccuuaacuggcauacugugucucagauuacauucuucuuuuauaccaaugcucagcacccaggaagugugcaguaaacaguuguuaaaugaauauuccaaguuccgaagauccuuccgguuuuggaauaugcucuuuagggcuuuugcauauucauaugccagcccuuugccugccauucuuaacuuuauucacugcaugcauuauuuauaucacuuccucauaguccuucagucaaauauccccauuguuuuggaaugaugaggaaaaaaauaagguauugagaggaaauuguguaagugcuacuuuauugacaggaccaauucuguacugagguggcguuugucugaauuuaccuguuuguuccuugauauggcuuuuauccuuccccagcauccuccauugccucuuuuuuuuuuuuuccuuuuuugagacgaugucuugcugugucccccagguuggaguacaguggcgugaucucagcucacugcaaccuccaccucucaggaucaagugauucuccugccucagccucccaaauagcugggauuacaggugcccacuaccaugcccagcuaauuuuuguauuuuuaguagagaugggguuucaccauguuggccaggcuggucucaaauucccauugccucucauccccucaaauuucuacaugguuagguggccagagcugaaauguguugccuuccucucauuugcugugucaauuguauauauuaaugcuggguguuaggaagggcagagauguuucugggcaagauccccauaauuguaggggaucaaaguugggguuuucaaguacacuucagccaguauauauuagagaugcaccaaauacauacacauuuggccauaugccaaaggaucaaguauauaaaucaguauuaacgcuauaacccaaaucaccauuauagaauaaauuucuaggaggcagauaaacuaaaaauauugcaaaauauuuuuguuaauauuacaacauuauuauuaaaaagugauggggccaggcuguuaaaauuuaacaucauggugugggaaccauaauuucucagcacugucaguugcucuuguguuuccuguucugcacaucugccuuaguaaauacauacucacuuucaguaaugcauuuaauaacaucacuaaccuuuuuuguguucauaauucagaaaaaauuuuaauuucuucucuaaauaauuuagugccuaggauuuauagcuuggggaaaucucaaaaucagucuaucuuuaacuacugaggauggucagcuauccauagcaaucaauuuuuauuuuaaauuuaaaaacuaugaagaauuaaugcauucuuggaaaguuguuuugaaguuuaguggaaacaaaauguguuuugauuaccucacuuuucuguaaaauuuucuuuuuaaucuuuacauuccuugucggaaucaaaaauaguuuauaauaaauuuuggaauuuuuccucuucaugaaauuucaaaguugacauuuugcuuuuaauucauacaauaugggaagacuuuaaguccuaaauggaauuaaauaacuaaaauuucaauucaguucuuaaagguuauuuuguuuuuaugaaugcuguauggcauguaggaacguaauaaagauaauucucuguauuuaggcuucuaauauauuuucucacugauaaucacugacagccuagcaugacuagggcaacaaauuaggaaauuuguuuuaaaaaucaggcagugggucucuaauacauuaaauauguuuuuacucuugugucccauuuauauuuggugucagacaacagacauuaccauguacuuugcugaguucugggggaauggaaaugaaaaguguguuauuauguagcauauuuuaggguguuacugugugccagguacucuaagugcuuuaccuauguuguuucauuucaccugcacagucguccugugaaacagaugcuuuuuacaaguuuuacugaagaaacgaugcuuagaaauacuugaugacuuguguuaucagguauaguauaaagaaacauguuuggucuuugucccugguuccuggacagaacacccuuaaaccccugggauuuccugagugacaggagugucucugguuuuacuuaagaagucaccuuucagcacuuggcauuuauacuaaugagguggcuuaggguggcaucucuagauagcuucaggguagaggcugguuaccagaaagaccaaacaguugauuagaggguggagcuuuuagcccuauuccccccaccucccuggaagggaaggguggcuggagauugaauuauaaaagcccuugaaaagugaguucagagagcuucugcaugggcagacacauucauaugcugggacgguggcccacccaggaagggcauggaaguucugugccccacucccgccccuucccuuguccugugccccacucccgccccuucccuuguccugugccccacucccgccccuucccuuguccugugccccacucccgccccuucccuuguccugugccccacucccgccccuucccuuguccugugcccuacucccgccccuucccuuguccugugccucuuccucuggcuguuucugaguuuaggccuccauaauaaaugggcaaucauuaaguaaaacccuuuccugaguucuaugaaaaguuguagagaauuauggaaccugagaggggccugugggaacccgugaauuuguagucuacuggccacugguguccgaagugugggcagucuugugggacugagcccuugaccugugggaucuguguuaagacacucugcaugguuauugucagaaaugaguuguauuguugggcaccuguugguaccuguuggauuggugugaagagacaccaugcauuugauguuagaaggcaccacaacaggcaagaagcagcagaggguguuccaggagagaaauagcaugcacgaagacuugagguggaaagaggcuugacuagugccgguaucugaaagaacguguuguaaacaggugucuuacauuaucacaugugagauuugaaaucuauuucagaauucuaauuacaacacagaauuggagugaucagaauuggggaaagaauacuugcaggaagacguauuaggcagcuggcgcaauauucuaggcaaaaaaaaaaaaaaggcuugggggccaaggauaaggaaaguggagauuaccacauguaagguaucauaggaaacaccugcauguuuuacaaagcuuauaaaauacacuugauacuggaaaaaacaaaaacacuguauaggcacauccaaaguuuuaaugaugagauuugagauucagggugauguaggagaaaaccccuuguguauguccagguuuguaugaccuugguaaguaauuuagucaucagaaucacaguuuuguaauuucaaaaaugggaacaauaaaucuuuuugaccuacuucauaggcuuugaagaucaaguaagauaaucuauguuaaagcacuuuguacguuuguuguaggagaaugccacaucuuauuuguguuucuugccauuaucaaaaccaaaacaaaaauaaccagucagguaacauuucuguuuugggauauuuucaccugaccuacuuguaaaugaguuuuccaacuaacuguuuuaagaaaagucauuccuguuuuaggugaaguaauuuccucagagguucuuaaacuguauuucaggaacugccaguuauagaggugacacugaucucuucauguggguaaaauacucccccuuucugcccagggcuuuaagagaggagcgugcaugcgugugugugugugugugugugugugugugugugugugugugugugugugugugugugugugucugugugugucugugucugugugugucuguaugaggaugauaggggguucuuguuuugagcaggcuggaaggguggagaaagaugagagaacuagucagugaggggguaguggugguaacuugcaacuuggaaauaugaagagaaagaagcauguugacagccagaaugcauaaucagucggccacauguuaggggauccauaaggugaaaacugcuuucuaucucuaucaaauguuagacauuuagcagggcuuguggaauugauucgcucuugauugacugcuccccagaaauagcagaaccuggcuuucauuuuaaugcuuauguggguaacgguucuagaacagcucauuuuguuaucagggcagggacaugauuuuguucacugcagcauguccagaaccuaaaagugugucugcuauacauaauaggugcuaaauaaagauuuguugaaugaagacaucuuugucuuaauccauuugugcuguuauaacaaaauaccuuagauuggggguaauuuauaaacaacagaaguuaacugcuugcaguucuagaaggugggaagucaaagaucaaggugccagcagauacagggucugguaaggacuuguucucugcuucauagaugguaccuucuugcuguguucuucacgugauggaggggcugagcaaguuuccucagaccucuuguaagggcacuaaucucauucagauaggcucuacuguuaggaccuaaccaguucccaaaagcuuugccuccucuucuuuuuuuuuuuuuuuuuuuuuuuuuuuuuuugagacaggaccuagcucuaucacccacuggcgugcaguggcaugaucuuggcucacugcagccucugccucuugggcucaagccauucucccaccucagccucccaaguagcugcaaacuauaggagcgugucaccaugccuggcuaauuuuuuuguagagaugagguuucaccauguugugcagacugaucucgaacuucugagcucaagcaguccaucugcccuggccuccaaaaaagcuuugccucuuaauacuaucacuuuggggguuagguuucaacacaugaauuuugugggggacacaaacauucagaccguagcauguuuuuguaaggcauccucucaguguuaauuaaacugcugucuucuugguuucuauauuuaagagaggucugauguguacgacuaagcuucuguguauauucucuuaaauauauuauguaccugucucagucacuuugggcugcgguaacaaaauuccauagacuaguaauuuaaauaacacacauuucucagaguucuggagccuggaaaguucaauaucaaggugccaguaaauuuaguaucuccugagggccuguuuacugauuuguagauggcuucucacgugguggaaggggacuuagcuaguucucuaguucuucuuuuaagggugcuaauuccauucaugagggcuccacccugaugaccaucacauugggauuaggguauggacauaugaaagaagagggguacaaacauugugcauuauaauaccccuguaauccauagagucuaguugauucuccuuccuuaauauuucucauaccgauccuccaccuucaucuccacugccacuuccuucauuaauuauuauaguuuuaaaacugauauccuuccuucaaauguuauaccuuccaaccacccuuucuauugcugcauuucuaagguacuaauuuaguuuccugcuaaaaugcuuaaacaguuuucccuuacuuacagcagugaguuuccagccaugguguccuaacacacugacauaacugggaacggugucaggcaaacuugucuuccauuugauuccuaaauuagauagcuacaaagauaaaaaagcuacauacccuccucacaauuugcccacaaggauauuccuguggagaaaggacagacaagaacucaaagucaucccucugcucaugugagaaaaaugcuuaucugaguguuuccucugcccuauugcuucacuaagccagacuaaggcaugagugacuauuccucuaccuccaccucacaugucaauuguguauuuaguaagaggcuaaucagagacucaaaagaaugcaauuguuugucucuuaucuaccuaugaccuggaagcccccucccugcuucaaguuguccugccuuuuuggacaguugugaggugauagauauuucagagaauauuugacucaugaaaauaagucaaaaggagguaaaaacgaggaugguucugucagcccaaaacaucugagacaaaucucaaccaauuuagaaaguuuauuuugccaagguuaaaggacacacccaugacacagccucaggagguccugaggacaugcgcccaagguggucggggcacagcuugguuuuauacauuuuagggggacgugagacaucaaucaguaucuguaagauguacauugauucaguccagaaaggcaggacaacucgaagcagggaggggacuuccaggucauagguaguuaagagauaaacaguugcauucuuuugagucucugauuagccucuuacuaaauagacaauucacaugugaggcggagguagaggaaucaucauuccugccuuagucuggcuuagugaaacaauagggcagaggaagcaaucagauaagcauuugucucacaugagcagagggaugacuuugaguucugucuguccuuuguccacaaggaauauccuugugggcaaauugcgagggagguauguagcuuuuguagcuaucuuauuuaggaauaaaaugggagacagguuugccugacacagucccuagcuugacuucccuuuggcuuagugacuuugccgucccuauuuuccuuuuauggucccauuuugguaaauuaucucuuaaaucauucaugaaaucaaagauagagacagagcagcuaagaauguccauuuucuuaccguauguggcuagaaaguacauacuucuaggcuuugcuaaaaagacauaguacuucagaauguuuucauuauggugauacuauuuuuaacuuagugacuuguguuguaaaugauagugguuuuauuaauaaauuaaagguauuagucacauuauacuuuccauaauacagguauuccacauuuuauuggucauugucaugaauugacuguaaugccgcacagacaauaugguauagcaccaacauugcagucauuuuguaggucaggaaauagcaaggccuggauguugucaauuacaagagucacauuaaaacaaauccaaauagcauuuuauccauuugaaaguaaauuuuuauuacuuugaauucguauuuucuuuauauaccaauguaaauaaacauuuauauuggaauacugaguuaagguauuuauauuaaguuuaacuuucaaauuauucucuuauuaaauuguagguauuuugugagggucacuuuauaaugcuaaaggggcauaguaaauuguggcauuauauauuaauacacuugaauaauguauucugcucaaagugucagagugcagaucucaaagccagcagagcagcuggaaauuagaggaaucgccagaggcagccacagagaggguaagccuaccucugccugaauucuuggcuaaguaccacauuguacaggcucaggggagacccauaggaaacuagaagccacaggaucaaaacagauauaagcagcuccuuacuauggauuagagucugcaguuuuaaucuaggcaaaguaccugccuguuagaauacaaauucaggaguccucaggaaacaugauagaaucuaguguuucgguaauauguuaucuacaaucuccaguuuucuacaaaaauauuagacauggaauuaaacagaagagugugaucuauaccccaaaaaaggcaaucaguagaagcugacuuagcucagauuugaauuuagcaaagacuucaaagcagcuauuuuaauuauauucaaagaauuaaaggaaaauaugguaucagugaauggaaaaauguucugagcagggaaaugguaaccauuaaaaaaaaaaaaaacuggaaauccuagagcugaaaaguacaguuacugaaauuuaaaaaauugccaggugagcucaaaagcaguuuggcauugucagaagaaaggaacagcaaaccugaacacccaguagaaauuguccuguaugaggaauagaaaaaaaaaaugaagaaaaaggaacagaaccuaugagaccugugaaguaguccaguauacaugugcuuggaguccugaaaggagagaugaaaaagagacauaaacauauuugaaggaauaauggcuggaaacuccccaaauuuagugaaaaacauuaucagauccaagaagcuugcagagucccaagaaauacaaacacaaaaccauuccuagacauaucauggucaacuguuaugauaaacaaaaaauugugaaaucagccagaggaaaaugauacuugcuuacccuucaaggaaaacaacugaaaguauuuguugcugaugcuaaaauuugagcuuuuaggaaaacaagaauuuuggaaaacuuguauucaccaauauuucucaauauuugacuuuggaaaauuuguaaccaccaacagcuucccaauacuaaaaaggcuuguuuuuuuuuuuuugguuuuuuuuuuuuuguuuguuuguuuuaaagacaucgaugguggauaacaaaugugacuuuaaaaaaauuauauaaugcaaugugucaacauuuagagaucugcauaaucuauguaauucagugaacaauuauuuuccaaguaaccaauguaugauguuacaaaaucauucacuaaagauccauucaaagugcaagguagaccaauggauuuuaauguaacaaauuucaaaaaguucauugauaugguuucaguuuucauaugacaacuaguuuuuaagaagcuauuacacaucaacguuuguuauggaaugaacaaagaauaacugcaguuuucugaaaagguucuauuacucuucccuuucccaaauaccuaucugugagaggccagauugucuuuacauuuuucaaccacaacaauauugcaacagaaugaaugcagagcggauuugagaaugcagcugucuucacuuaacccagacauuaaagagacuugcaaaaauguaaaaaaaaaaaaaaaaaaaaguucuuuaggaaauuacagcuauuuuucauaaaauauauuuuuauuuaauacaguauauuaaaugaauaaauauauuuuuuaaauuuuuaauuucuaauacaguaaaugucaguagaucuuccccauguuaacaaaagcucuuuggcauccuccauucuuuuuagguguaaagguguccugagaccaaaaaguuuagaacuguuuugagucugcucugccuccaccuucagauaguacauuccuuuaagggcaucagacgggaaaauuagaaauaucuuguagcucaggaaauuagaauucuugaguuuauggugacauccaauuuuuguuggugucuuugauuauuuucaaguaaacaauaaaauaagcugucaagugugcugcuuaaugcuucuaauccccccuccccccaacucaauuucuuuccagaccuuuuauuuuuuaccaaggacucucaccaggaaaauaauaagggacuuuugcaguggugacuaauucuuauguuuagagguuaucaaagaauguuagaguacuuuaauagugaauagcauaauagugcuagcacagucauuacuaugcuauucugaacuguuauucaauuucugggaacgagcauuaaucauuugaaaucaaaagaaucaaagaaucauugaaguuuauaucauuugguaugaagaauuguaaagaugguaacugaaagaaacugaaauuuuuuuagucccacuuauaauuuucuguuaaaugcaugugccacugcuuguuucgguuuaucugguaguugacaaaaccaaucuaccagaaauaaauuugucgugugauguucauaacauaaauguauaauaaguuuaauuuugcauuaguuuguuuuuugacaaaaauaaccaccaaaaauuaaaaacaaaagaagcccacuuaccuaccugcuugcaugaaacugaacagaucucaacuuccauacauucccucccaugcauuauugcuuuucccauuucuugguguuccuccccuucucccauucuucuuagugacucugcacuugcauuugaauuuagaagacccaucacuacaaauaagcuuguacagaucugauuauuguuguuguuucguuuuuaagagaugggaucucacuccaucacccaagcuggcaugcaguggugcaaucauggcucacucuagccucagcugucuggcacacgagaucuuccugccucagccccuggaguagcuaggacuacagacacaugccaccaugcccagcuaauagaucugauaguuuuuuaagacuuacacuuuuguggucauaaaaucagacaaauguuacuguacucuggcuucugaucuuuuauauuuucaccuaguauuuuugguaguuuugaaacuuacauguguggacaggaucacuaaaacaauuuuguaugcuauuucuuuauguuuauuuuuauuuuauuuuagagauguugcccaggcuggugugcaauggcuauucacaggcgugaucauuguguacugcugccucaaacuccugggcucaagcaauucccuugccucauccuccugaguagcugggaugacaggagcaugccacagcaccuggcuuuuauuucuuugauaauugaguugaguuacacagaaauaauaaaauagacaauuuucuccuguauuguguuuaaaggacugaauagugauuugcuuucugaaucuucuuuuauuuuugaaaugauaaggauuuucauuucuuugccaaugguugugguucugaaagucacauaagggccuacaccagaagagaaagcuaaucuguggaugucaauuagagggauauccauuggggucugcaaauaaaaccugauuauuuaucaacugacuucuucaacugcaguuucccuuauuauuauuuuuuaggccaaagaugaagaggaagccuuucuggauuggagugaugaugaugaugaugaugaugauggauuugauccaagcacacucccagauccagauaaauacagaagcucugaagauucagauagugaagauauggaaaauaaaauaagguauguuuuuacuauggguaugaaauacauacuuaguacucucacaucagucuuuuaaugaauccaaaagacauuacuaagaguucuacuccaagagauguuuguugcuuuuuuuugauaccuuuacuuagauuccuggaaauccugcugcuguuuuuuuacucauuuugcugcagauuguucuggucauguuagggccuuuuugauuauuucuauaaucccuauuaauagauaugaguaugauauaugaguuguguuuuuccuuucucuauucuuuuuuuuuuuuucuuaucuuucucugaguccuuuaugccuaaguauuugaugcacuaaaaucuguucucugcaaacagaguuaggguuuuauuuuuuuucauugucagagaacucuauuaaagauacugcuaaaaauuguccuugaauuuuaaaacguggacauuauucuuccacauucuuuuauauggaauuaaauaacaaaauacugguggggcugggcgcuguggcucaugccuguaaucccaacacuuugggaggcugauaugggaggauugcuugaagccaggaguuugagaccagccugaucaacaaagugagaccccaaaucuacaaaaacaaauuuuuuuuuaauaaauaaaauaauggaacacuuguacagaaacaacucuugacaaauuccuucacuuuaaagucuauuugcuauuauuuauuugcuaccauuggcagaaacaaaugaaacgugaugaauaauaauaugacuugcucaccauuuguuuucagaguacuauguauuagauuacauuaagaguuuauugauuucaaaguugagaauguuaaacuucaugcucaaucuaaaccagugagcuucuuuacagaagggagguacuaauaacagauagaguuaguaugauugaagggaagaggaagccugauggaacccuugaagugcuagcacaggguguuugcaguuggagaaguaggccauagagagcuauaauuuguuuuaaacaagaacauuaugaaaaggucuuaaagauuuucuuaggacaaaaugcuguagagagacagaguuacucuucauuugaaucuuaugcauauuuaaacaugaauuauuuuuuaauaggaaaauucacuuauccaaauucaguuuucugaggugaugccagaaacuuccauuugcuguuggacaacuaggugguugaacauaugagcuuuauauaguauguguaggcucuagguaguggacaucauuguuuuacuaccacaagaggcaccacagauaaaaauaauuugauuaggauuuagaaaaauauacaaauguuugugccauaaggauuaaauaauuuagguucugggcauauuccuaaucuuuaaaaauugaccucuaagaguaaauauacaugcucugaguuccuugguguauggucugagaccuagaugaaccccaguggggucagguuugcuuccccuuguguuccuauauaaaugcaccucuuuuagaaugguuuauggggucuguauuuugguagaugugauuuaauguaacauacaugacuuucagucauugucuuccaaguguuuccauguaacuugacucccuggaagcaacauuaauugguucuugcauuucugcagccauauuuugcauaucuaucuaauauaccuuuaaaaaauagucaaccuuugaaaccuuuggcaggaugucagcaguccuucugcauuugauuuauauggauuuuuucccuaacauuuuagauaguuucugggucaucuuucaucuguguacagcaggcauuucauuuaauucuucugccauuucuugcccuuauagugacauuuccaugcuaccaccuaguuaauagaacuuguucucuaguagcucauguguuucauccuguuaauuggcuguaaauguuuuguaccuagaaauuguccuuacauuuuuuuuuugguaccaacacuuaacugcucuagccucaauucccaccccuaauauuaaugucauggcacagagaaugccuugacauauuugaauugauuaauugauugaugaaggagauuuacaggguuaaaaaagaaauguaauuauaagagacuauaucauugguccuaauauuaauagguuaaaugauacaagagaugacagaauauagauggagaguuggaagaagccaaguucauacaguguaauggugaugaacaagaagguaggaguacugugagagaugacaaagcaucuuaacuuaaagacaaggguucagauggaaaguauuuaagcauuauaugaaaauuaaaacaguuuuaauuucaugcacagcuaacaagucagcauuaguggagacugggauuggucaacuuguuuuaagcugacagaaauugucuuuuguugaagaggaggauaucaacaagggcuugaucacugaugagggauuuuauuccuguagcguauauaagggcuuccuagcagguuuuuuguuuuggccugugaacacagagauugucuaaucuuauagccuccuucuagaugaaaaaaccaaggcuuuaaaggcuaaaauaacuugucugugaucacaauaaaaguuagggacagaucagugugaucuuuguaaauuaaacuaacucccuaguucuagaaucucaguuagguuguauagaauuacccugguguugagagagguagcucaggauaaugucauuugacuaaacaccuggauccauggacuaaccauaagauagacaugguuucccacccucagcauuauugauauuccggcccagauaguuuuuuguuugagaaaggguauaagcugcuuaacaucauccuuggccucuaccacuagcauuugggacaacuaaaaaugucuucagacauggcagguaucucugaggaagcaaaauugcccacaguugagaacaacuggauuagaccccagauggcagauacauauuacuggugcuuaauuuccccuguccuucagucagaguagguuuuuucucuauucacuuccauuuggccuaagcaguccucagcacagucucugucaaucaauuggaacugguacggaagguaaaaccuauuugccauuccuggacuagcaggcaggauuuggaguaaauuauaaguaguagccuacaucuguaauuucuauuuauacuuuaauuuccauuuuucucccuuuucugugguuuauuugccucaauggcaaugaaucaagauguauguaaacuaaaaccaaaauuguuuuagauaaagaaaauguauuuggaagauuguauauacuagaauuuugacagugguaauugcuguugcugcuagcauuugcauaguagcgccaguaaaguuuuucuguauucuuccaguuuggcuacacacuggaagcauacagcuuccaucugcuuaugcuucucauaagcuguaugauuacgugcuaagaucuuaugaugucagcuuuagugaguccucuugacauguucacagguuuuacuugcugugcugucucuagcccucuacucaguaauugaggcaauggcuaguacuccagccucuuggacaucaucacaucucucaguagguuauucucuggcuauacacuuagcauuuucagagacgaauucacucuuaugggacuagauagaccaauuggaaaguagcuauuaguccuggccgggcgugguggcucacaccuguaauccuagcacuucaggaggccgagaugaguggaucacgaggucacgagaucgagaccaucuggcuaacacagugaaaccccgucuguacuaaaaauacaaaaaauuagcugggcauaguggugggcgccuguagucccagcugcuggggaggcugaggcaggagaauggugugaaccugggaggcggagcuugcagugagccgagaucgugccacugcacuccagccugugcgacagagcaagacucccagagagagagagccgagcacaguggcucacgccuguaaucccagcacuuugggaggccgaggugggcggaucacaaggucaagagauugagaccauacuggccaagcuggugaaacccugucucuauuaaaaauacaaaaauuagccgggcgugguggcgggcgccuguagucccagcuacuugggaggcugaggcaggagaauugcuugaaccugggaggcagagguugcagugagccgagauugugccacugcacuccagccugggcaacagagggagacuccaucucaaaaaaaaaaaaaaaaaaaaaagagagagagagagagagaagaaagcgaagaaagcaaagaaagcacgagggaggaagggagggaggggaagagaaggagaaagaaagaagcuauuaguuccaaccuaaacuagcaugagcgaguuucuuugaaaauuuccucuggguguuucuuuuuccuuuacuucauugacacauauaaauauucagcaugaguaacacuuuuguuucuccacauggaaaagacacugucaguuggaacuaggcaauggagagccagauuuaguggagaaugacagaaucuggggucaauaguucccccucagggagggcugacaggguuuuaaagaguuuuuacuucugccuucuuucucaguucagugcauagcugcaauagaauuuaaacuaccuucgacccucuaaaauuaucagaauuguuaucuccagcacugagauuucaaaaggguucugauguggauucaacccaguuuaguuagcaugacuaaaagagaacuugcuuauaauaugguuucagggacaaagaaaauuaugugacuuuggguuucuuuuaaugagcuuuaagaauacccccaugaauaguuuauuuauccucaaaaacagagcugugaaacaggggaccagcuaaucuacccgcaguacagaaguaguuggggccagauguccaaacuccauuuaaggaucuaggcuuucaugugcuauuuuugaugacagguguagaagggagagcuugauguucucuggcuuuuuuacucuucuuuauccaucuuauauauugguauaggcuguguuuuacucuggcuuucaccucucauucuuccuuugaauauguggaauagguagaauuaauagauguuaggauuuguuguuguuguuguuaucauuggagacacaacagcuuaguaggaaacccagcucucuguuucagugggcuuugugacauucauugaauuuauuggucugcugggaacugcacagaguccuguguucuuaucucaaguaaguuuugaaagaguuuuguaccuuuugaggaaccaagaccucagauacuguaauugccuuugggcuaaugaaugauuuuucauuucaaauaguccauacaauaaaguuacaccauguucaaaauaaaaauauuuuuaaaagcuucuauguggagugccaaggaauagaguaagaaucuucugcauuauuuaaaucauauuuuacuuaagaguuaagaauacccacuugaucuguuagucucuggauuauaacauuucuuccauccauucuuucaacuaaaaauguuuuagugccugucaugggccaggcauggauccagaagauaaaacauuaaacaggaaacauaucuuuccugcuuucacaaagcuuuuuguuccauggagguuacagguagcuaaauaagcaauaacacaacagugugauggauuagugcugugguuugugcacuuggggaggcgauggugaguggaguagguagggaaugaacauggagaccacauaagugauggguccaaucuaggccuggugggucagaaagagcuuccugcaggcaguggugucuacacuaaaucggucuuagguguaaguauuaacugagcagaggggaggguaaauugcacuucuaaaaagcguggcuucuaaagugagaugagugucuuuaaccguauuccguuuaaacucuucuuucaauaaaauuguuucuuauagcugugcuucacaagcugagagacuugauucugagcauauaagauuaauuuuuguauaucuaguagcauuuaucauguuugguuuuuggccaucuucgugugaauugcuaaugaugugaaaauuugcaaaguauuaaauacaaugaaaaagaaacagccggauguuccagauguucauuauccagucaaauuaaauuuuuaauauauauaaucuuaaccuuuuucaaacaaaaaaaggaaaaagaaaaggugaugauucaacucuuacuaccuuacaucaaucuuugcuuuguagacuacauucucugaggcagguagcuuccuaaagaauucuuacauggugcaggguauuucguagauuauucuagguagcauaagaccaauuacaucuauaguuuguacugaggcuauuguccucauuuagaccugauaacuucuuuauggauugauaccuuuuccaguacagaguaaacuauuccacaucuaaauauaauuagguguucuuuuaaccuauuuuuacacaucucugaaucaaaagacuaaucaagguuuuuggucugcauguuuguucuuuuauuuggguuuuuguuuuguuucuaaaaaucuguuccauauucauuuuucuaucuuuugagugaacuugccugucuuuaaaaaugaucucuuaugugagguagaugaacugcuuuaaccacuguaguuucuccuaguauugaguucugugacaucucuuaaauaaguuuugcucaguaccuauucuaagauuuuacagucagcuucauaauuugugggaggcuuuucacuuggaaaacaauguucucagaagccauuuucauuucuuucuuguuuuuggauggagcuaaaagagcuuuuucuuagucuaggugauuguuuaaaaaaacuacuauucacugcaguuuccaauuacuugaaccucuccuucauuaugaaucucauuguguguagaaaauguagaaagagguuggcucagcuuaauuauauagugaauuuauugugugccugccauucuuuccucuuacucuuuucagcuucaggaguauaugcccccuucccauaugccaagcaacuuucaagagaaaaucucagucguuucuuauuugucaaacauuugaaaauaagaacaauauuuggagaaacuccugaggcagauuguuggggugggguuugggaaaggcaauauuugucuuaggacuuuuagagaaagguugcuacacauuggggaaggaggauguuauuuucuggggugaggacuggguugagauggggaagacacaguuugagaaauugggaguuuaagaagcuacucucuuacuguuacuguuuuugcccugugcuuucuacucuaucauuuagucaaccauuauauauaacuuaggacaguugugagccugucauuuuucagaagcgccaggaucucuaagaagggugaauagcucaggaugcuaugaggcuaagaugaaccacccuugcuaguaggguucucuggcagcugcccuaacucuggugcacugcaacuuuguuuucacugaaaagaccuuugugagugacuucuuaggauguuucuuuuugucauuucacauugcauucacauagaaugcacucaugccuaaugacugcaaacuuucuaucacuugguuacaccauaaguuccuugucuaccucccuuuuaaaauuuuuagauuguacccaugcuuagguuuuugguucuuguuugauuuuauuuuguuauuacaaguaauuuuaauggguuuuaauuuucgcuauuguaaguaauuuuuaaaaauuguuaguaaauuuuuuaaagaucguacccaugcuuagguuuuggguuccugugugauuuuauguuguaauuauaagugauguuuuggugggcagcuuuguugaagacuggguuuucuuuccuuugaagucauuugaaggacuaaugaagagugagacuaaacuguaaaacuccauuuugucagauagcuggaacauuagggacaugcuuggguagguggugaucuuagauauugaaaacuaaucagggaaaguagauugagagagaaguggaugggauguguuucugaggagcacaaaauguucuacaugcagauuagcugugagaaaaaggcauagcauaaacucaacuuguaugauguuuaauuuuuuuuuuuuaaaucugggagaagagacauaauuauaccuucuaaacugcuguggagcagggauucuuaaccugggcucuauggaugagcuuuagggaaaucuugagauuucgugaaaaaugauggcaugggugugcauguagcacagacacucccaugcaguuaacuggaugauuuaugacgagaaaaauagaguggggccaaaaacuuuuugccagccccaaauggcguuguagauauuuuacagauggaaacacauaugugaaguagugguaugaugugcagucuucugccuucuaguucuuccucaccaccaccagccuuuucugauuauuagaauucugauccaagaggaccaguuuuuuccucuccuuuugcaguuauguuuauaaugaacucugagcccaucaaucuuuucuuagaugaaauuguuuuuacaaauuuguuuuuaauacugagcagcuagaaaagagacauuaaggacaugauacauuuucacuaccgauucuacaugugguagccuuugcugacaggagaaagcugagcacauuuuauggaauguacugcaguaauuaaucuucauuaggacuguugcauggccucguaaauuaaaauuuaugguaaggggaaaagucucuggcacaacauauuugaauaccaaagugccaguacuuuaggauggguauaaagguuucugagaauguuucagaugaucacaagcucauguauuagguuuaaauuauuuaggaaaaaauccaagcuacauuuaugauaugaaugcaagaaggagaguuuuauacaaauaggugcccaaaacugggcucucaggcgcuaaauucuugucucucacaguagcuuuccacagccaguuuagcagcauguuguaaaaggacaccucaggguuucuguuuaagggcauauucacuguucuccaccuccagacacccacccuuagcuuccuugcagcuuuaucagucuuugguucaccugauuucuuaacuuagcauuccaaaggaaagaagaaaaagcaagagauugaaaagcugcucagacagucuaauaaagggagugugcuuucuuccagcagccccuuguccuugcuuuugugaaauuucugaauaggcuguacagugaugucaauccccuauuuuguaauuuaacacauacaaacuugcacaccccuaauuguacaugaagaaaugcagcugccacagaaguuaugagcucugaaaugaggcauaugccacuuucuggccgcacagucucuuguucagagucaggcuuacagaaucccccauaauuucaguugccguuuuauaacuuaauuauuggaacugucugccccagcauccuuggaaguuuagugcucacuccacuagauuguguuucuauaaggcacugcauccagcaggagagaaguuaacagauuuucccagaagauguuuuucuucuauguugccuugggccacagccauaucagacagcacuuggaacuuuuuuuuuuuuuucuuuuucugauggagucucccucuguugcccaggcuggagugcaguggcgugaucucagcucacugcaaccucugucucccagguugaagcaauucuccugccucagccucccgaguagcugggacuacaggcgugcgccaccaugccuggcuaauuuuuuuguauuuuuaguagagaagggguuucaccauguuagccaggccgguauugaacucuugaccucaggcaacugccugccuuggccucccaaagugcagggauuauaggcgugagccaccgugcccagcuggaacaucuugaaguuugguuuagugguucugauuauuguguccucgcagcccaggaagugugguuucuagguuacaaaggacauucugacuuguuuuguuuggauuuaauucacacaucauuuaaaguaugcuguuuaccagugagaggucuuccuauucauggcagguaccaaugauuaccuuccucuucugugauaauauguuauuugccccacucuuucccacacuuguaaguuuauuggcuaaaguguccuaaaagccagaaagggaauuaaaaauucaaguggaauaagcccuaggaguucucgcuacauggaauaauauaucagugaaucagucucucuccuuaugccuuucucuaucaauacauagaaauuuaaacuaugccugauccuggcaggguguucucagaagcaucuguuuuacaaaaauaguugcucuagcaggugugagauaugaauuacaugagguucugugaaccgagagacugaaugccuugcccacaugcaccacugcuuguaguuuuggaauauugaucuacacgcuguauuauuaucaacuuugcaacagggaaaguaguuuugugaaauuaagacuguuagaacaaaggcaggcuacuuggcuuuguggggaaaacuguggguuuggggauuugacagaccugaguuugaaucuuucuuuuacaaguuauggaccuuugacaaguuacuuaaucucugugacccagcuuucuucaucagucaaaggaagauaauuuuuaccuugcaaaguuacugugaagaucuaacgaggguaaaaagaaagugaaauaugacauugaauagggucauuaaugugcaguaauuauuuuaauuacuaaaagcaaaacugguaggaguuuguaaaugaguauauacauugauaggaauaaaacuuaauguccucuaggauagcuacuuuuccuuguuuuccucauugaagucauucauuaaguccccagguagcacuaggcccuauauucaaaacaguuugcaaaaauaucuuacagccugguugaaauuaaugauguagugacaguaaugucauguaacauagccuauucaaaauauggauggagaguccacguuaccaaauuggaguguaggaaugcccuuaccugucuguuuuccuuugacagucacauaauuuaggcauuugauaaacugcuaguuuaccaugugacuggcagagagcaauaaagaagagauacuggaccccagccccucauagagcguacgcuccagcaagagagacagaccauaaggaaguaaacaaaaagcagacaagagguggugacagggccuugaaaacaauaacugaugagagaggaauugggagaguucacuuuagccaagaugguuaagaagaacccucucugaggcaagaccugaagaauuauugcaagccaccucugggaggaaggaaugauucauccuaguguucuaagcaugguuugcguagacaauuauuauuuaaauauuuacccuaauagcaucaucaugacuguacaauucuguguauuccuguuaggagauuccuuggcugcuuuucaccucaucaucauucuacccaugugucuauccugauugugauacugacuucauagaaggugaugaguauaggaaacaguugcuagucuaguccauacaguggcaacucauuagaaaggagugagccagcauugaaauucucauaagaacagaaaaguggaauugagauggucugaguacucuaaaugaggaugggaaagguaagucaggugauguauuaaggggcauguaguucuuuggggauaaaaaaagaaaaaucuaauguguuuuuaugcucaauuuaauuaaguuauaauguauuggggguauacuaacucuuuuaaacuauacaucuuuuuauugacuuucugccuaggaauuuuaguuuuuacaguaaacauggagugaaaaauauaguuuucauauuucucuucacuaccucuccaauuuccccuauuaguaacaucuugcauuagugugguaaauuuguuacaauugaugaacuaauauugauacauuauuauuaacuaaugucuguaguucaaauuagaguucacuuucggcauuguauaucuuauggguuuugacaaauguauaaugucauguguccaucauuauaguaucacacagaauagcucauugcccucaaaaucccuugugcuccaccuaucuauccuucucuuuccgaaucccuugcaaccacuggucuuuuuauuguauucacaguuuugccuuuucuggaaugccauauggguggaaucauauaugcagccuuuucagauuggcuucuuucacuuagcaauauauuuuuaagguuccgcuauaucuuuuuguggcuugauagcucauuucuuuuuaucacugaauaauauuccauuguauggauguaucacaguuuguucaucuauugaaagacaucuuggcugcuuccaaguuuuggcaauuaugaauaaagcugcuauaaauauucaugagcaggauuuugugugguaauaaguuuucagcuccuuuggguaaauaucaaagggcaugacagcuagaucacaugguagggaguauauuuaguuuuauaagaaacugcuaaacucucuuccgaaguggcuguagcauuuugcauucuuaccagcaauaaacgagaguucuuuuugcuccacagccccaccagcaucuuguauugucaguauuuugaaauuuaaccauuucauaauaauuucuguaguuuaaagaaagcuguuuuuaacguuuaaaauacaguagacugugauaauaauaugcuuugucuuuucagauuuugguuauaugcuggauuaaguacuauucugccaaacaugaaauucuagcucagcauagcccuuccuuaugaacagggcugcccuuugaggaacugucuucucagccucucaaagugaagguucuuaccugagauaaggcuaauaauaauauacuuaauuuuaauaaaaacgucaaagacuauuguugcuugcugaggaccuuaaccuaacagggacccagaaccucucuucccuccaacaacauuugucccagaccccuaccccauucaguaucccuuccugagugucccagcuccccaggaguucucucaugagccaugauagcacccuguacuccagccugggcugagcaagaccguaucucagggggucgggggacaucucaaguuaaaagacuuucaccuuacaugguaaagaccaauauaauccaguuaacaucaacagaaaaguaagaucaugcccaccauggggaguuggagaagcuauaguuaacauuuauaaugcauuuaccaugcauauaucacuuauuuaaucucuccaugagguagauauuagucacauuuacaaacauaaaaauuggcacccugugacguucagcaguuuucccaaguuuuaggcaacugccaggguuuaaaucgggucagacugacuccaaagccauuuucuuuuccucuauaccagaauuuuggaaaugacauauuuaauaacagugcuugaaucacuguuaaguaacuauuuuuaaaagcagucauuucaacauuaaacagggaagggagaaaaguagauauuuuuuacauuaugccauguguacauuucagagaaguuaccuguaaaguuaaggggauaaaagguuccauggucacaguaucuuccaaauauacugaguuaaacuugauagagacgaaguuacaauaagauccaggcaccaugaacuagauguuauaaaauaccuuuaauaauaaaccuuuuaggaaacuaaagauucuucuuaaucaccuaguuacgcuuucuccuaauuuugucuucagauccugugucucaauguuauccacaagguuauuguguguucuaugccuuguggaagccuaaaagcauucauuuuccugcuuuaccagucaaauaacccucuaaaagcaguaagguuggucugauaugaauuguuuuuagugagccaacaaaagcuacuagaaucaggggucugguuuuugguuuuguuuauuucgcacagugcuuguuuuauaugucagcaagguauaaaauauaaaaaagggaucuacccuuuuuccucuaaagggcuagauaguaaucauuuuacacuuugagggauacucaucucugccagggcagugguaaagcaaccguagacaauacauaaacaagggggugaggcugaaucaucauuaaaacuugauguauaaaacaggcacugugugaaauuuggccaacagguauaguucgcugaccaggcuuuccuauuuaaaguuuguaguucacuuuaaagucuugguugaaagcuuuauauacuuugcaaaauuuaccuucuccuucucuuugaaaaugggaaccaggccgaacaugguggugugcaccuuuagucccagggagguugaggcaggaggauugugucagcccaguucaaggccaguuugggcaacauagcaagacccccaucucuaaaaagaaauaauaauaaaaugggaaccacuuuuugccagucuccagucuuugaggauccucuuccauucuccauugaaucagagauggccaaaugaacaagaugguuuccacauucucuaagaacccaguguguaguucucaagagucagggauguacuucauuuagaguagcuaguggcuucauauaaucuucauccacuuuguuucuuuccuggauaccaauguuucuuguuuuuucuaaaggucuuucuccuuaaaagaaaacaaaaguuaugaguugagaauuugcuuuuuggucuuguuuuccaucaacauuagguaguuugugacaaaaaugaaaguaauuucaauuuuuacuuuuaauauuuuuggcaagugcuguauucgcuuauuauacucuuuguugaaauauuguaucugcugguggcaaaccacccugagucuaaaguccaggauaaugaggggagauccuacuguuacugcaugucuuauggaaccugauaccuuugucuugaagucauagucauuuguuggcugugcuacaugcuguuaaagaaaaaaauucaugacacuuacuaaagaaggguaagucaaacguuauucaagggguaggggccacugcaaugggguuuuuuaguaggggcaagagauugagcucaacugagaguacaacucggacaagugagaguuacagagauuuacagggaggggucauuaauggaaaguuauuaagaaggaacaucaggguuguggaggauucuggcuaaacagauuccacaggauuauuacugaaggcaagccugcgggaugggaaauuugaccagauauuaagggugagagauuuuuguucagcugacuuagcaggauucuugcuaaaacuggacuaagugggcagaccuggacuaaagacaaagcccagucagaaagaggacuuagaauagccagacucgaguuuggucaaaagagaguaucuuugucaguacuucauugaggguuaagguuuugaugugaucacacauuuuuaaaaggauaauaguuagauauuauugcaaagaacaucaaaauuacucauuuuuauugaagugacaugccgaguuuugaucuuuuuauaaucuuaaaaguauugucucauuucucagagccugaaguuauuggguacuucuuuuuuacaauauaauuucccuuccgccauuaguguuuuaauuuucacuguggcuuugaucucuucaauuucuuuggaauuaaugauacaguguuuagagaaaaaauacaaugcagauuuaaaugucuacuuacauacuggcuuaaaaugaaucaucuaugcugcaaagaagauaagaaugugguuuuaguuagggagcauucuuucugacccuguaugacauacaguaggccagucagauacuaaacaguacagaagcucagcccaguggguuuauucaugucuucaagaaacauguauuaagcccuuggguaccaaggcaguguggcugcacagaacaagacaguuuuuguccuuagggaacuuguaaucuaaucgaagauaagcacauagacaguugccauaaggcauuucagauggugugauagagauggugcgauggaagugugcacaaugugaggguaacccuaagagggcacuugacucagaugagggugggucagggaaggcuucccggagcuggaucaggugaaggagggcaaggagugaggaugguuguagaagcccuagaaaacauagguggauuugagagaugaucaauucaauuaagguuauaaaagagaagguagcucaaggaugacuuccagguuuucagugggggaauaguccuuuucacuuagaagggaaauaaauacaggaagagcagauuuggggaaaacauguaauagaagcauguuuacuuugagaugcagguagaaacauccaggagcugguugaauaugcugaucugguggucuggaaaaaacccuaggcuaaaaugcauauuuuuaagucauuagcauuguggaagauuguggaaacacugaacugcaugagaauacccagaaugaauauguaagaugaggauaguugaggcccaaggauggaaccuggggaaaugaacauuuauguaauggauagaggaagaggaaacugggaagguacaaucagggagguuguagucaaccuuuaaguauuuuaaauuuagaugauugcugauuacaucucacauggaaguugcagucaugguaaaauuuaaacuguccauugacagggcguuaacucagcagaaguuguguuugaaaaaacaaguuacuggguuuagccauaauuuggccacuuauauaauuuuuaaaaacaugcaaagccaaaauuuagaacacuggaacuugugauauuaaaaacggaggauuagucagcagacaggagccugugcacccacagacuggauugaguguucugggggugcucccacacgugacacucuccucuguuaacuccgcuggaagucgaauucgcagcaaaauccauugaaauguugccuuuuuuguugcagugaugguaauucuuggggcuuugaacaacccuaaccgucauuauuuuuacuauucagaugaauggaccuuuauugaaugaauucuuuaagucaucuucagaaaugaagacuaggagccccagaccucaaaaagcuaaccauuugguaggcagaagaagaaaucuuccaccucaagguggaauccuugaggaagagguaucauuugaacuggcuuuugaaggauaagggagguuuagauaguuagaaaacagaaaagggaauuccagauggagauaaaagaaacugagaagcuagggcauauucagggaauagaaaggagccucaaagagcaagggguauauuaaggggggcuaaugcagaacagguuacagaggcaggcuuauaccagaucaugagacucuuuaaagauuauacuaauaaucuuucuagagaaccacugaaauuuuuaugaaaaaggcaagaccaaguggugcuugacagagacuacuucucuaagcaugcuuacaaugggcucaaaagagaaauguuauacaugaagguuuuauaaaugauauuucaacaagaacuuuuauuuaagaugacugguucuuaauuuuuuuuuauuugaggggaggugggcauggaaaccauuauugaauggcuuccuaagaaggcugauauauaagacugaaaaguaaaauuaucaagaauucucacagguuucuccauaugauccauggagcaccauuuucuauccuggaaugaugacuuccaaccuuuucaucaucacaagacaagcuuuuguguauccauuuucacaaaaauuucaaaaucaucaaaauagaauuucccugucaucaucuguuuuguuuucaaugauaauggucccauguuuuaaaagauuuuugucucucaagaaaguuaauauuucacauuuguuucauuaacgaagauguaauuuucaguucauccaaguauaugaaguauugaacguuuacaaagcucaguuaauauaauucuagccaaaagcaaagaaaucccacaacuuagucuuugccacacaauugcagauuuuuaaaaaaauauugaaaauaacccaugauucauauaucuugaccuaagcagucucaccuuuucccauacaucuguagacacagggacccuaaguuggagaucagguuaucacaggaacagagauuauguagcauaccuacucugucaucauguguucagauuacauauuacaugcugauuuuuucucuguuguaugauacguccuuucaguggcacaccagacauuacuaauaaagucuuuauuauuuggauuauugaaagacuguuaucucugaauucuuuagcucuacuucuuauuuuuauagcaguaguagggcguaccuacucuguaugcuucugagccuuguggaauuaaaaagaguaauugacguauaccuagcuacccagaacuucaaauuuaauuuuuuucuuuauugcaaagaguaauacaggcucauuacagaaaaaugagaagacauauauaacagcaaaaagaaaauuaaaaaaaaucuuccaaaccuuuuucuaugcaaacuuacauauagacuuuuuaaaauacaaauggacucucucuuuuuguguugguuuuauaauauugucagugucaaaagcaauuccugaaacaucauuuuuaauagcugcauaguaucucauuucuaauuuuauaaccuauuuaauccuuuaugguuggacuuugggauuucuaacuuucugaaauuaaaaguagcuaucccuugaauauccuugugccuaaaucuuugucuaaaucucuauuuccuucagauaacgucccagaagaaaaauugccaggaauauauauuuuaaagauuuuugaaggguacugccaaaaugcccucaagaaagauugugcccauucacuuuuccacucacgaguuuacauucuaauugggaguuaagaugcauacaguuggaaaagaaaaucaauuuaguaucaggaaauagcaaucuuaggugcaaaaugacugauagauaauuggcgcuuuuccaauucagaagagcucacuuuuaauaggcagauuuguaccuuucacgggagauaaggaauuggagaugggucuugaaggacaaggggaagacccagaagagggaggugccacauuuacagcaaacaccguggaaaugcccaagugucugccgaucucgcgagugagggccgugcuugaggagugagggacugggaggaaggcugaccugaacguucuaacuucagguuuuccucuggcucuuuuguuucucgugaaauuaacacuguuauucuggggugaugguguaacuacaaguaucugaaaaaauuaaaauggugaaaccaggaaaucaacccuauuaaaaaaucgguucaauuucucggauuauuuugauguuugggguuucagaaaauuuagaaauucagaaaguuauauuccauuuaaaacucaauuacaaauaaaaauuuuaaaauugaauucacauuccaauguuguaucuuguuuucuuaauuauuagcaaugagugaguuguuuggcucagaugguuacuuugguuaucaagacaagcuuuuguguauccauuuucacaaaaauuucaaaaucaucaaaauagaauuucccugucaucaucuguuccgauuacauauuacuugaugauuuuuucucuguuguaugauauguccuuuaaauggcacaccagacauuacuaauaaagucuuuauuauuugguuuauugaaagacuguuaccucugaauucuuuagcccuacuucugauuuuuauaguaguaguaggccuuuuggugugcugaguuaagccaugcuuuugcuuuuuaagaugugcuuuauccauuacguugcacugucuuaaugcugagcagugauauguuugcuuuugacccuugccucgaacauuuaaagaauguggcaaaaaucuaagucccacagaagugcugacacgaagauaaaaugcagagcucaggcuuggacucgccccaauuuugaaggaacccccucauugucagucaucucagggaccuccuuaccucccucggcuuaguggagaacacuaauuucacuccuuuuucgaccucuauugcauuuucauuauuucauuauugcauauuucauuauuuuguuacauuaucccccuuuugguaauuugucuguagaaugccuauacuguuguuuaauaauuaacuuguuauacagauugcugcuuauuugcuauagaaaguaguauaaagggccuuucuagaauuugaagugauccacagagcagcaaagcugccuauugugaaaauacuuggacuacauaaauuuucuaccuuuuauuauccaaaccaccuauuuccugcagggcauguaaugugcaggagcacauuaacagaggaugcaauagacagcccacuaauuaggccauuucugaugagcugaccugagaugcacuugauguauaggcagagcaaauaccaguauucccuugaaccaaauagauccuggcacuauaacccugugggacugucacaggacuggccauacucauaaaaagauuagggcucaauacuuuuuuuuaagacccucuuucacuaagaauuauuuuaauucuuugcugacugaauuuguaucacagggaacucuuucauguucaucucuccaggcacucuuuuaaaaugcagugauuuguggcuuuaaagaaccucauagugccaucuaguuugucuuuccuccaguggugaaagagaauggcugagucagagcauuggacacuucugggaggaaaauggaggaauuauuuccaguuuugcaucaagcuggucauaaauggauaugcugaugaggcacauucacuuugauauccaggcugucuucuuaaagaguaauccaggccguuggaaguugagcaguuuguucucuuucagaacacaucaugugcuugggguauaauguaauauuucugugauuuuuuuauuuauuuauuuugcugauuagauauagugaaugugagaauuuaaaagggaguaguuuuuagaaaguuaacguguauugagcacuacuguguguucucauuuaucuaaguucauuuaauucucacaauuuuaaguaaauuauauaaucccugucuuuacaaauaagacaacugaggguuagaaguguuaacuaaaggucugacuguguugaugucaaaccagugcucuuuccacaguuccuggcauuuaaauguugacugagucaacucuaauugcuuucaaaagcuugccuuuggggcuggauucaguaucauucauaucugaguuugaaucccauggguguaaucuugguccaggcauuuaaccucucuuaaccucauugcagaaugagacuaaugcacuccacacugaggguugccaugaauauaaaugacauaaucuauguaagguauuuagcgcagugccacacucugaggaagcccuggauucaugguugcugcuacuaauagauggacuuuuuauuuuguuuuaaucauauauccaauaauugggucaucuuggaacagauaauaucucaaaaugcuuugaggagaauguuuugcuuuuucuucuguuuuuagcauaucaagugauuuccucaacuuucagaaauuagcuuuguuuuuauggucuaugucuugaguauguacuuaauacugcaauaauguuugcuuucuuaaggcuaucuguaucuuugauacagauuuuuaaauggaggaaauuuauuugaugucuuaacuaaucuguaauuuaacaucucagguucuauuuuaugcauguucucuagaucacaacuuaaugcaacagauauuagaagcaguaccugguguccagauagcuguuagcuugcacacugcuaccuaaagauaaccugacuuucaguagagguaguuugguguggcaggacaagcacacacuggagcgagacauaccuguggugcaucucaguguccucaaauuguggaugauacagcuguaacuuccuagaaugauugugaagauuggaugacccagugugaacaaaguaccuugcaugugccuggugcgugguaggaccuagcuacugaugggaagguacuuacuaauuauacagauaucuugauguugccaugguuuccuucauucuugaauaauaucacuuuaccaacucucuguuaauuuuguccuauuuuaaauguuugauuucauacugagucuaaaguaaaucuuuggauuucuucucaccagugauaccaagaagaagcaggggaugaagaagaggagcaacagugaaguggaagacgugggaccaacaagucauaacagaaagaaggccaggugggacacuuuagagccuuuggauaccggccugucuuuagcagaggaugaagagcugguguuacaucugcuaagaagucaaagcuaaauacuuccugcgccugccuucuccuugaaaccuugguuaugacugcguaggcaagaaguugaaaaacaguugauuugggggcacuuagguaccauaugccccauucccaaagggcacauuucuggauagaagcgaucguaucuccaagucccucucacaggacaugcuuugugccaucacugagcauacucagaucgaggguggaugauaccauuuccugaccccguuuuccagcauguguucuguuagauuuuuauccauggguuccuacgccuugucauuggaaacacugccuuugucuuacuggcaaguucuggagcucuugugucauuguuagaaaucccugucuugcuuacuguacagaaguuucuguugcuguuaaaauugcucaugauuucgacguauuuaauauuuucaaagagacuaugauggaccagcccugagaaagaaugaguauuuuugaauugagaugaucaauaauaaacauauuuccuauaa

SEQ ID NO: 192053 - RNA, 175047 nt, Homo sapiens
uuuccgcagcugagcggcgacccgggcggcggcggcggucgaggagcucccauggcagggacgaggcggagggaaggcgaaaggggggcgaggaguuaagccagagccuccgcggggcggguuuccgagggaggcacagagggaaacggcucucgcagcccgaggagggucaggcgcggagcuugucgcaccucccgcgcauucuguccagcccgggcuccggagaugcaucugcaucagguccucaccggagcugucaacccuggagacaacugcuacuccgugggcagcgucggggauguccccuucacggugagcggcggccgggagcccuaggggaagauaccaggggccagacgcgggggcagggaccuccuguccagggcgcacgccuccucaggaggcugugagauguuggugggccccacccguggccccuuugcagccuugggguuuaguucccccugggacccgugggaccguggguccugcgucugguguaggaaaucacccguuaggggaaaggcuuaggaauccaccgcacucuccaccccaagcaaacgggccugaggugacuggacuagaaggcuccuccuagggcggcccuucggucugcgguggaggaaagugguggugcggcugaaaccccagagcguccguuucgcagcugcucucggcguggaggcgaagagacuugguguuggucucggagcguggaggugaagagacuugguguuggucucggagcguggaggcgaugcugcgccuuggcucccccugcccgcugugcuagggcagcgaggagcugcuggagucuguggcuuuaagccugacucuguaucuccugauaaugcaggaucuuaauuccaacaaaaagauagaaaaauucauccuccgcgcccgaaagauuuagaauggaaagguuagagucacaguggcuuggagagcugucucauuuaucaggaggucguaguuugguaauccuccuagauaauauuuuaaucuguaagguagccuuuuuuuuaauauaguaaggcaaugugaaaaauuuacaacagugcuuguuugagaaaaguguauguauacauaacguuuuagaaucuccuuaaaagcuagaugaaguagacauguuucucaaggagauuggacucaucaguccuuuuugagaguggaaauguuuaaaccaagccuuggagcuucguuuacucauagauagacucccauaaauugaguucuuuuuuaaagaaugaaauuuauacauggucuuccuuauaaggaacuguaggcagccagaccuuuauuaaauauauuuuguaaacuguucuucuugauaaaacuggaaauuccguaaugguaugcuuuuuagacaaggaaaacccuuugaugucugcuuuccaacaguguuuuuaaaacugcggaaaauaaagcuucagcaaaacugcagaaucauuauguagcagugcauucuggaacagaauuuauuuuuugacguuuugugauacauuaaccccagaagauugcuuuuuagccauuuuaauuuuuuaguguaauccacuuggccuagcuccaguuuagaacgaccccuuuugucaucuguguuuuauguacaugugacuuaaaauauucauauagagcugagcuuugucuucaaguguguggagaaucuugguuuuuggggauagagagaagaaauuucccuguuccccaguagugcagauaggaaguuccucaggguuagaagagugggccucuuucaucaagaaacaaagcuggaaucuuugguuauauuuuccugcuagaaugguggugguaguuuucugcuuccaucuaaaguggagugcugucucacggcaggucugguauguagaacuaaauaaacggguucagaugcagccuggaaaagccuguguaagaacuguuagugcugugcaggugugguuaugcuguaggccacuugugaccagaugcuuagagucauuuucaaaucuucuugcacuucccuaauucagcguuucacgaagucuaguugacucugcacugucuaccagauuuacuccuuuucauauccuuaaccaccaccuuauuuuacaaucuuauugguauuaauauaaaagcuuucaaaacugucauguccgauaacuucuucauccuccacaccgcugcuaggauaauuuucuucaagugucauuuuacuauauuacucuuggcuuaagaauauguaauuguuuuuaauagcuguguuaggaaauguaaacuugucaaguauucuccaucuuugacuuuauuuuuaauuauauguacuccucacuuuggccccucuguuacauacugaucuucuuacucuaaacugcauuuuuauguugcaacaagacaguccuuuuggguuuccaaauucgacucaaaauuuacgugguuuaggaugccugccugugacacuguuauuuuggucuuuugacaaauguaaauacaaacccauuuugcacaccaucucauuuaacuaccuuaguuuugagcgcacugauccaguuuuaauuuugccaugaacuagaaaugaucucuugggcuuugugaaaaacagauugaaaaacaaaacaaaacaaaacaaaaaacaagcugcuuucaagcagucuauauauaaucaacuaacaaauacuuaaguuccuauguuuguaaauauaggaauaauaaauaguaauaauaguaaaauaaaauaaaguaauauaauaguaaaaauaaaaagcaagcuccucuucauggagccugucacuugauuuuagagcaaucagaugaagaaacuuuaguucuggaucagaugauuaaaagggggaccagccaggacuuggaaugaaggucuugugacuucucauugugugggcuuuucuugguaguauuuccuucuuaauaucagagugccugcucuggagagggugugugggugcguagguggguuaguggauggauggaaggccucccagacauaguguagaaggaacuacugucuugcaacuaacucaugauucuuagcugauguuguguuucaugguagccugagaaccuuuucaaaauacaauacauacuuuauuucagagucuaaaauugauacaucuuugaagaacagaauuguucuaaaaggauuuugaguuuaugacaguguaauaauugaaagaaauguguguuauauauuuugcugugcaugguggguggcgugauugguuggcugugaaugacuacuugaugucgugaugucccaauuugugcaauauugacaugguacugcagucuguaguggacaaucucagcugaugucugugguuuuagugguaucacguaagcuaugaugcuuuucacuuguguuuaggcaguauacagcuguuuccuuaaacauucgauugugauuucguaaauguagcuguagauaucacauuuuaaaacaucaccuuuugaacaauuuuguucuuuucaguguaagaucuagguuuucgaaauguuauccugcaauaagucaaaucucugguaguucaaagagaugaucuucucccguguaugagcuuuauuauacuuuauuuugccuuuaagacauuucuuacuacccuucagugaauguuuugaggguuuaugcaacagauauuguaaauuucucauuauuuauguuauuacuuuucugaaagauaguccuuggcuauuuuuuaaacuuuacugcacauauuaaaauauuaauugaaauaaugaucauacgugaugauuuuuuaaauuaaaaauucauuuggccuuaaggcuugcagacuauuuugagauguauaggggcaguuacuauuauuccagugugacaugauuucaacacauugaucaaaguuuacaaaaauuaguaagucauuugcacucuuagggaauuuauaauauacuggcagagauuaaaaugauuuauauaauuauaacauaaggcagauggaagagauuguaguugggaaaacaagaagagguuuuauggaagaguaagguuuggaaagauaagaacaacagaagcaaaggaauggcauaauacgaaggauaaauuauugagugacuguuuucuuugcaaaaguuacuuuuuaaucacaggacuucuucauuaaauaacagacacucuuagaauguugaaaaaauauaauaugcaaacauuaccuguagcuuuucaggaaaacguaccugguauucugacauucaauuuuuuuuuuaaauuaaaauaccaacaaaagguuggaaauaaauggaaaaccauucauuuaaaaauuagaaaauaauguuguauaaccucuuuuauggcauuuagauaugucuuaacucuauuguagaauaaaauuucaguccuagaguuaugguaacaccaaaccuugaaaaugaucaaccaguuuauacauuuagcaaauguugaacacauaggugugcuaagcuuuguggguauuaaaaaaaaaaaaaaagaauuacaagacauagucuugauuucagggaguuuauugaagaaguguaggaaccugguagucuaauacgagaguaaaagacacauaccuaaccacaguaggccagcugugcaauauuaccagcauuuaagugggaauucaggaagacuaagagaacuuuuggccaggggaaucaagggguugguuagaaacaugcuucuguacuggcugguuauuaauguguuaaccugugcugagaggaaagugaaagacagaagucaagaauuuagaauggacuuguuuucuaagagaaauuggccuuuuuguucuuggaguguagcuucuuguuuguuuaaacggauacauuuaaaaccuugugggcuugggcuuagugucaaccaguaagugaauauaggguuuauaaguucuuaugucccugcguagauuguuaauuagccuucuugcuuguagcaagaagacuccuagcaacuacucagaaacucugguaagguucugaauaaugucuuccccaaaaaugggaggucagagaccaacuacuuguaugguguuggugaaaucacuuaaacauguuuaggucuuugaucuguaaaagaaguucuuaaagauauucuuuaaguauuuagaccacgaaugaaaauuauauggacuucucuagagauuuucaggggucaaaagagaaaauggacuagaaacauaaagugguuguguugaaguuguaggucuggagucuuuaucguauauugcuucucacuuguauuuacaagacuugaucagaucucacuuguauuuacaagauuugaucagaccucacagucggggagucugaccuccuuucuggcucaguagauaggccauucagagcauuuaugaaguagugggucuaggaaugagucuuugggcuuacagcugaggagaagccucuugauuagguuuugguccuuggcaccuggcagaugauaguugccugcgacugucauaguacaguauugggugggagaugggaccagugugaugguguuuagguucuccuuucgcagcuuuccuuuucccgugcaaugccuuuauuuuaguuucuguucuuaggauuugggcuauuuaaaauauuacuuuagaaauuauaaucagauuaucuuaacuuggaucuugguaaauuuuuagaacaaaucagagucucaguauuuaauuaucugaaagagcacaggauguugggugacaaccauaauggcacaguagaaaaacaagucaugccugaccaauuuaauuuccuucugugaaaccaaggcaguacuuaaaaugggauauaauauagaauaucuaaaauucagauuuagucagacuucucuagcuugucaguuuuuuuuuuuuuuuuuuuuuuuuuagauggagucucacucugucacccaggcuggagugcaguggugcaaccucugcucaccacaaccuccaucuccuagguucaagcgauucuccugccucagccuccugaguagcuggaauuacaggugcgugccaccaugccaggcuaauuuuuguauuuuuaguagagacaggauuucacgauguuggccaggcuggcuugaacucuugaccucaagugauccuccugccucagccucccaagguauugggauuauaggcaugagccacugcacccggccauuugucaguaauuuuuuaaaacaaauuuggaagccaaauauuucaguagaaguuuuaggguuuucaguccuuucgaguuuguagaauccuuuugcauuauguuagugcucugaaacccugauccaugauguaacuugguauugagggacaaguacaucuuaacaaaggugacaugacuauauucacucucucuuaaagauagcucauguaauccuggaauuugauguaaauaugaaaccaguugccugcacuucuuauuuuuguguguguggguuuuuguuuucuuaaauuucuuuuuuuuucguuugccugcaaguuuuacucucaaauccucucauuucaugauuccugaggcuuccuuuaaugcuaucuaccccuaguccugaacaccuaaaaaauguaaugguuaucauuuaucucuuucagauacagaaaacagaguuaggccccucuaaauaauauacaugguaauuuggugggagugauuuuaggggaauaaauaauacccucuuagauggauuaucauuggagagauguuccuuuagguccacugucuucuaaaaacugagccuugggaguaauaacauuuaauuuaauucauacuaaauaauuguuguuuucuuccugugauuuuaggagaaacccauugguucguacuaaaucaguaguguuuucuucuugugaucuaaggagaaacucaaaaagucguaaguguguuuugcaaguaagcauagauggacacaaaaaacucauaaacauucuggcuuagacucauuucacagauauauguagcucauccguuagcuguaguucaaaaacaaaauuccauacauuuucuuaggaguaaugauuuugguuuugugcuagcaacuucuucauaucaucucuggccuugacugcauccacacuuaagaggaucuaaucagcaggagguaaucauauuaucaucauguaccuuucccauaauaacucccaucauuccuuuuauguggaugaauaaccaauguuuucagcaaaggccacuuccuccauuuagguucuaaauugggugugauuuuguccaccaggagacauuuggcagugucuggagacauuuuugauugcugugacuggagguggggaauugguacugccaacuagugaggagaggccagagauuuagauaaaacguccuacagugcacgggauaguccuccacaaugaagaguuaccaagcccaaaaugucaguaguacugaaguugugacaaacccugauuuguaccuuacgguuugcaucucucuuuccuacucaagugcaugauucuagcaguuucucccuucucucauaaaaaugcuuuuucugcucuauugaaacacugucuucauuuagccuucuuaguuuucuccuaccaugcuuaauugcuucuucucagccugauuccagauuuguauacucagcuguuucuuugacaucuccuccuugaaggucuaauagcuaucacaaagaccucauaacauuuuccucuuccagucuucccuaaaucaauaaauagcaacuccacuuuucuuuacuuuccuuguaaucuaccuuuucucuuccauuuaugucccguaucuaauguuagcaaauucuaaugguuauaccuucaaaaugcguccagaaucugauuacuucuuaucucuacugcugccaccuuggugcaagacagcaucauuuuuuuccccuggauaauggcaguugaaucuuaaauggucuuccugccuuuucugacucuagccuauccuccuucaguuuauuuucaacauaguagcuagaaugcuccuguuaaaauacaaauaaaaucuuguuagccccuuauuccagacuuucacguggcuuuuuuuuccacucagaauaaaaaccugagugccugcaaugcccucuauugcuauuucuuuagcaccuaaaacagaaggugguacaaaaaaguacucaauaaauuaguaaauggaaaggauacuuaguguaauacacacauaguaaaaacagugaucuuuucauaaggcuauuuuuuuauaauacuucuugguauaggucaguggcauuaagucauauuuagaaaaaucaauuuuauacgaugaaggcagagagcuuugauauaauauagguguaaagcugugcugcccugguuuacuccaaggauauauauuaauguaucaggaggaauugacaggugguucucaaauuuuccucaguggugcuuuugaaagacuuaaguauauaaugaauuagagauuagccugacaaauaccuggaguguagagauucuguacuuuaggaguuuaauauguuguauuaauuugcuggggcugccauaacaaaauaauacagacuggguagcuuaaacaacagauuuuuuuuccucacaguucuggaguuuggaaguccaagaucuaugugucagcagauuugguuuaucuggaggacuuucuccuugucuuguacauugcccccuucuuguuauuuccucauauggcuuuuccuuuguguacaugcacuugcggugucuuuuucucuucuuagggacgcuagucuuauagggccccacccuuaagaucucauuuaaccuuauauuaccucuugaaaggccuuaccuccaaacacagucacguugguaguuagaguuucaagcuaugaauuuugggguuacacaauauaguccacaacacauguuaacaaucagcugagcugguccuggaauugaaaauugaggagccuagcaaagacaugauugagguggccacccuacuuggugguaaucucagcucaaccaaaggaguacucuuggauagaagcaagauucuguuaaagaaauuuuaagaauaugcuaauauguggacaaauggaaaauucaaacaugacugugauaauuuuaugcuggacaaauuuuauauagacauaauuacaagcacaguuuggccauuagaagcaaaaagcaaauaaaaaccccaaagaauucagauuuuuuugguuuaaaaaauuaauauaauaucugcauuguaaaaaaguuauaauuccaacaguguugaaauauagaaaguaaaacugaaaguuuccaguucccagaagaauucguauaacuuacugguuauccuuuauucaaaaaauauuuuggcaccuagacauugugcauacaggauaaacuagcuauugaaguguacuguuguauaagaggacuugguguauguuguuauguugcaggaagucaaggacccuaaacggagggacaggcugaagcuauggcagaagaacauaaauugugaagauuucauggacauuuauuaguuccccaaauuaauacuuucauaauuucuuacaccugucuuuacugcagucucugaacauaaauugugaagauuucauggacauuuaucacuuccccagucaauacucuuaugauuuccuaugccugucuuuacuuuaaucucuuaaucccgucaucuucguaagcugaggaugaaugucuccucaggacccugugaugauugcauuaacugcacaaauuguuuaaacaauaugaaaucugggcaccuugaaaaaagaacaggauaacagcaauguucagggaacaagggagauaaccuuaaagucuggcugccugugggcuggguggaacagagccauauuucucuacuuucaaaagcaaauaggagaaauaucgcugaauucuuuuucucagcaaggaacaucccugagaaagagaaggcgucccuaaggggaggccucuaaaauggcugcuuuggggcuggcugucuuuuacggucauagaugggggaugaaauaagcccuggucucccuuagugcucccaggcuuauuaggaugaggaaauucccaccuaauaaauauuggucagacugguugucugcucucaaacccugucuccugauaagauguuuucaaugacaaugcaugcccgaaacuucauuagcaauuuuaauuucaacccgguccugagaucuugcccugccuccauuugucuugugauauuuuauuaccuugugaagcauaugaucucugugacccacacccuauucguacacucccuccccuuuugaaaaucacuaauaaaaacuugcugguuuugcggcuuggggggcaucacggaaccugcugacaugugaugucucccccggacacccagcuuuaaaauuucucuuuuguacucuuucccuuuauuucccagacuggccgacacuuagggaaaauagaaaauaaccuauaugaaauauugggggugaauuucccccgauauuguuauuagcuauaaauuaguuaaauuggggaucauguacuaaugugacgauuugauuauggaauaauugaacuauagccauucuuccuggcaguauuaaauagugcuaucucuaugugguugguauauagaaaacaaggcaauuuuuaaaaguaguaggauuaauauuuaucuuguauauuaaauugguacgugaaauuaagucugcuuuacaaauuaaaucuagucuaguaucuucauuuugugucuggaauugguuccugccaguggguucguggucuuccugacuucaagaauggagccgcagaccuucgcggucaauguuacagcucuuaaagauggcauggacccaaagaaagagugguagcaagguuuacugugcaaagcaaaaggacaaagcuuccacagcauggaaggggacccgagcggguugccgcuacuggcugugguagccagcuuuuauucccuuacuuguccccuccuguguucuguuucugugcuaucagaaugccccuuuuucaguccucccugcaauuggcuacuuuuaggauccugcugauugguguguuuuacagagcgcugauuggugcauuuuacaauccucuuguaagacagaaaaguucuccaaguccccauucgacccaggaaguccagcuagcuucaccucucaauuucauagauggggauacuaauacuuuugagaaguuaaaugauuuaaugaaggccaccuaguuaguacugugauagaauuaagacuggaacacaaagcucccauuucucccucccaccccgcaagauguaaaaaguaacauaugcccuuguagauaauuugaaaaaugcugaagaaagagaaaaucauuuauaauggcacaauccagagauaaccccacuuaacauuuugguaaauuggacugaggccucauggaggaagcucauauuauuacugauuugagaauguuuaccuguaauuuucuuucuugaaugauuuuuggguaguuauuuugcuaauaauuuauucuauuuuguguagauuuucaaauuuaugaguauaaaguuguucacagcggccucuuaauaucuucuuaggucugcagcaucucuguugcuucuuuugucauuacugccauugguuauuugugccucucccuuuuucuucagcaaagguuuaucaacuuuauuaaucuuuuuuaaagaacccacuuuagcuuuaccacuucucucuguuauauacuuauuuucuauuuuauuaauguuuuucuuaauuuauuauuuccuuucuucuauauuauauuaauugugcuguuuuuccccuaccuuauugagcuaaaugcuuagcucauuuuugucuuucucccuaauagaugaauuuagaauguacguuuucuuccaagaucugcauucucugcauucuacaaagcuguuuuuaaaaccaugcacucauaaguaauuuggaaguaaauuucugaauauaugagacuuuuaaaguuacaaauaugcuuacuaauuucuagcauagcuguauugugugcaaguggcaugcgguauguacuucuagucuuuuuaaguuuauugaaauuucaguuggucaguuuuuauaaguuuuuuuuuuuuuuugagauggagucucgcucugucgcccaggcuggagugcaguggcgcgaucucggcucacugcaagcucugucuccuggguucaugccauucuccugccuuagccucccaaguagcugggacuacaggcaccggccaccaugcccggcuaauuuuuuguauuuuuauuggagacgggguuucaccauguuagccaggauggucucgaucuccugaccucaugaucugcccgccucggccucccaaaguucugggauuacaggcgugagccaccgugccuggccuuuauaaguguuucauaugugcuuaaagaaaauguguccucuucaauuguuggacagaauuuuauauauuuuaggucaagguuguuaaucauguucuuuaaaucuccuaaaacuuuaccgcuuuucugucugcuuauucauuuugcugagagauguguuaaaaucuacuauaaauaugcauuuauuccuaucuugugguuuuguuaauuuuguuuuauuuauuugugcuuacaaguuuaaaauuauuauaucuucuuggugaauugaucuguugaucauuaggaaguaacccuuuuugauuucuaacagugcuucugcaguguacuuucucuggcauuaauauaguuuuauuagcuuucuuugguuggcauuuguacagucuuaucuuuuuacuucaacuuuucugcauaguuacguuucagaucguucuuccaaauacagugaugcauugauuaacaaugaagaugcauucaauauauugcuaggcaauuucaucgucgugcaaacaucauaaaguguacuuacacaaaccuagauaguuuuuuuuuuuuuuuuuaagacugacuuucacucuuguugcccaggcuggagugcaauggcgcaaucucugcucacugcaaccuccguucucccggguuuaagugauuuuccugccucaaccucccaaauagcuggaauuacaggcauguaccaccaugccuggcuaauuuuuguauuuuuaguagaggugggguuucaccauguuggccaggcuggucucaaacuccugaccucaggugauccauccuccuuggccucccaaagugcagggauuacaggcgugagccaccacacccggccacaaacguagauaguauagccuagaacauaucuaggcuauaugguauagccuguugcucccaggcuacaaagcuauauagccuguuacuguacugaauaauguacccaguuguacugcauugguauuuguguaucuaaacauaucuaaauguagaaaagguacagugaaaauauggcauuauaaucuuaugggaccaccaucauaguuuaugugugguccauuguagaccggguccguuguagaauguuacguggcacaugacuguaaaacauaguuggauuuuuaaaaauacagccugacaauuucuguguucacuagaacuuucacuucauuuauacuuaauguaauuacuggcauguuuguguuuaaauucacaaucuuacuaugugcuuuuuauuuguuccuuuuguucuuugcuccuuuuucuccuuucuugugucuuuugaaaugaauuuuuucauucaguuuuuucccucuaguccuaagacuccauauucuguuucuauucuuuugcuaguuacucuagaaauuacaggaugcauucuuaacuuauuucacuuauugaagccuuaugaggguuuacauucuuuguagacaauucaagaaccuuuuguauugcuuuuuaacucccuuccugcuuauaauauauccuucuaugguaagccuauuuuuauaacccuggaagacauuauuauuuuacagagucaaugcuuacuuagauuuacccauauguuacuuugcucuucguuucuuccuuccucucuuacauuccauuugagaucauuuuccuucuuccuggagaaucuccauuagaauuuccuugguaucaaucuguuaguguuguaauguugucuuuuguuugucuaaaaaagccuuuuuuuuucauucuuuuuuaaacuuuuaguuucagggguacaugugcagguuuauuauacagguaaguuguguguugcuugguuugguguacagauuauuuugucacccagguaauaaguauaguucccgauagguaguuuuuugauccucucccucuuccuuccuuccacucuuaaguaugcuguggcaucuauuguucccuucuuuguguccauguguacucaguguuuagcuuccacuuauaaaugagaauaugugguauuugguuuucuguuucugccuuaguuuacuuaggauaauggccuccaacuacauacauguucuugcaaaggacaugaucucauuuuuuuggcugcauaguauucuguggcauauguguaccacauuuucuuuauccagucuauuauugaugggcaucuagguugauucccugucuuugcaauugugaauagugcugcaguggacauacgcaugcaugcgucuucaugguauaacgauuuauauuccuuuggccauauacccaauaaugggauugcuggguugaauuguaguucuguuuuuauuuuguuucauucuuuuuuuuuugagacugagucuugcucuguugcccaggcuggaguguaguggugugaucuuggcucacugcaaccuccgccucccagguucacgugguucuccugccucagccucccaaguagcugggauuacaggugcgcaccaccacaucuggcuaauuuuuguauuuuuaggagagaaggguuucaccauguuggccaggcuggucuugaacuccugaccucaagcagucugcccaccucagccuccaaaagugcugggauuacaggugugagcccagccuauuuuguuucauucuugaaaggccguuuugcugucuuuuagcagguagacagguagguagagcauggcaguguuuucuuucagcaccuugaggauuauagucuucuggucucuacuguuucuguugagacguaaacugcuaauuuacuguugguucuuugaaaguuauauauuuuuuucucuuaguugccuuugagauuuuuuuccuuuguguuucugaaguuuugcuguguuuggucuauguauacauuuaaaaaaucugcuugggaguuuucaaaucuguaaauuaauaucuuucaucauuuauugaaaaauuucagcuguuucuucaaauauugccucugcccugauugaccuuauaaaacaaauaaauauguuucagacuuucugacuuuauuucugugacuaauaccuuuugccauguuuucuaucuuuuuuuuucuuuuuucuuuuuuugagacggagucucgcucugucgcucaggcuggagugcaauggugcggucucggcucacugcaagcucugccucccggguucgagccauucuucugccucagccucccgaguagcugggacuacaggcaccugccaccgugccuggcuaauuuuuuguauuuuuaguagagacgggguuucacuguguuagccaggauggucuugauuuccugaccuugugauccgccugccucggccucccaaagugcugggauuacagacgugagccaccgcgcccggccuuuuuuuuuuuggugggggcagagucucacucugucacccaggcucuggagugcaguggagcaaucucagcuuacugcaaguuccaccucccagguucaagcgauucuccugccucagccucccgaguagcugggauuacaggcauccaucaccaugccuagcuaauuuuuaaauuuuuaguagggacaggguuucgccauguuggcuaggcuggucucgaacucugaccucaggugaucugcccaccuuggccuccgaaagugcugggauuacaggccugagccaccuugcccggccccauguuuucuaucuuuuuauccuuuugugcaacauucuagauguuuuuuucuaaucaauuugcaaauccuauauucagccaugucuaauuugcuguuaaagccauccguaaguucuuaguuuugguuguuacacugguucuuucaugaggucuuuuuuccuugugugauagauauuguugacuuuguguauuugaaaaaagacuuuuaggaauaaccuaaggcccaagauggugguaucuuacccaaaagggaauuuuaauuuaauuaggugacaugucuuggggauuuuacuguuuagggaagacauuaauucaagcgcaaggcuugaaauuuucuaaaccaucuaaaugaugcaaagacagaugcgaaucucuacaaguggccgggcgccauggcucaugccuguaaucccagcacuuugggaggcuguggugcguggauaaccugaggucaggaguucgagaccagccuggucaacuggugaaacccugucucuacuaaaaauacgaaauuagcugggcauagcgucgucccagcuacucgggaggcugaggcagaagaauugcuugaacccgggaggcagagguugcagugagcugagaucgcgccacugcacuccagccugggcgacaagaacaaaacucccaucucacauccacacccccacacacacacauacaaaaucucuauaaguguguugguuuaauucuaggucucuaauguuauguggauuaaucuucaagauuucaguuuaaaguguuggguaguuuauuggagucccaucuuuugucagauggagcacuuucauuuuuguuccucuagauccaagagaccaucaaaaugcagcucaguuuuacccucacucuuuuagauuagcaaaugcuguuaggacaaauuggcauucagugcugagcacagccuuauguucuccuuuucucuuagauuuuggcccacuaauuccucacaguauuuuuuauuuuuuuagcucuuugaguguuuuuacaucuauguucauuaagaauauuaaucuggggccgggcgcgguggcucacgccuguaaucccagcacuuugggaggccgaggcggguggaucaugaggucaggagaucgagaccauccuggcuaacaaggugaaaccccgucucuacuaaaaauacaaaauauuagccgggcgcgguggcgggcgccuguagucccagcuacuggggaggcugaggcgggagaauggcgugaacccgggaagcggagcuugcagugagccgagauugcgccacugcaguccgcaguccggccugggcgacagagcgagacuccgucucaaaaaaaaaaaaaaaaaaaaaaaaaaaaaaaaaaaaagaauauuaaucuguaugggcugggccggguagcucacaccuauaaucccagcaguuuggaaggccaaagcaggcagaucacuugaagucaggaguucgagaccagccuggccaacacggugaaacccugucucuacuaaaaauacaaaaauuagccaggcaugguggcacacgccuguagucccagccacuugggagguugaggcacuagaaucacuugaacccaagagguagagguggcagugagcugagaugaugcuacugcacucuagccugagugacagagugagacgcuguuuaaaaaaaauacauauauuuauauguuuuuuucccccguuguacuguuuuugucgaguuuugguaucaugcuaagauguuuuuuguauauuucaugaagcuuuuuguguuuuaaauuuagauccuaugauucauuuugaguuaauuuuuguguaaaauaucagauuagauuuuuuuuuugauauaugaacauccaguuguuccaacaccauuuguugaaaagcugcccuuucuccauugaauugccuuuguaccuuuguaaaaaaucaauuggcuauauuuuugugggucuauuucuggaaucuguauucuguugcacugaucuaugucucuauccuuuugccacaauaccacugucuugauuauugacuuuaugguaagucuuauaauugaguagugugauucuuugaacuuuauucucuuuuuuuacaauuguuuuaguuauucuaguuccuuuaccuuuccauuuaaauuuuaggaucaguuuguccauagcuacaaaaaaaauccuacugggaaugaacuugauugccuuucuuuuaaaucuguagaucaauuuguggagaagugacaucuuugagucuuccaauuaugaacauaugucuauauuuauuuagaucuucuuugauuuuucaucaguguuuaugcauauagaucugauacauguuuuguuagaaguauuuaauuuuucagaccuauguuaaaaugguaucuuuuuaaacauuuuauuuuccaauuguuuccaguuguucauggcugcacagaaauucugauuuuguauccugugaccuuauuagcacuaggcuucuuuuuuuuuuuuguaaaucucuugggauuuucaguguagauauccacacuagcugcaaauuagacaguuugaauucuucuuuuccaauguauguguucuuuuuuuuuuuuuccuuauugcaguacuagguuuuuuuuuuauagaugcccuuuauaaggcugagaagauucuuuuuuauuccuuguuugcugaaaguuauuaucauaaaggaaucuugaguauugucaagugcuuuuucuguaugcauuaauaugguuauauauuuuuucuuuaaauuauuaauguguggauugccgugauugaguuuugaaaauugaaucagucuuguaguaccaguauaagccccacuucguuaugguauauuauuguuuuuauuuguggcuggauuugauuugcuaauauuuuauugaguguguuugcaucuguguucauuaagaauauuuuuuauuauguuuuuucuccuguacuguuuuugucugguuuugguaucauuguaauacuagcuucaugaguuuggaaguauuuuguccuuuucuuuuuuuuuuucagacggagucucacugugucacccaggcuggagugcaguggugcaaucucagcucacugcaagcuccgccucccggguucgcgccauucuccugccucagccucgugacuagcugggacuacuggugccugccaccacgcccggcuaauuuuuuuuuguuuuuuaguagagaugggguuucgccauguuagcuaguauggugucgaucuccugaccucgugaucugccugccugggccucccaaagugcugggauuacaggcgugagucacugcgcccggccguauuuuguccuuuucuacuuucucucaggauuauguagaauagguguuauuucuuuuuuaaauguuaguagaauuuauaagugaaacaaucugggccuggaguuuucuuuuucagaaggguuuuaacuauacguuuaauuuauuuaauaguuaaaggacuauccuaguaauauguuucagcuuggguguguuuuuacuguuuuugguuuuagaggaauuggucuuuuucaucuguuucauuuuuauagguuugcguauagaguuguuuguggcauuucguuauuauacuuuuaaugugugcaggguuaguacugauaccccucuuuuauucuugauauugguaauuugugucuuuucucuuugccuaucuugcugaaguuuuuauguuauauugcucuuuugauuucauucauauucacucuugguuuucuguuaauaucauugauaucugcuuuuuuauuguuuccugccuucuaugugauuuggaauuguuuuacucuucuuuuucuaauugauuaagauggaaaccuauguuauugauuuggggagugcccacacuucuuuaaacauuuuucuacuagccauuuuaacaucuuugucaguugauuucaacaucugugucuuguugucucuucucuugcaaguugagauuuucuuaguucuuuauaugaguaauuuuggauuaugccuggacauuuaaaaauauuacguuaugcgacucugggccuuuuguaaauccuauggagaauguugauauuuuuguuuuagcaggaauuagagcuggcuggguugagauggaaagguuugaccaaccuucuguauauuguaguuuccauguaaguuccauuuucaaagccuuugcagugcuagcugaauauacucuauccugugaugugccacugaguggccaguauggaaccugggcaguggucucaaggucuuugcucugcuguuuaagcuuaagauuaugcuugcacagccuggggaugagcccgggaguuuacaagcaaguuuguugaguugccuuuccagacuccucuuucugugacuuuccugguacuuucugguuuucuggcuggaaaaccagucacuuccugugacuguaccugucuauauucagugccaaaguaccuguagagaaagaaaaagagcaacguggauccacucuacucucuuggggucauggcaccucagaguagaacuguggaauuauuugggggcugugauaucagaaaauagagaaaagggaaaaaaaagauaaagggagaauuuuuccucccuuucugugaacauuaagagucuccuuucccauuccuugagccaaaaguaaauggcuucuccuggagcucucuguuuuugcugcuugguuuaggccugacaguccaggccuaacuuaguucaguaaaaugggaaacucugcuagaauagugaacuucaaacuccauucuucuuaccgcauuuaucugcuauaauucaccuuauuaagaguccucaaauagcuguucugugcuuucuguuuauguuuuauggcugcaucaagugggagagacaucacugugguuacuuuauuuuacuuggaacuggagcuaugaugucauuuuucauaccaucaaaaaggaccuagcaacaaaucuaaugauauauguguaaaacuccuauaagcaaaauuaauaaacuuuauugagagacuuaaaggagauaaauacuauguucauggacuggaagauucacuacuguaaaaauaucaaccauuuccaagcuuauuuauguaucuuugaugcauucccaaucaaaauuuuaagagaauuuuguggaauuugauagaaugaugcuaaaauuuuauggagcuagauagugccaagaauagauaaggcaauauugaagagcaauaaagaagacuucuaccagcucaagacuuauaaaaguuguagucauuaagauagugagauggcagucugaggacaaauacaccaaaaucagcaccagaaagagacccacacauuuguugauguuugauuuauaucacaauuggcaugguagaguaacaggaugguugaucuuuucaaucaguggugcugggacaucuuguuaucuacauaggaaagaaggaagacuuggucccuaucucaccccauacauaaaaauuaacuccaaguagauuagagaugugcaagacagaacaauacauauuuuagaagggagaauucagaggaauacauguagaggaaaauguauugcuaaccuugagguugcaaaagauuucuuaaaacaucaaauuuuuuuuuuuuuuuuugagauggagucuugcuuugucacccaggcuggaaugcaguggugcaaucucggcucacugcaagcuccgccucccagguucacgccauucuccugccucagccucccgaguagcugggacuacaggcgccugccaccacgcccggcuaauuuuuuguauuuuuaguagagaugggguuucaccacguuagccaggguggucucaauauccugaccuugugauccgcccgccucggucucccaaagugcugggauuacaggcauaagccaccaugccuggccaaauuguuuuauuuuccucuaauuugaucuuucuugagagugucuguaaacucucuggagaguggcuguuaacuguaugucuguccugauggggcuccagggauuauuguggagcugggauaugaccauaugagauggucauggauguuuacagucugucuuucaugagauaguuuuuuaucuugguagauguccuaaugcuuaaaugucagaccuauggccagguguucuucucacaggaaacuuauacuggcagauacccuugugguucuuguccuauccguguccaguuuauuugaccaagacagccacgcucuaggagaacccugaccaagcggagaauuagguucagguguguuggucaggugagcuacagaggagaugguaaaacaaaacgcaugaaauaacaagcaguuuuaauuucagauuuuagagagaagagaaaguagcacaccuugcaaggucaacaggaagaggggugccaccuaggacacgcaagugcaaccaguggaugggaugaaagagaaaggaccuagggaacuaaagccuuuacugggguccaggguguucuuaaccaagcaaguuuccuaugaggaguucuaauuuguagguuggagcaagcaggcaugagucaugcugugacuaagagguggucacugaggcauaucugugcaggguuuggggucauuagggugagucagguagauucuaccuagcucuccuaaaaggaggugauaaccaggaggugguuguaaaaggcagguaucuugauugaccacauugaggaccugggaggaaauggagaacuaaaaacugugucaagggugacugagcccugauucuugaaugagaaagucagacuuauacuugaaacgaaugccaaggcaaccuaaaauuauaggaauucacuacacaaauaaaccacaauugcagauagaaauauuuuggauauugugagccagguuucucauuauugaagaagagaguuacaaguguagaaagugggaaggcagccgggugcaaugggucacaccuguaaucccagcacuuugggaggcugaggcgggcagaucacgaggucaggagauugagaccauccuggcuaacacagugaaacccugucucuacuaaaaauacaaaaaauuagcugggcauguuggcacgugccuguaaucccagcuacuugggaggcugaggcagaagaaucgcuugaacgugggaggugaagguugcagugagccaagauggcaccacugcacuccagccugggugacaaagcgagacuccaucucaaaaaaagagaaagugggaaggccagaaugaaccuugucaauauaauugcauuagaggcauuagugugaccucauagauguguaugugucuauacacauaugaauauauuacauguuuauaugaauaauguguguauguauacaugcauauauuuguguauauuuaaacagacauagagcagugauguauagguauagagauauguagauaugauacggauguuuguauuggugugucuuugauccuaagcccuuucaguggacaguugaaaauagauaugugugugucugucuauagauacauacauaaacauacacacacauuuguuuuccuaacugucagcugagaggccuagaagcagugauaccccuguagcagugaacacaacuggcaucuagaucuugguuucuaaauaccuuuguccacuaaaaggaaccacuauuucuuggaggaauagcugauuuuaggcuggagcaugaaaaaugagaugaaucuggaauuucuugugccagaaaguaaggaauugcucaaagaauggucauagcaugucauaaugacacuggagcuagcuuaaaggucuuccacuggccaaaucugggacaaucuggguaugaaaauaaaugauaguggauuauaacccuuugaauaagauaaaaauccaugaauuuuuacugauauaaauaaguacacaaauaaggaacgcucuucuuuacagagggaaacugacaaaugaugcaacgauggaauuagaaaauugccauuuggcagccaucauaguaguacuaaaacuaauggaugaaaguuuaguaaggaacaggauauuuacauaaucucaaaauauauucccacaguauacuuauuaauuauaaaggaaaaacaacauagaggagaaaccuggaagauacuaucugcauuugcuguccaaaguaaacaucaucagagauggggcaaauuaacagaagugccaccugauaaaaugcaauaagaacauugcuacauuucugugguauuccugccccaaacccauaaccuaaaucuaauugagaggaaacaucagagaaaccugcauuuuaagauauucuauaaaauaacugaucuguguucuucaaaaguguuaaugccaugaaagacaaagaaagagugaagaauuauuccagauuaaaggagucuaaaaagacauagcuaaacacuuaaucuggaauuuucuuuuacuauaaaggacacuauugcagcaguucaagaaaucuaagcucuauagauaauaguauuuuaucaguauccauugcccgaucuugauaauuguacuguggucauauaagacauuuuuaaggggaaacauuaaaguauuaaggaauaaaaaggaaucaugccugcaacuuucaaaugguccagaaaaaaauauauguauguauacagagacaaggguaaagcagauguaaaauauuaacauuuggggaaugugguauacaggaacuuuuuauaacuuuguauaacuguauaaauuuacaacuuuuuguaagccugaaauuaugucaaaauaaaaaacuaaaaguaaaggaaguacuguaucauaaaaggagauuaaugauagauuggacuacuuuaaaauuaggaacuuccucaaagauagcauuaaaagugaaaugcaaguuguggaguuggagaaaagaauugcaacaucuauauuugacaaaggacuaguauccagaauauaacaauaucuacaaauaagaaaaugauaacaauaacggaugaaauauuugaacaggugcgucacaagagaaaaucuaaaugaccgguaaauauuugaaaaggagccauagcucauuaauaaucacaaaaagacagauugaaaucaggagauucuauuauauaccuaacagauuugcacaaaauuacuuacucucacauguaucuggugauggcaaggauguccagugaugggaauucucaugcacugcuagugacaguauaaauugguacaacuauuuuggaaaacaauuuagcauuaaugccaaaauuuaagauacgccuaaccugugauccaucaguuccucuuuuguguguauauucuagagaaaugcaugcacguaugcgagauuucccuacaagaauguucauagcagcauuguauguaauaggcaaaauguccaucaacauuagaguggauaaauugugguacauaccagggaauauuaauaagaaaugaaagugagugaaucacaguuacauacaccaggauaaacuucugaccuaauguucagagaaagagacacaaaagcauacaguaugauuccauuuacauaaaguucagaggggaggcaaaacuaaaccauauuguuuaggcaugcauacagagguugaaaaacuacaaagaaaaauaagggggugauuucccaaaaaggguaguggcuacuuuugcuugagacggagaaguguaauuuggaagggacagauaaucuuuugaguugcuggaaauacucuucucuucuuggguggugguuacacauguacucacuuuaauuuauucuuuguggaggauguuuuagguacaccucugaauuuaaaacauugucuuaguggguuuugugagguuuuaugagggauuauguaggugcauguuugucugcuuuuuuauuauuauuauuauacuuuaaguuuuaggguacaugugcacaacgugcagguuaguuacauauguauacaugugccauguuggugugcugcacccaucaacuugucauuuaacauuagguauaucuccuaaugcuaucccaccccccuccucccaccucacaacaggccccggugugugauguuccccuuccuguguccauguguucuuauuguucaguucccaccuaugagugagaacaugcgguguuugguuuuuugucuuugcgauaguuagcugagaaugaugguuuccagcuucauccauguuccuacaaaggacaugaacucaucauuuuuuauggcugcauagcauuccaugguguauaugugccacauuuucuuaauccagucuaucauuguuggacauuuggguugguuccaagucuuugcuauugugaacagugccgcaguaaacauaugugugcaugugucuuuauagcagcaugauuuauaauccuuuggguauauacccaguaaugggauugcugggucaaaugguauuucuaguucaagaucccugaggaauugccacacugacuuccacaauggucgaacuaguuuacagucccaccagcaguguaaaaguguuccuauuucuccacauccucuccagcaccuguuguuuccugacuuuuuaaugaucgccauucuaacuggugugagaugguaucucauugugguuuugaucugcauuucucugaugaccagugaugaugagcauuuuuucaugugucuuuuggcugcauaaaugucuucuuuugagaagugucuguucauauccuucgcccacuuuuugauggggcuguuuguuuuuuucuuguagauuuguuugaguucauuguagauucuggauauuagcccuuugucagaugaguaguuugcgaaaauuuucucccauucuguagguugccuguucacucugaugguaguuucuuuugcugugcagaagcucuuuaguuuaauuagaucccuuuugucaauuuuggcuuuuguugccacugcuuuugguguuuuagacaugaaguccuugcccaugccuauguccugaauguuauugccuagguuuucuucuaggguuuuuaugguuuuaggucuaacauuuaagucuuuaauccaucuugaauuaauuuuuguauaagguguaaggaagggauccaguuucagcuuucuaccuauggcuagccaguuuucccagcaccauuuauuaaauaagaaauccuuuccccguuucuugcuuuugucagguuugucaaagaucagaugguuguagauauguggcauuauuucugagggcucuguucuguuccauugaucuauaucucuguuuugguaccaguaccauacuguuuugguuacuguagccuuguaguauaguuugaagucagguggcgugaugccuccagcuuuguucuuuuggcuuaggauugacuuggcaaugcaggcucuguuuugguuccauaugaacuuuaaaguaguuuuuuccaauucugugaagaaagucauugguagcuugauggauggcauugaaucuauaaauuaccuugggcaguauggccauuuucacgauauugauucuuccuacccaugaacauggaauguucuuccauuuauuuguauccucuuuuauuucauugagcagugguuuguaguucuccuugaagagguccuucauguccuuuguaagaugaauuccuagauauuuuauucucuuugaagcaauugugagugggaguucacucaugauuuggcucucuguuugucuguuauugguauauaagaaugcuugugauuuuugcacauugauuuuguauccugagacuuugcugaaguugccuaucagcuuaaggagauuuugggcugagaugaugggguuuucuggauauacaaucaugucaucugcaaacagggacaauuugacuuccucuuuuccuaauugaauacccuuuauuuccuucuccugccugauugcccuggccagaacuuccaacacuauauugaauaggaguggugagagaggacaucccugucuugugccaguuuucaaagggaaugcuuccaguuuuugcccauucacuaugauauuggcugugauaugacagaccgucauagauagcucuuauuauuuugacauacaacccaucaauaccuaauuuauugagaguuuuuagcaugaagguuguugaauuuugucaaaggccuuuucugcgucucuugagauaaucauacgguuuuugucuuugguucuguuuauaugcuggauuacauuuauugauuugcguauguugaaccagccuugcaucccagggaugaagcccacuugaucaugguggauaagcuucuugaugugcugcuggauuugguuugccaguauuuuauugaggauuuuugcaucaauguucaucagggauauuggucuaaaauucucuuuuuuuguugugucucugccaggcuuugguaucaggaugaugcuggccucauaaaaugaguuagggaggauucccucuuuuucuuuugauuggaauaguuucaggaggaaugguaccagcuccuccuuguaccucugguagaauuuggcugugaauccaucugguccuggauuuuuuugguugguaagcuauuaauuauugccucaauuucagagccuguuauuggucuguucagagauucaacuucuuccugguuuagucuuuggaggguguaugugucgaggaauuuauccauuucuucuagauuuucuaguuuauuuguguagagguguuuauaguauucucugaugguaguuuguauuucugugggaucaguggugauauccccuuuaucauuuuuuguugcaucuauuugauucuucucuuuucuucuuuauuagucuugcuaguggucuaucaauuuuguugaucuuuucaaaaaaccagcuucuggauucauugauuuuuuugaaggguuuuuugugucucuauuuccuucaguucugcucugaucuuaguuauuucuugccuucugcuagcuuuugacuguguuugcucuugcuucucuaguucuuuuaauugugauguuagggugucaguuuuagaucuuuccugcuuucucuugugggcauuuagugcuauaaauuucccucuacacacugcuuugaaugugucccagagauucugguaugucaugucuuuguucucauugguuucaaagaacaucuuuauuucugccuucauuucguuauuuacccaguagucauucaggagcagguuguugaguuuccauguaguugagcgguuuugagugaguuucuuaauccugaguucuaguuugauugcacuguggucugagagacaguuuguuauaauuucuguucuuuuccauuugcugaggagugcuuuacuuccaacuauguggucaauuuuggaauaagugcgguguugugcugagaagaauguauauucuguugauuugggguggagaguucuguagaugucuauuaggucugcuuggugcagagcugaguugaauuccuggauauccuuguuaaccuucugucucguugaucugucuaauguugacagugggguguuaaagucucccauuauuauugugugggagucuaagucucuuucuaggucucuaaagacuugcuuuaugaaucuggguguuccuguauuaggugcauauauauuuaggauaguuagcucuucuuguugaauucagcccuuuaccauuauguaauggccuucuuugucucuuuugaucuuuguugguuuaaagucuguuuuaucagagacuaggauugcaaccccugccuuuuuuuguuuucuauuugcuugguagaucuuccuccaucccuuuguuuugagcguaugugugucucugcacgugagauggguuuccugaauacagcacacugaugggucuugacucuuuauccaauuugccagucugugucuuuuaauuggagcauuuagcccauuuacauuuaagguuaauauugucaggugugaauuugauccugucauuaugauguuagcugguuauuuugcucauuaguugaugcaaugucuucuuagccucgauggucuuuacaauuuggcauguuuuuacaguggcugguacugguuguuccuuuccauguuuagugcuuccuucaggagcucuuuuagggcaggccuggcagugacaaaaucucucagcauuugcuugucuauaaaggauuuuauuucuccuucacuuaugaagcuuaguuuggcuggauaugaaauucugggugaaaauucuuuucuuuaagaauguugaauauuggcccccacucucuucuggcucuuguagaguuuaugccgagagaucagcuguuagucugaugggcuuccauuuguggguggaccuuucucucuggcugcgcuuaacauuuuuuccuucauuucaacuuugguuaaucagacaauuaugugucuuggaguugcucuugucaaggaguaucuuuguggcguucucuguauuuccugaauuugaauguuggccugccuugcuggauuggggaaguucuccuggauaauauccuguagaguguuuuccaacuugguuccauugucccugucacuuucagguacaccaaugagacguagauuuggucuuuucacauagucccauauuucuuggaggcuuuguucguuucuuuuuauucuuuuuucucuuaacuucucuucuugcuucauuucauucauuucaucuuccaucacugauacccuuucuuccaguugaucgaaucagcgacugaggcuugugcauucgucauguaguuccugugccuugguuuuuagcuccaucagguccuuuaaggacuucucugcauugguuauucuaguuagccauucgucuauuuuuuuuuucaagguuuuuaacuucuuugccauggguucgaacguucuccuuuagcucggaguaguuugaucgucugaagccuucuucucucagcucgucaaagucauucuccguccagcuuuguuccguugcugaugaggagcugcuuuccuuuggaggaggagaggcgcucugauuuuuagaguuuccaguuuuucugcucuguuuuuuccccaucuuugugguuuuaucuaccuuuggucuuugaugauggugacguacagaugggguuuugguguggauguccuuucuguuugcuaguuuuccuucuaagagucaggacccucagcugcaggucuguuggaguuugcuggagguccacuccagacccuguuugccuggguaucagcagcugaggcugcagaacagcggauauuggugaacagcggaucguuccucuggaaguuuugucucagaggaguacccggccaugugcggugucagucugccccuacuggggggugccucccaguuaggcuacucgggggucagggacccacuugaggaggcagucuguccguucucagauguccagcugagugcugggagaaccacugcucucuucaaggcugucagacggacauuuaagucugcagaggguucugcugccuuuuguuuagcugugcccugcccccacagguggagucuacagaggcaggcaggccuccuugaacugaggugggcuccacccaguuggagcuucccaccgcuuuguuuaccuacucaaggcugggcaauggugggcgccccucccccagccgcacugccaccuugcaguuugaucucagacugcugugcuagcaaugagcgaggcucugugggcguaggacccuccgagccaggcgcgggauauaaucuccuggugugcuguuugcuaagaccauugcaaaagcacaguauuagggugggagugacccgauuuuccaggugccgucugucaccgcuuucuuugacuaggaaagggaauucccugaccccuugcgcuuccugggugaggcgaugccucgcccugcuucgguucacguucggugcacugcauccacuguccugcauccacuuuccgacacuccccagugagaugaacccgguaccucaguuggaaaugcagaaaucacccaucuucugcgucgcucacucugggagcuguagacuggagcuguuccuauucggccaucuuggcuccaccccccuugucugcuauuuuuaaugagaaucucaagccuuuacaaauuaaaaaaauacaaacaaaaacuuacuguccacuucucucucucuccuccuguccuagcaaaauauaagcacauguggcaggauccuguguguauuuucuaccacauuaugcccugugugccuggucuagaguaacugcucaacagacauuuguugacuuaaugcuuagcaguuaucguauuaugaauaguuguugaauaaagaguuaaaauggaaguugggugcaguggcaugccuguaguuucagcuacuugggaggcugaggugggaggaucaccugagccuaggaguuugaguccaacuaacauauugagaccccaucucuuaaaaaaaaaaaauuaaaauggaacuagucaaggcagauuaccuuaguaaugggaaauuuauuguaaggauauagaaaagagaauaguagacaaaucuuccaagagucuuguaacacaaguuguaguacagcugagccucaguuaucagggacucauuucuguggacugcuuacucuuucuagugggcuauguggucucuuacagugucuguuccucuuuuuguguugggucuauuaaaacuggcuuacaugagaaucacagugacuucccuggccucuguguacauaaagccauuuuggcuuuagugccuguuaauaccugcuacauuucuugauuuuacuaguugaauaucuaggaaguagaaucugacccaguucacucuuuuaagccagaccacaucauagcuugcuggcuagccuauggcuuuugguauuaaauucuuggucuuuggaaucaagugucaacgccagauccagucaguuuuauacuguugaucacguggucugccagggcugcucuuucagaaggacuguagauggggcacuuuucucuagaaaggccugugaauaagaugaacaauacauuugacaugauaaagcauaauuuuucuauuauguguuguuuagauuguuugcuuuuuuauugcuuuacauaauggugcaauaaacaucuuaauacuaauugugaucuuuguuugcaugucuggauguuuucuuagggucgaguccuaaaaagagauuuacugaaucaaaguacucuauuuaauucucuuuauagucucuuaauucauaauaucgaauuauuuuccagaaaaguuguaugguuugaugcuguaccauacucuagcucauugcuuuuucuauacuuuauuaaaggcugaaaaaaaguacauuuagcuaucuaaugcucaaaagccuugcaaucacauauucuggguuccaagcaaucacagauaacuuuaguaacugcuaucacuguaugcauccuguuuugcucucuuuccucccagaauucucauuguacuccuuacccuaauuucauggccaaauccacauuuucuuugaagcccugcucuguauaucccuaaucuuuguaccaguuuugcuucuagucagggcaagaggcaaauguacugaaguaagagcaagguuuauuuuaagauacacaauaaaccaucaaggaagagcaauuggacuucagaguaauuggaaauagaaagcugguaguaucaacugcuuuguuuuagggauuuuaugcauuguuuucuuacaggucuuucuugucuuugggcaucugaucuauuugcuucugaaacuugugaguuccucuucaaguugcacaugauucuuaauaguugccuuauuucugaauaugcaugacuuuucagcuccacucuuucugguaacucugggucuuuugguuuaaauuucccggaguagacuuugauuggcuuagcucaucuuuuccagcugguuauuagccaccgucauuuccagaugguuauuagucauuauucuggaccauccucuaauucugccaucugugaggaggggaaacaucacaaaguaaagaacauacugugccugcuuaccuacggcucuauguaaaauagugcacacuggauuauuuaaucuuuuggagacuuuuugaagcaaauuuguguacagccacagaaauacaguguaaaaaaggggucucaaaugaucuagcugaaaucuuucauuuggcugcugaaggaaacaucuauaggaagauugugauauacccauuguuacaguguuagcuccucuagauucucaggaauaugcucuuuccaucauacugaagguguuggaaguuuaauuacaguuuaauaguauaaucacaauuuaauaguuuaaucauacuauuugagcaaaguuuuugggacacuguuacgacuauuucccucaaaauaucaacauuuagauuaaaugguuuuccagaaauuuccaauaguuacaaaaauaauuugaaguugucauaaauauuaauuuauguugguauauaugacauaauauacaauuaacuuuaaaacuuucaaauguaaaauguauuaagaacaaauugagaaacaguauuguggcuggguguggcagcucacaccuguaaucccagcacuuuaggagguugaggccuguaaucccagcgcuccuggccagaucacuugagcccaggaguucgagacuagccuggacaacauggugaaauacuaucucuaccaaaaaauacaaaaaauuaacaggguguggugcuugcaccugugguccuagcuauuugggaggcugaagugggaggauugcuugagucugggagguggcaguugaagagagcugagauugugccacugcacuccagccuaggggacagggugagaccucaucucaaaaaaaaaaaaaaccccuaaacaauauugggucaucaccaucagagugaacaggcgaccuacagaaugggaaaaaaauucugcaaccuacucagcugacaaagcacuaauauccagaaucuacaauuaacucaaacaaauuuacaagaaaaaaacaaacaaccccaucaaaaagugggcaaaggauaugaacagacacuucucaaaagaagacauuuaugcagccaaaaaacaucugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacugcuggugggacuguaaacugguucaaccauuguggaagucaguguggcgauuccucagggaucuagagcuagaaauaccaucugacccagccaucccauuacuggcuauauacccaaagguuuauaaaucaugcugcuauaaagacacaugcacacguauguuuacugcggcacuauucacaauagcaaagacuuggaaccaacccaaauauccaacaaugauagacuggauuaagaaaauguggcacauauacaccauggaaugcuaugcagccauaaaaaaugaugaguucauguccuuuguagggacauggaugaagcuggaaaccaucauucucagcaaacugucucaaggacaaaaaaccaaacacugcauauucucacucguaggugggaauugaacaaugacaacacauggacacaggaaggagaacaucacauaccgggaccuguugugggguggggggacgggggagggauagcauuaggagauauaccuaaugcuaaaugaugaguuaaugggugcagcacaccaacauggcacauguauacauauguaacaaaccugcacguugugcacauguacccuaaaacuuaaaguauaauaaaaaaaguuauuuuuauuucuuuagaaguagcuauuuuaaaaaguaguauuuuacuucauuauuuguuaugaagcaaauuguuacauacuccaagcuuuugagaauaaauuugaggcuaaaaggugacuguagguuuuuguauauguuggccaggccaugggacugauuuuuacaguauugauuuuuuuuuuuuuuagagauuuuugacaaugaauacuuugaaugguuuauucuuagcacugacauauaaauaguuauuaaaagcacugacauauaaaauauaagauauaagauuuuugauuuccacuuccggaucuaccuuuuauugagaaugcaggcaagcuggagauagaguugguuuuauaaugguuaauuagagcaaauaauuaauuauugcauauuuugcuuuucaaggucucauuuuccuuucagauauuacuaccaccagugaaaaaaacacguuuuucuucuuuaucagagguauauaaauagacuuaguuuggaccacaaguuuguuucucuuuagcuuaguacuuagaaguuuguuauagcuccaucuauuaguaaauuaucaaaauuggcuaguuuuuuuuuaguaacauuaaauuacucuuuuuaaagucuaaauuuaaaauuuuacuuuuauaaagaaaguucuuucuuucaggccaguugcuguuuuggaguaguuaggaagaaauuugaaaucaucuugccuuuuaccacuuacucauaaacgcuuagaacguuuucuuaaguuuucuucuguuguuuuuuucuucccauagauuuuuguuuuuacauauuuguagucaagcuuugucuuauguuucccucgacauagcacccacagcuuugcguuuuucuacugcucuugcauaaauuuuguuaauuuugcauuuucugauaugaguuguuucuaagaggaacagucccuuugauuaccacacaagcagucguuauuagguuauuuccaacauuuccguacucaucauugacuuagguuaaacuuuuuugcuguaagcuuucuucauacugucuaguuccuuuuucauguauuuauuuugcuuauucagcacucucgaguggacuuugggcaguuagaauaacugaaucaugucaguaaaguguguucucaaucauguggacaaaagaacuuauucaaaugcuaccccuucccugcuuuucuuacuguaguguggacuuacaucucaaugguaggaguuuuauguaucuuggaguuggcggugccuuguggugggugggaguuaauaaugguaaggguuuguuuguaggugugaaaaacugcagaaagacaaauggaccaauaauaugaauagucaguuuacagagaaagaaauauaaauggcugauaaauaugugaaaagaugcuuaucuucuaauaaaaauacaaauuagaacagggagaugucagguuuuguuggaauggaaagauuaaaacauuugauaaugauugggguuagugaguaaguggagaaauagguacuuuuauacagcuuggggcuauaaucuuuuuggaagacaauuugcaguugcaauuaauuuuaaucacugauccagcauauuauaucuuagaauuuauccuguagggauucuuggacacauacgcauauaucaucuauacauacauguucaucgaagcauuguuugaaauaguaaaagacuggaaacaaccaaaauuaauuauggcaaagccacaacaugaaauacuaauacugugcagcuauuaagaagaaugaauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaugacagggaugcccucucucaccgcuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugggugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauagguaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacgugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuaucgcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaacauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaaaaagaaaaaaaaaaaaaagaagaaugaaguaauuuccucugugcugauguagaaaguucuucaagauacauuguuaacuaaguggaaaauaaguggcagaauuguguauagcaugaucccauuuauguuaaaagaagauauauaaaagauauacuuuuauauauugaacauuucaggaaggguucauagguaauuauuaaguaauugcuuccugggaaugaggaggggagggguaagaagggugaaaaggaugagaaggugacuucauuuucuuauuuaauuuuaaaauuuaauauaugugugauuuccucuaugaaaaagaaaaucuuguuacugaaaacauuaauauuaaacauuuuaugugccuuauuuaccuuguacaugauuucaauguauaugugacuugugaaauuucuugcuuaaucaggaacguauuaaggaaaccuauuuguccuuuuuagaaauuaauaauucugagaguaucauaaagagcuaggguuuuaauuaggugacuaaaauggagagaaggaauggguguuuuccugggaaaucuuuguuaaucuguguuuuguccucuugguuguaagauuuuucauaugucaacacuggccucuuaagacuuucuauaagaucucuugguacagccaaguaaccaucaaagcccagacaacccugccuuccuguuaguuuuuuuguuuaugagcaaagaucacagcagaagugaagaauuuaaaugcaauuaauaaagagcaaaaaauuugagcaacagaaaacgaaacgauagaaaaaugucauuaguaaaguggaaaaaacaguaaagagggcugaguuugaauuauagucauguauuuaccuugugacauaggaauuugauuaaauccugugaaauuccuuuuucaaaaauauuaaggugggauuaauaaccaacuucuaggauuguggcagucuugaaagaaagauuaggaauauagaaugaaaauaguauaauacuugucacccaguagguuuuuaauaaaugguaccuccuucuuguaauuauuuuucuaacucuuaauaaaauguaccuucuucaguagaaaaguagacauauuuacauugaucaaaacucacucccagggagcggugggaguuuaauaguaacacucuugauauaguauucuugguaagauuauaguacuuuguuaaaccucucaacaugcuuaguacaccuugauuuaucagguuuuguuucuuuuuuuuggucuuugaaguuuagacacuuaucaguaguugucaaugaucucaaacuuugacccuguaacuuccgggauguuaaaacauccaacuauucuauaguaaaugcuaauguaauuaaucuauuguaugcuauaguuucauaggaaauguggucauguuuguuuaagcuuuuuaaaaguuuuccuuuuguuacucuccacuucaauuuaucugagacauaaaggaaauuugagaaauuagaacaguguuugugggauuagaguauuaguuuucuuuucugaaaauaauguaguuaagacaauuauauauaaaacuaaaguuagagaagacugaaugaguguguuaugccucuucacacugcauuuuaaaagaccucucaacaugccuaauacucccuuaucagugcuuuuuuugucucuuaaauuuagacgcaucugucagugguugucagugaucucaaaauuugcauuguucauuaggacauuaaacccucuagagcagcggucuccaaccuuuuugguaccaaggaccgguuuuguggaagacaguuuuucuacagcgaggggugaaggagagggaugguuuugggaugauucaagcacauuauguuuaucauuagauucucauaaagagcauacagccuacaucccuagcaugugcaguuuacaauagggcuugaguuccuaugagaaucuaaugccaccgcugaucuggcaggauguggagcucaggcaguauugcucacucacucacugcucaccuccugcugugaggcccaguuccuaacaggccauggacugguaguaggaauuggggaccccugcucuaaagaaagcagcaauaucuuuauugugguaauaguaccacagcaaagaaaagaaacacauucgcacaacuuuaaauacaauuuuucggaguucagagaccuacugaggccaucuaugacuuaugucuauuagacuucagguugaaaacuuuuaguuucaauguucaaagcagagaauacuuuucucuuuccuaauaggauggauuuggucuauaagaauaggauuauaacaagugaggguuaauauuuuuaaaguuuuuuuuggauguaacagcuuaugcuacagaauuaucucugagcugugaauuacuaauaucagcuaaucauucuuuaucaucagagaaacaguuuaguccuuuuauaaaacaaauccucccacaugaauggaaggaaagcaauuuuucuaagacucuuccucuuuucuugggccuucucuguguguaggggcugagccauauccuugauuucaagauaaaguguuuuauaggucaguacuguuagaagagcaguacacucguauauugugcucuggcacaggucagcucuacaaagaauccaaggagggauaauccggucaagggauuccauuucuccagaaaaggcuugcaguccuuuuccuugccucccuauaauaauccuguggccuaucucccacaugugaagagguuaguuuacuaacuuuacuaacuuagcuuagucagaaguauuucauuuaucuaacacaaaggagcccacauccauacucucuggggucaauuuaguauuugcuuguagucuuaacgaacacccuguuuuccuccugcacuauaaauucuuccucugguaaaacuagauucugaaaaagaauggaacaaaaucacuuuugaucucucuaaaauugagagaaugggaaucuuuugaguaaauuauagauuuuguauaaacuguuggucuuuacagaaugcuuauucugugcuccaugaugugguaaauuaauugggauuacaaaaaugaacacacuccuucuagcaccaacaggaucuucauggaauagagguagggcaaugcaauggaaagagcaggaacuuuacugugaagcaaaugaauccucauucagugaacuagggcaaauuacuuacccuuucugggccucagcuucucugucuucaaaagcaggccugugaagauaaugauaauuuuuguaaagacccuagcaaaacagcuugaucauaguagguauucaguaaauggugaauuauaaggaaggcuuugguagauucucuucuaguagaucuucuacauuuauugauacuguuagcuggaaaaucagucagaaucucucccucuuuucuuaagcuuaugaggauagguuggccaaauuauuagcaacaaggcagugucaguguuucaacuccaaguucuuugacuaaguuucuagguacuuagacuucuggagccagacauucgguuaggaagacuuuaauaauuuauuuacuauacagcuauuuauugacagcugcuuaugugcuagguguugggaccacaaugguaaacaaggacaagguaagguccuugcucugaugaaccauucaguauagugggaaccagacagacauuaaacaugccuuaaaaccauuaaaaucucaugggcccucaauuacagaaugcaugugauucaguacugacugauuauaugagucccuuuuucuuccacccuuggauuauuuaugcauuagacucuuuagaaaaugccccugugcacuuuuucaagcuguuagugugcaauaguuuaagagauuccauucuagcaguaaucaugguuauuauauaaaaugguaggcauugcguaacucugguucaacaggaaacuagcaccagacauaaguuguuccauuuugaugggaauuacuaguuugguaggggguuugagaccauucuaaaccaguggucuuuaaacuuuccauuuuuuuccuuuucuugagacagggucucacuuagucacccaggcuggagugcaguggugcaaucauagcucacuucagccuugacuucccgggcuuaagugauucucccaccucagcuucccgaguagcugggacugcagucgugugacaccacgcucaacuaauuuuuggauguucuguagagaugaagucucacuguguuucccaggcuauucucgaacuccuaggcucaagugaucuuccugccuuggccuuccaaaguguugggauuacaggcaugagccacuguacccagccucuuaacuuuuaguagcuguguaguauuccaguguaauucaguaauuuauuuaacuacuccucacugaugagugguaugauuauauuuaguuuuugcuacuauaaauacugaggcucugaauguccuacauauauuuuggcaaacuuuuguauauauacuuauaggguaaaauagggaauauuugaucaaaagguauauuguacuuaagauuuugauagauauugccaaauuauuuuauccauguagauuuuaauuuagucuggugugggacugagcagucuguguuucuaacagguuuccuaggugauuuugaugcauccaauuugaacuauugccggaucagaaaaauggaguauaguacacauucucuggaaaacaucaggcaauuaugguuaucuagggaagaguaaaaagccuuuucagugacugagccguaagagugaauuuaucuuaaguagcacuaguugcuagggauggcacaucuuuagagaaacaaaguguacuaauauuuaucuggaauauuuuaugucuuuuugauauauaauguagggaaaagaauguaagaauuguaaggaccugaguuugaacacuuugcauuuaguaacaguaaucuugggcaaauuaaugcacuugaauuuuucuuuauacagugauaguaucuacccuccagguuuguugcaaagauaaagagagagugauccaacacuuguugaguacuucuucugucuucuacuauuuuaugacugucucugucauggcaguuugucauuuaguuguaauuaguaauuuaccuagucaucuccccauuagaguaacugggaccaugucuugcacuuuaguguucucagucccuagcccagacuugagacuuggugcacuguucuguuucuuaaaugacuguguaaauuuuccauuuuaauuuucacaaguauccuaagagacaaguauuauuugcuucauuuuaccaugaggaaaugcuuagggaacuuaaauaacuuucuuaagauagcacagcauggcauaaccaaaacugaaaacugugugugugauuucaaacuagauaaagucugcuuuuuccaugaauccacuuugcugagauaaugauauaaggcacguuggaaauuuugaaauuguuccucaagaguaagaugauuuuuguuauuuuaauacuauacuuuaaaaauuagcauggugauccaaacauuucuucugcauauacucaauauuccccuucaguuuggcuuuccugaauucaugguauaaccaagucugccuugucuauaagaauguaagugaucauuuccuccugugagugauuuucuccauauuuuucuugcuugaaauucugucuuugcuuuucuuuuggugaacuuuuugauuuuuauaaacacauggguugaagauguuuuauauagugguuauggcaggauuuugguaacauuggaaguuuuaguagaauuaaugucuuccugucuggucuuuaucuucauuucccucuuucauuagcagccuuauauggaucccuucagggcaugggucacugauucagaugucaucacaugucagcccuggcuauuggauaucucuauuuuguaggucguaaccacacugcuuaaggguguggaaacagugcggaaaaauaccauuucauaaguuuuauguuuaucuugcuuuuaauggagcuuuucuuuugagaauuggguuguuagguuguuuugaauauuuaaucauaaguaguuuggaagaaaaagaaauaugucccaacucucugacccuuaggucauaaaauucacaaaguugcaaaacaggaauagcauacagcaagaaguguugcaauaggaagaaaugugugguuuuacucauuagaguuggacaugggaauuuucccaacaauuuaauucuguguuguagucuauuuucaagaucauauagugguauuugcccaauauucuauauaaauucauucauuuucuauuuuauuugacuuuuuuaccuuugguaaaacaacuuuggguugguuuccuuucucccucaggccugaugauguuggggauggaugguggauguuggaggcaggcugcguuguggauucauuugagucuugaugcauuuaaguuuagccauugccuuagugcauguaauucugccuuuguuguucauguuuauuuaacuagcucuuuaaggcauguggaauuguguuggaaaaugcaugccugauuucuaucuugauauuucuuaagccugguuugaacccugggaacacaguuacagucuucaguggcuuaguauuuuuagauggagcuuuuauacuuuaggguuuacugagaugaacuuuggagagaaagucuaaacagaaugacuuaugaccugcaggaacaguggcuguucuaagaacuggaagaacccuuuuccuauuaguaacaguuguugaaugauaaugcauggagugucaucaguuuauuuuuuaaugugacuuuuaauguucuuauuuagaaauugauauuauauuaacuauuuuguaaaaugucccaagguauacuuuauaauggcaauaaaaucuaagauaaaauaguauguaauaagauuucaaaaguuacauaucuuauguauuguaaaacuuuuuuuuuuuuuuuuuuuuaggcauauggaucaggcugugauauuguuauuuuggcaaaugacuuugaauguguacagaucauuccuggugcuaagcauggaaacauccaagucagcuguguggaguguucuaaccaacaaggaagaguaagggauuuaauuucuuuacugaaugucauuuaaaaauguguuuaauaaucucagaaucuucuuauccuuuuaugcaaagcuugcguauaauuucuuauguauugcuugggugauuauuagcagaaguugcaaagugauagguuuauacaaauuguaaagugccauuaaacugauaauuugauaauuguucuacagcuguauguauacugucuucaaagaucuguaggccuuacaauccugugcauacugauauucugccaguuaauacuucuagcagccauuaagccaguaaggggaaguaaacuuuuuucuucucuaccuagcaccccuuauaucacucauacuauaacaucaaaguuuuauuaagaaacucugcaaguuguuaauaucuaauaucaugcuugucauauaggaagugcuuuguaaagucuguuaacauaaugaaagauuuuuuguugagugaagagucuuaugguucauucaggcuuuaaaacagagguuuuauuuugaaauaguuaaaauuucaucauauguaccucucccccaauuuucaaacauaauguacaucaaauuuugguggcaugucaaguaaauauaggauguuugcuguauacuccagcaauucaguaaggccaguauuauguagccgaguugaaugucucuacgagaauagaguaauaagguuuuuaccuguaaucauuguaacaguuuaaacaaucuuaguguucuagaaauuguuauuuauuggguaacaaauuugaucaagaguauguuaaaucagaauauucauggugauaaauaguaaucauacaaauuuauacugaaugauaaauuaugguuacuuuaucauaccauuuauccugcccuauccuacugcccauaucaagccuuaauauuuguguaaauguaccaguacuugacaguucagugauacauuugaccuaguauugaaacacgauuuccugguguuuccugguacuuguuucuugcuuuucuaauuuuuccccccagguacuccccacccucaagcauugcuuacacuuaguuuagaaaacauggggagugucagauuucucuuuuuaauuuuuuguugcucuucucucuaggccaagcaagguagcuuaagccugccuaaaguuguaugauaguugucagaggugaauuuuaguaaauaacucaagugcuggugauaaucgcaaugaacacacauucucuggaaguaaaacuuuuuaaaaaaguauauaagacauugguauucauaccaugggaaacagagcaacuuguguuucuacuuuucuugagaugguuuaauguaaauaaggcaaaauuauaauaucuuuauugucuuuauugacaucuucguuuaguccuuuuaucccccaguccuuguggugauaacuuucacauuggugaccuuguauuagucuguuauaaucauucauucauugauugacauguugaauggaauuauucacaacacuuuuugcguaagugucauuugaaguagcuuucuguuguggauuaugauuuuucuuggaaagaauguuagauguuggauaagaguuaaaaucacuuuuugguauaacagugccuuaaaaucacaggggauauuuuuggcaggccuuaaaagaauauauaccuaauugaguuuuaaagguuaaccagggugcagaggugucagaaaggacgguuuuuggucuauucccuguaguuaauuccaucuuaccaagaggagagugaacuuagaaauagccuucaagaaauuauuggaaaacaggcugugguaguuucugggaacagagggauuuaugucuuuucuuaccagguaugugaccuggaacaaaauccuccuggucccuaaauuucuugcuucaguccucuggagaugucuucaucagcucuuucccccaggugcaguuuauggcucccugacuucuccuuagccuguuuuuuguauuccuuccucuagauggugucccaauugguauuuucuguuugaugguauaauuaggccauuuuauuugaaauauuuuuaagaccuguuauuaguugaugcuuuucucauagauuuuauauuauuuucacuggauuauaaaguuucugacaaagaugcaugcuuuugaaauguauuuuuuaauaguuauuuuauauuaaaaauaaaauucuuaugaaaaauaugauuuuuucccauauguauauauauauuuuuuauuauacuuuaaguucuggggcacacgugcagaacguguagguuuguuacauagguauacacgugccauggugguuugcugcacccaucaacccaucaucuacauuagguauuucuccuaaugcuaucccuccccuagccccccgacccccugacaggccucagugugugauguuucccccaguguccauguguucucguuguucaacucccacugaugagugaggacauauuguuugguuuucuguuuguguguuaguuugcagagaauaaugguuuccagcuucuuccaugucccugcaaaggacaugaacucauccuuuuuuauggcuguguaguauuccaugguguauaugugccacauuuucuuuauccagucuaucauugaugggcauuuggguugguucuaagucuuugcuguugugaacagugcuacaauaaacauacaugugcaugugucuuuaaaguagaaugauuuauaauccuuuggguauauacccaguaaugggauuggugggucaaaugguauuucugguucuagauccuugaggaauucccacacugucuuacacaaaugguugaacuaauuuacacucccaccaacaguguaaaagcguuccuauuucuccacauccucuccagcaucuguuguuuccuggcuuuuuaaugaucaccauucuaacugaugugagaugguaucucauugggguuuugauuugcauuucucuaaugaccagugaugacgaacauuuuuuuucauauguuuguugcuuaucagcuuaaggagauuuugggcugagacaaugggguuuucuaaauauacaaucaugucaucugcaaacagagauaauuugacuuccucucuuccuaauugaauacccuuuauuucuuucucuugccugauugcccuggccagaacuuccaguacuguguugaauaggaguguugagagagggcauccuugucuuguacugguuugcaaagggaaugcuuccaguuuuugcccauuuaguaugauauuggcuguggguuugucauaaauagcucuuauuauuuugagauacguuccaucauuaccuaguuuauugagaguuuuuagcaugaagggcuguugaauuuugucaaaggccuuuucugcaucuauugagauaaucaugugguuuuugucaucgguucucuuuaugugauggauuacauuuauugauuuguguauguugaaccagcuucuuaucccagggaugaagccgauuugauggugauggacaagcuuuuugaugugcugcuggauuugguuugccaguauuuuauugaggauuuuugcauugauguucaucagccauauugguguaaaauuuucuuuuuugguugugucucugccaggcuuugguaucaggaugaugcuggccucauaaaaugaguuagggaggauucccucuuuuuuuauuguuuggaauaguuucagaaggaaugguaccagcuccuuuuuguaccucugguagaauucagcugugaauccaucugguccuggacuuuuuuugguugguaggcuauuaauuauugccucaauuucagaaccucuuauuggucuauucagggauucaacuucuuccugguuuaguauugggaggguguauguguccaggaauuuauccauuucuucuagauuuucuaguuuauguguguagagguguuuauuguauucucugaugguaguuuguguuucugugggaucauuggugauauccccuuuaucauuuucuauugugucuauuugauucuucucuuuuuuucuuuauuagucuggcuaguggucuauguauuuuguuaaucuuuucaaaaaaccaguuccuggauucauugauuuuuugaagaguuuuucauguuuccaucuccuucaguucugcucugaucuuaguuauuucuugccuucugcuagcuuuugaauauguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucauugguuucagagaacaucuuuuauuucugccuucauuuuguuauuuacccaguagucauucaggagcagguuguucaguuugcacguaguugugagguuuugagugaauuucuuaauucugaguucuaauaugauugcgcuguggucugagagacuauuuguuaugauuuccauucuuuugcauuugcugaggaguguuuuacuuccaauuauguggucaauuuuagaauaagugugauguggugcugagaagaauguauacucuguugauuugguguggugaguucuguagaugucuauuaugucugcuuggugcagagcugaguucaagcccugguauccuuguuaauuuucugucuugucgaugugucuauuauugacaguggaguguuaaagucucccacuauuacugugugggagucuaagucucuuuguaggucuuuaagaacuugcuuuaugaaucugggugcuccuguauuaggugcauauauauuuaggauaguuagcucuucucguugaauugaucccuuuaccauuauguaauggccuucuuugucucuuuugaucuuuguugauuuaaagucuguuuuaucagagacuaugauugcaaccccugcuuuuuuuugcuuuccauuuucuugguaaaucuuccucuaucccuuuauuuucagccuguaugugugucugcaugugagaugggucuccugaauacagcacacugaugggucuugacucuuuauccaguuugccagucugugucuuuuaauuggggcauuuagccuguuuacauuuaagguuaauauugugaugugugaauuuaauccugucauuaugaugcuagcugguuauuucgccuguuaauugaugcaguuucuucauagcauugauggucuuuacaauuugguauguuuuugcaguggcugguaccaguuguuccuuuccauguuuagugcuuccuucacuaaggaaggaaggccugguggugacaaaaucucucagcauuugcuugucuguaaaggauuuuauuucuccuuugccuaagaagcuuaguuuggcuggauaugaaauucuggguugaaaauucucuuuaagaauguugaauauuggcccccacugucuucuggcuuauaggguuucuuccaagagaucugcuguuagucugaugggcuucccuuuguggguaacccgaccuuucucucuggcugcccuuaacauuuuuuccuucauuucaaccuugguuaaucugaugauuaugugucuugggguugcucuucucgaggaauaucuuugugguguucucuguauuuccugaauuugaauuuuggccugucuuucuagguuggggaaacucuccuggauaauauccugaagaguguuuuccaacuugguuccauucuccccgucacuuucagguauaccaaucaaacauagauuuugucuuuucacauagucccauauuucuugaaggauuuguucauuuguuucacucuuuuuucucuaaucuuguccucuugcuuuauuucauugaguuuaucuuuagucucugauaucuuuucuucugcuugaucaguucggcuauugauaacuuguguauguuucaugaaguucucgugcuguguuuguccgcuccaucaggucauuuauguuccucucuaagcugauuauucucauuagcaauuugucuaaccuuuuuucaagguucuuagcuuccuugcacuggguuagaacaugcuucuuuagcuuggaggaguuuguuauuacccaccuucugaagccuacuucugucaguuugucaaagucauucuccauccaguuuuguucccuugcuggcgaggaguugugaucauuuggaggagaagagguguucugguuuugggaauuuucagccauuuugcacugguuucuccccaucuucauggauuuaucuaccuuuuuucuuuaauguuggugauguugauaguauuccuuuauguuuguuaguuuucuuucuaacagucaggccccucugcugcaggucugcuagaguuugcuggagguccacuccagacccuguuugccuggguaucaccagcggaggcugcggaacaacaaagauugcugccuguuccuaccucugggagcuuugucccagaagggcacccgccagaugccgggcagagcucuccuguauguggugucuguaggccccuacugugaggugucuccagucuggguacacgggggggucagggacccacuugaggaggcagucuguccuguaucagagcucgaaugcugugcugggagaauugcugcucucuuuagagcugucaggcagggacguuuaagucugcugaagcugugccugcagccgccccuucccccacgugcucugucucggggagcuguggugggcuccacccaguucaaacuucccagcagcuuuguuuacacugugaggguaaaaccaucuacucaagccucagcaauggcggaugcaccuccucccaccaagcucgagugucccaggucaaccucagaugcugugauagcagugagaauuucaagccaguggaucuuagcuugcugggcuccgugggggugggacccgcugaaccagacacuggagaaaauuuccuguucugcugguugugaagaccaugggaaaagugcaguaucugggcuagaguguacuguucuucccgguaccgucucucacagcuucccuuggcuagcaaagggaaauucccugaccccuugugcuucccaugugaggugacgccccacccugcuucagcucaaccucugcgggcuguacccacuguccagccagucccagugagaugaaccugguaccucaguuggaaaugcaggaaucaccugccuucuguguccaucucguugggagcuguagaccagagcuguuccuauucagccaucuuggcagcuguccauccaaauaugauuucuuugaauaggucaaccuuguauaugauauguaaaauaaagccugcugaauuuuuugauaacaggggagagacucuuaacuccaguacacuuccagguauauuuauggaaggaaauaaaccaugaauacuguauugagauuauauguaauuaguuuauacauuauuaugaaaaggaagauaucuuuauuuuacccuuuucuagauauuaaugcuguauuuauucuuuuuuagauugcagcuucauaugguaaugcuguuuguauauuugagcccuugggcauaaauucucauaaaagaaauuguguaaguauuaaccaauaauagaauacuuuuagaaucuaguuaacuuuagaauccaauugauguuaauaaaaagcuccuuaggagcuagugcugaaaauagacuagaguaucagugaaaaauuggucuagugcuuuauguuaggauccuuacauucacuacggauacaucccuagugcuuuuagaaacccaagucucuagaauauugcaaauugacauuuacuguguuaacugagaucuacccuaguuugaacuacuguuauuucuugucuggauuacuaauaucuaucugauaucugguuuccugcugccuucagccccagugucuguucucaacagaggagaucaugacauuucucugcuuaaaacuuuguaaugguuccauauuucucucucuuuuuucuuuuguuuugagacagggucgcacuguauccccugggcuggagugcaguggcaugaucacugcucacugcagccucaaccugucaaaugguccucccaccucaaccucccaaguaguugcgacuauaggcauguaccaccauggccagcuaauuuuuaaauuuuucguagagauggaguuucccuguguugcucaggcuggucuugaacucuggggcuaagugauccucccacuucagccucccaaauugcuggaauuaugggcaugagccaccaugcccagcugcuccauauuucuuucagauaaaaagccaaaagccuuuuguagacuacaacuucccuucuacucaguagcacaguuacuaugucucagagcucaccucguaaguucuuguccucucugguucuacucuggccacauuggcauuuuuacuguuucucaguuaaccuucccucuuugagccuuuguguuguuuguuuucuuugucaggaauguuuuuccuccagcuaucuccaaggauagcucccauagauccuuuaggucuuugcucacuaauaccuugucaaugagguuuaccuugaccacccuuuaaaaaauuguacccccacuuaucuugcuauuuaaaaauuuuuuuacagcauuuauuuauuuauuguuuacuauguaaaauguuaucuaaagguacauaaggguaggaagcuuuuuucacugaugaguccccaguacuuagaacaguaucuggaacagccaggugugguggcucacaccuguaaucccaacacuuugggaggcugaggcggguggaacacgaggucagggguuugagaucagccuggccaacauggugaaaccccgugucuacuaaaaauaaaaaaauuauccaggugugguggcacgugccuauagucccugcugcuaggaaggcugaggcaggagaaucgcuugaacccaggagguggagguugcagugauccuggacugcaccauugcacuccagcuugggagucagagcaagacuccaucucaaaaaaaaaaaaaaaaaaguaucuggaacauaguagguauuccuaaauguugguugaaugaagaaguuaggaguuuaaaaagcucacuuaccagcucagcuaagugguuaagcauaccacauugugaaccauucagauucauacugggugcuauauuauauuugucuuacuuaauguucaaaacaucuaaugugguuagaauuaagcccuuuaaaacauccugcaugcauuacauuuuuaccaucacucagaaauaaucaaaauugcaaaugcuaaaucugaaugcugaguauauauuuacaaauaauuuuuaaaguauauuuuuaagugaaaugccuuaaaacaaaugguuuugguauuuuuucauuaaauauauguauuugaauauaucuuuuuacauucccccaaaacaguauaaauuaaaauauuaaucuuucccuauaauaguauugugaaauggauaucaaauuuuggacuacuuaagagucaccuagagcacauacuaaacauuuagguuuccaggucucauuccccaaauuucuucaagguaguugcuccacagauugcacucugaggaacacuaaaggaaagaauauuagggaugucuauaauuuuaggaauuauuuaauuacuacacuaaaauagauuuguugaacaguauuuaguguuaugcuguugugauuguuguuuggucagcagugguaggguuuaaaaauagcauuuucucugauuauaaaauaucaaauaauuuuuggauaaugaagugcaggguuugcagaugcacacacacacacacacacacacacacacacacacacacacacacaccccacacacacauuuuuuuuagauauagagucuugcucugugacccaggcuggaauacaguggugugaucaucauagcucacuauaaccucaaacucaugggcuaaagugauccuucugccucagccuccaaaguagcugggucuacaggugugagcucccaugcccagcuaauuuuuaaaguuuuuauagagaugggggucuugcaauguugcccaggcugguuucaaauuccuggccuuaagcaauccuccugucauggccucccaaacuguugggaugcagcuauguuuuaaaauucugccuugagguagucaggaaaccuuguauacauuuuaaaauuguuaaauauucuuaaaauauuauaacacaaaauggcauuaccguuuaaacaguauuauuugccaagccguuaacauauagcuugccuaagguaacauagcuuugcaaagcuuuucacaaauguccucucacaaaaggacauuuuauauuuauguacuacaaagaaauauguaaacauuuaacaucuuuaugccagccauuacaaacgcugaagauaacaaaauuaugacacaguuucugcccuugaagaguugcaauuuagugggaggagagucagauguauagaccaauacuaauuccaugugaucaguguuauaauggcagaauguaaaagugguauuggugcugccaggaugucagagaaggcuucauagcagagaugaugaguuagcuaaucuuaguggaaggauagggguuugcagauggagacgugaggaauaggauauccuaaauauaagaagguauuuauaggcaugagaaaaagcgugagagaaccugcuuuguuugggcauggcaaggagcucaauaugguauaauaaauaguaguggaaccaaugaaaguuacguuaaaaacaguauaugaaaauaauagugaaauauuuucaucuuuguuccagaucuuaaagucuuaaguugaagaaaaugauaaaaugguaguguuuugggauauuauuugaaaaacaucuuuuucuuuuuucuuauuucuuuuugucuacguauuucagcaacucaagugccaguggcuuaaaacugggcaguuuuuuuugaguucugugacauacaacuuagcaugggauccucaagguauuuagcaauuguauuuaaaauuauuuaaauuaaauauuuguuuuaaauguaugauaauaaugugauauagucucccauaauaagaaaaugaucaauguauuauauuuucuuuuuguugaugaauauaauuuuuccuucuugguauacagugcuuugugcaaugcuuaauuuacuauucuguuuuuuccccugccuuuguguguuuuauuucaagaagcaguuaugauuuguuuccuaguuaauguguacugcccuuuacucuuguuguauuugcuaagaaacaccauuggaaauaaaacagagaccaaaaaaacuucaccucauuuuaucauuuguaucaggaaauuacuaucuuuaauuuugaaaaauuaggaauuucuaaugauaauagcuguugucccuuuuuauauucacaauuaauaaggauucuuuuuauauuucauguguaaaaccacauuuuauuaauuuguaguuaugccuuauaucucgaggacauuuuaugugguauauaucagaguuuuggggacuuuguuauucuauuaauacauuuguuguuaguuuuuuugacuugcuugauaauaauagcucuuugccaguaagcuuuacuuuguuguucucaaaucuuccuuaagaaucuuuguuguccagaagauucuuuuuucuuauaagggacuuuaaaaaaauauauaccaaguguuuuucguuggcgauauugcuuacuuuucacauaauauuaauaguuuacagaucuaaacagaagcccaugugcauuuauuucccuauauaauauuugcauauucaucauaacauucuuuaauuuucagauaauagauuguugacagcaacugauucuauucaguugugggcuccuccaggagaugauauucuggaagaggaggaagaaauugauaauacaguuccuccuguuuuaaaugauuggaagugugucuggcagugcaaguuagugucuauuucuauuguuauauucauuaauuaaaagcaagugcuuccuaaaauauguuuccuuucacaaagaucuuuauuuuuugaugguaccauugcauuuagaugccuagaaaguagauuuuuuucuaaccaaaacccauauaauagcauucuuuaauuugugcuauaguuaaucauuuaaaaaaaggaugaaaguauuuucauaguuauagccccaggacaggaguugacaggguugauacauaggaaauacucauuaauagauugagguaaggauggagagggggaagaugugaaaguugccagccacucuuucaaguggaagauguacuauuaacagucauauagauuaugugacgaagacuagucagggaugaugauaagcucagcuuuuaacauguuauauuuaggauguuggugggacauguagguggagauauacuguauucauguuacuuacauucuucuuuucccaaagugaauguuggauuaguuuuaauaaauuuacauuuuuauggaggugaaauauuuuauuuauauuuuuagggaagcaaaaacagucuuauucugaggauucugacuuugauguuacaaaaaucucaucuugaccauuuuuauauacaguacaccagauuuuaaaagggcuaauugccuaacucucucuuuuuuagaaccucaguaucuguacauuugauggaauggucuccugauggugaauauuuugcuacugcuggaaagguaaaggaucaaacaaaaacauacgaaauaaacaaauaaaagaauuuaaaauguuccuuauuuauuuuuauuuucaguuuucucaucuguaaaacugggauaauccuccuuggcaaagcuggccugaagaauaaaagugguguuuguaaaagaccugguauuuugcucacagguuguaggcgcuugggaaauaauggcuauucuuauuacucuuauuugaccuuggcuuauuugcguuuuuaaaaacuaaguuuuguguuuaaaaauagcauauguacauaacuuaaaaaguaaaauaauacuggauucacaaugaaaagauguacugcuugccucauuauuccaacgcuaauuccuguguccaggaggcaauuauuugucaaguugaauauuuugcuauuuccuuccauguccuucaauaacuugcaggugcucccauuucuugauucugcccagcccccugaguuauauauauuauuuuuugccuucccacuguagaagcugaggcuuuagcuugauaaaggugagggguugauauccccaacaucaucuucacaucuaauauauacacauauucauuucacuugcuccuaucuuccugauguagguaucucaugauuuuggguaaaucagaaguuauuguuuauguuauuaagauuguacagauuauucuuaauaguaauuacuuuggagauaguaauugcuuuguuuuaugguuugcuuuuuuuucuauauaccuaauucauccuuagaacugcuuugacucuuuucucaguauaaucccacauaggagguauucugggaacaugaguucucuuugcucucauucagcuuaauugcucuaccagucuaaaauagcagagcuaccauuuucggauuuucuuuuaccaacuuugggaaauucucuuugccucucuccuuuguuaaauuuucuguuucuuagcaucauuuaucuuccuuuuuucuuguuuugauggagauaucccccaauagguuccugaagaaaggugaaugggaaaaaacauuuuuucaggccuuacgugucugaaagauuuuuuucuuaugcuugauuuucucgggcauagaauuggguugaaaaaucacugaccuucgauauuauaucucaauaaacuuuuuaauugauauauauaugggauacaugugauauuuugauacaugcguaauguguaaugauggucaaauuagaguauuuaggauauccaucaccucaaauguuuaucucuuuuuguguugguaacauuucaaaucuucuaguuaauugaaauguacaauauauuauuguuaaccauugccacccuacuguacuauugaacacuagaacuuauuccaucuaucuaacuguguauuuguaccaauuaaccaauuucucuucaucuccuuuuuuagcucccacauaagauugagaaaauaacgguacuuuuucuuugugugcuugucuuauuucauguaacauaaugacuucuaguuccauuuauguuacuacaaguuauaggauuuuguccuuuguacagccaaauaguauuccacuguguauauuuaccacauuucauuuaucccuucauuuacugaugggcauguagguugauucuauaucuaggcuauugugaauaguguugcaguaaacaugggaguguagcuaucccuuugauacacugauuuccuuuuuuuuggauaaauacccauuagugggauugaugaacuguaugguaguucuaguuuuguuuuuuugagaaaacuccguacuguuuuccauaaccacuggcaccugagcaagcugccuguaggcccaaggacugguccuccuggaccugugacuacuggcgucuuguaugcugccugggagcccaagggccugcaugccuggccugccucugccaccacgggugccucagaacuggccugucuggugucccugucugcagcaaagccucacuacagccucugcuaccaaccacagccuaagccaaugaguaacucacagccaccacugacacugacuacaccugaagaaauuguaugaagacuacucuccugcacucacccagaaucaaagccaaagcacacuauccaacuaacgcuacgacauuugggggaccuguuaaaucugaaacucaugucuuucaauucugagagauuauauuauuucuuucguguuauuucuuucucucucugaaucuuuucuuauucagauauggauacuuuuacacuaauucucuauuuuacuaucuucccccuuuacuguuguccacuuauucaucuuuuucuuuuaauuucugggggacuuuucagauguaacuucaaaguaauuuuuuucugcuauuaaauuuuuaauuuuuaagagguuuuaaaauucucugauuuuuuuuaaauuacaaaauauuucauaaauuaaaaaaguauauauaaaacauguuauauaagauauaauaaagaauaaacaaauacacauguacccuacuccucaacuugagacaaagaacauaaaacaaauggguccuuuaucuuucuccaugcaucuccuuccuccccucccaccccaggcaaccagaauccugauuuucauguuuauuauuuuauuuaaaaaaguuucacucaucuaaauucccaaauaagguaauauuuaguuuuccacaguucugaacuuaacagaguuuguguuuuucuuuuuuuucuuuucuuuuuuuuuuuuuugagacugagucucaauccgucacccgggcuagcgugcaauggcacagucacggcucauugcagcguugaccuccugggcuuaggcaguccuccugccucagcugggaauacagguguguaccaucacaucuggcuaguuuuuuuuuuuuuuuuuuuuuuuuuuugguagaaauaagguuucauuauguugcccaggcuggucucuuuucccuuuauuuaugaugcccuaaauuaaaaaaauuuuucuucaaacaugaacagaaagguacugaacuccuauguacccaucacuuaguuucagcaguuaucacucagccaaucuuguuucaucuguacuacuccucccccaguuggauuauuuaggcuugugucacugaugucauucgucuguaaauauuucaguaucuacuuuugaaguauaaagauuuuacaaaaauauccacaauauauagugaguuaauuguaguuugaaucuuguuuaggaaaauuucuuacugugaugcuauaaaaguauucuuuuuuauuuucuccuaaaaucuuaaaauuuuaaucucuuauaauuaagucccuaauccaaaugaaaguugucucaauaacauuuacugaauaguucauucuuuuuccauugaucugccauaccauuucugacauguauuaaauaaugcugcagcagaugucuuguacaugucuguuaggcucuuguguggauuucucuuggguauauacauaggaauagaauugcuggguuauauguuauauguaucuuuaauuucaguagauaauaccaaucuguuuuccaaaguugauauacuaauuuacacucucauaguauacaauaguuccuguugcuccuagccagugcugauguggucugacuuuuaaacuuuuguaaauuugguagaugucaaguaccaccuccguguaguuuuuuuugcuuuuuguuuuuuuagagacagagucuuacucugucacccaggcuggaguacaucggccgaucauagcucacuguaaccuugaacuccugggcucaagcgauccuccugccucagccuccuaaguagcugggacuacaggcaugcaccaccauggcuggcuaaguuuuaucuauuuuuuuuugguagaguuguuaucuccuuauguugcccaagcugguuuugaacuccugaccucaagugauccuccuguuuuggacucccuaaguguugagauuacaggcgugagccacugugccuggccuccuuguaguuuuaaagugcauuucccugauuauuaaugaggcuaaauaccuuuucauuuauuuauuggguauuuggaugacugauuuaaaagaaaguaacugggcaaguuccuugccuguuuuuaaaauaguuuuuggucuuuuguugauuuguaggaguucuuuauuauggguaugagcuuuuugucaguuacauguuuugcaaagaucuucucccacuccauuaguugcucauucauucucuuaaugguaucuuuugaugagagauauuugauuuuaaugucaaauauaucaguguuuuucugaguccuauuuaauaaguuuuucauacugugagauucugaggguuuuccuauguuacauaaucuucuaggccagaguugcuuuaaguuuuuuugugcuguguauuccuuugcaaaucuagugaagccuauaauaacuuuccucguaguaugauguuuuuaaaugcauaaaauaaaauacguagcauuacaaaagaaauuauugaaauacagcuucaagauauuaaaaaauacguuugugauagagacauuauguacuuuuaaauuaaugcauucgguaacaaaaauugcacuuaaaauaugggcaguuuuaauuguguuuagcuauuguauguggaauuaaaauuucaguaucucacuuucuaaggugaggguaggcuuuccaagaacaacaaaauucacugaaggcuuuuuggguugaucucuaguuguagaaacguuaaauuuuacuguuuuauugcucagcaguuaguuggcacagagguaguugcuuaacgguugcaugaacaauauagacaggaagacugcaaucaugugcgguuuaguaguaguuccaauaacuaacaauuucaaaguagaaaugaguguaaaaaauacuuugaaauaugcaguaacugucaugugauaugaaaacaucuuugauucuguuagagacaaaaucauauguacugccaauacuacuuuguuuuuuucaauuagcauuuaugaaaauagagaaguaauuguuuuuccccauuaagguucaugaugccuuugggucuuaguuuucuugguuucuucagaagcagacccugagauaaggauucaaguguaaguaauuaauauggggaaugaucacacgaaauauacuggauuggaaggagggaagugaaggcacuuaauaaccuuuauuaaguguauuaagaagcuugaaucucuggguccucugggaacccguguuccucacuugcaucguguuccuuacacauguucuuuacacacaucauuugaaggcaggugagggccaggcaucaguucucagcacucauaaccagcuccuagaagaccucagacaaaaagauguagaugcuugcaguugaaacuggcacaccaaaaugcuaaggcaugaugggauacaaaugaugugucaaaaguaucuuuuauaucuugaagucuauccacaggaccuuugggucagaggaccucaggccaagagccucuggucuagaauauggacauuuuauguuuuaucuuucacauucaggucuaaaaucuaugugaaauaauguuuagaugugauuugaagaaggucaaguuuuauuuuuuccuuauggauaucugguugucuugaacaauuuauuggaaaaaaucuucccuuucuucauuguucugcauuaccacuuuugucauaaaaucaaauguccauauuucuguaggucuguuucuaggcucuuuucucuaguucauuggucuuuccuuguaugagugucaccugacuuaauugcuauagcuuuaaauuaagucuugauaucugguagggcaaguccuccccucuuguuuuucuuuuuuaagaucgucuuaucuauucuuggcccuuugcauuucuauauaaauuuuagaauaaaugauaauuuuuacaaagcaaacagaaaaccucuuaugauucugauugguauuacauugacuguguaggucaguuuggggagaauugacaucuuuacuauaauuagucuucccguuuaugaacaugauguauccauuuauuuuagaccuuuuuuuccucaguaauguuuuauaauuuuaucugugaagaucccaaauaucuuuugggauuaauuccuagauauuugauguuuuugauacuguuauaaauggaaucaucauguaaauuuuuaaaaaauaauuguuacugguauauagaaaugcaguuuuuguauauuggcuuuaugcccagcacccuuacuaaacucauuaauucuaauaauucaucuguagaucauuuuggauuuuauauguacacaauuauauaaucuaugaauaaugaaagcuguaguucaucuuuuguaacucucccauuuuucauauuuuuccuuuuuuuuuuaacugcagugucuaggaccucuagcagagugcugaauaaacguggugacaacaggucuaucuuuuucuuguucccagucucaaagggauacccuucacugugucaucauaaauauaauguuuacuguugauguuugugguagauacuuuuuuuucagauaaagaaacuuuccuucuauuuguuguuugcuagauuguuuuucuaaaccacaaacgauauagaauuuuaggaagcauuuuuucugcaucuaaugagacaauuuuuaucuuuuuuuuuuggagacagaaucucgcucugucacccaggcuggaguccaguggcacaaucucagcucacugcaaucucagcuucccagguucaaguauuucucccauuucagcuucccaaguagcugggacuacaggcacccaucaccaugccgguuaauuuuuguauuuuugguagagaugaaguuucaccauuuuguccaggcuggucucgaacuccugaccucagaugauccaccugccucggccucccauacugcugggauuacaggcaugagccacugugcccggccaucuuuuuaauuuuuuaauaagaugaaauacauggacugauuuuguaaaccuuguauuccuggaacaaucccaacuucauuauaauguguuauccuugcuggauuugaucugcugaucuuuuuuuuuuuuuuuuucuuuuuuuuuuuugagacagugucucgcucugucacccaggguggagugcaguggcgcgaucucggcucacugcaagcucugccuccuggguucacgccauucuccugccucagccucccaaguagcugggacuacaggcgcccgccaccacgcccagcuaauuuuuuguauuuuuaguagagacgggguuucaccguguuagccaggauggucucgaucuccugaccucgugauccaccugccuuggccucccaaagugcugggauuacaggcgugagccaccgcgcccggccugaucugcugaucuuuuguuuaagauuuauguguuagagugagauucggccaauaauuuucccguuuucauaauguccuugacagauuuuuauguugauguuaugcuggccuuauaaauggguuggaaagcucucuuuugugaagaguuuauguaagauugauauaguuuuauucuuaaguauuugcuggugaagccaucuggaucaggaauuuucuuuguaggauucaguuuuuuaaauuauucagauuuucuuuuucuuuuguaugucaguuuugguaaguuguauuuaccuaugauuuuucaguuuuauuuagauuuucaaauuuauuagcacaaaauuguguaaaacaccuuaucuuuuaauaucuauaauacauguauagugauuucuucuucaguuuugauauuauuuaugccuucccucuuucuucauucaucucaccaagaguuuaucaauuuuguaggucuuuuuacugcccuaaaagucuucuguacucugccuguuuuuaacucuggcuaccccugcuuaguuguuacuguuaucuuuucuacuuuuaaauguuggagugcccagggcucuucuagucuuaagauuucugaugccauuuaaaugccauuuuuguaugcugaugacauucaacuuuguauuuuuugccuguaccucuucccugaucucuacuucccuaaccccucaaucuacucccugauggcucaccuuuagaauauauccacaaucugcuuacuucuuuaccaccuccacucuuauaaucugguugaagccaccauuauuuaucacuuguauuauuguauuaaauuuuuaauugguuucccaauuuuugcugcacuucuguacaaucuauguucaaaccagcagguggagugauuuaaaaaauuguuuuuuugagacagagucucucacugucgccuaggcuggagugcuguggcgcaaucuuggcucacugcaaccucugccuccuggguucaagcaauucuugugccucagccucccaagugacugggauuacaagcgugugccaccacaccuggcuaauuuuuguauuuuuaguagagacggaguuucgucaugauggccaggcuggucucgaacuccuggccucaagugaucugcccaccuuggucucccaaagugcugggauuaugggugugagccacuguuccuggccuggagugaucuuuuuaaaauguugucagaucuugucacucuucuuuuguacaaaaccgucaaaagcuuuuccauuucauuuaccaaaagaccaagucuucgugaugguuuagcaugcuccaugcuuaccaggacucucgucacugcuucaaccucaucuucugcuaacucucaccccugcacacuccacuccaucuaauuugccucauuguuuuuaaacuagauuuuaaaaauaaaacacugaaauuuugauaagccaguucaauaaucuacaaauaauaaaacaguauuucuggauagaaauguagagacacgugaagaauuuucuguaaugucuugagaagcguggguaucucaugaaggguacacuugucagaaucacuggaaaaacaguuugagaaauaauauaauucaugucuuuuuuuccuuuuuaauuuuauuuuacguaauucaugucuugaucucuaaaacaggcagucaccuuuaaaacuuuggaucuuuaaaaacaaauaccccauuacuccuaaaauuugacugaaaaaacucacagauuugucuuuuuuuuguuacucauauuucuuaggauuaccacguuaauaagugauuaauaaagccagucauuccuuugacuuaacaaauccauaauaggugaaccuauggaugauuuaauauaggaccaguucagcaugucagagagcugcuggagagucauacuggaauccagcuuuaugauauucccaguuaaucauugcugaugucagcuuggauauuguacacacugugcaucauuuggagcauguuuuccuauugccuccuuuuaaauaucguuaauggcacuaugaucauggauagguauuguauacacuuaaguuuuccuugacucauguacaguuaacccuugaacaacauggcaguuaggugauccaacccccugcacagucaaaaaucccugucuaacuuuugagucuccagaaacuuaauuacuaauagucuacuauugacuggaagcuuuuccaauaaaauaaacaauaaauuaacacauuuuguauguuauagguauuguauacucuacucuuuuuuuuuuuuuaaacccugcauguggcauccaauaugugcuauacucuuuuaaggaagagaagaaaaauguuacuaagaaaaccuuaaggaagagaaaauaaauuaaccguucauuaaguggauguagauggucauaaggucuucauccucaucauuuucacauuuaguaggugagagaggaggaagaagaggagggguuggucuugcugucuuggguggcagaggcagaagaaaauucacguguaaguggaccugugcaguucaaacccauguuauugaagggucaacuguacuuuaacauauauauuguuugauuuuuuuuuaucauauaacggggcaaagaaaaugcauuuuagaauucuagcaaucugcacuugugagacacaugagaaucuuuuauaguuguauucauaucauaauagacuuuauauacguaaaauugauagugcauuuuggacaaaaaguugauuugaaauuauaucugaaauuaacaaccuucauucacauguuuagcagauauucuuuugaacaccaccauauacccugaacuguugugugugcuggcagucuuaugaugaagaugauagacaaggcuuuuguucuuauaggacuuaauuucuggugaggaaagacagaaaaaaauaucaaguauuaacaagugcuguccagaaaauuaagacaggaugauauaguagugugauugggugucuguuagagugagugaucuauagagaaagcuuugcugaggagauaaccuuuaaacugagaauugaauacuacgaaggagacaacugugaaguucaggggaaagaguguuuuuggccaagggaacaaacaccaagugcaaaugcucugaaauaggaauuagcagggcuuguuaaagagcaacagaaagcuggaguguagugguuagaccaaaguuugagaugcaucugaguuaacauaucagauaggauaagacagucaggaguucucuggcaauuugaauucuuuagccaaaggcgguguuuaaaguuaugggucuggaugaaauuaacuagggagaacguguguauuagagaagagaaugggacucaggaucaaaucccaggauccucaaacauuaagaaaugauagagagaggggagauaccuacaaaggaugcugggaaggaguaaccacugaaauaaaacgaaaaccaggagaaugugacauuagagaagccaagaaaaaagguucaaggagggaaugucaguuaauuuugucaaaagaccuagaacacaugggagaacaguuaaacaucuguagauaguacaggccuaacugugcguaaauuaaagcaaagaaacuuuuguggaaucauaaaguuuuaaugaucuuagugaucacagaagcagcuaagguuuuugaaguccaugucucugcccuccacugccacuaccugugucagcaucuucggggcugcagaccuuuacaguagucucuuaagugauguccugcaaacauccucugauuggucugcccacaggagccagccaccugaacaugccguucuccuuuucaccaccuuuuaaugacuccuauugcuccuaaaaugaagauuaugaucuuuaccauggccugugaggcucugcuguaugaucuggcccuuccgugccucuccagcuucauucccaccuuaaugccuacgacacugauguccuuucaaggccuugaauaugccaagcucuuuccugcuuccacgucuuuuuaugugcuguucccucugucuagggaauaccuacaauacccagacuuccuuauucuuuaccuggucgucuuuuauguauccuucaacucucaguuuaaauaccacuugcuuaagaaauccucugaucucccaggcaaggucaagucuccuuauuaaauacuuuccuggugcccucugcuucuuucuuauagugcuuaucacaauuguaauuaaaacaauaauuuauauccuuacuuaauguugccuuccuuucuaaagaauaagcucugugggauuaggaaauguauuuuauuauuucugucucuuccucugccucagcuauauccccagccauucacauaguggcuucuuucaauaaauacuuguuguuugaguaaaucuuguaaauguuccauaguuguacaggcaguuaauggcacaucaucauuaucuauuaguacguugaggacugauuuuguuuuuaagccugagaaugguuggaaagcccuugaguuugcuuagagugaaauguggcucuuuaauaaaucuguaucuggacauaaucaaauguauaauaauugguucuuaugaaacauaguaaaauauauguaauuagauugaauuaagaauaguagcuugauacaaacuacaggaugccuacccuucccugaaagagacauaugaacuguuaaaauuuccacaaaaauuuuauuuucuagauuauugaguauuauuuucauuguguuagucacgucucccuaagcugcuuauauccaguuauccuaagaguuaaguguuucauaauucuuauggaaagauaaugcuuuucugguaaggauccuauggagguuaagcaaaugugucuuggauugaaaaagcuauuuucucacauuuuugagaauauaccacaucugauuaagauuauccugauaaaaagaacagaaaguaacuuuggaauguugggcaguuuuuuuuuuuuugguacaaucuguucugcuucuguuaauaaagccaaauuugaauugauaaaacagauggucacuguggaucucccacuagaaggcauuuuccaccgccucugcuacacaugacaggguuuuauuucagguguugugagacucaaauucaauuacuuccaggauuuuuaauauuacgguccauugagcacuuuggcugguaagaucuauuuuuuauaaaugugguaaauuaaauuuuucuuaggcuuaagaguauuuuaaauuucuaucugaacuuaaaauaaagccuuacuuacuaaagagccuuuucuacccaacgugacauaccugauuaaaucuuuaguuuaagaauugguuuucucugguucgcuuacuaggagauguuugcugaaauucuauucguuuauguucauaaaguuuguauuggaacauuuuaaaaaauaacacuugguuauuuuguaaaauuugcaaguaauuuaaaguauccuguuuucuucaaaaaauggaauuuaucuuuucuuuuuuugaguucucaugcagcauggugaauauaguuagugauagaauaguguauauuuuaaaauugcuaagaguaaauuucaagucuucucaccauaaaaaacauuaaguauuugaggugauggauauguuaccuagcuugauguaauuaucauguuauauucgugaauuauaacaucacuucauacuauguaaauguauacaauuauaaguugucaauuuauaauuaaaaaggcagcauuuucuuugagagaagauuaugccuuugagugaaaaacuggguuuugcaagggcuaggaugagaagauuucuugaggggaaggguugucccuucuaugcugauuuugcugaggguuuuaauuauaaagggaugcuggauuuugucaagugcuuuuucugcaucuguugagaugaucauuugauuuuguuuuuaauucuguuuauaugguguaucauauguauugacuugugaauauuaaaccaucccuacaacucuaguaugaaacuuacuugaucaugguagacaaucuuuuugauaugcuguuggauucaguuagcuaguauuuuguuauggauuuuugcaucuauauucaucagggauauuggucugugguuuccuuuuuuugucauguccuuuccuggaguuucugcacaguaaaugaaacagucagcagaguaaacagacaguccacagagugggagaaaaucuucaugaucuauacaucugacaaaggacuaauauccagaaucuauaaggaacucaaacaaauuagcaagaaaaaaccaaacaaucccaucaaaaaauggacugaggacaucaauagacaauucuccaaggaggauauacaaauggcugacaagcauaugaaaaaaugcucaacgucacuaaugaucagggaaaugcaaaccaaaaccacaaugcgauaccaccuuacuccugcaagaauggccauaaucaaaaaaccaaaaaauaauagauguugguggggaugugguauaaagggaacacuuuuacacugauguugggaauguaaacuaguacaaccacuauggaaaacucuggaaauuccuuaaagaacaacaguagaacuaccauuugauccagcuauccacuucuggguaucuauccagagaaaaagaagucauuauaugaaaaagauacuugcacaugcauguuuauagcagcacaauuugcaguugcaaaaauauagaaccagcccaaaugcccaucagucaaugaguggauaaagaaauugugguauauauauauacacaccauggaaugcuauucagccauaaaaaggaaugaaaugacauucgcagcaaccuggauggaauuggagaccauuauucuaagugaaguaacucaggaauggaaaaccaaacaucguauguucucacucauaagugggagcuaagcuaugaagaugcagaggcauaagaaugauacaauggacuuuggggacuagggaggaagggugggaggagagugagggauaaaagacuacaaauuggguacaguguauacugcuugggcgaugggugcaccaaaaucccacaaaucaccacugaagaacuuauucauguaaccaaacacuaccuguucccccaaaaccuauggagauuaaauaaauaaauaacacaaaaacacuaaacaaaagugaacuuaaaaaaaaaagcuaggaauuucccucaugcacucagguaacugcaacucccccuuuugauauguuguacuuucauuuucauucauauuuucaacauauuuuaaaauuuccccuguaauuuagaaguuuuuaguuuucaaauauuugggaauuuucuagauaacuuucuguuacuaguuacuuaauuuuguugugguuuuacaguuuuagacaauaacagaugaaauagggacugcuucauuugagggggagauuggugggaaugggagaagggcuagaguaucaccugcuccuggggcucuuuguauuuccauugugacuuuugaggggcucucggguaccuguagaauuucuuuguuacguagucugaaaccacugcauagaaugugcuguaaauuugauuaugugaaaaugaugcuaugcugaagaagauacuuggaggaaagcaacuaguacauuguuaaguggcugucuaagggcaaacacuuaaaagauuugcuguauaauuaaaauauccaaaaaaagagacauuaauggaaauuuuuguuucauuaugcagcacaaauugagaaugaguaccaagaugaaaaaaacagaauuguuugucuaguccaaaugaaaauauuugggucaaugcauacuuuucaggaauacauaauugcagaauuccucagagguuauauuuuugcauaagcgauaacauuuauuauuucccuuuaaugcaguuuuuauuauugguuauaaagcacuauaaaagauaguuucuguuaaaauacaguuguuuagccuuuaacuaaauuguuaggacuaaguaaaaugauuaagucagugccuauuguuauacuuguaaauauuuuaagugggcauugaggugguuccugacagcuaccuccaugcauucuuuaucaucacuuagaguagggaucggagaacuguggcccaagagcuaagaauguuuuuuaccuuuuuaaagggauguaagaaaaaaagaagaaucugugucauagaccuguguagcccacaaagccuaacuuauuuaccaucuggcccuuugcagaaaaauuugcugacucuugauauagagcaagaaacaauucauguucgugaggugaagggugaagggcuucacuguuaaagaccacuucaaaaaggaaaggauaacaaugacugaaaagauagcauggaucuuucuaauucuuucuuaacuaacuuauucaaggggcuagcaucagaaucuuuuuucuguacugaccaauuuaugucuaaaugggagaauuuggcaucagucugcauuugaaaaacaauaucacacagaaaagauugauaaugaauagacuguucauuuauuuuucaagaauaguuuucuuuaaaguaauguaauuuugagauaaguuuuguauuauguauaagucacauauuaguuuuuagauguaacuuaauuuuuaaaacuucuucaaaccacuuaaauuuugaauuguguauguacaaauuaauuuuauauugaccuauguauuuuucaggaugauugucuuuugaaagugugguauccuaugacugguuggaagucuucaauuauaccucaggaucaucaugaaguaaaaaggagacaguccucuacucaauuuucuuuuguuuacuuggcacauccccgagcugugacagguuuuucguggcgcaaaacuagcaaguauaugcccagguuagaugaaugaaucauguagcuuuaguuugcauccuuaaauguuuauaaaaauaaugaaaauaaaguccuuuuauuuacaugguggcaauuaauagcauaggcucuggcaucaagcugccugaaaucaaauccuacuauuagcuucaugaguuuuugacuaaauuucuuaagcugucuaugccucaguuuuucucuguagagugaggguaguaauaguaccuaccucagagaguuacugugaaacuaaaauguaguuugugggugggaagugcuuaguacaggccuuugcacauacuuuguguccagccaaugaaauuguugguaguagcugugguacuagcagauccuagcaagaaaauguuugcaaauaacaggaaagcacacauugaagggaaauagaucaguauuaugucaauuauguauaugguguuaaagcauauaauguacucugaaaaaaguggccagguuguguuuuuuuuguuguuguuuuuuuaaaucugagagcugucaacagaagcuucucaaaggauuuuuuauuauacauuuuuuccucaucauuguggcaccucuuaaagguauuuagaagauuaaauaaacugcaaaaaagcuuauacaaaugauuccuuuauuauauacaggucuaagaaagcuguugggcacucagaagcuugcuuagaaaucuaguuuguucuugagggaggguuauuuuaccuacuaaauauaucugaggauuguuuaugccugauaggaaauauagcacacauuguagagaugcucaguaaaugauaaugugggaaauuuauauacuuuuugaaucuaaauauauucugcuuaagucaucugcaucuauuugcagaauacuuuugacuuagauucugugugagcauuuuuuuaaagggagaaugauuuuuuuguuccuuuguaacaaacagguaaguuacuuuagcugcuccaugccaugccguuuuugcuuauuuuaacuuaauggaaauggauuuauaguuugaaauuauauucuccuuacaguuuuaugaugaagauaauuauuuguuuguaacuguuuggguuauaggaaggaggauguaaagugaugaaacuacugccauaagccagauaguuuaauuacauuuaaugaucuuuuauuauggucauucucuaauuugcaaugauuagguuuucuuuugcuguuuaguuuguauguuuuguuuaggagauacuaauaauccucuagagccugaauguauaaucuggcaguaauuucuguuucuuuuuucaaaacaauuucccgguucuuaugauguucacagugaugcuauauaugauuucaagcucuuugauugauuccuuuuuuccauaguguuuugcacuaauguuaucuuuaugcaugaagaaccaaaauauuaauuaguuaaugggauugauauucacauuaaccuuuauuuauuucucuuuguuguuagggguucugucuguaauguguuguuaacuucaugucaugauggugugugccggcucugggcagaaacuuuauuaccagaagacugucuuuugggugagcagauuugugagacuaccacuuccagcauugccagcagccuuucucaugcuggaagacacaaagacagaauacagcaugcucuugagguauuauauuauuuaaaaugguaaaugaauuuugaagauaaugugagccugguggaaauucaugaacuaacaugcagauggcacacaugguacauguaaugagugaaauuaauagcaauaaacucucauuuaugcuuguaagacuacucauuuauuccacuaagaagccaaaugcagaaauuaaugaucucagacauguuuuauagguaaauauuauuaaaaguuuuuuaaaaauugauauuuuaugcucaaguucuagauaauauuauuuuaauucuuuuguuuugcaugucacaugugaaaaucuaugggacuaaguauuaguaaaauauguaaagauccuugaaauuaguuguaauuaaaaauauuuugcuuuuguuucauaaagauuaaaaucuuauuguucuaguuaaaaaugacuauuuuguuccuuaagaauaaagauguuuauuaagauauuagacacaaaugaacugcuuuggaguuuccaugauugaagauuuugaaaaugaaauaauuuuuauaauuuuuaaauacaguaugaaauaaaagugcuuuauaagaaauuacguuauaacacauagcacaaaugauugugucccauaugauuagguaauacaaugagauauaugcauuauuuugaauugucagaaauuuauuauaguaaacuuagauuacuauuuuucuuguggcuguuuuuuauuauucaaauacuguaugcuuauucuagaauuggauuaagaaaaggagaagaaauacggaauuuauaauucaacuauucuaguccugugaauauguguauuuuucuuuauacgauugagaucauauuaugcaguaauacuuuauaaguuuuuuauacuuaauuuguuuacagucuacauuauugacuauacuuuuacauuauauauuuacauugacaguuuaaagguugcauagucaaaguggcuuugccauuuuaccaagcagaaauauuauacaacuuugacaaguuaaggaugugguccuuaaaaguuuuaugugaaguaggccuccucagguauugucuguauugggccauucuugcacugcuaugaagaaacgucugaaacugggugauuuauaaugaaaagagguuuaauuggcucaugguccuauaggaagcauggcaccagaaucugguuggcuucuagggaggccacagggaucuuuuacccauggcagaaggugaagcaggagccggcacaucacaugguggaagcaggaacaagagagaguugcggggaggugccacacauuuuuaaaugaccaaaucuuaugagaacucacucgcuauugcaaaggcaauaccaacaccaagccaugcgggauccgccucaugacccaaacagcucccaccaggcucuaccuccaacauuggggauuacaauucaacaugagauuuaggcagggucaaguaucuaaacuauaucacugucugugauugggcgcuauuuuuacauuuuuuucaauauuuaaaauguaagugaaauuaaaagcagaugucaaaacaguuaaaguuaucuuuuauuuugauauugauauuuaguaggacaaaguacuuaauuuuuaaguagauauuugugaucacuuacuuauacuuauguaacguguuuuaucuucaaauuauauaugagccuuuggaaacuaagggcuuuuagacaucuuuguauccuccaugguaccugauauauugcuuuucaaguguuuguuaaauugaauuauugccauguaaaauagaacagaaauauaaguaaauauguaaccagugauuugacaaguuuuuacugucuuuuauuaauauuauuaauuaauauguuaagauaguuuuuaaaagaaaaaacguaauugucugacuuacgagccacuuggcuuucugacauccuauccuuuccuauggaacuccuuacuguuaguucuauauaauuguauauauucuuaaguuauauguuuuguuucuaggagaaaauagccaguauuagaucagucuugucagucuaauuuaaaaugaugguuaaugucaaagauccagugaaaauaauuugauaggcaguuuugaccagggguucucuaaugucaaucuuaacccuauuaucaaagcaaugagcaaccccguagugggagaccagaggugggggacacaccauugaccugauacuguuuuccauaugcaaaaugagaagggcuguagaaauugagaggaugugccaguuauguuacuuuaaugaagaaagaauugauaacauuuuauacuuuauuuaauugaauguggggaacaaaggaaaguaauaaaaaauuauuaugaaacauggucuucggaguggguuaaguuacagaauaaggaauuacugugagguggggccgugauauggagaaaaaagauaaugccaagaaugacauggccccaugacuaaaauaguccacaugaucacgcaugcuaaugaagaauuuuaaucauauagauuuaucucuauuuaaacauauccaaauugcaaauuguuuaaaacaauuuaaacaaauuaaagaucaacauuuuaaugaggucuuuccuugucuacuccuaucuaaguagguuccccuuguuauucuguauuuucauacccuguuuuguucuuuguaauagauaucaugaauuugauuguuuagcuggcuguuuaauucuaagugagaggcaguauuggggaggcaauauucuuccugguaggaagacucaggaauuuuuuuuuuuuacucuuaugacuagaaaauucugucucaguacuaggauauccugaaaaaaaaaucuuuggaccuccuaauauuaacgggaaucuuuauucauguuuuauagauaccaugaauaaguauuuuugcacacugcuuuuugccuugaacuaaaaguuuacaagaacuguagagaauacauccaaaauaguucuacuguaauuuaaaaaguuuccuuuaaaaugaucagguuuuuauggagaaaaaaaucuuaaaccucuuaauaauuaagaguacuuugguuggcauuuauuagagguuccagaguuggacucagcaacuauuuuucuauuuuagacaauacaccauuugaaaaauuuaaggaaaggacagaggaggucaucuguucuuguaacucaugcugaauuaaugcccgaccagacagcaaugcaugaaguucaaagacacauuucccaccaugcaaaugcacucugucauuuucauauugcagcaagcaucaacccugccacagguaaaggauaaaguuuuauuucccauaaauauguugaagucagguaaauaaauagaaaaguggaacuacuuucauaaccuguuuuuuauuauuucauguugccuuuaaaauacuuaauuggaguagagauauaauauaaaguaccauuuuuugaauugggccuaugugauugggacuaugugauucucaggguauuaacuucaguaacuauuucugagcaucuuugucuagacuauaacaagcauuccuaguaaauuagagcugugauugaaccugguaucacaagugguggcagccugguaaauuaguguaauuucucucacuucacaguuuaaaucuucccaacucuucuuuauaaccuccucuaaauauauuuuuacaaaguuuuccuuauaucucagcauaucuuguuuucuacccuuguagacuuucuuguccuauacuaaggaaaacacuuuuccuucuaaccugaauauuuucuuuucccuuuuuccccuaugugacugagaaguauuuugaggcagguucuguguuggcaaaugcauauuugagagcuucuauuuaaaggcaauauguuuuccuucuacauggaaauguaggagaaaggcuauaaauuuuauauuacauugcucauagaacuauauaaaguuuuauauaaaguuauaguuguauguuauugaacuggaggucuguugcuucagagugaaggggcuuuuauuuuuaaauguuucuguauguaaauacaguauuuaguaaauagaauucuaaaagggugaucugcagugguaacucuagauaugugcuguuuuauagaguagccacuggccccguauuagcuauuugagcacuugaaauguggcugguccaaauugagauaugcuguaaaauacacacugaauuucuaagacuuaguauaaaaaauaaugaaaaauauuucauaaauaauuuuauuucauauugauuacuuguugaaauacuauuuuauauauguugagucaaauaaaguauauuauuaaaauuacuauuaccuguuucauuuuaccuuuuguaacguggcuauugaaauaucuaaaauuacuuaacaugucuugcauuuuuggucugcauuauauuucuguugggcagugcuuugccaucugauuaaauguuguuuugcuuauauuauccuuucuuaucuaauaucuuaauuguauucuaagaaugucuuuauaauuuguuuucaaaaugugguuuuagauuuuuaugaauuuuuaaccuuuuuaaaagaaccguuucuugaauuacugugauaaaaauucaacuucaaaacaaaaugcaauucgugauagucugcacuaaauucaauacauauuagaaaccuuggcuuuuuaacuguguacacuauccuaauuagauggaauaggaucacagaggaugagcauucugucacaucauuugagccuaaggacuggauauguucuuguagccauugggccuuggucuuccccaucuucuuuacuaaccuucacuaauuuuauccaugcucauccuaacuuaccuacauauuauuuuaaaaacaauuuuguuaaaaauguuuaacaucaugcauuuuuaguuacugcauguaaauauaacauuuagguugaccaaauagauuacuaaaugcaaauaauuuuauauuguuaggacuuguccucuucacuuuuuuuucaaaaaauuuuuugaaacuacaagaaaguugaaagaauaguacagcaaauauccauauaccacuuaccgagauuuaccacauauuaacaucuugucauuuauucuuuuguucuccuccucugccuguauagauaugucuuugcugccucuucccuuauuuuugacggaaccauuugaaaguaaaguuguugauuacaauacccuaaauauacccuaauuauccuaaauauuuuccauuaccuaaauauuuaagaauguaucuuuuaguaaaaagggaauuugccuccauagcuguaauacuguuauugcaugugaggaacauagauaaaauaauaucauguaauauaccauucauauacaaauauagauuccuuucuuaaaugcagauuauuuucuuuaaauuccuccaaucuagaacagucccuuucucaauugucaaaaaaaaaucuguuagucucaaaaaguugucucucaguuuucuuucaaaaugucucacagucugaauauuuguuaauaagauuuagguuuaacauucugagcaagauuacuacauaggcacauaggugauguaguguuuuauaggauugcuaauucacaaauccuauuuuauaugauuuauuucauuuuuaucacaaaaccagaauagucauccaggaacuggaaagaaagaacaaauuagagcauuuaacauucauauuuauuguaauagaacauuaccagaauguccaugcauuuuaucuuuagauuuucacuucuuuuugcaaaggacaauuuuuccuucuguugaaugaauuauuuauaauauggauugaaauuaaggagauuaaguuuuugauuuauaccauuuuuugggcggaggaggacagggucuugcugugucacccaggcuagagugcagccuugaccucuccggcucaggcaauccuaccaccucagccuccugaguagcugggaccacaggugugugccacuacaccuggcuaauuuuuguaguuuuuguagagucagugucucgcuguguuucccaggcuggucccaaacuccuaaguucaagcgauccucccgccuuggccuucagaagugcuaggauuacagacaugagccaccacaccuggccaauuuauacucucuuacaugaacucaucaauuucauaaauuucaguuaccucaaauggagaaauuaucuuauacuuagaauuuugccugccuucuuguguuuuuuucuugauuuuauuucccaacagcuauuuaguaaaguuucaaacacugagaaaaguuggaagaauaguacaguuaauacuuuuauauucuucacuuugauucaacaguuguuaacauuuugccacaguugcuuuauauguggcaaaugucucuguguguauguguaugaaauguuuucuuuucucuuucuuucuuucuuccuuuuuuuuuuuggaaacggagucuugcucugucacacaggcuggagugcaguggagugaucucagcucauugcaaccucuaccucccggguucaagcaauucuccugcuuaagccucccaaguagaugggacuacaggcacaccccgccacacugggcuaauuuuuuguauuuuaguagagauggggcuucaccguguugcccaggcuggucucgaucuccugagcucaggcaauccacccgccucucccucccaaaaugcuaggauuacaggcaugagucaccgcacauggucgaaauguuuucuuagucuuuucaaaguaaguuacaccuaucaugguguaucacccuuacauuagcaaguaucuccuaaaauucucucacauaaucauaauaucaucauaccuaagaaaaugauaaguaauuccauaauaucuaauauccaguucauauuuaaacuucucuaguuaucucuuuuauagcugcuuuucugcuuuaauuuuucauccccuguccccaaacuggaauucacugaagguugaugcauucguguauuuuguuuuuaaguuaauaguuuaauuucauaugucuaucauuaauucuuaagauuuacauuuaccauuaaauucaguuaaaguuuuuacaaaugcugcuaaaauuauguugacuuguuuagcaccuuuucuuuauauagauuagucauuguaagcacuugucauguuuuuaaagaaauaaaaaaaauuauauugaaaucucuuuuauuuccacagauauuccaaaugucuugguuggcacugcauuuaauguugaugauggaaaugggggcuuuguaguucauugguuaaacaacaaggaauuucauuuuacaucaucuacagaaguauuuaugcaucaauuacgaaaacuuucugauaagcagguagaucaugaaaaugaugaugcagauagagaagaugaggaacauucacaggaggauagagaacgggguuuacauaugaaauuagaccaugguuaguauccuguguucagauuuuacuuacuccaaaguuaacagcuuucugugguaccacuuuuaguuuugaauucuuccuucccgcucuuccuccuuuuuacuuuucuauuuguuacacaaguauuuacugaccaucugccuuggaucagguacucugcuagccccugcaaacaucaucuaacucuauauguucuuuggaagccauauccuuuucuggggaacagguuuugcuaaaugguaguaauaaugauagggugaaugaaguuuuaauuuaucuaaaaguaguaacuguaguaacauucaauucagacaaaaguuuccuuuguuuuuuuuucugacuguaaauuggaaaagagauuuaguuuuuaaagauaguaugccauuuauuuauagucuaguauguaaaugaauuauuuaaugcuuguauugauaaauauauuuucugguucagauuuaucccuggauagagaaucugaggcagguacaggaucaucagaacaugaagauggagaaagagaaggaaguccuagaacuuacucacgacuuaguguaccaaugccacugccuacgguucugcuugaucggaagauugaaacgcugcuaacugaauggaauaagaauccugauaugcuuuuuacaauacacccuguagaugguaccuuucuaguguggcaugugaaguauuuggaugaauauaauccuggaauauuuagacaaguucagguauauuuuauugaugaaauaguuauuacauuucuuaaaauaguaaaaagaaauaaaugcuuuguagaguuagcauguuuuuagaauuacugaaaauuuugguuuugauaagcaucugaguaaagaauacuucuuucuuucagaagggaucagugaccauaagcuuagcaaacuugauuaguuagaagauaaugaauuuggccuugaaaugcaguacugaauauuuaaauauauguguugauuuuugagggaauuaauaauauuuugaauaagauuaagaaacuacccugaaaaugugaaucaggaugagcuccuccuuguggccaauuugaugagcuaaacgaagcugccuuugucaucucucucaacuuuauugcuauuuagaucuguggcuguggucauuuuguuguacaagcaaagcacuugaacuuuuuuucuucagccuucucuuaggccaugaauagagauaugguauuaccuaaauagagcaaggggacuggaccauaaagagguugaaaaugacauuuuuugauaagaagcugagauuugguauuuugagaauagaagucuuuuuuuugagaggagguaaacuauuugcacugaaucauauaauuauguuuuucagguuucuuuuucuucucggauuccuguugcauuucccucuggugaugcaagcucucuuaguaaaaauaucaugauguaugccuguauaaaugcgacaaaagauucucaccacacgcuguuacaccaggaggggaugucuguaggcaguccucacggaucacagccacacucuagaucccacaguacacauaugaacaucuuagcucccacaguaaugaugaucucuaaacacauagaugguucuuuaaaucagugggcagucacuuuugcugauaagucugccuuuaccacuguucuaacuguaucucacaaauuuagauauugcggucaucgauuucaccucaaugaccuggcaugucauucaguuuuaccacuguuauugacauccucucaucauaaugcucuauugacuccugaauuagauugucagugggacucagacaauaaauuaaguagauuaauggacccuguaaaacauauaaaagguuccucgaaacaaccucuuagaaaugcagcaacucguacauuucaugacccaaaugcaaucuacagugaacuuauucuguggcguguagacccaauaggaccuuugucauacacuggaggaguaucagaauuggcucgaauuaacucuuuacauaccucagcguucucuaauguggcuuggcuuccaacucucauucccaguuacugucuagguaaguguucauuguaauugugaaauuaacacaagcuuuuaaacuauuauuuguuauauacgaaaugguuuauauuuguugucauuaagauuuuuaauaaguauucaguuuucauuaaggugauuuuuaauaaauauucagaauacaggcaugagacugauuuuuagaacuuccagaaguuuuuaaccuuuucucucauaauccauuuuuuaauuaaacuuuuuguuaauaauuuuguaucuacuuauugugccuguuuaauuaugauucuagaccaugguuaagccuaaaaaaaaugugaauacuuguuucuuauccuuuagccaauaagaaaaauacacuacauguuuagaacccagaggccuuguuuuccuuucucaggcacauacugcaauucugcaagugcuugcuuuguugcuucugauggcaaaaaucugagacucuaucaagcuguaguggaugcaaggaaauuauuagaugaauugucagacccagaaucuucaguaaguauuuaauaaucuuuauuaauuuaucuaaggagauaaagaauucucuuuugacuuugucuaggaccuguguuuguuaguugcuguuuagggaguaaguauauguucugggcugcauaugacauauauaugacacauuuauuuuuuccuaagcuguguuccaagguacaugaaucaaaauuuuaguguacauaccacacauuaauacauuuuacaugaaaagaaauaaaaaggauuuuuuucuaaaauauuauuuguuuguaacauauuuuacucucuaguuugguucuguuagucuuacuuugcuuaaaagaaguuuuaaggcaucuuuaccaagcuguauguuuagguuggaaaauuggaacuuuuucaagcuugauucaccauuuuaaaaaauucucugguuagaauuuguuaucaguggguggcagcaucucauucugauaguucuguaucugagcuggaagucauauauguuaguaucuagaguugaacaguagauuuuccauuuaccuauaaaaacaacuauucuaauaaaaauguuuccaguauugaaaaccaaugacuauuuuugagcaucuacuauguucuccuagauguagagggaauacaaaauauaaguuucagaccuaccuuuaaggagcuuuuaauuuagcugaagagagagcuuauuaauaaaaaguuaaguagcaguuuaagacauaagaagaggagucuaagggugguauguaauuaauugccaaaaggauggcccuagaaguguuucauuauucagaggagagagagagaucagauuaagguaggcauagaauucuuuauuaaggacaauauuuggguucauucuugaugaguggauaagauuuagaaagauaaauucuuugucuuugccugagugagaaaauugccuggaaguaaguauagauacaggaaaguacauguguaaagcuuguuccagaaacagugagaaaaccauuuggauuggagcuuaagguuugacauagagaaagucuagaaaaauagaaucauagaacuagaauuggaagauauuuuaaaggucaccuggucucaccagccaucugaugcuuuauuccccucugcuucauuccugccaauuugucaucuggccaucgaugagggagacucaacucuaaaugcagcucauucuauccuugaauagcucacacaaucauauugaaacgcuauuuguuuuguguacauucuacuugcuagugcuaguucuacuuagaauaaaucuaauauuucuugcguaugagaguaccucaagauauuaaaagacagcuuucuuguaaccugugaaccuuacuaccucaggccaaaucugcucccccugugccuaucaaguuucuuuaucuguuuuacauuugacccugguuacucuucugagcaguuuucaguuugucuguacucugagccuuguaggaugacuaaaacauagcaauauugugaccucucucauuagauacauuuauguuuugacagucacuccacauucuucguauguaauugacucaucaugagcugacugucaauaucccgaagucuuucccccucccugcucucugcuaaaccuugucuucuccauucuguauuuguacauuuggauuugggguccaaauguagaccuauuuuuccuauuacauuucaucuugcuaagcacaacuaaacaguccaaucucucaguaucuuuuugaaucuggauuauguuauuuaauguauuuguuuuugcuuuaugacuaugucaccagccuguuugaagaguguuauaccugcaccaucugagucaguuauuaauaugauaaauaggcaggucugaagaaagagccuagcaguauacauuugaaaucuuucuccauuuucauuuuuuggaauguuuuccagcuuguuucaaggauuucugugagacagcuugccauauacuuugcugaaauaaaauacagucuuucuaucuucugcagucaacgaagaaagucaaaguuacaugaggugauuuguuuuaauauaugauagguguaaugugcacaccuugacaucacuuggugaccaaaacauuguacuagguagacauuaagcuccuuggucugcccugcagaaguauguucuuuuccuuuuugaaaaugggaauuuuugccuguuuuuaguuuuuugcuauugaugucauucuccaugauuugggggauuuuguguuuucuuaugguucuauuuguucuccauuauacucaguguuuuguuuuuggugguuccucaagguuuuauaauaugcaucuuuaaccucucauagucuaccuucaaauaauaauauaguacucaaaauauaauguagccaggcacggugacucacaccuguaauccaagcacuuugggaaugagaugggaagauugcuugaccccaugaguucaagaccagccugggcaacauagugagacccccccaucucuaaauauauacaguaaacaacuuucaauaguguccccaaucucccucuccuguggucuucagcaugcauguccuaugaauguuuuguuagguuuauacauaaguauuucauuuauucuacugacuguaaagggugcugucuuuuuaauguugguguccauguaguuauggccagaauauacaaauacaauugaauauacaaauacaauugaauuuuguauguuuaucuuauauccuguaacauugcugaaugcauauauuagguguaggaguguuuuugguagauuucuuggacuuuuccauguagauaaucaucucauuauaaaugggaacaauuuuaucucuuccuuucuaaucuguauggcuuuuauuuuucuuauuuuguugcagugacuaaaacuuccaacuccauguugaauaagaagugagauuggauguucuugccuucuucccauuuuuggaggaaaagcauucagucuuugaucauuacauauaauguuaguugcagguuuaaaaaauuuuuuuaaaauuuuuguggguacauaguagauguauauauuugugggguacaugaaauguuuugauauaggcaugcaauucuuaguaaucaaauaauggaaaaugggguaucuaucaccgcauacauuuauccuuuguguuacaaaugaucuaauuacacucuucuaguuauuuuuaaaugagcaauuaaauuauugacuauagucacccuguugugcuaucaaauacuaggucuuauuaauucuaacuauuuuuuuguacacauuaaccaucccuaccucccugccaaucccuuacgaccccuccuagccucugguaaucacccuucuacucuaucucuauggguccaguuguuuugauuuuuagcucccauaaauaagugaggacaugcaacgcuuguauuucugugccuggcuuauuucacuuaaaauaacgaccuccaguuccauccuuguugcugcaaaaugacggaaucucauuuuuuuuuuuggccaaguaguacucugucguauguaaguaccacauuuuuuuuuucuucauccauucaucuguugauggauacuuagguugccuccaaaucuugguuguuuugaacagagcugcaacaaacaugggagugcagauaccucuucaguauaccaauuuucguucuuuuggguaugugcccagcaguggaauugcuggauuguaugguaggucuauuuuagcuuugugagcaaccuccauacuguucucuaucaugguuguacuaauuuacauucccaccaauagcauaugaggguucccuuuucuccacaucuaugccaacauuuguuauugccugucuuuuggauauaagccauuuuaacuggggugagaugauaucuuauuguaguuuugauuugcauuucucugaugaucugugauauugggcaccuuuucauaugucuguuugccauuuguaugucuucuuuuaagaaauaucuguucaaauguuuugcccauuuuuugaucagauuacuagauuuuuuccuguagaguuguuugagcuucuuauauauucugguuauuaaucccguuucagaugaguaguuugaagauauuuucucucauucuguggguugucucuucaccuugcugauuguauccuaugcuuuuuaacuugaugugaucccauuugugcauuuuugcuuugguuuccuguccuugucauauauuacucaggaaauguuugcugagaccaauguccuggaaaguuuccccaauguuaucuuguaguaguuucauaguuugaggucuuagauuuaaaucuuuaauccauuuugauuugauuuuuguaugcaguuaaugauaggggucugguuuuauucuucugcauauggauauccaguuuuccuggcaccauuuauugaagagacugucuuuucuccauuguauauucuuggcaccuuugucaaaaaugaguucacuguagguguguggauuugugucuggguucucuuuucuguuccauuguucucuguguguguuuuuaugccaguaccaugcuguuuugauuacuguaacucugcaguauuauuugaagucagauaauaugauuuuuccaguuuuguucuuuuugcuuaggauagcuuuggcuauucugggucuuuugugguuccauaugaauuuuaaaucuuuaaaaaauuucuauaaagaaugucagugguguuuuuauagggauugcauugaaucuguagauugcuugggguaguguggacauuuuaacaauaucaguucuuccaauccaugagcauggaauaucuuuccauuuuuuuuguccucuucaauuucuuucaucaguguuuuacaguuuucauuauagagaucuuucacuucuuucaugaauuccuagguucuuaauauuauguauggcuauuguaaaugagauuacuuuuuguuugcuuguuuguuuuugagacggagucucugucacccaggcuggagugcaguggugugaucucagcucacugcaaccgcugccucccagguucaagugauucuucugccucagccuccagaguagcugggacuacaggcaugugccaccaugcccggcuaauuuuuuuuuuuuuuuuuuaguagagaugggguuucauuguguuagccaggauggucucgaucuccugaccucgugaucugcucgccucagccucccaaagugcugggauuacaggggugagccacugugcccagcugagauuacuuuuucaaaauuucuuuuucagauuuuuugcuguuggccuauagaaaugcuacugguauuuguauguugauugauauccuggaacuuuacugaauuuaucaauucuaaugguuuuugguggagucuuuagguguuuccagauguaagaucaugcuuucugccaacaaggauaauuugacuucuuccuuuccaauuuggaugccuuuuauaucuuucuuuugucugauugccugagcuggcacuuuccguacuacguugaauaacaguggugaaagugagcauccuuauuguguucuagaucuuagaggaaaggcuuucaguuuuuccccauucggcaugauacuaggguauagaagguauguuccuucuauacccacuuuuuuuagaguuuucaucaugaagggcuguugaauuuuaucaugcuuuuuuagcauuaauugaugcuaaaaaauuuuuguccuucauucuguuguccuucauucuguugaugaaauguaucacauugauugauuuguauguguugaaccauccuugugucccuguuaugauaaaugaucuuuuaaucauuuuaaucauauuguugaauuuacuugguaguguuuuguuuaggauuuuugcaucaauauucaucagaguuauugaccuguaguguucuuuuuuugaugugucuuuguuugguuuuggugucaagguaauacggccucauagaaugaguuugaaaguauuccuuccuucucuauuuuucagaauaauuuuagugggauugguauucguuccuuuuuauauguuuggcagcauucagcagcaaaaccauuggguccugggcuuuucuuuacuuagagacuauuuauuauggcuuugaucuuguuacuuguuuuacugaucuauucagguuuuggacuucuuuugugguuuagucuugauagguuguaugugucuaagaauuuguccauuucuuguagauuuugcaauuuauuggcauauaguugaucauaguagccacuguugauccuuucaauuucuuuggcaucaguuguaguaucccuuuuuucaucucugauuuuauuuauuugggucuuuucuuucuuuuucuuagucugggaaaaaacuugucaauuuuguuuuaucuuuucaaaaaauuaacuuuuuguuuuauuaaucuuuguaugauuuucuuuguuucaauuuaauuuaugcucugaucuuuauuauuucuuuuccuuuaccaauuuuggguuugguaugcucuugcuuuucuaguucuuuaagagucaucguuagguuguuuauuugaagucuuccuuguuuuuugauguaggcacuuacagcuauaaacuucccucuuuuaguacugcuuuugcaguaucccauagauuuugguaugucauguuuucauuaucauuuguuucaagaaauuuuucaauuuucuuuuuaauuucuucauugacucacuugucauucaggagcauauuguuuaauuuccauauguucguauaguuuccaaaauuccuuguuauugauuucuaguuuuauuccaauguggucagagaagaugcuugauauuauuucauuucuuaaaauguuuuaagacuuguuuugugaccuaacguauggucuguccucgagaaugauccaugugcugaggaaaagaauguauauucuguagcuguuggaugaaauguucuguaaauaucuauuguuuuugauaguacagauuaagucugauguuucuuuguugauuuucugucuagaagauauguccaauucugagugaugucgaagucucaagcuaugauuuuauuggggucuaucucuuucuguaacucuaauauuugcuugauauaucugggugccccaguguugggugcauauacauuuaaaauuguuauauucucuugcugaauugaccccuucagcauuauauagugaccuucuuugucucuucuuacaguuuuugucuugaaaacuauuuugucugauacauaguaucagaaaauaaugauacugauaucaguauaucugucugauauaaguauagcuauuccugcucuuuuuugguuuccauuggcauggaauaucuuuucccaccucuuuauuuucagccugugugugucuuuaugugugaaguguguuuuuugcaggccacagauuauugaauuuuguuuacccauucagccacuauaugucuuuugauuggagaauuuaguccauuuaguccaaguaauuaguaaguaaggacuuacuccugccauuuuguuauuuguuucugguuguuuuguggucuuccuucuuuauuuccuuccuguguuucuuuuagugaaguugacuuuugcugguggugugauuuaguuuuuugcuuuuuauuuuugguguauucacuguauguuuucuaauuugagguuaccaugaagcuugcaaauauuaccuuacaacccauuauuuuaagcuaauuaugacuuaacacuguuugcauaaauaaacaagcaaaaagaaaacuaauaaaggcucuacuccuuaacuuuguccugcuacaacuuuuuguuguuacuauuuguaucuuuuuguaccaucuguaucuugaaaaguuguaauuauuauuuuugauugauucaucauuuagucuuucuacuuaagaucaauuuacacaccacaguuacaguguaauauucuguguuuuucuguguacuuacuauuaccagugaguuuuguaccuucagaugacuucuuuuuuuuuuuuuuggaggcagaaucucgcucuuucacccaggguggagugcaguggcaccaucucggcucacugcaaccucugccuccugggugcaagcaauuauccugccucagccucccgaguagcucacucgcacacugccacgcccagcuaauuuuuuguauuuuaguagagacaggguuucaccguguugcccaggcuguucuugaacuccugaacucaggcaaucugcccuccucggccucccaaagugcuaggauuacaggcaugagccaccacgccuggcccagaugacuucuuauugcucauuaauguccucuuuuuucugauuuaagaacuccuguaacauuucuuguaugacacgucugguguugaugaaaucccucaguuuuugucugucugaaaaaguuuuuaguuauccuucauguuugaaggauauuuuuacuagauacacucuucuaggguaaauuuuuuuuucuuuucagcacuucaaauaugucaugccuuucuccuggccuauaagguuuccacugaaauucugccgccagacguauuggagcuccacuguauguuauuuguuucuuuucucuugaugcuguugggauccuuucuuuauccuugacuuuugggaguuugauuauuaaaugccucgagguagucuucuuugaguuaagucugcuuggcguucuauagccuucuuguacucggauauugaugucuuucuguagucuugggaauuucccuguuacuaucccuuugaauaaacuuuccaccccuaccucuuucuuuaccuccucuuuaaggucagugacucuuagauuugcccuuuugagguuauuuucuggauccuguagaugugcuucguuguuuuuuauucauuuuucuuuugucuccucuguguguuuucaaacucauaaauuauuucuucugcuucaucaauucugcuauuaaaagacucugaugcauuuuucaguaugcuaguugcauuguuuagcuccagaauuucugcuugauuguuuuuaauuauuuaaauuucuuguuaaauuuaucugauagaauucugaauuuguugucuguguuaucuugaauuucuuugaguuuccucaaaacagcuauuuugaauucucugucuggaggucacauaucucuguuucuccaggauuggucucugguaccuuauuugguugauuuggugaggucauguuuuccugaauugucuugauaguuguagauguucuuuggugcauggacauugaggaguuagguauuuguuguaaucuucacagucugagcuuacuuguaucuguccuugggaaggcuuuccagauauuuagaaggacuuggguuuugugaucuaagcuguaucugcuuuggggggaccccaagcccauuaaugcugugguucuugcagacucuucgagguacugccuugauggucuuggacaagaucuggaagaauucucuggauuaccaggcagagacucuuguucucuucuuuuacuuuauuccuaacaaacucccauucucucucucccucucucucuccccccacccaccccccuucuuucucucucucucccacccccucucucucccucucucuccuucccccucccucucucuuucucucucucuuuucugagccaucuagagaugggaguggagugucacaagcaccccuguggccaucaccucuaggacugugcugggucacaccugaagccagcacagcacugguucuugcccaaagccugcuguaaccacuccccagcuaccaccuauguucucucaaagcccuggggcuccugcagucugcagguagcaaagucagccgggccuguguccuucccuuuagggugacaaguucccucauacacugggcuggucuagaaguaccaucugggagguagggagcagagucaauaaucuuagaaaucuaccugguguucuauuguacuguggccgagcugguacucaaaccacaagacacagucccuccuacccuucucucuccuuuccaaaggcagacgagcuucacccuguggccaccaggacuucaggccuacagggaguacuuccagacuacuaccaauguuuucuuaaggaucaggagcucuuugguuagcuuguuguaaaugcugccuagucugagacucaccauuucagggcauugggcucccuucuggcccacagaagauccagaaaugcuguaagagccagguccuagaacuggggacuccaagagccugcuuggugcucuacucccuuguggccaagcugguaccuaagaugcaagauaaaguucccuuuacuuuugccucugcuucucuccaauuuuaauauaugugcugucgaagcgagcacauugccccuccuuuucucuagcaggagucuugcccuguagcuaccauagcugggaaugugccgagucucaccucaagccagccagucucagggucucauccaagaccccuggcacaguaccuggauauugcugcugguuauucagggcccagaggcucuucaguuagcaggugaugaauccugccaggggucuuuccccucauggcaguggauuccuuucuggcccagggugugucuacaaaugucgugugggaaauagggccuggaaagggagccucaugacucugacuggugucuuauccugcuguagcugagcugguauccaagaugcaaaacaaaauccuccccacucuucugucgccucucuucaagcagaaggaaggagucuccuuuggagccgugaguuguacagccugggguuagggaagggaugaugccagcacuuuuuuagccaucccgccuggugucucaguagguugcaugccuccccagcccacugucuuuggcccaguucagcccuaggacucaucuaggaguugcagaccuuguggccuagauugccuuucaaguuuauuuaaggccccagagaaccugagccuugugguggcaaggcuuuuggggaaucaagcucagacagauaggaucagcgauuccccucuggguagggcucccuccaugggugagcgucagcugaguuuggucugguuuuucuuucugcuauauaacaaggcagcacugacuucagugcucacaguugcuugcucuuccuuuccccagugcacagaaacucucucagcaccacgcugcugcugccagggugugggagaagagugguguuggugauucaaguguguguuuccuaccucuucagugcuucuuucagugauaaugaaguuaaaacuggguacugugaaugcuuaccugauuuuugguucuuaugaaggugcuuuuuuucguauagugguuaaauugguguucuugcuugggggacgauugggggagcccucuauucugccaucuuccucuauuccuaccuccagcuguuggguuauuuguagauacucuuuaucaaguugaggaaucaagaaaauuaacaaaccuagaggagaacuuccucauauguuuugauuuccuuugagaauuucucuucgacccucgauuacuuagaaguguaagauuuagcuuccaagcguccuguuacugauuucuaguuugauuccgucaugguagaaaaauguaccguaugauuucaguccuuuuuaguuuguugaaguuuguuucauggcccaggaccuggucuauuuuaguacauguuccacucacuaagcacuuaaaagaauguguauuuuguuguuauuggguagaguguucuaugaauguuaauuaauccuguuuugauugaugguguuguugaguucuucuguaucuuuacugauuuucucccuaaucauucuaucaagucuugagagcgagguauugcagucuccaacuauauugugaauuugucuguuucuccuuuuacuucuauaaguuuuugcuucacauaguuuucagcacuguucuuugguguauauacauuuaguucaaauucaagguguuggcaaggccaugcucuuucugauauucaaggggaggauccuuccuugccucuuccuagauugcuccuggcaguccuugguguucuuuggcuuguagcugcaucacugucuucucauggccuucguccaucugagugucucugcguauccuuuuuuuguaaggacagaagucauuagauuuugcaccuacuguaauccagugugaccuuuuuuuaaacuaguuaugucugcaagacccuacguucaaacaagguuacauuccgagaugcuggguggacaugaauuuugggaggacacuauuuaacccacuacucugaucaacuuucuuuucucaucaguuauauuuguaguugcauagucaggaacuuucaaagucucuugagccuccagacuuccuugagccauuuugacuuugagacccccaugcuauaaggcauucugggauuuuuuaaccuuucuaaaauauagacuauagagucuugcucuuauuuucagucuuaaacucuuaagaugacaugacuacuuucugucacauuuccauuauuucugcucaucguuuugauuuucuuaauacaauagcaguucuccuacuuacuucuucuacuaauugugaggcaaaauguagcaagaauuugucacaugcucuccuauuccuuaaaugagauuuuuaguagaugacaaguaaaggcuagcuuuuuaaaaauuuuguaacagauacuugaaagcuauaaauauuguucuguagguagagggguagauuuaggaagcacaggaagggaaauaaagugauuaacuugcaggguagaguagaauugguagguacuggaagcauggagauagcagggagucuguugaggccaacuaagcaugugggaaaacaaaccugaucuaaagugggauuucauagucuaggaaaggagaagagcagagcuuaguagcugcuugaauauggauaugaaaacagaggauuccaagugugauaguuguuccaguagcuauggcaagauaguuuugagguauuuacaaugaguuaaauuugggacauguugaaugugaggugaccuugguuuuagauuccuaaguuuggcuuguuuguuuauuuauuuauuuuauguuuuuauuuuuuugagacagagucuugcucuaucagcccaggcuggagugcaguggcaugauaucagcucacugcaaccgcugccuccuagguucaagugauucuugugccucagccuccugaguagcugggacuacaggcgucugccaccaugcccagcuaauuuuuguauuuuuaguagcuagggguuucaccauauuggccaggcuggucuugaacugcugaccucaagugagccagccgccucggccucccaagugcugggauuacaggcgugcaccacugcgcccagccccuaaguuugguuuagauuggagauacuccuaauguuccacauuagguaccagugcacauuugggauuuauuauuacaaagacaguacuugaagucauuagaucucuaaaggcauuaguaauaguuaauguucauaaauaugacugucagucaucaagaagagauuuauguuuagcaggcuauuuaugaagacagggauuaaguuuuuuuuauuccauuuaaaguaucaaagauacaguuguuuuggugccuaaaaaauaagcuuuugaauaucuagauuggugagaugcuagauuggugagauccauucauucagguauuuagugaguacuuacuaagguauucuacaaauaaauaaaggagaagucaugaugaaagauagggugguauagugugugcugcuauuaguaaaaacaagcuuuuaaaguaggaaugaucuaaaguguaauuuguuuucacucaguaacuuauuuacucaaucuuuaauuuuuauugaggacucacugugcauaaccuuauaguacauggaagaauaaaugugcauauuguaccaggugcuaagaguguuaaaaugaauagaaguagucccuacuuucaaggaucuuguaucuauagagucauauaaauauguacauauaguauguaauaagugguaaauuagaagaaaaggcugauuucaggaugugaaauucauuuaauuggccuccacuuaagccagcucauuggauucauugaugcuguccauuccuucuauaaaauauaggauggaugcucauagggaauaguauaccaggcuuuguugauuccacaaguugacuuguaaccuuaacaauaauaacagcugggaaaguuauuuaaccugaaaaaaaugcugcuacuacuacuacuacuaccacuaccacuacuacuacuacuacuacuacuacuacuacuacuacuacuacuacuagcaaacuuuuaucuagugauuauuguaugucaggcugucuucuaaauguuuuauauauauuaacucacuuaaccuuccugguaaccuuaagaaaaauguaauauuacuauccauacuuuagagguaaggacacugaagcauagagaaacuuaauuacuugucccaguuuagucagcuagcaaugguaggaccaggauuugaacccaagcagccuagcucuagagaccaaacucuuacaacuacggcugucacucaagagccagcuguguuuauuuucaaccuuguauaugucaaguuguacauauuagugucauucuuaacuuaauuaaauauuauauaaauugaugaaaugugaguauaaaaaacgugaauguuuuuauaaaaauaagugcuuuggaagcaauuuugcuaaaaaucacuaauuaggcauggucaaaacaacuguaaaagauucaggaggaaaugguuuaagaaaaacugcacucgaauugcuuuguaggugucuuuauguuuuuacucccauuuauguauuuauguauuuauuuauuuauuuauuuugagucugaaucuugcucugucauccaggcuggagugcaguggcgcgaucucagcucacugcaaccucugccucccagguucaaacgauacuccugcuucagcuuccugaauagcugggauuacaggugcgcacugccacgcccaacuaauuuuuguauuuuuaguagauacaggguuucaccauguuggccaggcuggucucaaacuuuugaccucaggugauccacccagcucggccccccaaagugcugggauuagaggugugagccaccgugucagccuauucccauuuaaagaacugaaaaauacagccagggccuuacagggguggcauacgcaagaaagaccuguaauucccauuagcaagcccauacuccagggucuuacucaacaccaaaauaucaguuauuuguauacguuuauguuuaaaauaaaacaaaauguuuaaaguauacauauuauuuuaaaaaugauucucuggguuaacugaccuugcugagugauuuguccucucucuguccaaugcugucaguuaagauggcuuuucuuauaguuagaagcaacauuuaauccagauugugaugguuaggaaagaauuucugguggagauagauaucugagauaagacuuacugaauggguaagacaugaaagugaaggaggaaaaggauauuucagguagagauaacagcaacuaacaaugcacagagguagaagaaugugcauaguaaacuguaaguaguuuauuacagccauagcauagaaugugaauggcuguuggaaauagcugagacuggauaggaaguuagagguuagauugugaaaaaauuuguauugcuuucuuuaugauuuugcucugcuuucucaaagucuguucucaacauaggaguuagaaugaugcccuuaaaacguaguucagggcugggugcggugaacccuguaauccuagcauuuugggaggccgaggcagguggaucacgugaggucaggaguucaagaccagccuggccaacauggugaaacccugucucuacuaaaaauacaaaaauuagccaggugugguggcgugcaccuguagucccagcuacucgggaggcuaagacaggagaaucacuugaacucgggaggcgcagguugcaaugagccaagaccaugccauugcauuucagccugggcagcaagagugaaacuccaucucaaaaaaaaaaaaaaaaaaaaaaacaagagacuuugucaaaaccagagaagcaaagaaggagauuuugaaaauauuauuaauguguuuguuuccauuaaagccagaaaaauaaaacuauaauuaguccaauuucugguauaaauaaauuuaaacuuaaaguaauaugugaguuuuaaugcaccuacuuuucaauuuuuuagcauuuuuuaacuacuuugauguucuggaaaaauguuaacuacagccagguguggugguuuaugccuguaaucccagugcuuugggaggcugaggugggaggauugcuugaggccaagaguuugagacuagccugagcaacauagugagacccugucucuacaaaaaaauuaaaaaauuugucaggcaugguugcaugcaccuguaauccuaguuacuugggaggcugagauaggaggaccacuugagcccaggaguuggaggccaauagagcaagacccugaaaaaagaaaagaagaauguuaaccauuaaaaaaaaauauacaucaaaacacauaugugcaguuuugaugcacauuaaugguaucaguguggcucauuaagauacucuuggguucuauauuuaaauguuugauauuuugcucauuauggauuguuuacauuaauuuugauuuuaaaauauugcauuaaaauauuauuuuucuugauuauugaauuuuugagcacucuuuuaaauuuugcacccugggcgaaugcuuuacuucauucuaauuuccaguaguaucuuccacuauaaaaugaguuccuugguuggaggugauguugagugagauucuguagaauucuggaauucuguaguguaguguucagaaagucuguuaauuauagugcuggcagagaguugugggcagggaaagcaaauccuuagcuggaauacauaacuauucuugugaggggaucucaaccuuggcugcacauuggaagcaccucaaucucugugggugggaccuaagcaucauugauuguuaaagcucuccaggugauucagugugcagccaagauugagaaccagugaucuacagcaguccuucuuaaacuuuaauauacgcaugaauccuauggaagucucauuaaaauacagaugucuuaguuucagggaguaaguaugcauucauaaaaagcuucccaucacugcugguccauugacuacacuuugaguagcaaagcuuuguugugugcuacaaaaauuucacuguuuucaccucaccaacuauaggccacaguugaguccagauuucaaugaacaaacccagcagacuguuaacaccauuucuuuuuuuuuccuuuuuggacggagucucgcccugucacccaggcuggagugcaguggugcaaucucggcucacugcaaccuccgccucccagguucaggugauuuuccugccucagccuccugaauagcugagauuacaggcacccuccaucacuccccacuaauuuuuauauuuuuaguagagacgggguuucaccauguuggccaggcuggucucuuaacuccuaaccucaggagauccaccugccuuggccugucaaagugcuggaauuacaggugugagccaccacccuggcccuguuaacaccauuucuaaaugucugagcuaacacuuuaaaucaugaaucuugggugaacauacccauaucaguaaauucagcccuaccuaacuacauauuuuuuucuuuugaucuaauaacccuagaaucaauuuucuuacaugcucucuggaauccuacugauacaaauaagaaaguuucuacaacuccaguguauaugcuuguacuuauaucucccuaccuuguacuuauaucucuaggcgaagcuagccucuaaccccucuuauuggccuuuuugagguagugaaaagugguaaaggugggugcugaggagaaugggcauuucuuucugaggcaaccguuucagaugaaguuacugaaagguuuuuaugcaagagaaagcugguuggaacaugggugaggaggacuguucuuuuuagcagaaaguuuugggauuuugggguuccaaaguuaggcuucauuuguuuguucauacauccuuaucccaaggcacaagagucccacuucuucucaacccuugcccuuaccuucggucuggcaggguuguacuuuuaaauggcauugcacaucugcagaccacucaggcauugggccagaucuucagccaugucugucuugggcuuuaagguugcaaaaaugaagaagauaugauaccuugaaguuauaugcuauuuuuguaaacauuauaguuuucucucugcuuaacuuuagacuuaacaugagaaugaguauggaaaguugaaguauuucuuugaauguauuacauuccauugccaaucagugaauauuuagagggggccuuaaauguccaagaugcuguaucauauugacauuagauuauaauuuguuggccauuaacauuuuguguuuuuuauuuacagaaacuuauuggagaaguguuuaauauugugagccaacagucuacugcucgaccuggcugcauuauugaacucgacgcaauaaccaaccaaguaaaaacaugcuugugaauuggugauauucguauacuuuaucccaugguguuuuauauguauaugauauaugucauucucagaauaauuuucuuguuuguuauuaaaugcagacaacuuauguugauucccauagugaaaaucuacuaaugauuuagggauuauuuuucuccuugggaaaccaagaacuguauguucucauuuauaagugggcgcuaagcuaugaguaugcaaaggcaugcagagcaauauaauggacuuuagagacucagaagagggaggguggaaauggaacuagagauuugaaaaaccacauguuagguacaguguacacuacuugggugaugggugcacuaaaaucucagaauucacuacuaguucauccauguaacaaaaaaaccacuuguaccccaaaagcuauuuaaguaaaauuuuuuaaaaaaggaauuauucuucuccaguugaauuguauuuguagcaaaggaaauuugauucauuuagagaaaccaugaccuugaucuugaaaugcugagagaaaauacagugcagcugcauagaagggucggguugugguuucucauuuuauauuauuacucuuuucaacucaauagaggguaaccucaguuucagaguguuugccuuguuaggccccauguuggguacuuuugugagguccuuuaaaaugcagaugaaagucagauucaaguggacauauacuuuuuaaucacagguccuuuguguaguauuccuccccagcuacuaccuaggaaagaaggagaacccuucucccuagagggagauguaaaacccauuuuagcccucaggauauuuguuucuuuaggacuauguuuauggucuaagggauagaacuaacauuuauuccaaaugugaaaaggauuaguuugguaaagaagcuaccaauaguuuuaaacaaggaaaugaagaaagagccaacuauaguugaaagcaaguauagaguuacaucauaaauuuucuuuagugucuugcacuuucuauuggggaaaauguacucauuucugcuaauauagauaaaauacaucaucucuugauagcagaacuggggcugccagacccauauugcuaauaccuccugggaaaugcuuaacuuuuuaauccccagugccccaccuuucuucagauucagccugugauuucuuuuuucuacucaauaggaauguagaagaguggguuggcuuccuuccuauagauaacuuaauuuuuaauggauuggauguuaaauucauccccuacuuuagccuccuuugcacucauuaccaugggauauuaacacagucugcucucacaaagcaguuuuuuuacuucauauuugcucaacacuuuuuccccugcuccuugugccuauuuuuaacacaggggcugguaaacuguaagcaauaaugaaugacaaaguuuaaaauucuuucuagguuuguucccaauguguuguaugauuucuauaucugugaagacaucacccuucucuuuacuuucaucuauuguuugucccuuggggaaaugaccuccuagacaaugaaugugaagagauuuuuaauguuucuaccuagagaaacacaaaauacccuauaacuuucauaaaauuguauggcccaaccuaauauuauaauccuuuuauuucuuucuauuauguaaagaggcagguuuuccuuuauucuauaagauuauagacuccucauccaaugccaagauaaucauagcugcuuccuuuucuugaaaucucugggggagccaucugauugauugucuuaauacacuuccaaaauaagcuuuuguuuggaucuagccuuuccuugaacuucaguuccuguuaagguucuaaguagccauucgugauagucuuaaaacauggucauggagcauagcaguugacagugauguuucauccauccuucgagggguucuaguuacuuauguguaaguuuaguucucuagagauguaucauccugcuggcuguuauaggaucccucauaauucccacuagacagagcuauugggauacuucgaggagcuuucuggguuuuguuuuguuuuuugguucuccaguggaauugaaaaaauuacaaguuguguaguagucuagugugucuuacauagugcagcccucccuagucaguugugaaucugaugcuuucaggcucaaaguggugaagguugcuuaacuguucuuuaaauuuggaauuuggguuuuuuagcaucuuuuuuuuuuuuuuuuuccugagaagcaaaccuguugauuuguuuguacuagagcucuucuauucugcuauuggcugugacauuuuugaaaguaauuuuucucugaccaggauaguuuuaaugauucucuucuguugcuuuuuucuuucuaauuaguagugguaaagaauagaaauuguuagauauauuucuucugcauuagcauuggggaggugacagaugggagaugggagacagggaauuucaaagauaaaaccucuucauuuuuuuuuguauuuguaguguggcucaaauacacaguugcuucauguguuucaagaagacuucauuauaggauauaaaccacauaaggaagauauggagaaaaaggaaacagaaauauuuuuucagccaucacaagguacuuuaaaaaaauagucugcauuuguuuaccuucaugcuaaaaaaugaucucuaaguuuucacugaguauggaucuucaaaaguuaccacucucauaauuuuugacagauucaccaguuaguucugucaaaauugcuugcuuguagaugaagagggcugugggugaaaauuacuuuuugcaagacaauucauuggugacaucaacuuuuacuaagaaaugguaucugugaaccuuaauuuguuuuaaaaaguaaguuucuucaacucuauaauuaaauuauuuugauugguaguuccauuugguaucuuaaggaaaacaguuaauuuuauuacagguuuuaaaaaauuaccaguaaauugcuucagaccaaugaugaauauaagauauaagguaucauguugugugggacacuagaaaccucauggaaauagugaaugcaagguaccaucucacaguuuuccccuuugaagugugguauuuuuuccuuuuugugaaaguaaguaguuuaacccuuucaaaaacaaacaauaugacguuuaguuuaaacuuuauaacuuagcuuaaaauguucccuucagacguuaaacuuuuauuuaaguuuuuuaaauuggcaaauaaaauuguguguauauauauaacuucauaauuauaaaaccaacauguucuauuugaaaagccaugucuuuaagaauuaagugucuauggcgaauauuuaguuuacaaaggguuuucagauaauuaaucucaugugguuacaaauugugaauauccagauggacauauuuaauuuucuuaguguagucuucaucacgaaauuauguauagcaucuaaggaaacuguuucuauguaauuugugcagacaauuuccuucgcuuuagugaaaaucagauugagguccuguauucuaagaagcuuagcucaaacaucuuuucacucgucagacuaguaacuuguuuuucuuucguauaucuuucuucauacacaaaacuuuucuuauuuguguuauucaauuauguuaaguuuuauuucacuaucauuauaacagcaguacugcuuuaccaauuuaaaauuuacuuuucuguaguaucuuaccuuugccuggguuaaucuuuuuaauaugguuuccaacaaauguagcugccauuuaucacauuauuucuaacaggaaagauaugccagcuuaccagaauucaaugcuuauauaaaguugguacuuuucuuuauaauauuuuaauugacuugcauuaaaaauuuucuuuauuucucgcuuuugauauuuguuaugccacugcuaaaucaggccaaaagauuuccucagugcuuucuugguuuuccuuuaguuuuugugugaaauuucucuuucuuccugauuuuauagcuguguucuuaaaggacuuguguagguuucuccucuucucugccucugcuuuauuuuguacuaaguuuuaauuuaaaguuaauuacccuuuuaguuaagaaaaaugccaaaaauagacaaaauuauagugcauaauuaaaugaaccuccauauucccauaauguagguuaaagauuuuaucacacuugcuuugucuacacaauuuuucuuuuccuuuuccccccgaauuuuuuuuuuuuuuuuccgagacagaguuugcuuugcugcccaggcuggagugcaguggcgucaucucagcuuacuguaaccuccaccucccagguucaagcaauucuccugccucagccucccgaguagcugggauuacagcuacucggcuguaagcccaccuggcuaauuuuuuuguauuauuacuagagucagaguuuuaccccauuggccagguuggucuugaacuccugaccucaagugaucagcucaccuugacucccaaagugcugggauuacaggcgugagccacuacgccuggccccccugaaauauuuuaaagcaaauccaccuacaguguuguuucacuuccauaugcguuucuaaaaauaacuuccuuacauauuugcuguuaucaaauugauaauaaaauuccucagaaucgugcaauaacuacuccauauuucuuccaguugucuaaaaaauguugagcuuuuuguuuguuuauguguuuuuguuugaaucuauauccaaacaaaguuuacauauuguguuuucauugucuauuuaaagaguauuuuaaucuaaagugauaccuuauauacacccucauuaugccacugacuuguuuuagagcaaguuuauuuuuauuauuauuuuuuauuauacuuuaauuucuggaauacaugugcagaacaugcagguuuguuacauacguauacaugugccauggugguuugcugcaccuaucaacccaucaucuacauuagguauuucuccuaaugcuaucccucucuuagccccccaccccccaacaggcccuggugugugauguucccuucccugugucuguguguucucauuguucaacucccacuuaugagugagaacaugcaguguuugguuuuucuguuccuguguuaguuugcugaaaaugaugguuuccagcuucauccaugucccugcaaaggacaugaacucauccuuuuuuauggcugcauaguauuccaugguguauaugugcuacauuuucuuuauccagucuaucauugaugggcauuuggguugguuccaagucuuugcuauugugaacagugccgcgauaaacauacaugugcaugugucuuuaugguagaaugauuuauaauccuuuggguauauacccaguaaugggauugcugggucaaaugguauuucugguucuagauccuucaggaauugccacacugucuuccacaaugguugaacuaauuuauacucccaccaacaguguaaaagccuuccuguuucuccacauccucuccagcaucuguuguuucuugacuuuuuaaugauugccauccuaacuggcaugagaugguaucucauugugguuuugauuugcguuucucuaaugaccagugaugaugagcauuuuuucauauguuuguuggccacauaaauguguucuuuugagaagugucuguucauauccuuugcccacuuuuugaugggguuauuuuuuucuuguaaauuuguuuaaguuccuuauagauucuggauauuagcccuuugucagauggauagauugcaaaaauuuucucccauucuguagguugccuguuuauucuggugauaguuucuuuugcugugcagaagcucuuuaguuuaauuagaacccacuugucaauuuuggcuuucguugccauuguuuuugguguuuuagucaugaaggcuuugcccaugccugcguccugaaugguauugccuagguuuucuucuaggguuuuuaugauuuuaggucuuacguuucagucuucagucccucuugaguuaauuuuuguaugaaguguaagaaagggguccaguuucaguuuucugcauguggcaagccaauuuuccuagcaccauuuguuaaauagggaauccuuuccccauugcuuguuuuugucagguuugucaaagaucagaugguuguaggugugugguguuauuucugaggacucuguucuguuccauuguucuauguaucuguuuugguaccaguaccaugcuguuuuuguuacuguagccuuguaguauaguuugaagucagguagcgugaugccucaagcuuuauucuuuuugcuuagguuugucuuggcuacgagggcucuuuuuugguuccauaugaaauuuaaaguguuuuuuucuaauucugugaggaaagucaaugguagcuugauggggauagcauugaaucuauaaauuacuuugggcaguauggcgauuuucacaauauugauuuuuuccuguccaugagcauggaauguuuuuccauuuguuuauguccucucauuuccuugagcagugguuugcaguucuccuugaagagggucuuguaaguuguauuccuagguauuuuauucucauuguagcaauugugaaugggaguucacucaugauuuggcucucugucuguuauugguguauaggaaugcuugugauuguugcacauugauuuuguauccugagacuuugcugaaguugcuuauuagcuuaaggagauuuugggcugagacgauuggguuuucuaaauauacagucaugucaucugcaaagagagacaauuugacuuccucucuuccuauuugaauacccuuuauugcuuucucuugccugauugcccuggccagaacuuucaguaccauguugaauaggaguggugagagagggcauccuugucuugugcugcuuuucaaagggaauacuuccagcuuuugcccauucagcaugauauuggcuguggguuugucauaaauagcucuuauuaucuugagauaaguuucauuaauacguaguuuauugagaguuuuuagcaugaggggcuguugaauuuuaucaaaggccuuuucuguaucuauugagauaaucaugugguuuuugucauugguucuguuuacgugauggaguacauuuauugauuuguguacguugaaccagccucucaucccagggaugaagccgacuugaucgugguggauaagcuuuuugaugugcugcuggauucgguuugccaguauuuuauugagguuuuucgcauugauguucaucagggauauuggccugaaauuuucuuuuuuuguugugucucugccacguuuugguaucaggaugaugcuggccucauaaaaugaguuagggaggagucccucuuuuucuauugauuggaauaguuucagaaggaaugguaccagcuccucuuuguaccucugguagaauuuggcugugaaucugucugguccugggcuuuuuugguugauaggauauuaauuacugccucaauuucagaacuuguuauuggucuauucagggauuugacuuuuuccugguuuagucuuuggaggguguauguguccaggaauuuauccauuucuucuagauuuucuaguuuauuuguguagagguguuuauaguauucucugaugguaguguuuauuucugugggaucagugaugauagccccuuuaucauuuuuuauugugucuguuugauucuuuucuuuuuuucuuuauuaguuuggcaaguagucuaucuauuuuguuaaucuuuucaaaaaaccagcuccuggauucacugauuuuuggaaggguuuuuuguaucucugucuccuucaguucuagagcaaguuuuuuuuuuuaaagaaguuucucugacuacuuacuugugauguuguuuaaacuuuuucuugucuacuguauugccuguacaguggaaguuagcucuacagacuugauuagaucuggguucaacauucugggugaugccauguacuucauauguaucauaccagaaaaaaaaauuuggauaucucacuuuuagucauauuaagauucggaagauucaguuggugguggugucauuauaguuugacagcagucuuuaucucauggcuucuuccauugaauauuauugaucuuaaaccaguuauuucauuagggauugaaaaauuaugauuuuccaauuuuaucaguucucauuuauuuauuagcuggaaagcaucuguaaagaaaagcauuucuuuaucaacuagggcuauuggauuacuuugaaaaacaguucuuuuuggaaagguuaagugcuuaguuauuuccauuuaauugacaguuucagaaugaggagucugcgcgcugguuaucucuagcugcuacuguugaauuuauuguuguuguuggauuucuuugucuuuuaaguaucaauaugaacucauuuuaagaaaacucuuuaaugaacuauaauauacauacagagaaguacucauauaacucaauggauuuuuagguauguaggauauuucagucaguugcagucauuuuuuaaaugcuuacauagugcuauauuaggcuaguaaguagcauuugaaguagguccuguguccuuuugacauaaccucauuauuguaauaguuuacuuucuuucaggagcaagauuuuccuggguuuaucuuguagcuguccuuugcaagaauggaaucauccuuccaaacuguuucuuuuuuaaaaauuauuauuauacuuuaaguucugcgauagaugugcagaacaugcagguuuguuacauagguuuacacgugccauggugguuugcugcacccaucaaccugucaucuauguuaggucuuucuccuaauucuuuccccuuccuagcccccuacccccaaacaggcccugauguguuauguuccccucccugugucuauguguucucauuguucaacucccacuuaugagugagaacaugcggugccagacuguuucuucuaaugaaaaugguuagaggccacaauuuuaacucuagcagcgcucauuaccaauauguugucauuaugaguuuuaaugauuaaggaaagcuuuuauuauccugcauuagaucucauuuucaguuaugaagaaucuaauuuucagcagggaaaauuauauauacaaguaaugucuuuuuuuaaaaaaugcaugaaauuucuacaaaauuuuuucuuuacccuaccacugcuccuucccccacaacuuaaguuuuuuuuuuuuuuaaugcuguuuucaugcaagaaaagcaggaugaauguuuauuuuauuauuucuuuuuaauugccaguuuucuaaauaaggcguaagugccccaguuacuccaggggcauccugugaggcuggcuugagcuuuugugugcucagcaccccgcuuccuucccuucuauccuccucccauucuucugcugcugcuuucuuuccuuugcuuucuuuuuuauguacccuuuuuugguauuugugugaacucauaguuuguaauaggauaaauacguuuuaacaaauuguauucaguuuuauucuuugaugcucaaaauguccccucuuugacuaguagguauccuuucauguuagcuuuuguguacuuuugacguaauuucauuaguccuugauagcuaucuaacuuucgguacaaaaauuauauaaaacuccuccuuaaagucuuucuugccuuuucuucccaacuuccaugcauaucaagagguggugguagcuuuuaaaaaguguuuuuuuaaccccauaaaaacauacuaauuuaaauauccuuuuccuuugaauaauaggauaccgcccaccaccauuuucagaaaaguucuuucuaguaguaauugagaaggacagcaauaauaacucuauucugcauauguggcaccuucaucuuaaaucuguacaagcauguuuagguaaguaauuauaguuuuauacagagaugauacauaacaaauuuauuuuauagaauaugcuuuacuuugguuaauucuguaaaaugaaguuccauuaaacuguaaauugaguugcugaauuaugucucuucuaaacuuuuaauuacaaggucauaaaucauuaaugaaacugguuaauucuaaaaaccagccuaagggcacauuagacauauugaaaaaaaauaaaagcuuuguuuauuuuuuucagugaauauuuauugaguguacauuaugacuguucuagauguccauagaacuaauauuguacuuuuuuguuaauacacauucccauccaauacacugcacaucaucagcuuuaucaucauuaaaauaagcagaauuggcugggcgcgguggcucacgccuguaaucccagcacucugggaggccgaggugggcggaucacgaggucaggagaucgagaccauccuggcuaacauggugaaacccugucucuacuaaaaauacaaaaaauuagccgggcgugguggcgggcgccuguagucccagcuacucaggaggcugaggcaggagaauggcgugaacccgggaggcagagguugcagugagcugagauugcaccacugcacuccagccugggcgacagagcaagacuccaucucaaaaaaaaaaaaaaaaaaaaagcagaauugcuguuugaugaaauaugauugagugccugagacuuauaagcagaacuguuuuuguagagcauuaagaaauacaggcugggcaugggcaugguggcucaugcguauaaucccagcacuuugggaggcuagggcaggacgauugcuugagcacaggaauucgagaucagccugggcaauagagugagacuucaucucuacaaaaaaauaaaaaauuaauuaagugugguggcauguaccuauacuugggaggcugagaugggaggauugcuugagcccuggagucagaggcugcaaugagccgagacugcaccaccgcacuccagccuaagugacaaagugagacccuugucaauuuuuccauuucaaaaaaagaaaugcaauuaugauuaaaaaauuacuucagccauucuuuugcuguacacauuuagauuaaucucuaaacuaauugggaaaucuguaguaugaagcaaagaaauugaucacagauuuuuuaaaaacaaacuuuuccuuuuugagagauaauuguuaaaaugaagaacugcauggauagccauaucacauugaaucugcuuuaaacuguuaacucaaaauauuugaguuguaagauuuuauuaugucuuguaauuaauugauuuuauacaacuuuuuauauaacauuuaauacagugaaagaauaauuuguacuuuuuuguucacauguauuauacauuaucacaauuguagcaguucuaacugggccaugaauuggcauuagaaaagccaaauuaugugacagaaccuuuaccuucaccuaguugagccuaaucuucuugaggcaccaggaauuuaaaaauucuuucaaagccuuuggaguuaauucuuugcauuauauguuguuugauagaaaugcaagagaagggaucugaaaccaguucaucaggaagagauucacccagcagagaauguaguaauuucuagaguugggcacagaaaugggaguggcucugaagagauuuauagggguaguaacagguccuugugggaggacaggaaccaugugauuuuguuuguccccacugcuuaugaagcgugugucucacuaaagccagggcuagaguugaguugcuugccuacccuguuugugacagcaguaggucacagacaaugagauuacaguagaggcaaauaauguacucuuuuuagcugugauagaaagcaucuaucuuuuuguucuaaucuuugcugcagauuuaacaguguauccugccauucacauuuaacgcuugaauuuacugcaguagugaauauccuguuagaggauaaaugauugguuuaaauuuuguuagagaaggaaacauguugaguaccuucugggugccaggcacugagauuggugcuuuauauaugugaauagauauuauccccaguuuacuaauggaguaaggguauguaacuugaccaagucccauuauaugguuugucacagaacuaaguuucaaaaucaggccuuguugacucuaaagucuuugcuuuuuuuccugcucuuauuuucuuucuuagcaugagauauauguuagaaaauaguaugauuuacaggaagagaaaugauguaguuuaaccuuaguuugcuggugagaaaguagccagagaugguggugaagugccuggccaaaggaaacacaucucauuagugauaaagccaggagugggacucugucuucugacuacggauccaaguuuguagucuuauuucauuuuacaaaaaaaugugaaaauauuucuuacuuaguggccugccauuauaagauagauugacauguuuaacagaaacaaaagaggauuauuauuuauugaauauucuggugcucuuugagauguacaaggcaauaacaacacaucaucccugccuuuagugaauuuguaguccaauggggagagacagauaaauaaauaaauauagaguaucucuuauaugucacggaagaacagauaacugaaucagagauuuacacucacuggaaguucuuuggaagaucaagucaauauggcuuacaaaggcugucaacuaauacuaucuuaaauuuucuuagaacuuuugguuuuuguguuuauucuugaaaucauucucugauuugaguacuugauaggaggcuacuagucuaaugucuucuuugccccuagcuaauuacauggccucaggaaaaucacuaagcucucugaguuuaaauuucuuaaucuaaaagugaggcaguauauuguuauuuccuaaaguuugguucaugauccaucuauuucaaaaacaccugggcugcuuuacugggaucuaccccauaucaucuaaaucagugucucugugguuaggccugggaauuugcauguuaacaaauuccucaagcuuuuaauguguuuuaaagguuguaagcacuggacuguauaagggguuucuuuuagcuuuuacauguugugauucuucccugucagucuugcaugauggaguuggugcuaagaaagaguaaaauuguaaaaaaaaaaauuuaagcuuaucaggguaacuaagcaaaaguuugaaaauugaccuugucugcaaaguaauuuuuuuaaaaaaauuuauugaugcauaauaauuauacguauuuauggcguacaugugauauuuuuauacaugcauagaauauguaaugaucauaucaugguauuuaggauauucauuaccuugaaauuuauuguuucuucggauugggaacauuucagaucuucucuucuagcucuuuugaaauauacauuguuguuaacuguagucauucuacugugcuaucaaacaauagaacuuauuucuucuaccuucauguuuguaccuauuaaagagucucuucacccaccccacaacccuucccauucucugguaucuauuaugcuauuaucuaccucuaugagauccacuuucuuagcucucacauaugagugagagaacaggugauauuuguauuucugugccuggcuuauuucacuuaacauacugaccugcaauuuccaacuguguugcugcaaaugacaggauuucauucuuguuuauagcugaauaguauuccauuguguauauauaugacauuuucuuuauccauuuauucauugauggauacuuagguugauuuuaugucuuggcuguugugaauagugcuacaauaaaugugggagugcaguuaucccuuugauauacugauuuccuuuccuuuggguaaacaccuaguagugagauugcugagucauauggucauucuguuuuaaaaagagcucucuuuucucuauauccucaccuccaaaauacuuuuaagaagcuauguuucuuaaauaauaacaaaguaauauucuagcuccuauuuauaguaaugauauacauacauuuuguaauuuuauaauuuauuuuuaaagcuaaagcuucagaaggggcuuccucugagagucuacuuucagucccuggacagaagaacguagauucuucuccagaaaccucuccuagugugagccccaugccacauucuucaucaauugccaaucuucaaacugccaguaaacuuauucugaguucuagacugguguauagccaaccccuugaucucccagaaucaguugaaguaauaagagcaacgccuucagcagguaaggucacuuuaagacugggcagugguagcucagagugauaaaauauaugaacucuuuaguggauaaaauagaugaacucuucugaaauauguucuauguugacauuaaaauaaagauugauuuucuauuaaugauaugucuagaugguuagaaacaugucuuuauuagaaauaauuuccuggcugggugcgguggcucacuucuguaaucccagcacuuugggaggcugagguggguggaucacuugaggucaguaguucgagaccacccuggcuaacauggcgaaaccaugucuguacuaaaaauacacaaauuaguugggcgugguggcacgugccuguaaucccagcuacuugggaagcugaggcaggggaauugcuugaacucgagagguggaggcggcagugagcugacaucacacuacugcauuccagccugggcgggcgacacagugagacuccauacacacacacacacacacacacacacacacacaaacccacaaaauuuccugugauaaauguaaucagcuugacagaaaauaguguaaauuuuuuuuuuuuuuuuuuuuagacggagucucacucugucgcccaggcuggaaugcaguggugcuaucuuggcucacuucaagcuccaccucccggguucacacccauucuccugccucagccuccugaauaguugggacuacaggcauccaccaccaugcccagcuaauuuuuuuuguauuuuuaguagagacgggguuucaccguguuagccaggauggucucgaucuccugaccucgugauccacccaccucagccucccaaagugcugggauuacaggugugagccaccacgcccggccaaaauaaugaaauuuuuuuuuuuuuuuuugagauggaguuucgcucugucacccaggcuggagugcaguggugcuaucuuggcucacugcaagcuucgccucccagguucaugccauucuccugccuuagccucccgaguagcugggacuacaggcgcccaccaccaugccuggcuaauuuuuuguauuuuuaguagagacgggguuucacuguguuagucaggauggucucgaucuccugaccuugugauccgcccacucggccucccaaagugcugggauuacaggcgugagccaccgcgcccagccaauagugaaaauauuuuaaugugaggugucuugccuacacuuuggaauauaaugauaguaaaauuuugaagaacaaauacauucauuuguaaaccacugaggcuuuuuuuaaaauuuaagacuucauucacauugugguaaucacgucucaccuuuauuaagaauguuugaacaacaguuggcagauacucugaggaaaaauguaggauaaaagacuauaguuuggguggucuggaaugauacugacuuuagcaagguagauauuuugagggcaagucuggcagcuguguuuaaagugaucuacuugcagaauuuuaauuggggaguuucuagaauaguguuuuugggaaaccaaaauuggagguucggggccgcuaaaauuacuggugaaugauauucaguauagguguuuucuuauucauccguaagacagguuugcauucacaguuggaaagaucauauugagaagaguguacucuugggcuuuuguggcuggugcagaucuaggccaguuuguuaaucuuucaaaauauuugaaagguuuggguuauacucaaauaaguuuauuggaguucgugauaauaaauuauauuuuacagacgccuuauaaaaugucuuauuugacaauaguaaucuaggggaaacaguaacugaucccaauuguuuagauggaauaggcucagaugauuaaguagcuuucccacuguuaaugaaauuauugauggguugaaacucaaauccagaucuucugaccucagaucuuuaaucucuauauccccuugucuuacaguugacaacagaugugcauuguuagucuuuggcagucaggaauagauaagaggguucugguucagugcuaagagaggaugaauuaaacuugguaaaauggguaagaucuauuggucuguuuugcggucugaaacaaaauuugguguaccaccuggggucuggauuauuugagagaagguuaggggcauuugaaaggcaaauuguaaagcucaguuaaguauucaugaugaaaaugauuaaauauauaguaugaaauucuaaggaggcauguugugaagguaaauauaaauaauagaaacacauuaagggcugacuuguuucagugcuuuugaguuuuauuuuaauuaaaugguugccucauuuaaacuuaauuaccuaaaaacaaauuaagugauuauuauugcauaccuugauuucacugaugggcucuucaagaccuuuauagauauguuggccaauggacauuuagugggauacuaguuaagaggaagacugcagagauauucugaagaagcucauagugacuuuaaauugaucacauuccagaauuugauuacuaccauauuauuuuguggcuuuauuauuauuacaacuaacuauuugcuuuuucuuuuuuaaggccaucugaguucuucuucaauuuauccagugugccuugcaccuuauuuagugguuacaacuuguucugacaauaaaguacgcuucuggaaauguuguauggaagccaacccagaguguaauaaaagugaugagaaagaaauuuaucauuggaagagauggccuuugaugaaugaugaaggagaagauaauagcaguacagugagcauugugggaagaccaguugcuguuagcuguucauacacaggucgccuugcaguggcuuauaagcagccuauccaccauaaugguuuuguuucuaaagaauuuuccaugcauguuuguauauuugaaugugaaucuacaggaggaucagaguggguuuuagaacaaacaauucaucuugaugauuugguuaagguugggaguguacuugauucaagggucagcgucgacaguaaucuguuuguguauagcaagucagaugcacucuugagcaaggauagauaucuuauuccgaauaucaaacauuuaguacauuuggacuggguaucaaaagaagauggcucccacauucuuacagugggagucggugcgaauaucuucauguauggaaggcuuucaggaauugugacugagcaaaccaacaguaaggauggaguagcugucaucacuuuaccacuaggugguaguaucaagcaaggaguuaagucaagauggguucuucuuagaucuauagacuugguaucuucuguugaugguacuccuucacugccuguuucucucucuuggguaagagaugggauauuggugguaggaauggauugugaaaugcauguauaugcacaguggaagcaugcugucaaauuuggagacacugaagcugauaguucuaaugcagaagaggcagcaaugcaagaucauucgaccuuuaaaucuaauaugcuggcaagaaaaaguguuguugaaggaacagcuauuucugaugauguuuuuuguucaccaacuguaauucaagaugguggcuuauuugaggcugcacauguacuuuccccuacucuuccacaauaucauccaacucagcuguuagaauugauggauuuagggaaagugcgaagggcuaaagccauucucucucauuuaguaaaauguauugcaggugaaguagcaauaguuagagauccugaugcuggagaaggaacuaagcgacaucucucucgaacuauuaguguaaguggcaguacagcaaaggaaacagucaccguaggaaaagaugguacucgagauuauacugagauagauucuaucccuccacuaccacuauaugcauuacuugcugcagaucaagauacauccuacagaauuucagaagaaaguacaaagauaccacagagcuaugaagaucagacaguaagucaaccagaggaucaguauucagagcuguuucaaauccaggauauaccaacggaugauauugauuuagagccugaaaagagagaaaacaaaucaaaaguaauaaaucuuucucaauauggaccagcuuacuuuggccaagaacaugcaaggguacuuucaagucaucuuaugcacucaagucuaccaggccuuacccguuuggagcagauguuccuuguagcuuuggcugauacaguggcuacuacuaguacugagcuugaugaaagcagagauaagaguugcucagguaaauauucucgcuaaaaauuuauaaaguuguaccuaauagaaauauuuguauuaucucuauacugacucauuuacugaauugcagucucaacuuucaaacuuugcagggaaaagaccuccuuaauagguaauuacuauuauauaauaugcucaguuagaaaagacgguugaggccggcauaugaaugcauggauuugugagauccaugugcauucucucaugaguuuuuacacugaaaccuuugugucauuuuggauuuauaaucuuguuuuuuuguguguguuuggguggguuuuuuguuuguuuuuuugagacagggucuugcucuguugcccaagcuggaguugagcggugcagucaugggucacuguagccuuaaccucucagguucaaguaaucuuccuaucucagccuccugaauagccgggaccacaggugugcaccaccauggggcccagcuaauuucuuuuuauuuuuuuuguagggacuaggucuccuuauguugccccagcuagucucgaauuccugagcucaagcaguccuccugccuuggccucccacagugcugggauuauagguaugagucaccauggacuggccaagucucuuguuuuuuaacacagauugaucccuaugauuuuuucuuugauaauaacagcccauuuguuaauguuacuauggaaucaugaggcuuauugggaccucaugggcucaacuuguuggucuucccauuucuagccauaaacaacuuuuuacaauuaccuaauuuucuccaaaaagucucuucagcgagauuuccauacaguuaaugucauacguauuuugccuaauucauucuguaacuagaaaauuuuuggcugcuuccuggaacuagauuccauucucuuuuaugcacauaguucaggguaaugguguugauuguaaaugauggcauuggcaaaggaaacugaaaauuaaugaucagaauuucauuaauucaauaaauauuuuggaggagugaaaaauugcuauguuucaggcacuuucuuuacuuuaucauauuuaauuaucacagucuucuagcagauagcuauuauuauguuuaacuuuauagaugaagacacugauccuuaagaaauuaagggacucaucugagaucacauaggcauuaaggaguagaaguggaguucauauguggauaaacuguugacucaaagccuguacccuuuuaacuauuucaugauuuccagaucugugggggaaagguagcuggaaaauaucucuucauauagauuuacauccuuauaguauaucccccaaaguuuucuucucugcagguuaaaauaacuagagaccuucuaggguuuugccuaugacuuauuuucucacuauuaauuggaaaagaaaaaucuuaaccauuaugagguuguaugcaguugaaugagauucuucccagaacaaccuuaagcuuguguuguguguuuaauauauauuaguuuuuacugugggacauuaagaaaguaggcauggcaugauuuguaaaaaauaguuuauacuuucuaauacaaaacuguaucauuggcuaagcaauauagaaauaguguauccuggacacaguggacauucaugagguaauaaggcaggaaugaaugucuccauuucacaggugggaaacugaagcucagagauuaaaugaguuacacaucucaguaaauggauucuaaguaaaugaguucuuccauuuguucaggugagacaacuuacagucauucuugacucugcuuucucucauacccaguauccaguucauuggcaaaugcuaucaguucuauuaauauccagaauccaauaaucaauucucauuaccucugcaguuacuacucugguccaagucccugucaucuccuaacugcuuuauucuuuuuaccuccaucuguucuuugcuuaggaaccagugauucuuuuaaaaccaaaucacauuaaaucucuccuuugcucaacauauacuggugccuuccugucucacuuuagaauaaaaguuaagagccuuacaguggccuaaaaggccccacacgaucuaugcucauuucuacucuauuagaaugcucuucuuccagauucaugcauggcuuguuccuuuacuuccucaaauugcugcuggcaugucaucuuauuggagaguuccuuccuggccacacuguaugaaauagaacucucuuacuccagcauucccuaucucucaguccugcuuuauuucccuucauagcauuaauuuccacauauuauuuguuuauuguuugucucuaccuccuaaaauaugauccccaagagaguagggacuuugccuuauucacugcugaauucccaguaccugaagagucccucacauguaauagaugcuugauuuguugaaugaauaaacggacgaaugagcaugguggcucacaccuguaauggcagcacuuugggagguuaagguaggaggauugcuugaggccaggacuuuuagaccaucuugggcaacauagugagaucucauguccauaaauaaauaaauagauacauauuagguuggugcaaaaguaauggcaaaacuguaaauacuuuugcaccaaccuaauagcuaucuaucuagcuaaauaaauagauggauggauggauauagguaaugggaagcagagcuggggcuugaucuuuggcaauuuaaaaguuuuuguuuuuuuuuuucuggaaaauacuauuugauucuauaaucauugaguacuuccaaagugucaguuauugggcuaggugcugucuguauuuuugcuuugcuuuuauccagcaguggcuauaguuuugguuacgcuugccauaccuucauacuuugacuaaguggaauuaauuuguauaaauaaauuuguagaaucaaggugaagguucaaacuaaccauguaacacuaacuagccuggguauucaaauuuuaaaucuuugauaguaccauauuucaguuaauuuaaccaaaguagaaaauacuaccugcuuaaauauauaacaaaugauuucacaucaguuauguaauuuccauuacaucucaucggaauucauguagaaaauauuauuaaaaguuguaccuaacuuaccauaguuaauauauuuuuuauuggauuuccagaugucuuucauuuauuaugagucaauauaaauguucuuguuaucuauucuaauaguuaauuguauuucuccaaaucauuuuucuuuuaagaguuuaguagucacauuuuuuuuuguaaagauaauuuuuuguaaagacguuaaaguguucaggaaggaauacacuaaaacuuauguauuuuauauaaauuaugacuaaguuuaauguuuguuuuauagcuuaucaguuuguggccucuugcauucuuuuuuccuuaaacauauuuccuguuuaaauuacaggaagagauacauuagaugagugugguuugagauacuuguuagcuaugcgccuacacacaugccuuuugacaucgcugccuccuuuauaccgagugcagcuacuucaucaagguaauucacucacuguuugaagcuuugcacaacuuuuacuuaauauuggagcgaugggguguaucauguuuguguguaaacauuagguaagucauuacgugcacaccuaucacuuggcuuaagaucuuucugucacauaguacccacuuaccauuuuucuauguauccuucagcucuauucugugacuuuugcucaucuaacuaaguuuuuuagaauuuauuuacuagaguaguagcuuaggggguaaaugugguaugccugagguuguaacccaaaguggcugucuacagaguagcccugaauaucuugaugucuuuucuuugaaaaauuauguaaacuuugcucugcgauguguuuuuauauuuacuuuaauguaagcauuauguucuaguuauuugccagcaaguaaaguugaugauucaggaagaucugccauauugauaacaguggauuuguguacuucaggcauacugcuacaccugauuugagacauaaggauuuauaucagccuucguauuacagauuaaaaaauugaaacuauagaauuaaaagugaccugcccaggauacaggacuauuuauuagaagaguugggagugcgaaucccaguccagagcuuauuucaguggacuauauuucuuuugaaaccaacaucuuggaaagagucccauaauauacgucuuaguauuauagaaccuagaacacuaggcuugauacacuguuauucuuacccauggcacuuacccuuuaaccuaugaauguucuuugaaaacauaacuauaaauagcuaucugagauucugugucuaaacuauauuucaucugcccaauccuuuguuuuugaaauagauuuugcugagguauuuuuucuauuugaauuaucacucuaaugaauaaccuuguaccuuggcauguaaauauuugcauuccugauuauuuccucaugcuaguuuuccagcaguggaauuacugaaucaaaaggcaugaaaauucuucagucuugauaaguauuaccaaaaugcccuucagaaaugugcucauuuacauucccagaaguuuguauacacguacuacguaccaacaaaaauugaaaacaaaaaauuauaaaaaauauaaaauaaaaaagaaguuugaugaugccaaaucucaaccccauugcccacauuugauauuaacauuuuaagcaaucuaugccauuuggauagguuuuuaaaaugguaucuccacguucucuuaaguuuuaguuuugggugauagucaagugguauugaaucaguuaaugacaauuuuguacauuuccuagggcagucuaaaacacuucaaauuucuaaagcugugucaaauuccauuuucccuuugacugcaguuaaaacauuggcgaugagaagugacugguguuguagguguugguccugggagcaguuuucagggaaaaguuaaguagccaguacauagauagaaaagcugagaagagcaagagcagagguaaacugcagagaauagccugccauugguagguaaauaaaaagaagugccuauucgugccccuguucuuuuucuucccuaauaacuuuuuucaccucugcagguuuucaaauacauucacugcucuuaaucuuacuuucugaaccuaauucuucugacaugucuguguguauuuuuguuucuucuuauaccaaaauuuuaauuaauuuaaggauauagaauguaauaugcuauguauugucauuuuauauuauauauuuuauaucagcaaaauuaugcauuuuguguugccguauauuaguugcugaagcagaauaucaauuauuugauaaaguaauucucucacagcagacagagauuuaaauagugaaaaaauuagucugccuuucagguuauaaaaaacuaaauuuauuuuauuaauuuuuucugguguuuuccccuaaauuuauaguggcagccaagacauguugcauuaauuuugugguaugauuacaaacacaguuguuauaugaguguuggcagugggaaauuuaaaagaguuaagauuguuauucaaaauaaucauaauaguuuuuauuuuauacuuucuaaagaaauuacagugaagcaguaauuauuagaaaagcuuuaaacuauguacaaaaucuauauaguaguugaaaauggaaaaaauuauguguaacaauauagauacuuaauagcauugagaggccuauguuguaaugugacuuucauugaccucagacauuucuuuguuucuaaaaugaauucauacagauggcuacuuggacuaguuuggcuucuuuccaaggcuucccagaguucuugccagcauucccauuauugauuaccauucugugugguucacauucauuauguuucguuuuuaccugcuguaagucgaauaucaguaagagcguuaucaguaauugaacuguugauaaauccauuaguacuuaaaagucuaauagcgucaguaaagauuuuguugccucuucaaacagccuagaucccugucagucuucucccagguaaaaaaaaacaaacaaacccaaaacaaaaaacaauguucaccaaaaagcaucaguauuaggcagcuuuaaacuuuuaacugaaggcacuaaaagcagaggaauguacaucaugauuguaacuuauccuuauuauuuucuggaacucuuacgaaguuuagagcuugcuuugaagugauauuuagcuccauggcuagagagaagaaugggguaguggcacuggaaucgacauccaggacugugagccaagugcuuuugacuugaauaaagcuuucaccacacuuuccuuccccugggcucuugugggggauaacacaccuuguguccucuugggcgggccggauucacagguccuggugacagagaaaccuggaaucgggccugggcccuaccuuccuaguuaugugagcuugggcagcucuuaugaccucuugauaaauuugguguaccguacaugugaauggccugauauucaaauauuuuucuuucuaaugauuaaguuuuagugucccuauuuuuguaggggaaaugaaaacaaauguuuggggaaaaagagauuuggauuuuauguaucacauuauugaucuuguauucagaaacuuuuauaguauaaaguccugaaugaugacagacugccuuucauucuuucuuucugcuucaaaauucuuuccaaaaugaaugcguaugugacugcaugaaaaauuguuuuucuucuuauuugauacaguuacgcagauuauuauuuuauauuuccaauuuaggugucucuacaugccauuuugccugggcuuuucauucugaggcugaagaagaacugauuaauaugauuccagcaauucagagaggggacccccaguggucugaauuaagagcuaugggcauaggauggugggugaggaacauuaacacgcuucgaagaugcauugaaaagguaacuuuucuuuaguggauuuugaguuauauuaaaaaaaccuuuuccuaacgaaaaaaagauacuaucucccagaaaaccuguagugggaaauuuguuugucuaucuugaggucuugagaauuuuuuuuuuuuuggagauggaauuucgcucuugucgccuaggcuggagugcaauggugugaucuuggcucacuguaaccucugccuccuggguucaagcgauuuuccugccucagccuucugaguaacugggacuacaggcgugcgccaccacauccagcuaauuuuuguauuuuuaguagagacaggguuucaccauguuggccaggauggucucgaaucccugaccucaggcgaucugcccuccucggccucccaaauggcugggauuacaggcaugagccaccaugccuggugagacuuuuuuaaauaaaguuuuuuggagauuacaaaaacuugaccuuuauaaaauguccaugcaguaugauauugugucuuucuauauaggcugaauuuauaauauauccguggaauaauaauauuuucuguuauuaguugagguaugcccugguuuaagaaaauggaaaaaucuaacuuuagaaaguaaacuugaguucuuguuuguuauuuacaauacauuaaaaaacucuuuuuauacaaaggacucucugcaucacuaguugaauaaguagcaaacguucuuugcacacuugaaaucucauuggauaaaaacaguuuugauuuguauguacuugaagaacauaucuguggcagcaagugaaauggcuaucaaaguuuuuaaggcagguuuuuggagucaguuuucugguagauuccuuuuaggaaaaaaauucaguucagcucucuaccagguuuggugccaguugcuuuucauaaauaauuccauguuauguucuaaucaaccccaugucaucaucuccauuuuacauaugauggaacuaagauucagagaggauggguaacaagcccaaacuccagucauuuauaaauguuagauuuagccugugccuuuucuacuuuagcaggauuaggaaaguggaauucuuauucauauuuuccuuuuaguccuuuggaauucccuggaguacaaucagugguacuauauuugugaaguaugaauuuguuucuccgaaggaugcaaagaccuuuuccugauuuauuccuuaauaguaguuccccagagaagacucaacugguaaacuuauguaaaaugcauauucuccaucccauaaccagagauuuuaauuugguagugguagggcugagguuucuucaucuuaaucagcaucccaugauucuggugugcaugguucucagaucacaguuuuaaaugugaguauaaaaguauuauuuuacuguuacguguaaggcugccaacaaaauaucaguauuucuuuucucaaaauaagcacagauauaagaaggaauucauuccugcaccaacuaaaaaaugugaucucugauguacaggaaaaguuaauuguuaaaggauauaaaugauacaguuucuacauuaaauguuuuauauuccaaagcacuggauaaaagaggacauacuuuaucugaaauguuucagauguaucccacaaagauuuuacuucuugucaacaugugucuugucauuaugauuaucugugauaauauacacaugauuuauuuccacaaguaauuuauuucuuaaaauuaaaucaaagggauauguacauuuucugccucaaaauguauauuauaaaucagcugaauacaaauaaaauuccucuaaaaauuaucuaacauauugaagcacuaaguuaaaugauagggggcagacaacacaauuaaaagggggaagggaaaagaguauugagaguaaagcauuuucuuuuuucuuuuucuuucuuucuuucuuuuuuuuuucuuugagacagagucuugcacugucgcccaggcuggauugcaauggugugauuucggcucacugcaaccuccucuuccuggguugaagcaauucucccaaccagccuccaaguagcugggacuacaggcgugcgccaccaugccuggcuaauuuuuguaguauuaguagagacgggguuucaccacguuggccagacugcccucgaacuccugaccucaagugaucugccugucucggccucccaaaaugcugggauuacaggcaugaaccacugcguccggcccgagaguaaagcauuuucaugauguaauuuuagaugucuuuucccuuucucccauaccuuaguauuauagcuuccugcuuugccaucaaugugagcuaauuaauaaaacauccacuguuguuuugucauuaugccuuucaacuuaaugauuugcagaggcuauaucucagcaucuuggaaaaauaagguauggccuauaugcucuuauguuuaagacaguaugauugcauacaauauaacauguugaauuuucaagaaaaagcucacaucuauugaauauucugccuucuuuauugcuuucuauguuaguuucaguucuacgugguuucuauucccuuuucuaacccuuacugugugacuguaggcaauucacuuaaccuuucugucucagucacuuuaucuauaaaaugggaauaaugauagugccucaugguuuguagugaugcaauaagauaacaaaaggugcauagacucgugcccaggacgugguaaauagucaauaagugcuggcuguaauuaggauuuuuaccauaauuacuggcuugcgaaugguuaucucuaggagcauguauuaauauuauaaccuacuggagauugugaaacagaaccaacuuuuucugucuccacaguuucuaucagccauggaaguagcaggggaacauuauuguugauuaauugauuguaauucuuaugucaaauugugaauuuaauauuuuauuuaucauuuagguugccaaagcuucuuuucaaaggaacaaugaugccuuagaugcugcacuauucuaccuuucaaugaagaagaaagcaguaguguggggucuguuuagguaaguugccuugacacuuaacgugauucaacagaaugaagauugugcugugaguaagaaaccuaaugcuuuugaaaauaauuagguauaugagcuucaucaaauccacuucuaugcgaccugguuccuuuagcugaaaaaaauggguaaaauaucuuuucagcuuaaucuagaggaugggauguuuuaaaaguugauaaaagcacuuugcaaaguaaaaaaugcuguuuccuauuuauguauacauaaggcauuauugaccuuccuucuuagaagaagugaagagaugcuugauaacaaaugccuguccuugaaguuauuguucuucuuuuagauuucuguuugagguuuuuauuuuauauuauuauacauucuguagaacauuuuaaauuugguuuaaccacuuuauguuuaugcucgguccccaggucacagcaugaugaaaaaaugacaacauuuuucagccacaacuuuaaugaagauagauggcgaaaagcugcuuugaaaaaugcuuuuuccuuacuuggaaaacaacgcuuugaacaaucggcugcuuuuuucuugcuagcugguucauugaaagaugccauagagguauaaauaagaaaacacacuauauaauacuuguaaaagauugaaaaccuaagaagguuguagaggagauuguaacuuuuggucauauguuuguuaggacacagaauaacuacagagguugcuguacuuaaaauaguggcacugugguaaaggaaaauaugaauaaauucaagggagaaacaaaugaaaaauuucaggcugggcaugguggcucacgccuguaaucccagcucuuugggaggccagggaagguagaucaccugaggucaggaguucaagaccagccuggccaacauagcaaaacucuaucucuacuaaaaauacaaaaauuagccaggugugguggcacauaccuauagucccagcuacucgggaggcugaggcaagagaaucacuugaacccgagaggcggagguugcagugaggugagauugugccacuacacuccagccugggcgacagagugagacuccaucucaaaaagaaaaaaagaaaaauuucauauauggcacauugcauuucaagacuauguguaaaauauaugaaaaaaaugcugaaaaauaguuuaugaaugucuucuuccagaccaucuugugauucugaacuguuuaaaguacauaggucacaaccuccuuauucugugcagaaaggcagauacauuaagcuguuuuuuuaaaugaaauucauaaauaaggaacugaaacuccaguuuguacuguuuuauaauaguuuauaauauuagaauauuauauuagaaaacgaugugaggagguaaaacuucccacuuuuugauauguaauccuagcagcugauuaugagaguaauuacaaauguuuguguuuacuucugauaucuuccucuuagauuacuaucaugaacaauaugaacagguaaaggacaaauacaguugggaauaauauaugauagaaaaacaggaaauauucaauuaagugaaaguacuuuaguauuuuaaauuuagaauuaguuggguuuuuuuuuacaauuaucccaggcauaugaguuucuuuuuuuaaauaacaaauacuuaagauuuuaaaauuggaaguuuagcuuagaagauauucaagcaaagagaaguguugacugagagaugcucauauugccuaaaugaccucaaaugcucagaacugguaguugcauuagaauacaggcucccagagacuaugaauagaacauauggcuguauuucauaauuuauuuacuauuuaaauaugaggcagauaguaauaauuaugauuaugcagaaauauguuuggaaauuaagaggaagugguauauaaauucuagugucauauauaguauuuaauuuaaaaaugaauguuauuuaaguugaucuuaagucugagaugauauuaauauacuuuguuucaugcuuauuuuauaaaugaucugucuaguuuggaagcuacuggguuccaaccuguuacucuuuuugcuauucuuuaaucuccuaucaaucauuuaacuacccuucacugucccuucgcccaccauuaggauauaaaugguagauaauuucaggguauugaugggauauuucaucucucuaaauaauuaucauuaaguaagauaaguauuaauauuuaaauuugcagguaugucuugaaaaaauggaagauauucagcuagccaugguuauugcccguuuauaugaaucugaauuugagacuucauccacuuauauauccauccuaaaucagaagauuuuggguugccaaaaggauggcucaggauucaguugcaaaagauuacauccugauccuuuccugcguagucuugccuauuggguaaugaaagauuacacccgagccuuggacacauuacuggaacaaacaccaaaggaggaugaugaacaucaagguaggacguuuuguggauuucuuuuuuuucuuuuuuaaaggaagagauacuuucugaacuaauguucacuuagauuaagaaaaaucauuaccagauuugcuuuucaacuuugagaauuuauuauuaaaauuucuugugugucuaaaggauuagauaggauuaccauccuauucuaauuacguauauauuuaacaagcauacaaaauguuugccacauucuguagcucuuuuuacauaaucauauagccauuuuuuuuaaauggaaauuuuggcuguuacacguauugguuugucacaugggccuggaaaaacuuuaugccucugugguaaauuuucuuuuuuccuuguuauccuaaauaauuuagauauuacaagcacuuaaaggauauuuaucagcauuguuuucaauaauuugaaaggaauggaacauuuuaaguuuuugucaauagaauaguuaaauacguuuuaauauauccacauauagaaacagugugucauuaaaaauugagguagauacauauguuaauaugugcuguauuuuuaagugaaaaaaaguaagaugcacagcagugugguucuuguugcauuuggcauauguauguuguacaaacaugcaccugaaugugcacacauguuaugucugccuccuccauuuccuuugguuguuuccugaaacaaaucauaagaaaugaaauacuggucauuggucacuggcuaccuuuugggaauaaaaaugaggagauccuugucuuugacuuuugacaacuugaccaugugccuuggagaggaucuuuuuagguugaaucuauuugggaguauuugaacacccuggaccuagaugccuaucucuuucccaagacuugggaauuuugggcuguuacuuuauuaaauguguuuuccucaccuuuucccuuuucuucuucuucuggaaugcccauaauaugaauauuuguuuacuuaauagugucccauaaauccuguaggcuuucuucauucuuuuuuuucuguuccuccuucuuccuuuuuuuuuuuuuuuuugguuugccugaguuauuucaaaagaccuguuuucaaguucagaaauucuuucuucugcucgaucuagucuguuguugaagcucuugauuauauuuuuuauuucauucauugaauuuuuuagcucuaguauuucuguuugguucuuuuguaugauaucuaucuccuuggugaauuucaaauucacaucauguauucuuugccugauuucauuuaguuguauaucuguauucuuuuguaucugaaugaguuuccuuaagacuaugauuuccuuaagaauuauuuuucuggcauuucauguuuccuugugacuaaggucuguuacuggagaauuaguauuuuccuuuccauucuuuuccuuuggugucauauuuccuugcuuucucaugguugguguguuucuacauugauuucuauguaucuggcagaaaaaguugccucuucuaauuuuauggaguagguuucauagggaaagacuuguuacuaugaauagguccugagguguugguuugguggagugcauugguuagauggauacaguaguguagucuccauguagcuucuucaccuguaauccacauuaguggcauuugcaauccucucaguugccuaggcugaaagaguuugcggugauggccauguagcuuugccaggugggcucgcugggcaguuuuucagguuggggugcauaugugcacacaaugggucagccagcuuagggucugguuggcugggauuggggccacaggucuguuacucuggccaggaguguggguacauggucacuuggccagccuggaggugugccugccagaagcagcccacagggcucauauguggccucacggcuacucagcuggccugggguuuugucuguuagggguggggauaaggcuauuucucaggcccaugacacgauugcauggcugcucagcuggccuggggguguuucugcagguguugcccauggguuauuuguauaccugugaugcaggugcagggcugcucagcuggucugguacuauguuagcugggguggcagugaggcugcuccucaggccugaggugugggcauaaggcugcucagcuggcaugggggcguuucuguuaggggcucauggggcuauuucucaggucugagacuggugcaaggcuguucagcuggcuaaggggugugcacacugggagcagccugcagggcuguuugaccaggcugggauguguccaccagggauagcccacagggccguggaagugggcucuuggcugcuuggcuggccugguggugugcugccaggggcggcucgaaggacuauuucucaggcguugauugcaggcgcagggccuuuggcaggccagaacucugagugcagggagcaggggcgcugcacgcuguuucugagguccugagugugggcauguagcugcuuugcuggccugggggcauaucagcugcucguaggcuuggagaccucucccauuugggggaggguauguauguagugguuuggcuggcucaagggcagguucacccugggcaagacugccagauuguuucucugaccaaaagugugaugguagggguugauuucccugccaugcaggaccaaagucauagccagucaugguccuaggcucugcauagcugggauuguagcauucagcuacccauguaggcuuggaaugaagacggguccccaguguuggagagguacagugacuccuggcccccagagcagugcgcaugccagaggugacuggucucaagauagugcuugugcugcagcagcuuggcucacuggcgguagguggagggcacacaccuuaugcuccuaaucugggucagugccguugcgugaacuucugacgucucuccaaacuggacacagggcuugcaaguacuaugggauucuucuguuguaaggacuguagauguuugugguggccaugagggcugauggggaucuucuguuuaccuuuuccccucugcaaugagaaguucuuccugacugugggcagauccagucugggugggggagauagggcugcagaggccggguaccuccacacugcucuccuagacuugcagucaccacaggugcaucuccacuccccugcugcacucuagugcucucccuuugacacuccagucaaaucuuagcuguuuauucauugccuugguccuuucuuuucggaggaugaaugccaggugugucuagcagccaucuugcuggcaucauucucuugguuuauuuuuauggaugcucagauuguucuuucacaaaugggaacuucuucagguuucugaauucuucuggcauuauuucuugauaguuuucuugcuuucugguacuacaaaauguuuaagggucaucuuguacauuuccugccccagaccuggaaaugaccauuccuccaaagcauucugcuuccuuuuaguggggaauaauauuuagaaacuauaguuugggcaccaggauccucauugguacuaaucuugucauaauuucuagacuauugcaaugaauggaauuaggaaauuuuuuuuccuuagaauuuaggaguuuacccugcuauuucucaugcacauauagauuauaggguucuuucuucuuagauguuaaguuugugucuuauaaugaaauguuuggauucucauggcaugaacauaguuauuugcuaucuaugugcauauaaguuucagaauaauaauauagauauuuuuauaauaacaugauucugaacauaauuuaagcuuuuuugcagaauuuuuuuguuuuaugguacauucugcuaaggauguacagucaaauuacuuguuuuuaacucacuuuuuagaguucaucucugugugauuaugcuaccaacuugauagacugauuuguuuaauuuugccuuuugugaauugugguuuagauuugguuuuauuuuaaaauuauguaaaauguugacaugguguuaaaauaaaauauauaaaaccaguguauuuucagagaaaucuagcucuuuuuuucccuguuuugcucuccccuuuuaaggaaucaauuaaaauuuuuuguguuugucuuccauuuaaaaaugauaagccaauaugcaugaguguguauuuguauuuccucuucacugucuuagauagauaaaagguagcuuacuacauguacuuucugcaucuucuuuuucuuaguguauccuggacaucacucuauagugaugggaaucacuccguagcauauugggaaauucuuucuauuucagcuguacaguuguaaugauuguauaugccauaguguaaccuaucguagguuaauauuuacauguuguuuuuuugaagaaaugcugacguauuuuauuguuuuguaauguaaauacauauuaacacaaugcuuugugauuuuaucuguuugauuucuauaguuaucaucaagucuuguaacccgguggcauuuaguuuuuauaacuaccuucgaacucauccuuugcucauucgaagaaaucuugccuccccugaaggaacuuuggcaaccuuaggucucaaaacugagaagaacuuuguugauaaaauuaaccucauagaaagaaaauuauucuuuaccacugcaaaugcucauuuuaaaguuggaugcccuguuuuagccuuggagguacucuccaaaauuccaaaaguaaccaaaacaucugccuuaucugcaaaaaaagaucagccugacuucauuucucacaggauggaugauguaccuucacauucaaaagcucugagugauggcaauggaaguucuggcauugaauggucaaauguaacuucaucacaguaugacuggagucagccaauaguaaaaguugaugaggaaccucuuaaucuugauuggggugaagaucacgacagugccuuagaugaagaggaagacgaugcuguugguuuagugaugaaaaguacagaugccagggaaaaagauaaacaaucagaucagaaggccucagacccuaacauguuauuaacaccucaggaagaggaugauccugaaggugauacugaaguugaugugauugcugaacaacuaaaauucagagcuuguuuaaagauccuuaugacugaauuaagaacauuggcuacagguuaugaaguagauggaggaaaacucagauuucaacucuauaacuggcuugaaaaggaaauugcugccuugcaugagauauguaaucaugaaucaguuauuaaagaguauuccaguaagacauauuccaaaguagagagugaucugcuggaucaggaagaaaugguagacaaaccagauauugguuccuaugagcgccaucaaauagaaagaagaagauugcaggccaaacgagagcaugcagaaagacgaaagucgugguugcagaaaaaccaagaucuccugagaguauuucucagcuacuguagccuucauggggcccaagguggugguuuggcuucaguaaggauggaacucaaauuuuugcuacaagaaucacaacaggugugaauaucacuuuuuuuucaaucuugguuauuucaguaauuucaguagcucuuccaguuauagcuauaaagcucuuuuacuacuuuuuacuaguuaaucuaaauauguucagcuccucucuuuauaggaggcagauauuuauacucuaugugucuuagacugaaguuuugauaauaaggaguaggcuuaacagcuugagaguauucuugugucauauuuaucuauauaccaucuacaucuagcauaguaccugguacauacugggugcucaauaaauuuguguagaaugagugagcgaacauauucccuuuacacaauguuuaucaccaguauuucugucagagaacugauaaaauuuuuuaaacuacuuugaaaaaaauaauucacuaucacccacaggaaacuacaguaaagcagcuccagucuccacuaccacugccuaccacccuaccucugcuuucagcaaguauugcgucaacaaaaacagucauagcuaauccuguauuguacuuaaauaaucacauccaugauauacuuuauacuauuguucagaugaaaacaccaccucaucccaguauugaagaugugaagguaauguaaaguuuaugaucauuugauauuauacacccugagaagguaaauauguuauaccugucuuuuaauucgaacuuaggggaaauauuucaaagugcuaccuuucucacucaugaucaguucaagacuauuaguccaaugaauguaauuuaaaaguaaguguucuuacuucuggagaaguuauugucuuccuuuaagacagacaaauacuuuuggcaauaaaacuaauuuucuugacaguauucuugcuacuuaauaucccuuuagauccuccauuccccuuaaaugaaccauuaaguuggaaauaugacuauuuguuuacaugccaagauauuaugaaaauacaaguuggggaguaucugggagggaagcaugacuggucacaaauggucccagagagaguguccuuauuacuguuuccuuggugguuguguuuauuggaggcaauaguuagaggcaaucagaguuuuggcaguuacuacugcgaacuauauugauacccugugcuaagaucuuaaaaacugauacaguccaagaaacacuagggagcuuggcaggaucuggggagcuagcugaucagacuuuucacugucccagccugaguguauuugugcuaugcuuuuuccaguucuacuggcugaugcacaauucagguccccuguuuucuuauuuuuuauuuguuuuguuugacaggcacauuuacucucuggcagcacauucuucuaaaggccuggucauaaccaauuagggacuucucauccauauuaugaauuaaccuguauuaguauuuuagcagagauuauuuaaaucauuuguuaggugaauagggacacgcagaaaaggcauaaaaagcauaugaauucaaaguaaacauuucuaguuccuagacauuuggauaaggcuuucaaagaguaaucuguauaagguaugaaacuguuucuaaggucccuucaaauuuaaagauuuugugagucugaaaauauugauucaguauagcauuucagggugguggguuuuuuuuuaauuauauggagaaauuuaaaacuuucuaaauguaaaauucuaagacuguccucaauucaugaguaccaaguaaauuacuuucuggaaaaucugcuguuucacacagugauugacacauuuacuaaaaagauuuaauucauuuucauugauaagauuaaguguuuauuuucaucaaggcgaauuucgugaggcaagcuuaaauaaaaacucugaaaauucuauucuuauuuucuucugcuuuuuuuuaaauauuacuauuuaagcuaauuguuaggguaggacaaaugccuguaauaugaacauuagcacuuugcucagggccucguaaacggcaggcucacaguaaguaacuguuugauuaaaaugugucugaaacaaucagcuuuauuguggcauguguauaaaggugggugacaguuacuuuagaagauuuaaagcagaguuaguagucucaucuaggauucagucuuauuuaugauguugcuagguuuccuggauguuuucuaauuuuugaaauauuacuguuguguagaaauguuaguacaaaauguaauugugacuguuuugguuuuaggugcacacacuucauucacuagcagcaucacuuucugcaucaauuuaccaagcauuaugugacagucauagcuacagguaaaaaaaaaucacccaaaauaguauuaauacagcaaaaacauuaaacuguuccagaguuauauuaaguuucuauuuccuagggacugaaaaaucccuaaauaugacagccaugauauuuuaauacaugcgagagaaucagaaauaaaauaauuauuuguuuaguugucaccuaguagucacagagaaauauagaaaguaacaaauaguaaauguaaauuaccaucauuaccauccuuuuuguuuuuaagaaagaagaguuuacuguccauaauaacuuauaauaugaaauuuucuaauuguuuuuccuuagaaacaauuucuuuuugcauuggauuagcagcuauuuaacuaauuauccauugaaauaaaaaauacuuuugaaaaaugaaaaaguacauuccuaaaauggaauuauuuaaauuacuuuuaccuacccauuuacauaugauguaaaagucuuuggaagugauaucaauuagaagaaauggauugaauuuuucuaaauguauaauugccuucauuaguguguacuuugcauuuuaaugacuagagcaauguaaguagcaggaaauugaaucacuuggaaagauaaccuagauuuaaaugaauaauguuaauaaaugaaaaguuuauaauaguagauucacauuaaauugauauuaaauauauuucuggcuuucuuucuuguaaugguagcagccuuuugugggaacauuugguaucaaguaaagaauuaucuaucaaaauggccuguacucugauuguaacuuaauuaggcugugucuaaauaacuccaaagauuggaaauguaaauaaggaaaaaaguugauuuaguugacuguugucaucuaaaugaucaaagauaacuuguuugaugucagucaccauuaaaauggcaccaaaugaaaaugcaaauacauuguuuuuaaauauauauuuuccaguuggucggcuaugauuuacuagacucagcuugacuuuccgcuuuuauauuuuccccaacuucacaaagauagccauuauagagagggaaguaaauauuauuaaauaauauuuagggacauuugguuuuagguuuagguauuucuaaaaugugauucucuggguuuuaguucauaacuuuaauuuaggguuaaacuugcacaacuuugcagagaaaagaaaugcaaccuacuagucccugaaacuuucugccuacuguauccuaguaccagcaguagucuccuuaccucagacuuuguaaaaacacaaaauaaaaauuacugcaaauagaaaagauuuuaaaguauuaaaguggcaucuggaaaaaauucuaaaggaauaagugucaucugcccaacauaauaaaauuuguuacuuuguuuaaaagaaacaauaagcauuuguaacuaauuucaguaauuuucuaaaauaaauuuuuauuagaacagugaaugcauuuuaagaauuuuuguuucuuaaaauaggugucuaaaauagaugauauacauaaagugcaauuuuuuauuaccucucaggaugauaaauaacugaaccuauuuguuuuagcagucaaacagaaggaaaucaguuuacaggaauggcuuaucaaggacuucuuuuaagugaucguagaagacuaaggacagaaagcauugaagaacacgcaacaccaaauucaucuccugcucaauggccuggugagaauuuaaaugauuaaaaaaaaaaaaucuucuaguuggcaauuucuuccuaaaagccuacugaccaguuuccugcuuguugcuggauuuagugagugguuccuuucuuucuuuguuuuuugaugauguuuuucugcuauggauuaggaacuauuaaguacugcaauauugucugaagacucaggaaguuaaggcuucauaaaaccagcuauguuaaccaacauaaaaaagcaaugucuuaacauccuucauaaggauggagcacauuaucuuucuuagaaauguuaaauuagagucuuagaaaaucacagacauauuuucacagacauaccauagaaaauacaguuaguuguucucgggcguguaaauuuauguauugggguaggagugacuauucugugguacauauaucaugcugucugacaguccuuuuuuucuuguuggcucucuuucucauucucuacaucaguuguuucaaaacuucuccacucucuucaauauccuaaguguauauuucagauuacuguaaccauugccuuguagaaacacauuguuuucauuuuaaccucuuauuucaaaauaauuucagacuugcaaaaaauugcaaacauaauacuaaauuucacccagauuccccaaauguuaacauuuuaccaugcuugcuuugucauucauuucuucucucucacucacuugcuguuuguguaucuaaguguauuuuuuuugaaaaauuugagaguaaguugcagaccagauaucccuuuccaucuaaacauuucaauguguguuuccuauaaacagacauucucacauaauuauccaauuuaacauuuauguucucuaaucuacagaccuuuuuugaauuuugccaguugucccacuaaugugcuuuugggggcccauauguaacauuuaguugucaugucucauuagucuccucuuauauugaguaaagucuuccuucuuucucuuucacaacuuugacacuuuugaagaguaccagccaguuguuuuuuuaagugucccucaauuugggcauuucugauuuuuuuucuaucuuuccuuauguuuauuuauuuuauuuuauuuuuugagacagagucuugcucugucgcccaggcuggagugcaguggcgcaaucucggcucacugcaacuuccgccuccuggguucaagcaauucuccugucucagccuccugaguagcugggacuauagacgcauaacaccaugaccggcuaauuauuuuguauuuuuaguaaagacaggguuucaccauauuggucaggcuggucucgaacuccugaccucaggugauccaccugucuuggccucccaaagugcugggauuacaggugugagccaccgugcccagcccugauuuuuuucuuaauguuggauucagguuacguauuuuuuggcagggauaccacaaaaaagaugugucuuucucaguaggagauaucaagaggcauaugaugucauuuggccccagcugcuguuaacuuugaucacuuguuaaggugguuucugccaaguuucuccauuguaaaguuacuuuuuuuuuccuuuguaauuaaucaguaucuugugaagaguuaguuugagacuguguaaaauauuauacuuucacuugcuaauuuuagcaucuagugaugauuuuugccugaaucagguauuacugugggguuacuagcuggugauuuucuaacacuaucacucauuuuauguauuaguugaaauuguacuuuaaggaagagcuuccccuucuuaccuuuuguuuaucuacucauuuauuauaucaguguagacaaauggaugauuuuauucuauaggcuauaauccauuccuaucuuguuuauuuuguugcucaaauuauggaaauauuuuguaaaauauaaaugcauaauuuuggauaaguugcaaauuuggauguuuuuuccuucuggugcuucauccugacauacgucuuaugauuuuauauacccuuauaggugugagcucacuuauuaaucuuuugaguucagcccaagaugaagaccagccaaaacugaacauuuugcuaugugaagcuguuguugcuguuuacuuaaguuuauugauacaugcucuugccacaaauuccuccagugaauuauuucggcuugcagcccacccauuaaauaaucgaaugugggcugcuguuuuuggaggcgguguaaaacuuguugugaaaccucgaagacaaucagaaaauauuucagguaagauacguuugauaccaguaauguauguaaauguuaaucauuuugaauguuaaaauuuuuuuuaauguuucaagaaauuucacuuugaaaauaagcgaugcuuaaaguauaaucacucuuguuaugacagcaaauaauuaaacccaugauauaauaaacauauaguuuguuacuuuuauuuuuauagaaauaacauuuuugagguugauaaagcaggacauguuugaagaagauuaaaaauagaggaaagguaaagguaaauacagaaaaaauguuaaggaacaaagucauacaaaaagaguaguuccuaagacaauaaaaugaaaaaaaaaaagcaaaaacaaaacggauaguucuuaauuacagaaagaagaaaauuuaaguaaguguucaaaaucuuuagcgcauaccagcaguuggcuucagauuaaauguauggucaugugcaagauagccauuccaaucauacacacaguuuuuaaauucuauuuuuuuauucuccaaaauagguuccuuuagucuucaaugugauaguauuauuccauuuuccuuguguguuucuucuucccucauggccagaauauauuuuucaucccacuuuugaaaaugguaugauauggugagguauagacugaugccgcaggaaagauuucuaucuugaugcugauauauagaaaucaucuuaauucauccuuagaaauggacauauuacagaugagaaaucaguggcacacaaguuuaaugacacuaaccucugucuucauugucugugauugaguuaaauaaauagguuccuguguaagucauuguaagggagaugaucuuaucaacucccacugcuuccauucccaucaaauguggauaucugaaucucuuucuugcugcuugguuauaguccacuuuaaacuuaaaaguuuuucuccaaaauuguuuauuucucugccugaguuuucugauuuuuuguucaugguaauuuauccaucaaaucauccaugcuuaaaaccugccaguacauauuaauauuugcauuaauuuauucacuuaacaccuaucaggcaauuaacaaagauauuucagguaaugauaagaacugugauaaaaauggaguaaguggaaagacggugaugagggaaugggaauggaccaguuuaguuaaggugguuggaagacauauuucugaugagauagcauuugaggagagcuguaaggaaguugggaaucacaccauguggauaucugagaccagagcauuccaggcagaugaaugcaaagguccugagguagaauugaguuuggccuuuuccaagaacuacccagggaccaucauggcugucaugaagagggaguguuguaggagaugagaauagaagaguagcuggggcaaguuccuuuaggaucaugguaaaagcguuaguuguucuaaagagaggaggugacagaaucugauucagcuuuucaacagaaccgcucuagcugcuuuguggagaauagacuggguaacauaaauaagaguagggaggcuggugguagggaggcuaguucacuuaaaagauaauuguggguuaccaucaaggaugaaaggaucaacaaagugugguauauucgugcaauggaguguuacucagcuauaaaaggaaugaaguacuaaugcauacuauaaucuguaugaacuucaaaaauaggcuaagccaaagaagccagacacaaaaagucucauauugucuggcuccauuuauaugaaauauccugaauagguaaauccauagagacagaaaguagacugugguugccaugggcuagggggagggagaaauaaggagugacugcuuauuugguauaguguuuccuuuuggggugaggagaaugcuuugaaacuagauagagguggugguugcaugacauguuaaauguacuaaauaucacugaauuguacacuuuaaaauuguuaauuuuauuuuauguaaaauuugccucaauuaaaaagaaauaauagugguucauccuaggguguuaguuauggucagagugaaaagugaucauauucuggguauaguuugagguuagagccaauggauuuguugaugaauugugucugggguagggaagauagaagaguugagauaaaauuauuuucugugauggggagguuuaggagaggagcagguugacuucuacuuucuggcccucccauacccaauuccugaauccuuuugcuauuucuuuuguguaucacucauauacaacccuuccucuacuuuuuaccacccaccauauuagugcaggcuguucuuaugucaucuuccaucuuccucucuaauugaucagacaagccauaccucauugugugacuaaaacuuaagagguguuagugagaauugcccaaaacauaaguucccagguucauagccacagacuuguccuaaccuaacucuagacuguuguugauauuacuucccuccaugacuccugucuaccaaaaguaauuuacuccucauuuacccaaaccuucuuugauuauuuguuuauauuguccuuuuccauuuucccauugaacuucugcccuucuuuuaaggcacacuauuaaauucuacauauucagugaaucuuucuugaaccucauagccagggauaaucagucaaucacucacuuuaauauuuauugaauauaccacuuauuuaguguauuuuauauagaauuacuuuaauccuuauuuuagggagcacauggcaagauaggcuuuaaugcuuuaucuccaucuguaucucugccaugacugcuggaaagcugauucaguaacuagaaaaguuuagaagcacaggaauaaguaauuuaguuuagaccaaaacauggcaagaguaggauaaaaagaaagcuuaacucuaucaauuaacaauggaaaaugaaugcuagauuuuuuuuuccuucuaucuucauuuagcaccuccuguccuuucugaagacauagauaaacaccguaggagauuuaacaugagaaugcucgucccuggaaggccuguaaaagaugcuaccccaccaccggugccugcagaaagaccaucuuacaaagaaaaauuuauuccucccgaacuuaguaugugggauuauuuuguugcaaagguaaggagugugaggaaugcaagcuuuaagagaagucuaucaucuauuuuauuaacucuugcaugugucucacauaggaaugaugggguagcuuuuggauugaaucaccauaguuuagacguuuaauuuauuaaguccagaaacugaauagucauaguaaauucgaggaugaucaguuaccugaugauguaggagacaaauuaaaaucacaugggaguuauguauaaauuagaagucagcuuauuacauaaucagcaccaucuuuuucgagugacuggaauacuuguaucuaccaccuagacaccccucuucuaauuaucaguggcucccuugguaagcauggaauuagaauagaaggagauggauggacauuuggcgguuuuaucaggccaugaugaggccccaugauacaucucuguuuucccagcgcaaaggaaacuucucaggggaucagaauacucauggugacuagaucugguauagccccauuucauaccaugcugggugcaugcuaauguuugcuuuucugcacuuugcucuuuugagcucaugauucuccuucuguugguauguuucccucuuuacauguguuaacucuguuguuaccuugcugugcauacacaugagggaauacaucuccagagucaugccucuucccauuuuuagauuuuuauuagaucucagaguuauugaggcgcugaucccgcuccguuuuuuuguaugcuaagcugauccuuaaaaagucuuucaacaugaguuuggaagcuuuguuuuguuaucuaaagacucugaggccaggugcaguggcucauaccuguaaccucagcacuuugggagguugagguggaaggauugcuuacauccaggaguuugagaccagccuggacaacauagaccaugucucugccaaaaaaauuuuaaaacguaggugcagugcuguuugccuguaguucuagcugcuugaaaggcugaggugagaggauugcuugaguccaggaggucagcguggcagugagccaugauugugccacugcacaccagccugggugucggacugagacagugucucaaaaaaaaagacuuugguuacgucagugguucucaaaguguggucucagaaccggcagcaucggcauuccuugggaacuuguuugaaaugcagauucuugggucuucccucagaccccucaaucagaaacucugggagugagaaccaacaaucuaugucuuaacaagcucuccagaugguucuaaugugugcugaaguuugagaacuaugagcuuaggcacauugugagugcagauuuccagguuuacacucuaucaggguccgaguuauacuuccagagucauucuggccuaucccuuaaggcugccaauugaguugcacuuaguuguauuuagcuaauaaaccagggaaauaauaaaguacucuuaaaaauguauaggcaguucccacuccuaccuuuuuaaaauuuuuauuugccacgaaugaaagcucauugcaucauuaaugugagugauaacaacauuaagauuuguaaaugguaaugugcuaaauuuuuguuuuucaaaaauguuuccuccugauauauguucugaaaauuuggaaaaugcaaaauauuauaaagaagggaaauagcacucaucugugcaacaaagauaacuguuaccauuguggccaauuuacuauuaaucuuuuuuccucagauuaaaaaaauguauaauuggaucaguauauguaguuuuuuuucuguuaacauuaacaagguaaacaguuuuuaugccauuaaaaacuuauauagcugucauuuuaaaaacuucaguguagaaaacuuccaacauacacaaaaggagagauaauagcauaugaaucuuuuaucuaccaucauguagcuucaaaaauuaucuacucauggacagucuuguuucauuuauaccucuccccacuacuuuguuuggaagcaaauccaaacaucaugaaauuucauucaaaaauauuucauuauuuauuuuugaaaaaaaaaaaggauuuuaaauagaucuacauuaguguuacacccacagaagcacacccacaauucuuuaauauuaucacauauucagacaguauucacauuucaccaguugcaucuuaaauguuuuuauauaguugauuuguucaaaucaggaucuaaaauaugauucauaccuugcaagugguugcuauaucuucagucucuuuuaaucuauaggcuccaccucucucucucucucucucucuuuuuuuaacuuaacucccaccuuuuucguuugcccugaaagaauuuugaccuuuagaauuuuucaauggauuuugcugauggcaucaccauauuuuguuccucugaaucuugucaagugaaaauuaaauccaauuucauucugauuggauaggaagagggaguacaggauuaacuucauaggugguuuuguauauuucugucaggaagcuuuuuaugauuuuaguugaucuuugccuacauuuauuauuucagugaaaguuuuaaauuaugauaauauaauccugucauucauuuuucauguauuugcuggaaugucucuucaucaaccuauucaauuacccugaaguacauuuugagucggaaagacaggauaaaugcuuuauucuuuugcuuuuguguaccaguuuucaaaaugaugaguugguucccaagcauccuucagaggaggccagugaguuuuguuuugcuuucagcuuuguuaugaacuuauagauuuaaacauauuuuauauguuuuaaucuauugcaguuauuuuuuucucauggggacucagauuauccaucuuugccagugagagccucuuccacaauuggcuccgaaucuuuuugagauuauuccacuaguguuugaguuugccugcuuucuaguuuuauucuaggcuaaucauguauauuuccugcccgugacugagaacaaucacuuuuuugaaauaaccugguuccuuuuugugagaaauuauauuuagaaacuacagacagaugcuggggugcucgcucuuacuugguugaucauuguuucuagauaagcaucaauuauagugaccauguaacuuuucacuuuguuagugauuugauguuuaaaaugccaagaauaguaucuuuuaaaauaugucuuguucaugagcagauuauuuccuuaagaaguacuaggucaggcccggcaugguggcucacgccuguaaucccagcacuuugggaggccaaggugggcagaucaugaggucaggagauugggaccauccuggcuaacacggugaaaccccgucucuacuaaaaauacaaaaaauuagccgggcgugguggcaggugccuguagucccagcuacucgggaggcugaggcaggagaauggcgugaacccgggaggcggagcuugcagugagccaagaucgugccacugcgcucuagccugggcaacagagugagacuccgucucaaaaaaaaaaaaaaagaaguacuagguccaaggcuauaaacuuaaauaaggcuuuuaauacauauugccagauuauuuuccacauuacuaauuuguacucucuugagaauagugagaggaugcaucuaacuuuacccccuuauuagcauuaaguauuccuuuuucauuuuuguuaauuugauagauuaaaugauuuuuauuuucuguuagugacauuaaaauuuuaaugaucuuauugccauuugauuuuccaguuugagguauugacuguucauauucuuaccuaaauuaucuguugagauuaugguauuuuuccuuuuucuggauacuuuaucuagagauauuauuaauuuaucuuguuaagcuuuuucuaguuuauuugcuuuaaaauuuuguuuauuaugcauuugaaguuuuaaaaaguuuaucaugcacagaaauuuuaaaaaguuuaaaaauuagaucuauccauacauuuccuuauugauuacauuguuuuucagcagaagucuuuuccacuaauaaauguguacauuuauuuuaccuuccuucucuguuuccuccuguucuuuuucuuucuccuccuccuuaacuuuuaauucucuuauuuaucuagaauaaagugaggaacagacuggaucagacuucaucucccauucccacacuuagcuaacuaguuguuccauuauuauuuauuaaauaaucuuucuuuuucucccacugacuuaagauguuaccuuugucagauuaacuucuuauacguguaugauuuuuguauuauauuuuugcaucaaucuagacuacauuuuucuuacuuaguuuaauauccacuaaaaaaaaugggauuuuuuuuauuuaaaaaaaauuccccagcuaaucucaucuauuuuuucuucucuacgaacuucagaaucauuuuaaaguuccaaaacaggaagagaaauucacagggagauuuuuauugaaauuacuuaaagccuguguaaauuaacuuauaaagaauuacaguuuuuacacauuucaguccuucccuucauauaauuuuauaaagauuuauaauuuccuucacaauagcucucucacagcuuucauaguuuguccuuuuguauuucuuuagacuuuucuaacuauuuauugcugaucuauaagaagaaaacuauugauuaaaaaaaauuucacaucuagcuauucaguuauugaauaugagaguuuuaccuugucaucuugacuuuuguagauguagcauuaucugcaaaagaaaauuuuuacuuaugcugacaccauuuaaaauguuuacuuuuauguuagaacaaaaauaauuauauacuaaaaauauuuucuauauuaaauauauaauacauguuauauaaaauauauuuuauauguuuaugaaauuauaaucuuuaaaaaaauaauuuuaccuuuuauugcagccauuucuuccuuugucugauagugguguuauauaugauucugaugaaagcauucauagugaugaagaagaugaugccuuuuuuucagauacacaaauacaggagcaccaagauccaaauuccuauagguaaauaagacuuuucuuucucucauuuuuuuuuuggcuuuucuuuuuguagaaaauaucaauguuauuaauuuuaaauaacauuauuauccugaauuuauauaagaaaugacuuauguuuccagguuacaaauucuacaccuuugaggucaaugucuacauaguguuuucuccaccuccaaagacuagcuuuuauggagagugcaaacacaagcaucuuuagugaggaaaaaauauguaacucauggauauacuauuagaguuuaauauauaaauuauugguauacuauuagguuucaugugacuaugugguuaaucuuuuuccacgagguaauuuucagcaaguguaauauaguauugcaaguuuuuuguauucagugaccacagaggugccauuuuugcauaguaaauuucaaugacagcuuuuuuucuggguuggagagugggcuaaacaguuggcagggaacaccacucuguuucucccaugauuuuauuuuucacuuaaagacucuuuuugccccuccuugaacagcugggcucuucuacauuugacaaugguuaaacuagcacuucacaaugucaagaauuucuuuccuauugcuggacuggaauucucuggugaguuuggaauuuaaaaauuaauguuauuaaguauaauaaauugccgucaaguuucucuuuacaaaaucuauauauaaggucauuugguacuuaaaaaauagugcauuagauauuuuauaaagucuuguuuauuuuaggcuccaaucugugacuuuauuuuuauuuuuuuagauagagucucgcucuguugcccagacuguagugcaguggugugaucagagcucacugcaaacuccgccucguaggcucaagccauccucccaccucagucuccugaguagcugggacuauagaugugcuaccaugcugggcuaauuuuuguauuuuuuguaagagacaaaguuacaucauguuacccaggcuggucuugaacuccugggcucaaacgauccaccugccuuggccuccuaaagugcugagauuacaagugugagccaccacaccuggcuucagucuaauacuuuaguuuauaucaagaaucacucucuacacagaagauugagaaagagcagaaacccacuucuguuuuguugaaagcauuaagaaucuaaacuguauuacauuaacauuugcagauuuauuuguauuuucagaaguauuaucucugagaauucagauucuauaaauauuugggugaugaucgauauuuuuuauuaaaauaaauaacauauucugucaccuuguagagcugccuguaacaucaccauuagguauugcugugauuaaaaacuuggagaacugggaacagaucuugcaagagaaaauggaucaguuugaagguccacccccuaacuauaucaacacauauccaacugaccuuucagugggagcuggaccagcuauucuucgaaauaaagcaaugcuagaaccugaaaauaccccauucaaguaagaaagcucuuauaaugcugauaaagagcguagcuuaacuuuucuggaagacaguuuggcuaaauaugccaauauacuuuaaaacauucauaauuuugaaccugcaguccuauuuuuagcagaauacgcuuaagaaaaauaucagaaauuugaauagaauuuuucccaguauuaucuguaauucauagacauuccauuuacauaaaggaaaaagucuuuauuguauuaauuuccggugugguguuuuuuguuuguuuguuuguuugagacaagagacaaggucucacucugucacccaggauggagagcaguggugcaaucucagcucacugcagccucaaccuccugggcucaacccaucuuuuucaccucugccuccugaguagcuggaacaacaggcgagcgccaucggcuaauuuuuuuuguauuuuuuguagagacaggguuucaccauguugcccacacuggucucaaacuccuaggcucaagcagucccuggucuuggccucccaaagugcugggauuacaggcaugugccacugcguauggcauauuuauguucuuauugucagaacucuuacagaauuuuuuucuaacaaucuauauaugcaaauaaggugcuucugacuuuugucaguaauuuaacaguaaacacauuacagguuuuuaacugauguuuugaucuuuuaccugccaaucuaggucccuuuugauaagcagcaugcuuuuuuuuuugagguaguggacccugauuaauaguuuuuacuauuaaaauaagcuugaaagaacaaagcuuuuuagcuuguuaggcuguuagaaucgguaucuaugacuuguauucauuguugauaugcuuuaaccaagagaaccaauauaaaguauaauuuaaaaagagaauaauaagagauucauuugacucucagcuuaacugguucauucaguguaauuagagaauuaguugcuagaugaaaugauuuuuaggagaacuaaaaauuaaaaguaaacuguacaguuuuguugagcuuaaugcugugucuucuuugcaauagauuaugaagguuuuaaaaauaaauaucuuugcaauagauugugaagguuuuaaaaauaaauaucugcaaauauaaacauauuuucuauagacuaaaguagugugauauguuaauuuuuuuuaauaggucccgggauucuucugcauuuccagucaaacgacuuuggcauuuccuuguuaaacaagagguccuucaagagacauuuauuagauauauuuucacuaagaaaagaaagcagagugagguauuuugagaaaaauauuuucuauuguaauuuuucuuuaguuuucuuuaacauuucuaaggaaaucagugcuugauuuauucugaaauuuucuuucugguuggguaauagucaaaguucacuaaacuaccgugaacuacuuuuaagauaaaaccuuauaauuuucauuucauagcaaugaaacaacauagguacuuugauaaauuacauauauucaagugaaaguugguacuuuacaguauuugucauuagguuuuuacacauaauaaacauugugauggauggcuugaggaauuuaauauauaagcuuacucuauaauauucuccaaauauguacuuaaaauauaaaauagcccuuuaaaagcauuuucuuuacuuagcacuuagaaaugaacagaaugaugauuugaagcaacaaauucaggauacuuuugugagagaauaaacuacagaaauagcaaauacaagaugaaggaagauugcucuuacaaagcaagacagagguucugcauugcaugguuauuuuuaagcuaauacaauuaguaauguaauagcagacaugguucaagaagaauuagcaguuugggagauuggcaagugaccucuuccuuauaaaagugggaccuuuuauaugagcauuucagucuguuuggcuauuuagugagguaauuagugagggaaugagcaguuugaagaguauucagaguugagcgucugauguaauuaaagauuuggcaaacauggccgggcacgguggcucacaccuguaaucccagcacuuugggaggccgaggcgggcagaucaccugaagucaggaguucaugaccagccugaccaacauggagaaaccccaucucuacuaaaaauacaaaagauuagccgggcgugguggcgcaugucuguaaucccagcugcucgggagguugagguaagagaauugcuugaacccgagaggcagagguugcaguaagccaagauugugccauugcacuccagccugggcaacaagagcgaaacucugucucaaaaaaaauaaagauuuggcaaacacaaucaaugagaagagaagaaaugaauuauauuucgcuuagaaaagugaaaacagagagaguccauacggcucaauuucccgagauaaaguauaaaauugcuucucaguuuuuccucaugcccagggcaguggaaccuaccauacuuguucuuuuucccacucacccacuuaccugaaugguaauuguggucagcccuuaugaacagucauuuguuuucucuauggauuuaaaaauuauauacuuaaaugaggaaguagaagaaugaacuguagagaccuuuugaguccuaguuauaagcuuuuucauaacaaaagacccuuauggcauugaaauuauugaugugacuuuguuagggaaaucagaggcaaauuauuugccucugucauuuaaaccacuguguauagcauuuccuauagugaugcugaguccaaauuccauaaacuaaaauauaggaaucuaagauagugauuuaaaauaaaagauuuuagccaggcauaguggcucacaccuguaauccuagcacuaggugggggaucuccugagcucagggguuugagaccagcuuggcaacauggugaaaccccgucucuacaaaagauacaaaacaauuauccaggugugaugguguaugcuuguaaucccagcuacuugcagggcugaggcaggaggauugcuugagcccaggagguggagguuguagugagcugagaucacacaccacugcacuccauccuggguaacaaagugagacccugucuuaaucaauaagauuucuggucaauuaggggcucuguuauucacagaaaaccaguucauugagugaucaauuuucugaguguuuuguucuucaaauuauuaaaauuaaugauuuaucacaaguauguuuuaaguauugguaagguugauagcagcuugacugguugacuugucagaguguagagugcugugggaagccaggugucuggguuucuuggacccucccauucucgucuugcccuuccccacgaguuugcuucuuccuuaacuaauucucccccucuccgccccuuagucucccuuccauuaugccccucagucucuguguguucuauuuuucuuccagcaguggguccccaugaacagggaaguaggacagagauaaacggaauguuucuuaaagugcuauauaagcaucaguuggcuccaaggaagggaaguacauggcugggaguuaggauggaagaauuuuuaucauguacccuuuuaauuuuaaaacauugaauggaauuacugucuuguccaguacugucccauagaacuuucugugaugauggaaaucuguaucugcauaguccaacauaguagucaccagccacaugugguuacugaguacuugaaauguggcuagcaugauugagaaacugaauuuuaauuuuaauugaucuaaauuuaaauaguuacauaugguuagugauugcuguuuugaauagcucagaucugaaaaaaaagguguuuuauuaagaaaaaaauuaugaauaaaacauuaaggcuguuaggacaaaauaaaaacucgucguuaggcucagaaauaugcaaaacuuacuaaaacucuacccaauccaguaagagugcuuacaucuuuaaaauugucaaauaggauuuugguaaucacuaaauuuggcaaauucagaaaauugaccaauaaaauuggcaggcuaauccuaaaaaugcugggugcauuuaaaaaaaaucccugagaaaugcugaaguuauauauuuauaagaauaagaucuuuuauucacugaagauauuacaggaaaauauuucacaaaacaaguuuuugggaaacagauuggugaauucagcuaguuaagacaaauagauucuucagcaguuuggccuucacugaguuagcugugccacacauugaccauuccuuggaaguuuucuuggaugcaucuuuaucagcugcagcagccauaggggagucccuggaggcaugggcagaaaauuugaauggcccuucgugaugaaaggaaggcagucaccugaaaagguaugaggaagaguuuguuucucugaucaaaccuucagaguuuccacagcagagcagaaauauaacuucugauugcagccauccuuaggacccugcaucaacccgggagcaaauuacugaguuauuucuuuuuccgugccugauuuuauuaaacauuuauuuacuuagagaaaaaucaucauauuccuuauaagagugaaauaauuaucaauauuuugaaucuauguuuagaaauaaauauuuuaauuuguauuuuaaaucaaccccuauagggcaggaauuuauguagcaucuucugcaucugcuuauacaaaugggcuuuaauuuuauagauuaccaguuauguaacuuagauuucuuaaaacuguauacagauaacuaauuuuuauuuugaaauagcuuuuauguucuuguguuuauguaauagucacauuaauuuugcucuuuuggcuuuguguuguguuuauuugaugacuguuuuauucgguuuaauuuuuucuugauuuugcaaauucauuuuuaucaucuuuaagugguggaguggccauuucagcuugaaauauuucacugucuuuauaauuucauuccaugcauguguuuuguguuugugacgguguggugguauuuagucuauagaagaacauguggagcaggucaaccaaaacugcauagcagaagauugccacaucaagguaguauuccaagaucuuguauuuagcucauucuuuaaaguucaaggagcuaacgccucaucucugauacuaaccaugaccugcccaacuggcuaacuacucagagaacucauaguacucccauaccacuucaguggcacaggggaggagaugcuucacuguaucuggcuugcucugucuugcccuugguucuucucuuucuugcucccugucccaucuucacuugucacuuuuucuguuuuaagcauggcuguuucaucuucuugauucugccuuuucuuuccuucccaucaccaacccuaagccauugcaucuuccucucaucagucucuuuuauuccuuucgaaguaucccucuuuacaacuuuuccuuauuucugucucaccacccuuacuucaaagggugguuucuuugcgguuuucuauggcuuuuuacuccacucugugccucuuaauguauacacauucuuauugcagaauauuuaugcacuuuuggaagagcuaagagagacauacuacuguauaaauuacuaauaaaaauauauuagccauguuuuauaauuaaucaguaucuuaccaucacaguggaaauuggggugauuacaggacaucagagaauuuaagcaaauuuuccaaagcuaguuuucaacacauuaaaguuacucuuacccuuuuuucuugcugcugcugcugcugcugcugcuacauuuucuucuuauccuacauuuaaaucuuaugggaugugcauaacucuaaauagagcugugcugcagcaacuaaaacugcugaugaauguuuucuagguugaagcugaucugggcuauccagguggaaaggcgaaagucauccauaaggaaucugauaugaucauggcauuuucuguuaauaagguaaaagcucucaucauuauacacaguguauuucuccuuagugaaauugcuuaaaucaucgauucugccuuugcuuuauaggcaaauuguaaugaaauuguuuuggcuucaacacaugauguucaagaacuugauguuacuucucuacuggccugucagucauacauauggaucggagaagaauaugacagagaauccaaaagguuugucucauagucacuuuuacauauaguuuucuguaagaaguacccaccaaaugguuaugcacaugauuugaauuauuucaaaagguauacguguaucuccuucauuuggguaggugacaaauauaauugguuuagcugccagugaaagucuuugucuacauuaacugaaugaauuacacuuccauuaaacccuacacuauugauaauauuucaauaaggauaaucccuaacacuuggcuucaugauauucaguaaauuaaucugaucuggauaauuaaaacaguagacacaaauauguuaauuacacugagucacauuuaccgaguaauuuugcaguguuucuucuuaucaccugauaagcauaccuuuucuuaaacauaaaaauguagacggcuuuacuuuucauugaagcuauggacacugcaccaagaguguuuugccauucuuaccuauuuugagguuucuucuuugugguuugccuucccuccugcuuuucuccagacucuuagaaauuguucaugcuugaggauggugccaugauaguuucucuccucauuuuguugaauucuuuuuuuuguuaguaugugauauaacuaggauuuaauaucacauuucagaguagauauaaccauguacuaugauacaauccaucccaacaauuacuuucacauuuuauaugucuuacuccaagaaaucuuuaaacucaaauuucuuuaaacguguuaauuugauacugagcuaucuguacuugaagagaacauaauauuuuuccauagauaacaacaaacuuuuguuucaacuugugcagcaauaaaguuguccccaaacaacauuagacuaaauuuacauuuugccaaaagggaaaaaaguuaaccaguauuaacauuggcgauuaggacuuguaccuaaguuuuucucauggcuacuuaguuuuuaaaauaaagauuguccuauggguacauaagaagauuuuuaguuggaauuuguguuaagagaaaagggaauguucacaguaacacaugaauguuuuucacaguucagaugauguugauuaucgugguuccacuacaacucuuuaucaacccagugcaacauccuauucagcaagucaggugcauccaccuucaucucugccauggcugggcacuggacagacuagcacuggagcuagugugguauguuauuuacuuauagguaucauuucuggauuuggacucugaaaaaucaguuggaaucucuuugacauaggaaugauccuaaauuucagggacaaacaccaguagauaggccaugauaaugacagcugacauuuauuguggcuuuuuuauuuggugacagggucuggcucugucgcgcaggcuggagugcaguggugcaauuucggcucacugcagccuugaccuccugggcucaauugauccuuccaucucaaccucccaaguagcugggacuacaggugcaugccagcgugccuggcuaauuuuuguauuuuuuguagggaugggguuucaccacgcugcccaggcuguucucgaacuccugggcucaagugaucuacccgcuucagccucccaaggugcuaggauuacaggcaugagccaccacacuggccucauaugacuuucuuagugucagauacaugcuuuuucucacaacaauccuaggugguaggugcuauuauuacccuccauuaucauuuuacagaugaauaaacagauacaaaaugguaaagcaaaguuaaaggggaauucaugucuacuucuaagugcuugaaagcaugucaguaacauucuugucacuguagcuggaggggucccauucuuauguucugcucugaagcaucuggaggugcuccugaauauccucagggaggggcacuugaagaagaguuccuuuauuaugagaugaagcuccuugguaaccucacaggccagggcuauaccagcaagugacugugcuuccucacccucuucagacaaguguucuauguagugguucagaacauccauaacaggcuuuaucucaguaauaagcaagguguaagagaauaaaugucagaauuuauccugaagcauauccuuccucaucuuuucugcauacacaaaauaaaauuuuuaaaauuuucuuuuaaagcuuaugaaaaggaaucuacauaauguuaagagaaugacuucacacccaguccaucaauacuguaaguauuuaugaccuaauaauuguaaguguccucauuuggagguugauuuauagaauagaaaauauuggaacucuuuaauuucuuauuuccugcuuuuucucuuguguuucagaucuuacaggugcucaggacggcaguguacgaauguuugaauggacgcggccucagcaacuugucugcuuucgucaagcuggcaaugcaagaguuacuagauuauauuuuaauucacaaggcaacaagguuaguuucugggggcuacugcugaauucaucugaaaauaguuguggauauuuaggaguaagugauaaaagugcaucgaaaaaugaauucagugacccuggauuuaaacugaguagacaguuuguuggagucuauucauacacucucuuuucuuccaauagaagcaaaaaucuacaaaauuuaguauggauuaaucaucuauuuaaagauacuaaauauacugugagaguaaaaaaacugccuguguugaguguguuggugauuccuguaagcacaguaaaguucuugagagaaaccuaguuucuuacuaaauuucaucaguaagagguuagaggaaaacagugaaacagguaagcaguuaagaaguaauggaagggccagucacagugguucacaccuguaauuacaacacuuuaggagcccaaggcaggaggauugcuugaacuccagcauuugagacaaccugaacaacaaagggagaccacaucccuacaaaaauuuuuuuaaaaagcccaggcaugugccucuaguccuagcuacucagaagguugaggcuggaggaucccuugaacccaggaguuugagguuauaguaaguuauaauugcacuacugcacuccagccuggguaacagaaugagacccugucucuaaaaaaauuuaaaaaaaaagugacagggaauuuuuuagcacuuggacuuuuugggaaugacagcaacagaaacauaguuagaggcagaauguuuauuuaguagggccuuagugaaucuuccuuccauguuuuuaccuuugcuguggaugcuaagaacauguguuuaguaguuauacuguucuuacagugugguguugcggauggagaggguuuucugaguaucuggcaaguuaaccaaacugcaucaaauccuaaaccuuauaugguaaguaucacuaaauguucccagggcgcauauacacaacacuuuguucaugaagugucuguuucagacagugaaucucauuggugguccuauugggaaaaggaugauuuuuuucagcaaucccagccugacagcagcacccauccuuacccuaguuuuagacugaaaugaccugaaaaacaaaaagccuugcuuuucaccuugaaguacaguuuauauuuuaaaaauuuugggggcuuucccugugugugguacaacuuggguuuuuuuucauuauuauuauacuuucauccauuuugaaaacucuaucuucuuaauauacacaugauaaaauucugucauuaagaaucagguucugccgggcacgguggcucacgccuguaaucccagcacuuugggaggccgaggcgggcagaucacaaggucaggaguucgagaccagccugaccaaccuggugaaacccccucucuacuaaaaauacaaaaauuagccaggcauggugacacgugcaugaagucccagcuacucgggaggcugaggcaggagaaucgcuugaacccaggaggcggagguugcagugagcugagauugugccacugcgcucuagcuugggcaacagagugagacuucgucucagaaaaaaaaagaaucagguuccaaacaucuguuccaauuuguuccagaauugugcuuaccagauuauaaaauaaccaaucccaaugagccaccuuaauccaaauuggauuacaaaauaguuggugaugaagauaaguagaucuuuaccugauggagauauggugggggaaaggaacaugggggaggguggaaggugaugcuguccugugugaaacuucaggcuucacauauauggagggagguucagaacgccuugaaccuccugggaccagauagauuacccaaauacuuuuuaaaauuuuucuaaacuauacauauguucuuaauuauguguauaagauaauucucuuaaauuaggacacuauagacuguaccuugucuaugcagaaauggaaguaaucuugaauuuauacuuuugucuucagucagaucuguaccacuauaauuccagacagaaaaacaugcauuauauuuuaaaauaccuugacauccuaagacuaguugggucuguaagcauuuccuuugugacuguuaaaguuuauuacauguauuugagaucauuagcacuaaaauugacgggucuuagguagguucauguacuuugauguccuauucuuacauaaucugaaaaacaugaccuuuaauucuguuuuuaccaacuccaguuauuaaaaauuauuggacaguagccaaauaauauacacaugacaguuaagccucauacuaucacuuauucuuuuauccuagaccgaguuuuuaaaaacuauuuuuagcucaugcauauaguauguuauuagcagacauguauguugguacuguaucaaauuuuauccaaugguaaaauaacaucaguugcacuuuguuuuucguagaguuggcagugccacaguaaagccacaagugacuuugcauuuauuaccucuucaagucuaguugccacaucuggacacuccaaugacaauagguagguugacagaaaagcaaaguaagaaauauaaaaacguuagaaauccauaccuuuagcaagaauacuuuucuauuaguaggguuuuuccacucuaggcauuaaaaaaaaaaacuuuguuacauaauucuuauuucagaguguuuuuucuuaccaaaaagagaaaagcaaaaaugaaaguuauuccuaauauauguaauuuuuauuuuaaagcuauucagucuuuuuuaaacuacuacuguuaacacuguuaguuucucuaggacuaacaggcaucugauauugucuccaucauucucaacauuuuuauuuuauugcaguagguuugggggaauagguaguguuugguuacauggauaaguucuuuaguggugauugcugagauuuuggugcacccaucaccugagcaguguacacuguacccaguguguagucuuuuauucuucacccuccucccaccccucccaagcccccagaguccauuauauaucauucugauccuuugcauccucauagcuuagcucccacuuacaagugagaacauacgacauaugauuuucuacuccugaguuacuucacuuagaauaauggccucuaacuccaucuggguugcugcaaaaugugauuaucucauuccuuuuuaugaaguauuccaugguguauauguaccacauuuucuuuauccauuuguugguugauggacauuuagguugguuccauaguuuugcaauugugaauugugcugcucuaaacaggcaugugcaagugucuuuuucauauaaugacuucuuuuccucuggguagauacccaguagugggauugcuggauugaaugguaguucugcuuauaguucuuuaaggaaucuccguauacuguuuuucauggugguuuuacuaguuuacauucccaccagcagugagguguccccuuuucaccaccuccaugccagcgucuauuguuuuuugguuuuuuaauuauggccauucuugcaggaauaaggugguaucguauuggaguuuuaauuugcauuuuccugguaauuagugguuuugagcauuuuuuccuguuuguuggccauuuguauuuugagaauuaucuguucauguccuuugcucgcuuuugaugggauuguuuuuucuuguuaaguuccuuguagauucuagauauaagucccuugucagauauauacauuguauuuucucccacucugcagguugccuuuuuacucuugcugugcagaaguguuuuaguuuaauuaggucccauuuauuuauuuuuguugcauuugccuuuggguucuuggucaugaauucuuuaagucaaugucuagaguaguuuuuuuugauguuaucuucuagaauuuuuaugguuucaaguguuagauuuaaguuugacccaucuugaguuaauuuuuguauaaggugagagaugaggauucagggacuaacagguauuugacacuguccccaucauucucaacauuuauuuugaccucacaugguuuucauuagcaacacaugcccaugaauaacaucuuguuucccugcaguggcuaccaccuggggauauaaaagcauuccuuauacucaggaagucauaucaguuuccuggaguggcaauggaaaggagaugggguagaggaugcagagacgggcaggaccaugugagauggaacuguguaguuugacccuacccccauccuaguugggaaucacuacucucuauaggugugagugaacaaaaaagauaagaaugaauaagcaaaauauuugacugaaagacagguugucccugaugacgacuuauaacaaucauuuaugauguauuuuuguuauuguguuucuuuaaaagaaauguuugccucugggacacauuaauaucacccggaaacagccucauucauggugaguuaaggucuaugauuuuuaaaaauauaccaugaaggaauaauacaccaugaaggaaugcuuucuugguuuuaauuagugaauccagugaguguuuauugacagguugaaaauggagaaauauuuagaaugaaugacuaaaaauuuggaaaguuaauuagcauaucuggcuuccuugcugaguuaaagauauauggucucagaaauccaaaauagucuuuauauucuauucagaaaauaugguauggauagugguacuacuaacaaggcuauuuaagaaauuaguugcaaaguauucauugagcuuaauagaaaauaacauauuuuaaagaauuaaaccucaucauaaaauacuuuuugucuuuuuuuccuuuuuguggagaucaaggucaugcuguauugcucaggcaggucucaagcuccuagggucaagcuauccucccaccucuaccucccuaaguacugggauuacaagcaugagccaccacaccuggcccuaaccauaaaauaaaacaaagguuaaccuuauuauaaugacuagaaauguaaacagugccauuuaaauauuauuccuuuuaagacaauacuugccaaauuaguguccuaacucugucuuccacauaguaccacccaaaaagugcuccaugcucaaguaaguuugguuaaaugaaguagauugucagaaagacagaaagauucucagucuuuuaauacacugauaugcauuuugaaauauguaguuaauucucaauuuuauugcagaauucugcaaacagugguuaacauugcuuacagauuuucugcauguuaauuugaaucuuuaaucauauuaaaaugcaaauacuccugggaaggauaaugaacuucuuaacuuguaacugaaaacauucacacauuuucucauagugucguuguuucaauuacuuaccugaaaagaacuuuuuguacgguacagcacuuggcuggguuaauacucaccaacuuugagaagguuggucucugcucuucuguauacuuuuuaugaggcaguaucacuuagggcuuaagguuuaaacuuucuuuuucucucuguguucauuucauauugagauuauggauaaaaaguuuguucugacauugcuuaacauuuuucuuuaaucaugugauuacagaaauucaaugacuuacaaaacaauaaauguaccuuagaaugaaaaaugcaucaguaaggucuguauuuaaauguggauguagacaucauaauuaccaagacaagaaauuguuuugagaaauucucugauguuuuucuucuucagguuucacgugccacgaucauggugccacgguacugcaguaugcacccaaacagcaacuccuaaucucgggggguaggaaaggacacgucugcauuuuugacaucaggcaaaggcagcucauucacacguuccaggcccaugacucagcuauuaaggcucuggccuuggaucccuaugaggaauauuuuaccacagguucagcagaagguaacauaaaggugagucaguacaagagguuggaaugugcuaaagacugauuggaaagagaaaaaacaaaaacuccacauucuuugaaauaaagcuucacuuuauuucacuugggcuacugcauggagauacugcauaucucaacacucugccgccuccccaugcuccuguaugguucuuucuaaacuguuauggucaaugagauuaucaaacucauuggacucaggccauuagaaagcuuuaaagcauucuauuuugaguaaaguguaugaguuuaaugcaugaaauuuuuugaugacauuaguuuggcuccuuagaagcuucuccccucucccucaguacucuugugugugguggaggugacguuuccaguaagugagcuagugcagaugcuccuugacuuuauggugggauuaugucccaacaaacccauuauaaguuaaaaauauuguuaaaguugaaaaacauacuuucaacuuaauauuuucaacuuacuaugaguuuauugagacuaaccucaggauaagccaaggagcgugcugaaugcguauugcuuucacacugucauaaagucaaaaagucuugucaaaccaucguaaguaggggacugucuguaccacacuacuuuuacauagccuuaggaccuagcucagcaugaggaacacauuuaacugaauuaacucaaauaguuaauugaauuagagaugggcuacauaugguuaauaugaagccacaagaggaugugaaggaaaauauggaaggaggacaguaaaugaaucgugggagugguguuaucauuucccacuuagauaagcucuuaggaaagaggcagugggugggaagguugggcuuuagugagaucacuugggccaagggagcagaagggccauguuuuugcuuuuggucuuuucguaauauauuuuuaacuccuuuuguuuugcacuagguuuggagauugacaggccauggccuaauucauucauuuaaaagugaacaugcuaagcaguccauauuucgaaacauuggggcuggagucaugcagauugacaucauccagggcaaucggcucuucuccuguggugcagauggcacgcugaaaaccaggguuuugcccaaugcuuuuaacaucccuaacagaauucuugacauucuauaaagauugggguuuuauuuuuauauacauuucaguuaaaaggcacacuacagucaucacuaggcaauucugcuuucuaagcaguuguauugaaaacagagaaucucuguguagaauuugaauaugacccaagcugaguauuaucuaaacagguugguggaaugaaugcgcauguaccuuauuaugcugacauacuaaaaaaaauaaaaccuaguauuguaugaaggauagcuauucuuuacagcauuuagcaaaccugauucagaaaacauuugagauuagcaaauuaguaacuugaaauaaugaaaaggacguuuauaccaaauuaaggaagaaaauguugcugauuuggguuuuucuuccuguucuuaccacugacugaagcaugccugcagucuccuccucuguugaaugaaggauaaucauaagguguuuguuaggagcgcuagaccaccuggaaaacuuucuuagcuguggagcagugcgcagugaccaguucucugcugugagaggccguuuccauucuuuccugcugaauauuuuuccuguuaguguuuauacugagcuaguacuguaacuugcaaaugagugcaaauuuaaaugcaauguuuuacucacaauuugcacauucacauuuuuuggacugcuaguuuuucuauuuaaauauuugccuucauguuaggaauguacuaugugaacaugacauauuuguaguuaaccaaacacaccuucuuaguccaguuuaguacuuuuucuuuucguguauucaagguuaaacacccaaacauuuaaggauauguugaaacuacaccaauagagcauuucauaucauaauuaaaaugaauguuaggcuucuuguggccaguuaauaguugaugagauuggugacauuauuuauugccacagccuauuguauaaacuaugcagaguuaaauauuugcuuguaaaauauuagccaauguugucauuauuuugauguauuuccuugguuaugaccaaaaauauguugagauacugaaacuaaugucuguguguuuaaauguuuaccagcaaauugucuuaucauguuaaugagaauguucaaugccugugugguaaauaguaaauacaauggcauaaaaguaacuuucucugaagaugugauguucaggcugugaaauauauauguaaaagaaaaauaaauguuauuuguuagaguuuuuaguuugauacuguuuuugaccauugagauuuuuaauuugauaaaauguuuaacuguuagag

SEQ ID NO: 192054 - RNA, 27009 nt, Homo sapiens
guggcgcggacgccugcucagugcgcgccggccgggcaacccuaugcuggcguaaucggguuccuccgagccgccguaggacugguuccggcgggcuggugaggaauggagccgguaggcugcugcggcgagugccgcggcuccuccguagacccgcggagcaccuucguguugaguaaccuggcggaggugguggagcgugugcucaccuuccugcccgccaaggcguugcugcggguggccuggugaggagaggaggcggaggcgggaagcuugccuggggacacgccgugggcaugucccaggcuggcgggguggggggagagacccuugggacccaccagggccguccccggcucgcucgcccuaccugaggugacccccuacccgcgagguaucucccagccguggugccccggggggacuucccugaggggcgaaguuccccuuaagguuuucuccauaucuggcucuucuuccgaacuagcgcccugacugacaccuaccuaccccggggacuuuggaucccgcagggaucuccugcugcugcgccagcggguggggguuugugagcugugggagagacgaaaaugaacguccguucgcaauccuuugugcguuugcguccucagcgugugccgcuuauggagggagugugugcgcagaguauugcggacccaucggagcguaaccuggaucuccgcaggccuggcggaggccggccaccuggaggggcauugcuugguucgcgugguagcagaggagcuugaggcaaguagcaaggggugucaugcacagucauuugcagguuggugguucagucuuugagaacuauuuuuuuuuaaaucccaguuuuguuaauuaaaggaacaucucguuccgugaaaagauuuuguaaacaucaguuuuagugacuacacgguaaggaugugucaugauuuauuugaccguucaucaaauguugggccuuuuuuuuuuuuuuugagacguagucucgcucuguggcccaggcuggagugcaguggcgcgaucucggcucaccgcaagcuccgccucccggguucacgccauucuccugccucagccucccgaguagcugggacuacaggcgcccgccaccaugcccagcuaauuuuuuguauuuuuaguagagaugggguuucaccguguuagccagaauggucucgaucuccugaccucgugauccgcccgccucggccucccaaagugcugggauuacaggcgugagccaccgcgcccggcauguugggccuuuuaaguauccacauuuucacuauuaacaacaacgcugugcagaaccuucccuucaccugcuucccuugaagcaacuuuuuguugucuguuuuaccgggaagacaacugggugugucuugcucagugagcacaccuagaaagccaagaaccaaaacuuaaagccaaauauuucaacuucugauccuguacucuuuugcuucucuggcccccaacuucaaaaggggagccaacaccaggagagaugaagacucgaacuguggagucagaggggcugcaggguguaccaucucuggggaguggaagggaaccauuugacaguaaagugccaaccugcugcucugucacucuguuuacuuuaguacggcuuacagacagacauaacuacggugcagccgucacaaucaggaaauuaucacugauacauuucuaccauuuuauccucagacucgguucagauuuugccaguugucccaguaagguucuucauggcaaaaagaucuguucccaauugcaauuugcucugaguaaguccuguuucuuuaaucuccuuugaucuggaacaguuucucaagcuuugcuugauuuuucccaaucuugacacuuaggaaaaucacaggcuauuuuguagaacauccaucaauugugucuuuggcaggaaauaaucacagaagugaugcugugcuuuuuucacggcauacuuuagguggcaugugauuuccauucgucuuguuauuggugguauuaccuuugauuacucaauuaaggcgaugcuugccaagugucuucacuaaaaucacucuucuacuguaaugauuguuuugugaagagaucauuugaaacuauguaaauaucguguuucaauucauuuauuuauuuauaucuguacacucucggagucuuauuuaauucagugggauauaaucuguuacuguauuuuggugcucaaauuaccccucucacccccuaguuuggcuaguaggagcuccuucaggcuggcuucagugucuuuuuagagaugacuccauuaucuuugagcacuuuucuuguuuucuggcacaagauguucuaagcuugucuuggguuuuaccugccuugguccuggaauuggccauuaagcccuggcuccuuuugauggagugugguauuuagaaaucaaggucuagacucucuaaguguacuccuugccauugagggauuugcugcuccaaagcccagucauuagagccaaggaauauaaguauguauauacaugcauguguauguauauacauuaguauauacauauacacacauuuacaauuauauuucuauauauauguggaggcucaugaguucacacaggugcauccuuuucgaaucaaacgcaggaugcuuucuaguuuugucucugcucauauuuguaccucccuuuugggcaaagggaaaccugguucucaucauucuuaauguauuuagauauuacaucaaugccccauauguaaccaaucuucuguuucccccuuccuuggguggucuuucuccuuaccuuguuugggcucuggaacucucauuccagggagcuggccaguauccaaaggcaggcuuguagaaaacuuuucuucucuggcacuuugucucaacucuucccauuuucccagaaguuuaucauuuggaaaaauucaaaaugcaagcagauuuccucgaaaguguucucuggagcaucguuuauaauaagggauacuaaaaaccuaauguuaaucuaauaaauaaagcuauuaaauuauagacugcaaaugcauuaaugacaagagaaaauguugauuuuaaaagugaaaacagauuaugaaauuauauauuuaguaucaucugaauuauuaaagacaaaaaagggagaguagaaaagaaagccaaaauguuagcuuuuuuuuccauuuacuguuuuuaaaaaguuuucuaugguuuuuaaaaaguuuucaaauuuuuaccacagcaggcaugauuuuucuauagcuuuaagaguuuauacauuguaguggcuguuaauagccagacagacuuaguugugaaccauagcuuuggcauauaccagcggugugacuuugaaaaagcuacucaaccucucugagccucaggugcuaucuccauaaaauaaaaagaaaaauaauaauuuuccuaugcccuuauagaguuguugugaggauuaaauaaugaaaagguaaugcauauaaacauuacuuacaauaccaggagcauaaguucucaauagaugucuauuaaauauucuuuuauuaguaucauuauuaaaguucacauaguuauaguaaugcccuuagaggaguuccuccauuguaguaaacugcuggugagacaaaaacaugaaaacucuauccaaaucauacgugcuguuuauuuguguuuuccaaguuaucuaguggacauggguacuuuuauagccauaaagaaaguugauuuaacuuuucuauuagaaauauuuuaaaguccgccaggcaugguggcucaugccuauaaucccagcacuuuggaaagccgaggcaggcaaaucacuugaggucaggaguuagagaacagccuggccaacauggugaaaccccgucuccacuaaaaaaauauaaauauuuaaaaauaucaaauauauaaauaaaaauauuaaaguacaaaaguuggcugggcauguuagugcaaaccuauaaucgcagcuacuuggguagcugagguaccagaaucgcuugaaccagggagauggaguuugcuugagcugagauugcaccacuucacuccagccugggugauaaagagugagacugugucucaaaaaaaaaaaauuuuuuuaaaguccaccaaaagcuuuauaaaacagcuugccauuuguaacuucuuugaacaguggaauguggugucagcugucuuaacugugcuuugagaacauuucauauugaggcuuguuaugucacuacuucuagugugaauuaggaaggaaaauucagcaguugcuuuucaguggaugccucauaaacucucaggaccagacuuuuaauacuuguucaggaguaagaaaccugaggccuaaaagcuugcugaggguuauucugcugguuuguggcagaguugccacuaagaccuaaaucuguuuuuuguuuuguuugguuuuuuuuuuuuuugagacagagucucgccugucgcccaggcuggauugcaguggcccgaucuuggcucagugcaaccuccaccuuccuaguucaagugauuguccugccucagccuccugaguaguugggacuacaggcgcaugcagccauacccgguuacuuuuuguauuuuuaguagagaugggguuucaccauguuggacaggcuggucucacccuggccucaggcaauccacccaccguggccucccaaagugcugauauuacaggcgugagccacugugccuugcccguaaaucucuuuuucugucuccuuuacucacuauaccaggcaucacagauucagaugacucgaaggucaggcagguagcugaagagggucagguagcucaauagucguagcaccauggcagucuggaaaggcuugccuccguuuagccuuaguuaagaggcacguagucuaaguguugccaaaauguccaguuuuuaaaaagaaucuggaaauccacauuuuauguaaaaauucgguggaauuuugaacauuggcauucaguuuacauuuucugaaaaugcuguguggaccaaggaaacuauauccguaggucuugggcagcccugggccccacaggccaucaugcuaucugucucuuuuauuaguuuaucuauguagaauguauucugaaacaucuuggcauucccucaaauuauaauggaccaacuuuuuuuuuccauuuaacuaacaaugaggcuuugcuauauccuaaguacuucauuuuauucugguaguaaaaaauauuugaaaauagcuagcuuggaaaaauauaucauccuuuucauuuaauucagcugcuuugccgcuugucuucaauuggaaaguuuaguugaaaacaggugagucugaauaagcccagcucauaggggagauaggggacaaauaagauuaacuagggguaagggauguugcaucugagguccagaguacugagggaguuuaggaaaagguuuuggagaggagguggcacuuaaggugucucuagagggaaacagucuuaaguuccacaagaacagagcaauagaacauauggggaagucggugugucuggauaauauuaauaguaagcuaaggggcccugaaggaagccuugcuggcaagccuggaaauggaggcuuggaguauuugauuugauaagcagugaaaagggagugauacagccuguauaccuuccccagugcugagauuuuucugauacugugaugccuguucaaauaaagcaagugcaucuuuugcugguacuugauguuuuuguucuaagagcuucaguuaucauuaugaaaaugaacuuuuugagggcuggaaugaagaaauuauagguguuuaguaaaugaacugaaaaugaaagagcaugagugaaaaguaaaugagaaguagauugacucagaaugccaacauugaccugaaagaagguaggguaccagcaguuuggauggggugauacuuuuuuuuuuuuuuaaauuucugcgauacaugugcagaacaugcagguuuguuacauagguauacacgugccauggugguuugcugcacccaucaacccgucaucuacauuagguauuucuccuaaugcuaucccuucccuaaucucccacucccugacaggcccuggugugugauguucccuucccuguguccauguguuuucauuguucaacucccacuuaugaaugagaacaugcagcauuugguuuucuguuccuguguuaguuugcugaaaaugaugguuuccagcuucauccaugucccugcaaaggacaugagugcauccuuuuucuauggcugcauaguguuccaugguguaucugugccacauuuucuucauccagucuaucacugaugggcauuugaguugguuucaagucuuugcuauugugaauagugcugcaguaaacaugcauaugcaugugucuuuauaguagaaugauuuauaauccuuuggguauauacccaguaaugggauugcugggccaaaugguauuucucuuucuagauccuugaggaaucaccacacugucuuccacaaugguugaacuaauuugcacuccuacaaacagugugaaaguguuccuguuucuccacauccucuccagcaucuguuguuuccugaccuuuuaaugaucgccacucuaacuggcaugagaugguaucucauuuugguuuugauuugcauuucucuaaugacuaguaaugaugagcuucuuuucguauguuuguuggccacauaaaugucuucuuuugagaagugucuguucauaucccucgcccacuuuuugaugggguuguuuuuuucuucaaauuuauuuaaguuccuuguagauucuggauauuagcccuuugucagauggauagguugcaaaaauuuucucccauucuguagguugccuguucacucugaugauaguuucuuuugcuguguagaagcucuuuaguuuaauuagcuccuauuugucaauuuuggcuuuuguugccauugcuuuugguguuuuagucaugaagucuuugcccaugccuauguccugaaugguauugccuagauguucuucuaguguuuuuaugguuuuaggucuuacauuuaagucuuuaauccaucuugaguuaauuuuuguauaagguguaaggaagggguccaguuuuaguuuucugcauaugacuagccaguuuucugaacaccauuuauuaaauagugaaucauauucccauugcuuguuuuugucagaguugucaaagaucagaucguuguagaugugugguguuauuucugagcccucuguucuguuccauuggucuguauaucuguuuugguaccaguaccaugcuguuuugguuacuguagccuuguaguauaguuugaagucagguagcaugaugccuccagcuuuuuucuuuuugguuaggauuguccuggcuauacaggcucuuuauugguuccauaugaaauuuaaaguaguuuuuucucacucugugaagaaagucagugguagcuugauggggauagcauugaaucucuaaauuacuuugggcaauaugggcauuuucacgauaucgauucuuccuauccuugagcauggaauguuuuuccauuuguuuguguccucucuuauuuccuugagcagugguauguaguacuccuugaagagguccuucacaucccuuguaaguuguauucuuagguauuuuauucucuuaguagcaauugugaaugggaguucacucaugauuuggcuuucuguuugucuguuauugguguuuagaaaugcuugugauuucugcacauugauuuuguauccugagacuuugcugaaguugcuuaucagcuuaaggagauuuugggcugagaugacuggguuuucuaaauauacaaucaugucaucugcaaacagagacaauuugaauuccucucuuccuauuugaauaugcuuuauucuuucucuugcuugauuggccuggccagaaccuccaauacuauguugaauaggaauggugagagagggcaucuuugucuugugccaguuuucaaagagaaugcuuccagcuuuugcccaucuaguaugauacuggcuguggguuugucauaaauagcucuuauuauuuugagauacguuccaucaauaccuaguuuauugagaguuuuuagcaugaagggguguugaauuuuaucaaaggccuuuucugcaucuauugagauacucgugguuuuugucaucgguucuguuuauaugauguauauguuuauaugacguguauugauuugcauauguugaaccagccuugcaucccaggggugaagccgacuugauugugguagauaagcuuuuugaugugcugcuggauucggucugccaguauuuuauugaggauuuucauaucgauauucagggauauuggccugaaauuuucuuuuuuuauugugucucugccagguuuugguaucagaaugaugcuggucucauaaaaugaguuagggacgagucccucuuuuucuguuguuuggaauaguuucagaaggaaugguauuaguuccucuuuguaccuuugguagaauucggcugugaauucgucugguccugggcuuuuuuugguugguaggcuauuaauuacugccucaauuucagaacuuguuauuggucuauucagggauucgacuucuuccugguuuaguguuggaaggggguauguguccaggaauuuauccauuucuucuagauuuucuaguuuauuugcauagagguguuuaugguauucucugaugguagucuguauuucugugggaucaguggugauauccccuuuaucauuuuuauuguguguguuugauucuuuccucuuuucuuuuuuguuagucuggcuagcagucuauuuuguuaaucuuuucaaaaaaccagcuccuggauucauugaguuuuugaaggauuuuucuugucucuaucuccuucaguucuggucugaucuuaguuauuucuugccuucugcuagcuuuugaauuuguuugcucuugcuucucuaguucuuuuaauugugauguuagggugucaauuuuagaucuuuccugcuuucuccugugugcauuuagugcuauaaauuucccuguaaacacugcuuuagcugugucccagagauucugguacauuguguccuuguucucauugguuucaaagaaccucuuuauuucugccuuuauuuuguuauuugcccaguagucauucaguagcagguuguucaguuuccauguaguugugugguuuugagugaguuucuuaauccugaguucuaauuugauugcacuauggacugggugauacuucaagggacuaugcagaagcacugauggauucaugggauccaauuccaauuuuuuuuuuuucuuugcagaauguucgcaucuuaccacauacaguucuuuacauggcugauucagaaacuuucauuagucuggaagagugucguggccauaagagagguaaauaucaaaagaaaagcuuuugcuucuguuuuuuuaucaugugccuuccguucggaguucaauauuauacuuguccugagaguuaacugacuuucugaggcucugggacugccaccuguaguaugcaucaauauaucuaucuuugaaccuugaggaacccuuucugcuucagauugauuucuaaaccuuguagugcaauugaaacaaauucguuagaaagguguuguucucaauuugagaugcuuuaauucuccaggcacuuuuuauuauuaaaacagguuguaugacuuggcuauucaggccuuuuacuguauuggaacaugaggucccauuuacuaaaguuauguagagaaauggugcauuuuuggcuugcugagggaaaaggcagaauggguauccaagaugcgcacacucaggucccaaguuagacuuagauaauggauucucauugucuaauuugauccaggugacuguugaugcaaauaguaguuauacugcaauaucagcugaacagaaagguacaauagcaagucuaaaauucagcuguuacugcuaaauuugacaucacuggggcaaaagcaauauaugaacagaggggaaaggcagacuaguggugcaaaagaucagauuuauaauuuaaaagccaggaccaaaacagguaaaguguuuguuuuaaucaaugcuuuuagaccuuuauuuagagcauucucguguuaaaugacuuaaauauuuccaguauuugcuuuuuuacuuuuucauucucagauuugacuuuaaauggaugauauuuaucauuuugcuacuguauuuuuacagcaaggaaaagaacuaguauggaaacagcacuugcccuugagaagcuauuccccaaacaaugccaaguccuugggauugugaccccaggaauuguaggugagauaaauuagcaacuugaugauuucuuccuugcauuaaugugggguccuuuggauuggugaguuauuuuuagcuuagaaccacauuucuauuucuguccaucuaaaauacaauaaagucagucauauuuaccauggcauuauauuugccuuauauuaauguuuauuaaguuauuguacuucucaucucaagguuaccuguauaaauauccaguagucauucauaagaggggaaugaucucauucugccuuccuccaaauuaggaaguauuugugggcauuuucagaguuuugucaguucaagcaguauuguguuugguggguaggggugagauggggcugggauuaggagcaaagcugggccuuacuaggagacuucuguuucucugcuuugguaccacucuucaauguuuacagcaugagguugugccccuuuccaugcuugauugcugcuggugaauuuuugcugguuuuuauuauuuuugauucuuuucuguaguuaacugggggaggagagauucuguugaggcaguaauggugcaaugguuagauaccuggauucgaaugccggcuguaccgcuuaguaucuguaugacuuugagcaaguuaccuaacuucauggggcuucacuguccucaucaaggaaguggggaugaugacaguaguaccuuccuuggaggguugugagaauuaaaugaguuaacacuuguaaagcauuuacaauagagauacacaaagcaguaaguaaauguuagcugucauuuauguauuguuuuugagauggaguuucacucuugucaccaagguuggagugcaauggcgugaucucuacucacugcgacuucugccuccuggauucaagcaauucuccugccucagccucccaaguagcugggaucacaggcgcccgccaccaccacaccuggcuaauuuuuguauuuuuaguagaaaccggguuucaccauguuggccaggcuggucucaaauuccugaccucaggugauccaccgccucagccucccaaagugcugggauuacaggcaugagccacugcaccuggcugcuguuauguuuuuuuguuccaacucaguaguacucuacugagaauugucauuuuuaaucuucacugaaagauuuuugaucugaauuugagucuuauacagugagguaaaaagaauuuuacauguuuacaaaugaauauuauuuguucaguugcucuagcugugguuucuaaagggcuuaacauuuuuuuaaaaaaaagaguuuauuucuuuuuggccuggcgugguggcugacaccuguaaucccagcacuuuaggaggccgaggcaggcggaucacuugaagucaggaguuggagaccagccuggccaacauggcaaaaccccaucucuacuaaaaaauguaaaaauuggccaggcgcaguggcucacgucuguggucccagcacuuugggaggccgagguggguggaucaugaggucaggaguucaagagcagccuggccgacguggugaaaccccaucucuacuaaaaauacaaaaauuagccaggcaugauggcgggcaccuguaaucccagcugcucaggaggcuaaggcaggagaauugcuugagcccgggaggcagagguugcagugagccgagaucacgccauugcacuccauccuggaugauagagcaagacucugucucaaaaaaaaaaaaaaagcuaaaauuagcugggcaugguggcucaugccuguaauuccagcuacuugggaggcugaggcaggagaauugcuggaaaccgggaggcagagguugcaccacuucgcuccagccugggugacagaguaagacucugucuccaaaaaaaaaaaaaaaaaaaaaaaaguuuauuucuuuuuuuauacuaguaauaguuauuuuuagaaaaaaaaaauuagaagauucagauaagcaaaagcaccuuuaagcaccacagaguuaaccacucuuaugauguuaaccucuauuuauauauguauguaaauauaaaaaaccagaauacaauuuucuguagacuuguaaccuacuguguuagucuacuagggcuaccauaacaaaauaccacagacugggugacuuaaacaacggaagcuuauuuucucacaguuugggaggcuagaaguccaagaucggggauggucucucugaagcuuacuuacagcugcucucucacuguguucucauguggccuuuucuucauacauaagcaugcuuggugucucuuccuccucuucucaggacacuaguccuguuggauuaggguccuacccuugugaccucauuuaaucuuaacuaucucuuuaaaggccuuaucuccaaauauagucacaugggggguuagggcuuaaacaugaauuugggguaggcaguagggagggaaugacacaguucaaucuguaauaucuaccuguaaaauucagagcauauuacaaacauauuuccaugucuauaaauauauauuugucaucauuuuaauggcuauauucuaugauaccaauguaacuuuuaaucugaauaccagugugggacauucagguuuuuucuuuuuauuuucuauuugaaauuaugugauaaaauacuuggguauauauauacuuuauauaauugucaaauauuuuuaggguaaacuuuuaaaaauuggaauugcugugaaaguguauuuacuacccccccaacuuuuuaauuugaaaaauauggagaaguugaaagaauaauagaacagcaugauaaauacccauauacccuuuaucuaguuuagcaguugaaaaaauuuugcaacauuuauuuuuucucacuuugcuuauaaaaaauuucuuucugaaccauuugaaaguuaaauggcaaacaucaugacacuacacccuaaaacugucaaagcugaaaaacuuuuacucagauaguggcuuguuagcuuaaugauuaucuuagugaccuaaacuguaguuaucuaguuuuuacugacucuauuggugaaacuguuuaacuuuuucucuagugacuccaaugggaucagguagcaaucgaccucaggaaauagaaauuggagaaucugguuuugcuuuauuauucccucaaauugaaggaauaaaaauacaacccuuucauuuuauuaaggauccaaagaauuuaacauuagaaagacaucaacucacugaaguagguaaguuacuuuuauuuaucauuaacugcucauuuuauugauuaauuuuguuuucuuuuuaauucuggcuaguugguggauauuagguuccuuugggagaaucugaauuaaguacaccugucacuggagauguggcuaauucaaacaggugauucacagaggccagugugauacauguuugguagaauugauuuacuuuuuaaauuauuuuacuugcauuaaagcccaagagaaccagagaugaaaaauuuuucauaaauacucuguugaugauaaacuuguuuguauuuaguucugaauuuuaaggaauucuugcucuaauaguuuauuucauuuugcucuauuuuuguuuuguuaaccuuuuuuauucuaguaacaagcauuuuagaaguuuuuagaauacgcggguuaguucuuugugaacuaauuagaaagaugggaacaaguaaagugacccugaugagucuuaggaaauauaugaguuaaggcaagucuaucaagcaaggggugugcugggaaacauccugcagguaguguggauggagcccugaagugaauuugaagagguaaaggguuggcuuaaugucuaagcuuggaugggaaagcuuaacuuaauauaguaaacaacaaacgaauuacucaaggaaagcagcguuuagccuuuuaucuacaucugcagauggacugauugaauucacuucauucauuaaaaaucacuguuggcauaaaaacuauucagugguaacaccucauuuuugcauagaucagccagccuauagagauaaaccucuguuauuugaaaugggacuuaaaccagcuggaguaaaaaauuguguagcagcaaagguaaaauuuguuuuacugaugaggaaaaaaaggggguauacacauugagacuaguuuuuacaacuaucccugacaauguggaaaaaaaaaaaaaacuugcaagucauugguggaugggaggggaagcacagaacaagaggcauuagcagcaaagacucagccgggaaccucuuaauaauguggaagaggguggucaggucaaaguagaugguggaaagucucaacagccagcucuggugugacacaggguaguguagcuauuaagaaugcugacuuagaaaugaaaucaguauguugaagagauaucugcacucccauguuuauugcagcacuguucacaauagcuaggauauggaauuaaccuaaguguccauuagcugaugguggauaaagaaaaugugguauacauacauaaugaaauacucuucagccauaaaggacauccugucauuugcaccagcauggaugaaccuggaggauguuaagugaaauaagccaggcccagaaagacaaauagugcaugaucucacucauguguggaaucuaaaaauguugcucucauagaaauauagaguugaauggcaggcaccaggaucuggggugguugggaggggcuuuggggagaugauggucaaaagauacaaaauucguuuuggaggaauaaguucuugaggucuguuguacaacauggagacuauagucagugaccauauauucuuuuuuuuguuuguuuuggagacagagucucacuuuguugcccaggcuggagugcgguggcaugaucucagcucacugcuacuucuacuuccuggguucaaggguucaagugauugucaugccucagacucccgaguagcugggacuacaugcuguaugcaccaccaugccuggcuaauuuuuuuugucuuuuuauuagagauaggguuuuaccauguuagccaggguggucucaaacuccuggccucaagugauccaccugccucggccucccaaagugcugggauuacaggugugagccaucgugccuggcccauauacuauauucuugaagaaugcuaagagagugacuguuaaguguucuuacuacaaaaaugguaacugugagauaaugcauaugugaauuagacuuagcccuuccacaauguauauauacuucaaaacauguuauacauugauaaauacauacaauuuuaucugucaguuaaaaaauaaauagaagguagucaaccuuaaaagauugcaggcuuguagcuacucuaguucugcuacuuucuggcucuccaguuagggcaaguuuuucaauuuuucuaaaccuccauuuuccucaucuauaaaguggaaauaacuaacauugaauucacagaauugugaagauuaaaugaaaugacuuucauaaaacgcuuagcaacaguagauuguagcuagaugcuaguguuggccuccacccuaggcaggcuuuacugugugucacaugggcccuucaucugcaguguggccuuguaguuuguggggggaauaguaggguucuaaguguccuuagcucauucagaagccacaugccagaggagcauacaugugucugggcuugaagugacaauuaacgauggccaauguuuauggagguacuguaugccagauacugugcugcgcagcacuucuaaucuucaccacagcuuugccagacagaauucuuuauggaauauuuuugaugaggaaacugaacuuuaauggcaguagagaguuaaggcucuuaggguauguaaauagcagaguuagcagaaauguuaaagcuauucuaaauuaaggaugccaaacuuccuuugggaaaaggucagauagugcccuuaaaacugacccauuguuaaguguaaaggcaaaaugaauuuuaggagcaaauguggcuaugugcugagcuuaugugauuuuguaauaacauaaugagacuugauauugguaggcuagcuggagcgaacaaaguucagcaaacuaggucuuuuucagaguuggucaggugguuagcaaauaguaggucugaaacucaaaggaauggcuguggucagacauguugguuugagaaccauuuuguguguugccuggcagucugccuguaaaagcaucaagugucauugaaggccuuggaguaagccaguccagggcaacauagcccagauucugggaagauuuauggcagcaaauuuaguacaaggaaggaagaagaugaucaauguguugauguugacgagaugacuaucuauauucaauuggcucauaauguagaacuccuacauuaauuuuauucaggcugguaugguggcucaugccuguaauuucaguacuuugggaagcugaggcgggaggaucgcuugagcccaggaguucgagaccagccuggacaauauagugagaccucaccucuacaaaaaaacuaaaaaacuagccaagcaugguggcacgcaccuguagucccagcuacuuaggaggcugaggugggaggauugcuugagcccaagaggcggagguugccgugagcugaagucacgccacucuacugcagccugggugacagagugagacccugucucaaaaauaaauaaauaaauaaaaauuuauucagcauguuaaaggugacauaacuggauguagauucugucucagugacauuccagaaaagguaugaagaauacauauacagucauauguugcuuaaugacggggaugaguucugagaaaugcaucuuuaggcaauguuguuguugugugaaugucauaguacuuacacagaccuagauguuacagccuacuauauguguaggcuauacaguguagccuauugccccuagacuacaaacauggacagcauguuacuguacugaauacuguaggcaguuguaacacaaugguaaguauugguguaucugaacauaucuaaacauuaaaaagguacaguaaaaacaugguaugaaagacaguauaccucuauagggcacuuaacaugaaugggacuugcaagacuagaaguugguguggggugagucagugaguggugagugaaugugaaggccuagcccuguauacuacuauauaguuuauaaacacuguaugcuuaagcuacauuaaauuaauugaaacauuuuuguuuggccgggcacaguggcucaugccuguaaucccagcaguuugggagguccgagguagguggaucccuugcgaucaggaauuugagacaagccuggucaacauggugaaaccccaucucuacuaaaaauacaaaaauuagcugggcauaguggugugcgccuguagucccagcuacuguaggcugaggcaggagaaucgcuugaaccugggaggcagagguuguaguaagccaagauuacaccacugcacuccagccugggcgacagcgagacucuaucucaaaaaaauaaaauaaaauuguucuuuaauaauaaauuaacuuuagcuagacaaaaaaaauuuccauuuauauccuuauucuguaagcuuuucuccaccuuuaauuuuuuuuuuaacuuuuuaagcuuuuuguuaaaaacuaaaacacagucacacacauuagccuaggccuauacagagucaagauaauaucacugucuuccaccuccacaucucgucccacugcaaggucuucagggcaguaauacauguggagcugucauuuccuaugacaacagugccuccuucuggaauacguccugaaggaccugccugaggcuguuuuacaguuaacuuuuuuuuuuuuuuaauaaguaggagggguaaccucuaaaauuacaauuaaaaguauaggauaguaaaucauaagccaguaacauagucauucauugucauugccaaguaugcauuguacgugauuguaugugcuauacuuuuauacgacuggcacugcaauaggcuuguuuacaacagcaucaccacagacauuugaguaaugcguugugcuacacauuaggcaguaggaauuuuguagcucuguuaaucuucuggcaccacuguugcauaugcuuacugugcgugucaccacgccuggcuguccuugaccaaaguguuauguggugcuugacugcauaaucauaacccaagugaguaugugagguguucugugagagcagaauggguagauugcuguagggguucugccagugggagggaucaaggaggcuuccagaagcaggugguauuuaagcccuugaaggaugggaagcauaugagagauauggaugaguaauaucacuggcugaaggaacauagaaacacaggcacagagccaggaaaucccagagcauguuggagaaauaguaaucauuuugcaagcaaagguuaugugcagggaagucaugggaacaaaggguggggcgcauucaggccaggcuaaagagucugggcuuagcuccuguacacagaaaaugguagcuguuacucagaugucaucgagcagaggugaauguggcccuccuguguggggagacacuggaagcgggagaccacuuuagaguccaggcaagaaauaacacuagggcaugaggacuagggaaugaauuggaggaaaugaacaaaugauuagaugugaaagagaagggaagccucaguaauuacuuuugaguuuugauccuaggagacaagggugaugguggugcagagaccagaaauaggaacacugggacaggaggagcgggauugggagaagaaauugggaaaaaucaaaccccauuagagaugcuuguuuuggcuguugauucagugcugcugcuaaaggucauauggccaaaccuuuugugugcugccuuuuuuguccagagaggugacauagcuguuuccugggcaguacucuguccucuguccaccugagcauccugggaaucuuugaugaggcccugauauguggcacugguugaagcuaggacccuaguuuugucaguuuauaagagccaaaaucuugagcagcagaaacccuuuugugauaaaauugcuauauuuguuagaucauauuugcauuauagugccaaguauaggaaugagaaaacuggaaggaaaaacaaccccagaauuauugugcucugugaagcuuucuuauagguguccuuuccugagcugcuugaugucagcaguuuuggcuuauuccaaggcaucauuuucuucuggaaauugaagcuuugcccagcuuaaaauggccaucuucauucuuucacuugcuaucuuguguccuaauuuuagguagaguuggccuuccauauccauggguucugcauucauggauucagcuaaccacagaucaaaaauauuugagggaagugcagcaagaagccagguuucuaaacacaggaguggcauaauuugauagaucuuuucaaaauaacacucuugcuaugauguggugaucauuuuggaguacaagaguggaugcaggauuagcuugauuuagccauucaguaguguauauauauuucaaaacaccauguugaacaugauaaauauaugccuuuuaaauuuuucaguuaaaauaauuuuuuuuaaaaaguauaugcaggagacacagacuguuguagugguuaaggaaagaggagauggcagcuuggagcagggcaguggugaguggaguugaagagaagugaauggauucaagaugaaguuuggggcugaauggacaggauguggugacugaugagauguuagguguugagaaugagggaggugacagcgaugucaugcggguauguggcuagcgcagcuguauaguaccauugacuaaggugaagaagauuugaaggugcggguuggaagaucagauuaucaguucuguuuuggacauguuuggaauuugagauggagauauugauuauagacaguuggauauguuggccuggagcucuagagaauggucuagaggaaagauauuaauuugggaaucaucagguaauuaauggugauugaagcaaaagggacuggcuucagugauuugaggaggagggccggggaggaggcucaguagugcauguugauuguccaggguugguacugcuguaauauuauuuugacaucccucccuucugcuaaugcaaaggcuuuauugagacuacucaguaaggaucuccuugagccauuucuuagcuuuuguuuuaaacacuucauuuguacagucuuacaugggaugucaacauaaaaauaaagcagguaaaagcagagccucuagguugaagggugaagggagcauguuaggccuugaacugagguugcuuauucuccuccaccuacacuggaggcaucuuuggaacgcuuugcccaccaaagcacagucugaaagccccagcugcaacagaggaggggagagaagcuucccucccuggcagugcucaugcacuucuuccucuaaaccuucauguaauccagggaaggggcucuagacucagagcagugccuggcagcucuacagugccuggcagcucuaccugucuguaccacagacaggagagcuugagaaagcagaccuagcacugcugagcguuggcaagauggacuucagcuugagagccagagccucuuugcuccuuugagaaugcuugaggugguuaguuauauagcaaacaguugacucacaccugggauccucccucucuuuuccuuuuacaaauauccuucugacuuucuucuaggugaagcacaaaccuguaacauugccuuuuggggcacagugauuuucuggauuugaguuuuauuugcggagagucccauuagaaaagcuuuccuauugauuuuuacauuuuagggucaagagaggaaguucugaagaauucaguugccuuugcucuuugaaggagaggauuggaaguguccuguguuuuccauagcucaguaggcacaguucuuucuggcagccaguucugggguguguauuuaauuuuacuuuggucuggucugaucuagcuucuguaauauggauauaauuugcauguuaaaugugaauuuuggaaguauugaauccucacagacuuuuuaggaauaaaacaauacguaacagguuguuacaggcauuaaauaaguuaauuucuauaauguacuuagaacggugcucuguacuaguguuuguugugagauuggugaucuggugaucuagcuuguagauuguucagguucuuucugcucccugcuuuuugaaccuuuaacuacuugucuugaauucugccagccaccaagagggguaaaauagaacuuuaaugacuugucagauuccaaaaaagugugaagaagaacaaaguuuuaaaauuaucugaggacaucauagagagucuugaggggucauaggcaguaccaggugugaagcagagagaaucagugcugaagcucaagggauugaacuuguucugccuucgaaguugcccagcccuugagaaagcagaagugacaggaagcuaguguuaaaaaaaaaaaaaaaagcgaugcugacaucuauucaagacaaugaggcagacuuuauuugggagaccacugugaugggguuuugcacuaggggagagagaucaggcucaacuccaaaugcaccaaccacaaauggggauuuauagccaaggaggagggugggggcuugguggaugaaaaauuccuaagaggauggggcaauucuuugcuaaauuuaccuaacaagauuauuacuggcaagaacaguuucauccuauuccaaaaccaaagacaucucuugguggacaacuacaguaguuaacuugauuauaguugccaauccuacauggcaggucaguuuauccuguuaccuaagguuacauuuuguaaccagcuuaucaucuugaaagguucaccaguagguuacacuguuuaaagugccuuauaaauacuuuucuggaauuguuuuuaaugguugugguaagcuccugcuaauguaucaacuuuuggaaaauucuagaauaaaaucuguagucagauucuauggcggguggcccagaacauuggguccuugaugauccuuuaccuaugaauuggggggaacccagaaccuuucaggaaaacuuggcauugcuccuuauucuucccucauauuuuaggccuuugaauuuugagugucaaggaguuggaguuguaccuucccucuguuauuuaccgguagcaccagguagucuguugguuaaauacagagccaucugcucuaucaggcagccagccuuggcuaagguggguuuguucuuuaaguugggguaggggaaagugauucuacuuucuaggguuguguauuaggagggggaaguguuccauuagcugagaaccaacccacuagagaagauguugaaagaacaccacuggagaagaugguguuaacuggaaugugugacugaggcgagaaucuccaucauucgagguuuacugagccagagguugagggcguauccgggaaaaacacuagucacaaacgaguggcuguguacucugaagagguuuucaauacauguuuuuaaaggagagaaggaaggauggggaaggauaggcaugaggugaaugguuacauuccugugagacuuuaguuaguacucaguaaaucuacacuuuacauaagauaaggugaaccuuuugaagaaaggaagaaccauuuaugcagaugucucagaguaggugggugaauuacugaucucuuguuuuugugcagcaucugggaagauaagcuugcaauggacauuaucaguguggaauugaacagauuacagaccuagaguuacaauugacauguccuuguguuaugggaggauguacaucuuaaagguuuugaggccagcaaagauuuuccuuaugaaugauuugugggagcagucaucuggagaugccuaaagccuuuugccuuuccuggucggggggaggggugugaggcgguaggucuggcuaauguauaaugcucugacacaggguugugaaguagcaauauuaauuuggagagaggauggugcuucgcuugacucagccucuaggcuaaacuuucccuuuggcauaaggaguuuggagguccugagauuuuuuuaaaauuuuccuuuacauuggguauguguuuguuaaaugaaugggagugguugccuuuagaauauucagguaggauguuuaguggauguuguaaaagagcaucuagagcuuagaaaacaggaggaaagguugagauuuagaagucaugagguuucuaaaagcuaaagcccugagugucaggagauguggguuuuaauguagagucugucauuauauuguccugggguaguagucacuucucuggcauuggcaguccuuguuuguaaaauaaaacucuagacuugaucucacaggccucucccaacucugaaacuuuguucuaaagaagaaaauauauucucuuaaaauuucgugggcuagucuauaagggaaaaaagaugcuuuagcaaugguuugggguauaugaugucaugaaaguaauauucuuuuuacuguccaagucaguaauuuacuguguagagaauuggaaauggaccagaggcaguuucccagaauaggucauuauuugguguuaguaauuggucauucacgcaucugcauacccuuuguuuccuuaaguaacucuccuuucugguaaccaccuuagguuugucaagguggaagucauguggucaaaucaaauggaaacacaaguguguuagguauuagauucauuuuccuguccccaaagcacccguuugguaaugcuggcagaagacauacaugcggccaacaaucauaggaaaaaaagcuccacaucacugaucauuagagaaaugcaaaucaaaaccacaaugagaucguaucccauacuaggcagaauggcuauuaaaaagucaaaaaauaacagaugcuggcaaguuuguggagaaaaaggaacacuuauacacugucggugggaguguaaauuaguucagccauuguggaagauaguguggugauuccucaaagaccuaaagacagaaauaccauuugacccagcaguccuauuacuggguauauauucaaaggaauauaaauuauucuguuauaaagacacaugcacauguauguucauugcagcacuauucacaguagcaaagacauggaaucaaccugaaugcccaucagugauaaacuggauaaagaaaauguaguacauaugcagccauaaaaaagaaugagaucacguccuuugcagggacauggauggagcuggaggccauuaucauuagcaaacuaacacagaaacagaaaaccaaauacugcauguucucauuuauaagugggagcuaaaugaugagaauacaucgacgcaaagaggggcacaacagacacuggggccuaccagaggguggagggugugaggaaggagaggaucaggaaaaauaacuaauggagaaugggcuuauuaccugggugaugaaauaaucugcacaacaaacccccaugacacacguuugccuguggaacaaaccugaacauguaucccugaacuuaaaaaaaaaaucaaauugauagucuauaaacaagcugccagaggcuccagugaaaccugggagcugugggcagagcaaguaggcugucucuguuacacucugccaccuccuagcgguagcagcuuuuaguuccugugucacagaauugaacauuuuccugcuuugcaaggaacuuucaaaggcuaauucgccuuuacucucaccugcuuccguggaggaggugaauaaagccuguauuucagugauguaguaguuucuuaggcugcuguaacaaaguaccccaaauuuggugacauaaaacgagaaauuuauucugcacaguucaggaggccagaagucugaaauugagauggcaguagggguagugcuaccuugggaggcuguaggggagagucuguucuuuuucucuuccuaccgcuccaguuucugcuucuguggucacacugccuuuucuucucugucucuccuuuguacaucuuucauuaugaggacacugucauuggauuuagagcccacguggauagaccagaugauuuaaucuuaagauccuuacuaacauagcgagaccccaucucuaccaaaaaaaaaaaaauuuuuuuuaaagauccuuuuuccaaauaagcuuacaugcauagguuccagagguuugauguggauauaccuuuggcaugggcagggggcacuguucaccacacuauaagugguuagcgccuuuucucuccuuuaaaaaauaaaaaaucuguaaauucucacugcugcuagcacagcucuguguaaaccaguguuuuuuuuuuuuuguucccuacugagagccagcuugcaccuuggucuaccaagaguugcugcucaguacauagcugcuucauuauuuguguugauugcauuauuuauuaacacaaauagccauuuaguuuuuuuaauagaaaaaauaauuaagauuuugcauaauguuuguaaaaaauggaaaacuugauacagagaucgaagaggauauaaaauaagauaaaaaauaaaaaauggaaaauuugauagcuuaagccacuaaauugcccuuaagguggagugcaagucaguaacauuucauuuugcagcauguauaaaauaauuucuguuuuaaggcugucuuuaacuguugcucuucauuucucugcaggucuuuuagauaacccugaacuucgugugguccuugucuuugguuauaauugcuguaaggugggagccaguaauuaucugcagcaaguagucagcacuuucagugauaugaauaucaucuuggcuggaggccagguggacaaccugucaucacugacuucugaaaaguaugucuugugugcuucugauuucgucugugaaugaagggaaauggucucagguuuugucacuuugggguuaacaauuuaaaaaacguguuuaaagaauuauuaagauaauaguucauuccauuuuguaguagacauuggcuaaggggcuuacugaacauaauucugcuuacgguugaauaauuacauuuuuauauauauuguccuucaagaacuuccuugagucacauucuccuuaaaauuugacauugccuguugaucuuuccuuugacagaugugguacucugugugaccucaaugugucaccuccuuucuaguuuccuccuuuaaaggaaacacaugguuagaguguaucuuuauggcaaaacuucucagagcuucuaauaugcccagugcuguggaaaucuggaaggagaauagcauuaccugugacaguucccaaauguguuuggucacaaaacuuuuuuccacagaaugucuugcaagucguacugguuuuuggaaauucuguauuagaucuuuugaaaggcuuuuucaagcuuaaaaauuguggaucuuuuuuguuacuaaggcuuuugcuuucaaagauaaaaauauuugcucuucugucuugggagccauuacuuccuuuccaucuugaaugaaaauacauaucauuuugaguuugaaacaauuagguggacauaaauaucauuuguuuccagcaggaaaaucagacccuaccccacccucaaugcuuguaaacacuacuauuuguuucccacucuguuuaauauuugcauccuagaguggugacauggggacagacuguugcagau

SEQ ID NO: 192055 - RNA, 311949 nt, Homo sapiens
uguuuuuuaguguguauuaaaaugaauuuauuuacacaguaacaugaugccacggaguacacagcaaaguaccacagcaaaccaaaggguggcaccacugcuggcagagaggaccuuucaaugauagauuuauacaacuuuacaauauguaaguagaggggugaagcuccggaaagagcaaaaacaagauuuucaaauacagagugugggcagggccagagagaauuaaagagagauuggaaugaggacugucaugauucaaaucaccaaguagaaugaaaucuugcuucuguauuugccucaugccaaaaugcccugcauauccucaacagaaaaucccaacccaguguguucauacaucacacucuuuaguucuaacugguaaaggaagggauaaccaaguaguauuuggagcaaguuccugaaacagugugguuuaaccuuucaaaaaugaacccuaugucugguucaacauucaaguuaucaugagugcggacacacacauacuauccacacacuaacgggcaaaguggguuuucuguacuacaacaauauucguagcaaaauauaugacucuguacuucugcuagguuaaaaaauguccgaccucuuuugauucccugaaacuuucuugauuuaaaaaacaaaaccaaaccaaaccaaaccaugggggugaaugggacacgucaagauaaaaagcuggaauaaacccagagacuuucuggagugggaaacauguaaugggauguugggaaugcaggcccuugcagcccaccuagguggggaaagcuucuagcagugguugaugcaaaaaucuauucuaauuuuaaacaguugcagggaggggguguuuaacggcuguauagcaccuuguaccuucugggcacuuacagauauuaaaugauggugaugaugaaugguacacaacucuguaggaagguuuauaaaaacaauuacaauuuguuaagaaauuucccaagaguucuuuaaacaaaccuauuuaaacuaccauaucucuuuaaaaaaaucuuccgcucucaguauuauaugauguucucaagcugagguuugggcaauagccacagucaugucaaggggacauggaagagauccuucuccuuaaauacugaggaacuuuguaucugccagggcuuucuucaucuucaucaucaucaucaucuucuaauauacaaaauggacuucuuuuuaaaaaggugcuuuucugaggauggauuuaucagcuaaaugccuugacauggaauguaugugaacuccccucccacagcaucugucacagcucacccucaucaucuuagaagcaucaggauaaaaaggcuugauuucuuugguauaaucucucccaggaucuugcacugcaacucuucuggcuucccuuauggcaccguuuuugguccauggaauccccacuuuuggcacugcuguaagcacggacagcuggacuucagugcgcacuucagcaagagcagcacuuggauuugucucggcacagcacuuugggccuuugagaauaugagcuucgaugacauaaagcuaauaacuugguuuugugggcagccauccuguucacucauuaggcuggagcggaauuuucaauccuugucaacuagugaggagaaugaaaaacaugccaggguuggcccagcaaguccaguuugucucaccccucuccaagaauguucauacuauauuuacacaucuagaaucauuugaaauauaguguaguauccuaaauccaucucuauuucugugacuagccuguacuuuuucagaucacugcugguaaaaucuagaagaaauccuaauugcagucaaaucuagcgaaaacccuaauuccagcaaaaccaaaugucagguuacuucccugaaccaaaguauucauaacucaaaauugagacgcuuaguaggacccaaagaucuuuccuggaaacuuuuuuuugagacgaaguugcucaaucucccaggcuggagugcgauggcgugaucuuggcucacugcaaccuuugccuccuggguucaagagauucucuugccucagccucccgaguagcuuagauuacaggugccugccaucaugcccggcuaauuuuuguauuuuuaguagagauggaguuucaccauguuggccaggcuggucucaaacuccugaccucaggugaucugcccaccucgcccuccuaaaguguugggauuacaggcgugagccacugcgccuggccugggaacuucauacuacuagaaacuuuuaagauauaauuuuuaguaguuuuacucccagaaaugucauuaauauuucuagagcuuuagaucucuuggcuuagacuuucccauguuuacaaacuuauucugaguuuggaagcaaaagugacccccacuuaaucugauaaugggaggcuacuccaacuguuaaaauccuaaccaauauguuuuacuucuagcuccucaacagcagcaggguagguaggaugagugcuugugcccucaccucaacccauaccucacccaguucaucuucugagggcaaaucuugaaacucauugccauauuccuggcuuccaguucuagcucagccuagggguuggugauucuuacguuguuguuccacagguuacagugacucuuuuucucauccugcuguuauucuucaugaauuggcuucuaggcaacccaguaguguacauauaccaaaagggcucaccucagccagcacaggaggcuucuugaaguucuaguccucuuuaugaaacauccacugaauugcuuccaagacuagguuaccacucuaacaaggcacucugcuauacauucagucuugcucuuggcuacuuuagccacuguuguguuucucuagcacccaagugucacagagauuguucaugcucauguggcuuaaggaaaaguuccaauaggagcuuaauuguucaaacucucaauauaaauggaaaacucuacaguauagacuucaauagaaaacaauuuccaaucaauauugaaggcaauaacuuccuguuacuugagaaaauguaaagugcuauacuagucacaauucaaacacauagauauauaaauguguguguaugugucuacagaggguaggauuucuuuccaguugaugaacaaauucaaagguccuaccacaauuaaaaugaaaaauauuugugauaauguuaaacugacugaauuucauuuuuuuggaaaaauauucugaagaccaacucauguaguacuuuuugccuagaaauauaguuucuuucucuauucugcucuaaccuguaacacccccuucccucucuaucucacauucuuuggccaucacccagagaaaaauuaaucuagccaccugucucugggaagccugaggcuuuucucuggcuaguuugcauucaucuuuugcccuuaacaaaucugaauauaaaaacaguacuaaaaacaucugauaugaagaggugcuugguuuaccagugcuguaagauaaugguaguggagguguccaugcuuauuauaccauagaguuaaagugaagacuggauccaaaucauaacagaaaaagagaaagaaaaaaaaagauaaguagagacauaacaaauagagggaccaggaaacauucagcauuaaauauguaaccucauuaaauagucaacauugaaauuuacaugggcaaggcaccacgaacaugacauugagaagguauaucucaauaugcaagacauugcaagaugggaggugggggagguuaagggaaugugcuggcugacauggucaguggucugugugcugcccuucagugcauaaucaggcaaggaguuaugugcacauguucuaugcuaagaugaaccaaacaccaaccuucaaggcaaggcgcggccaugccacaggacaccaagagcagacugcuggccugcagcagcaugcccacuccauggccauuccuaggagcagagcccugcacucuggcuagaggaggcaagacucuuugugggcuaaccagccuucuuuccugugaguccuauauugcuggccaggggauaagggacauucuccaaauagagccucacauauuacaaucacuuaaaaaaguaauaagagcacaauaaaauacauuauuuuccuuuccugauccucuuuguuauacaugaaucacaugaaaagcuguuaaaaauguuaaaaguuuagaaauuuccaaggccacuaaugugcuauguaaguaauacugcacagucagucuuggcuuuaaggaaacucugcacugguagaugaggggccucagggcucacucacucacuaggcacagagaacaugucugucaacccugccacagguugcuuuucuagaggccuggccucuacuuccagcaugcgugugcacgcacacaugggcacacaaguguacacacacauuguucgagugacucuugggauuucaaggucaaaguaaacacauacucacaguuuugaauaaaacaagcacaggugaacauguguauacauacacacacacacacacacacacacacacacacacacacacacacaaccccaguggaaggaacgcucaucucuuagcgcaaauaugugccaagggaagaagggggaggguuucuguagacucgcuucaggugaaguugcaacauaaacacuguaauauacagcuaaaaaaauacauacaaaaauugcacacauauccauagaaggggagcacaggcugcacacauggugaacagcucucaaucacccaccucagcaaucagaauuccugugagcuguccuccagagccauuuuacagagucagaaggagcaaugagccacuuaaacacugggaggcagucucucuagaagaggucaaccuucugaggaggucagcagucucaucaguggccuucuuccucuccccugccuacggccaucccaacagcccaccucacugugcccucuaaaggagaucuuagagcuccacugacagcuauuucauucagggcaauuguuuacagcauuugguaaacuaguuaacacuggcuacugauagaagggagcuggccaauuacugcucggggaaaacugcaaaugcugacaguucugacaguaaucaaaggguacuuuaaacucuguuuccugauggccccuagagaauugcacaugcaagaaaaucaucuccucaugcccugccagcuauuuauaagcucugaacugcacuccacccugcugaggcauuggugacaccaccuugggucagcucuguaaugggccacaaguggcugauaaauccaaacuucacuggcaaguggggacagaguggagaaucaggcaguggcagcagaggggagacuauuagggcuguccuccaugcagugcacauacuuacagauaauggcaaugaaaaugggucuaugacccaaggaugggaucucuccuuuucuuucuacucucuccuggaacaaaagauauagucccugguaaccaaaacugggcugaugcuaaggauggcaguccugccuaguaagucaguuguugacaccuuaaaggaagagucuguugucagagucuacugggucgugguagagacugguuaagucugucuacugcuagugagaauaaauacuuggugcuaaaaagauaggugauauccagaauuauggaggaaauggacacagcucacuggcugaguucauaccaaagaagcugucccuucaagaauauggauuuucauuuuuaccugcauuuaugggacuauuaggauagaagguguuucaagggaaggcaacugcaaguuugugcagcugaauuucuguaaaguuaagacagacucagcuucucauucaaucuggggcaguggauaaccuuucugaauagacccacuuguucacggacagggauagagguuugccuuucuucuuuccuugaauuuggagugagcacuagggaggggaagugcaugggugacaugaagaaggugaagauguaguaaaagcaucauccagguacacauuaacggugcugcagaauuuucacaauacaacugagggagucuguaguggcaaaagccaaauacugagcacaaagccaguccucaaggcugauuccaccuucccuguccagggacuucucagcaaacuugaucaugagcaguguucgcuugaugucuagccaguuuuggagcaggguguuccucuguacuaggcuagggcaggcggugaaagucuggaagagaucuucgcgggggccccagagcagacacuggaggaugccuuuggcgucugaaaugaggauccgcucagaaggguugggauucaggaggcagcuggccagcugcugcagaccccgggaguagggggagcggaaugggaugcgaggcaggucugcucguguguauucccucuccuucagcucuggguucucaucaaagggguuggguaggugcagcaucucauagaugaggaugccugucuggaacucaucacacuuuuuauacuggguagcuguuaugaucucuggggcaaggcgagacuggucccggaggaucucgggguccaccagauggcucuucugcuuggccugagagaaguugcucacuauaagccuagugggauaagaugagguggggcugggcucugcaggcccaaagccuugggcaguccccccaggcugguaguggacaaguagcagguucucuaggcguagaucgcagugagugacaugguaggguuugaggugcucaagaccagagcauagcuguaagagcagcagacacaccugccucucauacaaaucagggcuuuucccaugcugggccagagagucucgcacaaaaucagccacaguaagacauggaaccucccuggugaugaccacaacguggcuccucugcuucuugcucaugacucccugauucucuuucugggaugaugcugcuucagaacagggcuuuggguuuuucccauccguuucuccuuuggcgucuucuucagucucuuccaugucauccucauccuuuucagggucaucuggauccucccagggaagcagacgguuagggacuucagcaaggaaaugaccacaguccugcugaauguuaaaauggacagccagacucugccggacagccaagcugugauaauacugcugagauucuuuagcuuugcucuuacagaucugaaagauaauaaaacaauucaaaacucacacucucauaaccagguuuaugauguaucagggaagauuaacuggaaggugacugguuagggacaaacgaucauauaguaaaguuguucgcaaggcuugccccauguuaaguggcaauaauaauggugguaaccauuucucaugguugucuacaugccaggcuguggugagcacuuuaaguguaccauuuuuaguccucacauuaaccuuucacaguagauugaggaucuaagaauuuaaaaaagaaaaaaagcccgggguuaugugugcaaaccuaaguuuguuuaaugccaaagccugcucuuuccacuauaaccuugcaccucaucagaacaacaacaaugaaauaauuuuucucuuacuucuguagagguuuguagcccagaaugauacagcaggccaauggacucauaauggagaccaaaauaccuuauuucaucacccaucgcccuuugugucaacaucucacagcuuaggagagugauauaacauuggccagguaaacuguggguuuuccuaacuuuucaaugaaugucauugugauggucacaacacuggcacucaugguucacugguaggguugagagagucacuggucugaccuagucagaacaaagccaacauuucaauggugguuuucugaguuuuaugcuuucucuuaacaggccucauuuaauacccacuauugaggcaauaaaaccuuucauaaagaacuuuacuaagugguuauggaucaaggaagaauuuuuugaucaaaaaaaguuagccaagaguucuacauacugugacgauucuauuucuacucuuaagggguuaucaaagcaaaaaguaaguaaaaccacccccaaauggguuauucucaugcuauagagaggcugaccguggaagacugagucucuaauacuaguucauggaucauaauagucuggucuggagucugcuccacagcccuguuaacugagggucauucucugcucucccuccucagcagaggcacacugccacauuacaaauaucaaaggcucccaggaacaugcacucucuguaguguuuacacugcauguuuauuacaauaauacagaaaagcaaaacuuaaaaaagcaauuucuagucauuuuuauuuaaaaagaaaaauguacacauucuuaggaagauucagauaggacccaguucugagaagcagcacauucugauuuccauucaaauagauuaaaaaaaaaaaaagaucaaagacaagggagucucagcggagaaaagcaucucucucucucuuucucuuauucucuaguuuaucauauuuacuacaguuaaagaagccugauaucagugaucagugccauggaaaucaaucaaucuaucuaucuaucuaucuaucuaucuaucuaucuaucuaucuaucuaucuauaccucagcacaaguuccuucaagucuucuacuaccuaucuaauucaguuugaggauauacuaaguauuucuuuuuuaagcaaacuucuggucuugaacagacauccccagccugaguucaaguucaaacauauaucuuucagaaaauauuaucucuggaaagcucucgaagucuuaguauaugcaguauaauauauaauccuauaugcucaucaaucauaacauuuguuauuuuuguaacugcacuguuggcaauauuucacauuuaaguguuaccagguauuuaaaaauucuauacuagucauuguuuaguuguauaggaguuggauccagcacauggcaccauuauccccauugccaguuaaauuugcucaauauuauauugucuucuggaaugaaagcucaagggucucaacucuucauaccacuaaauuuggcugaaucagauuggaugguuaaacucuagcuguuacauuauaaaaaaugacacucuccaagggcuugggaggccugggauuuagcuuugcuacuagcuguauaaccuugagcauuucacuaauuucucugggucucagucucccuauuaaaggagacaauaugaagaacacugaaaucuacuucacagggcaguugugaggauuaauugggaucaaguauauagcguacaucuguaaacuacaaaguuguacaaaugcaacacugauaaugacuaaagcaguuaacaacuugcaaaugucaaacuaaugcaaucuuagagaauccuaauuuuuugaaacaaugagcaaaacagaaaaauagaucuuuauuuugagucccgacagccaccugccacagcagugaggcucucugaucacaaauuugauagaggacagacaaaaagaaacugcuaacauucaauaccuccaagccagggucagcccugacaaacaaguuaacaccagcaguauguuagaauccaagacagggcaaccuaaagcuaugagagagaauuguuuggccaagucuaguuuuuaacuaugucaagucaggcugaaaaaaaaaacugugaccuuguaguuuaauauuagaagcagagaagguauucuaauugugacucguauuuuaauugugauauucuaauuauaucuagacauucacacagacacacacauuuuuauaagguccuccagagcuuugugaguagacaagaauguggauacuacaauaagaauuuauguuuagcuucacagaucuacuugagauaaaggaucaaagugauuuacgaagaagaaaugauaaauuguuucacgauuuuggaugcucuaaaggaaaauggucucccuagauagauaaccugagugggcagcacuuccuuaucucuucauuuuauaauacauagacagguugaagaauaaugagucacucuagcuuuaagagcaaaggcaaaagggagaagacuagaguguaaaagaggagggaaaaagagugauuuuacuugguucauaacccugaaaacaguuacaacccaaacacagaccaauggagauuuccauaauaggauuuugcuugauggguaucucauaaaucuuuauuauggagccugcaaugauguuaauuuagguaggaguauuauauuauucuagguaccacauuguagccauuuuucaaauauuaauaacuccuuuaguuaaaaaaaaaaccucaaaaugaccugacuucagauaacaaauuucuaguucaaaaguuauuucagaaaacaaaccaauuuuucagaacaaauggauaggguucuuccugucaaauuuuuuccuucugcccuuacccaguauuuucucuaccagggauuaaaguaacuucuucuuggcucucauuaucuuucuugaaaagaauucacauuccuucuuuauaaagaguagcuggcaucucaagaguagcaggaggaaucucaagaaagauucuacuuguucaugccagcuacucuuuaaucuauaaaugauuacuucaggacuccuccuaggacccccaaaauuuaaaaauaggaauaaaaauaaacuagaacuggaaugguccuacaucuucauuaaacauucccuuuucuaauaggggaaaaaucaccucauauuugccuuggcuauguuugggaaaaucuacuuaaaaugcugugaauuuggcagauucugugcugucuauauuuucugaaaggcaagaaaaaaugcuaugagagccugagccacagugacacuagagggagcugcaauaucaauauccaggagucauuuacuuauaaacugugcagcaggagaacaaaaccaggcugcugaagguugaaucuucuuguaaaauacaccauagggccucuuucuggauaagcuuuugcuucuaugaugcuggcaauaccaaaugcaugccaagggaacuccucgugugaagagcacagacaggaagagaagcccauccugggcacagugacccucgcccacuugccagcucacaggaaaugcccgcuugagcuauucuccaaaggagucagaggaacaucaaaagggacagccagucagcugguauauacauaugcaccaacaugaauaaccuacaguugcaaaaacagaggcuugaagggaaacuggcugcuugucuggguuaauaaagaucagugaggacagagaagggaaaaauauuaauucauuaucaauugaucauucaaacaaguaucucauggcuccugagcacuucccaucuguaagacacagcauccugaagcauucugaccagauuccuaaauacagaggguggggacccuuuaaccacugauaaaucaucuguuggaaaacugggggagaggggaaacaacauauugucuuccagaaucauagccaaauuacccucuccugagaccuucucagacucgggucaaagaacccaacauuuacaaucuuagcagggaaacagagcuugaaaaugauucaucaugcacaaccugaaaaguuuaauuccaaacauacauuucaguucaggggcucauuuuccauguugcucaugacaacugcccugcauaccuuuaaggcaaauuugucauuaaaaagcauuuauguuuguaauaacuucaaccuagagagcuaacuucuaaaaaguagaccaucaggggcuuugacuguaaagucccauuaaaaauagcuggggagaagauagugcugucuaacacuacugaaccuuucagaaugaucacaaagccugggaccugugagaggacauaccucuugaugcucucucaacaacagauacucuguuuaaggcaacuaagucagagggauagggggaaagguggaccugugcaaaacuggaugauaugacuauggaauuaaucugucguugaauggcaugguguuacucauucuucuucauugacccuuuuucccaaagguuccgugaagugcugguguuuggagugccugcucuccauccuaguuuuucauugacaaacucucuuccgcaagcuugcucauagcuucaaccaugucauauacacuacugacuuccgugucuacauuuguaacgcacccuugucuuugggcuuuaggcucaucuauacaaugaccuacuugauuucuucccauauauguccuaacccauagauuacuuaaacucaacauaaccaaaccugaacucuccgucccaccaaacucacugcuuucccaguacucccucucuugaugaauggcuuuguuaccuggaugagaaaccaaauucacuuuggauuucuccugcaucuucacucccuauggcuaauuaauuaucaacucucauugacuuuucuucuaaauaacuuucaaauuauccucuuuucuccaucucuauugcuaccuucaucacuugccuggacaaccacaaaagcuuuccaacuggucugccugccucuaaugugauccccucgaauacaucuuccacauggcuacagagccauuaaaaaacaacagcugguauuuccuccuuauuuaaauuuccuagcggcuccgcuuuauccucauaggagaaaguccuggccuugccucccuuuccaguccuacuucccaccuguguuccauuugcucuuacuauauugagcuaucugcagccggccacccacucuacccuccagguguucucucaguuuggggcuccuugucaccccucaucugccugagggauuccuacuucuuuuaaagcccuucucaggcauuacuuuaucagagagaggaagugcuaaauacccuaaacccccuuucuguguuacuucuauaucuuguacauaucucuauuauugcaguuaucacauuuuuuaucuuuaaaaaauuuuuguuuuuuauaauuuuuuucaauuuuauuuuagauucaggggguacaugugcagguuugcuaccuggguauaucucaugaugcugagguuugagguacaacugaucccaucacccagguacugaacacaguacccaacaguuuugcaacccuuguccccuuuccucccuccucugacauuuuuuugucuaucuuacaagcagauacuuguaucuuuagggccuagcacagagcaaggcacguaguacuugcuccauaugucuguaaaagauucugagaaaaggcagcaucugauccagugcugccauagggcuuauuuacucggaacagguagaauauaugaacagcuuuuaugaaacagauaaaaguuggcaaggugauggggugggggcaacggcagauaaaccugaauaauaaacacucaugaaugaccugacuacacaaaugagugaaaucugaucagugagggcugucuguugaguccaggcugcccugggggcuugcugauuuuguacugcacaaaacuacaaaacaacauggcucucugucauucgauucaauuuucucuccuuugccccaaagaaagcaauaauuacaaaauauaagacucuucaaaaauauucuacauuagcucugauuuuuccauuaugggcccaguaugccuucagccuacuuccaguuuaucagcagggaaucucauuuccaucucacucuaugcauucuauagugccucagugaaccuuaagugagauggaugcuauagggaaugaauuguggagggacaaaaaugagaaacauuaacaaucauacacauuacaccaucugugccauuuugucauaucacacaaaaguacaacugcaaaugggagugagcauagaaugaaacccugcaacuucuaaauugauauccaguauuugguauaaucccacucuaagaauacaggcugaucagugauugaccucaauuccuugaucugccuaggaggaguauugcuauacuugcugcuacagagcuaagacccacacacacucaaugcuguuacaacuauauucaaaauagauuaaguguuuaauauauaaaacgcugugugggcccaaaguacucaggacuccauguuguaggaaucugcuaugagaacuguuggguaggccagauaauuuacagcuugaauugcugcaaaaauguucacaugcccaagaaagugauuuuggauccuagaagagaaauucaagaagguaacuguguaagauuucaccauuuuauuugugacuuguacucaccaaagcuuuucacucucccacucagcauguguauccaaugaaaauaacuuguguuccugagccaguaauuuaggcugacagaaugaugcccaggauguucacacuagagaaacugaggcacagaguaguccaauaaccagcucagggcccacauuaggaauucaauuaacuugaauuccaacuugugauucucaacuauauccucucaccucauuaauuaaagccaugcucccuuuucccaccagacaacucauuuugauuccagguuuacacaaacauccaaaaccucuccuuccuaaaucaauucccaguugagacucaggugcuucuguaugcacugagccugaaacaaaacggacacaaaacuaggauggccaugaguauguguaguuggcugcugaucaaucacuuucuguaaaguuucacuguuaaaaauauuuauuuugaauuaugaaaguggaagugguuuccccucuaguuuuuuccucaccacuaagccaguaauuaauugucuguauauauagucugaacuaguuguaaauuccuaccaaucauaguuguuccuguaaugcuuuuucauuuaguaucuuguuuugucagcauccacccaaaugagauaaacggagacucuggagucaaaaaugcaguaaaagauguuggucuccacaguucaccucuacauuauuacaagcuuuuaacaagauucuggcauagccggaagaaaggaagcagccccgcuuuuguaacagggaaguguacaucuuuacugaguuuuguguguucuauccuugagaacaaagacugggacuacuuuaaagauaccuacuaucccaauucuggaacuguuggaaaauaacuaaaaaauuuauacuuuuugcuuaugugaaauuuuuagcauccucuucaaaguaacugcauccaaauuuccucuguggucucgcaugguaguacuuuuuauaaaaugaucucauaagugcaaugaaaaaacaauaucucagugauacuaagccauaauuuugccaacuguccauccugauucuaagcaaaaggcugucauuuuuccaucaagaaacaacacugagacacagcaaggucaguuuacugcuucaggcaugaaauaauaggagagguucuaccuaggagucaggagguagccugccacgaagaugguguccccaugcagaagugauuguuccucucuggccuuaguuucccacuguguagaauggugaaggcccuucuaaaauuggcuuuagucuacuaugaggauaugagggauuagucuacuauggauuuagauaugaggauuuagucuacuaugaggauaugaggauuauguacuuggucagugcuuacccagauucuuugaaagggaaaaagcaagguagauuuuuauuuagagaacagggaaguuaaguucaggcuuaaguuuauguuaaguuuuacuuugcgagcaggaauauuuaaguuaacggcagaaggccagccaauauauagcccacagagacagacaaugcaaucugggugguggcucaucaaauggggaagagaggauaaaagaagauauggaugagauggaaaaugggaguugaaaauuaaauauuguuuggaaaucaauuuggcucuucuuucaccaaaacauuuauuuaaaaaguaggcugugcucacugccuccacagcuuccucuuccuauucgcucuuuaacucacugugucuggcauucaccccaauuauuaccaacauugcauuuucuugaggcuuacaagacauuaaauucuugccuucuucugagucuucauucugcacaagcccucugcaaccuuggacucucuggccuguagggcccugccuuuugcuacagauuuuccaauugcuccugcuuugggucacuuagaugugugggccuuuucccacuuugcagacucuuccauuacaaucucauguagucccacaguuucaacuaaaucaagucuaugaccacauuucuaggcuugagcucucuucugaguaccaaacccauauuuuuaccugguuccugggguucuuucaacuuggcugcccuaugggcauaacccauugagaucucaucuuucuggcuuuucugauucauauuucaacuaauggcaucaccauucucuuggagguuguucuaccuugaaauuuuagcaucacugcccuaaucccauacucaccagacauggucuacugccuuccucagcucuuuagccaucugccccuucuuuuccuuugccuuacaucaggucucauuuuaccuggacuacugcaauagcauaaugacuggcuuccuugcuuccaguccuucugaccucucuuaccauaguugucauccaaaaucuuauguuauuucuguuuaaaaauacuuaguggcuucccacaaaacacaaaauaaagucuaaccucuuaagcucaucacucaaaucucuaaauuuguucucuaaucucuccguagccuaauuuuccacuauucucucaauguacugcauuuaccacaaagaauagcaaaguggauacaaaaggcccuuucuuauuggccccaagauauguguuaauaacuuauuucauucauuaaucuucauuuaucuuuacaucucugcauaccacucugaacuuucauuauaaucuguuuuaagagcuauuauuuaugccuuugucuuucuuacuggaauauaagcuucuugagggcaaggccuuuguuucauucauauguauuucuguaaacuacaacaaauaucacaauguuuuauacaguaaacauuuuuugaagggucaagaaauauuuauugaaugccagcuauggacaugauauuauaauagaugcuaaggauauaagaauuaauaagccaugguccccgccauggaaaaggucaaguauaauaguggggagaggggagaggaagcauguuuuuguuuaauuauacaacugucucaugauaaugcaaugaucaagaaauccaguagguauagcgugcaacaugugcucagaaaauuaaaguagaaaauucagagcuggauucuuuaagaauacauaggagcuuucuaaguaugugaaaaggaaggaauaaccaacuuuuacuaaaugcuuaacuuugugccaaaugaugcucucagcacuguguguguguguguguguauguguguguguguguauauauaucaccacauacauauuaacuucugugauuuuuuacaaugguuuuaagaagaccugaaguauuuuuuccauuuuacagauaaagacacuggauauagaaaaggcaaguaauggcaaagguaacagcuaauauguagcuaaagcacagauuuaaacccaggucugucugacuuaaaagccuaaauucuuagccacuuuguuaacaguccucacauuuuguaccuaggcaccgcuugggguacuugcuacaaaugcaguuuccaaggccuuacugccagucauucugauucuguaggaaaugacauuuuuaaugaggaucccucaggugauucugaaauaggucacagcagaucacaaugcagaaguucuuuauuguauuauacugccucccaggagaagagcaguccagagagaggaaccagagugugccaaagccgaguagcauuaaacaggugcuguuuauaauugguacuagaggaugggacuacagagaugaauaacuaaggauaccuguuuucaauaagcuuaguguuuaaugauccaaaaucugauucuuguuuuuuaauugaaaagacauuaggacaucauuuuuuaacuaaucaaaauaacuguuaccagcuugacauaggaauuauuugaguauuaccauuuuguaggucaauuuucuuaaaguuaugaucauguuauuaguauucugcuacuuucaugugacauuuaaaaaauguuuuucauaauuuuacguagucuucauaauuacugcuuuuagcagcuacaaacauuccauuggacuuaugugccauaauuuauuauauugguuccuuaauauaagguaccuaguuuguuuccaauuuuuggaaauacuuaaauucuugaagcugucuguagcuuucucucauaauuuuaaggaaaaacaaagauguuuacaucucugaaguaaagagaaagaauaccuaagugcagaaccuaucuaauaugcucaagccaaagccuaauguuaagaaagaauaauagugagugaucuauaagauguugagcagcaauuuuccauuauuguuaauaacaauaaugcauuauuuuauauguacuuuacaguuuauaaaacuguuucacuacauaaacacauguacuauaacaaucaucugagauaaguagggcaguuaauauacacugaugugaaaaccaagagaggcgcaugacuugcauaaaaauacacagugauaucuucagaacuuggacccaggucagcugacuccaaagcucuuuauucagugcugugaugccuuuucauuuaagaccaauacaaauaauaaagcuaaucauguugaaugaagauuagaauaaauaugaaagaggaaaaccuucaaauccaggaaaagcccugaguuaaaaccacuuacuuuauaacaaagacaaacaugacaccugcuauggacagaauugucucucuccccaaccucuucauauguugaagcccuagcccacaauguuacugcauuuuggagacagggcuaacaaggagguaauuaauuaaaagagaucauaagaguggggccaugaugugacaggauuaguguccuucuaagaacagacacuggggcgugcuugcacaugcuucuuguguucucucucacgcucucucucucucccugucauguaagggcacagugagaagaaggcuaucuguaagccaggaagagagcccucacuagaagccaaaucagcuagaaccuugaucuugggucuuccagccuccauaacugugagaaaauaaauuuauccuuuucagucuaugguauuuuguuauggcagccugagcagaaugagauuuugauacugagaaguggugugcuguuguaaaaauacuuuaaaagguagaagcagcuuuggaauuggguagaggcuagaagaguuuugagaugcaugugaggaaaagcccagauaaccaugaacagauaguugcuagaaauauggaugcuaggggcgauucugaugagguuucugauaguaacaaggaacauuauuggaaacuggaggaaagggaauccuugucauaacguggcaaagaacuuagcaggacuguguuuuguagaagacaaaacuugcaagagaugcaauugagauuucuaagcaaagugaaggaguggcuugguuccuccugacugcuuauaauaaaaugugaaaggagagagacgaacugaaaaaggaauuguugagcaaaaagaaaccagaacgugaagacuuggaaaauuugcagucuauccauacugugaaaacggugaggccaggcguuguggcucaugccuguaaucccaguacuuugggaggcugaggcggguggaucaucugaggucaggagauuaagaccagccuggcuaacauggugaaacccugucucuacuaaaaauacaaaaagcaguugguguggugacggacgccuguaauaccagcuacuuggggggcuaaggcaggagaaugacuugaaccuggaagguggaggcugcagugaaccgagaucgugucacugcacuccagccugggugacagagugagacuccaucucaagaaaaaaaaaaaaaaagggaaagcuuguucuaagagaauaccaaggguguggcuaaacaacuauuugauacagagaagauggauaugacuuauggacuuaaccagccaucucagcacaagucagggauaauaaugggauuauaccagcaaagacauugccaguuugaauuaaaagggacaaagugggacaaaauaaaggaaggcuacugaacuuggauucuacaggacuagcccagagagcuauuuggcugcaaacauguacuguucuucaaggaaagggaagaaugauccugaaagugauacagaaacaucagggcugcuuuucccaccaaaggaccaguaggcaaggcuguuccauccucaguuucaaagggugaagcugccucuugagaucugguaggcuaggauaaccaugaccagugccucaguauugcgccacuaugcagagccaugguggugauggugccaccccagugggcuugcaggggagaguaucaaaccaaagaggauuauucuugggccgaagauuuaauagaacuugacuugccagguuuuggaauugcucaggauuuaucacuccuuucuuccuucugauuucuuucucuuggaaugggaaugucuauccuaugccuguucacaguuguauuuuguaagcauguaacuugugguuucacagguucacaacuggagagccucaggacaaaucauaccuugaaucucacccauaucugauuuagaugauauuuagaugagacuuuggacuuuagacuuuagaguugaugcugucauaaauaagacuuuuggagcuguuggaauguguuuugcaugcuauaaggacagauauucugaggcaggauggguuagagguagagugcuaugggcuaaauuauguguuccccaccaccaacucauauguugaauccuuaacccccaaugugagacaguaccuacaaagagguaauuaaggcuaaaugaggucauaagcauagggcccugauacaauagaacugguguccuuauaagagauaccagugcauagccucucccuugcacucucuuccuuccucucucccucacuccuugccaugugaggacacaaagagaagguggcuggcuguaagccaggaagaaagcccuccccagaaagcaaauaaguuggaaccaugaacuugaauuuuuuagccuccagaaauagggaaaauaaauuucuguuguuuaagucauauagaauaugguguguuguuacacaacuugagcaaacuaaaauaacauacaguuaguacucuaugacugcaguggauuugguauuuaaggaugaggggugauauccuuuggcuuucaaauugcuaaauucuaccacugauuuuuuuuuuuuuuuugauauguugucccacucuguugcccaggcuggagugcagugccucagcuuacugcaaccuccgccuccuggguucaagcaauucucaugccucagccucccgaguaacugggauuacaggugcccgccacaaugacuggcuauuuuuuuuuuuuuuuuguauuuuuagcagagacgggguuuugccauguuggccaggcuggucuccaucuccugaucucaggugauccaucugccucagccucccaaacuguugagauuacaggcgugagccaccacgcccagucuaccacugacuuuuuguuugcaacauuuuaaagaacuuuuagucucuuuaagagacaguuacacccuuuagacuauuauaaauucccuuaguaugggaagggaauuuaagaagauaaacagaaaaaguuguuugugugggccaacuguuagugucuuuugcuuaucucugcaaagacaggguucacagagcccuaauaguacaaucaauugggcacuucuggcaauaccagagggucuuaaaagagacauuuauauuuagcauuuaguguaaaauauccuuuuccaaaccugccaacaacuccuaguauauaaccacuugccaucuguucuuuggagauugguuuuacaucauuauaagcaaagaaaucaauaccagaccacugauuugggaaagagacaagauuccacggcaauaauacauaaaguuagucaaguccuacuucucaacuguuuugaaagaacagauaguucaaugucccuuucugaaacagguacucauccugcauuggugauuuugcagcaauaagggcccaagauagauaaggcaccauaaccucaauuuauauaacagcucuuaagugcuauauagaaucucaaaauaccuuuuuaaacucaauaguaauguauuaacuugaauccagaucccccucuuuacaguuuaucccucaguuuaauuuaaaaagugugagcuggagcacaggguuacucugccagugacaucagacagucaacugguguagauacuguaacugcagaggguagcuagcugaaggucuguuucaaacauacauucugucuugauagacagguaaggccaaucguuaccuuauccauuaauuugcuaagauaccaucuggucuuucuaagccuaauuaacauguaaaagucauuuagauauguuaauugguuuugaaccagugaauagaaucaguaaaaagggacuaugggaauggaggacacuaccuuaaguuuacauauagggcuuuguguucuucaaaaaccuuucauaugcauuaucucacuugauccuacacucacuguaaacaucugaaagaggaggaaauugaggcucaaagauuguuacucucuuaaaguaaccuagggaagaagcuaguggcuaguuaaugaaaugaacaguuauuagggacauuuuguuuucuuuuaaccaaacaacagcuccauaagaugggugccauuauugacaaagcuacuaagaggcagaaccaggaucugaacccaaaucuuuuggacuucaaaguccacacuuuauuuauuauauugaugaaaccuauggcuuucugcuacagugaauguaacugggcaagaauucuugaugucaagaguuuagcugucuugaagaaguggguuaucugaaauaagcaauccacauguaagaaauugauaaguggcacaauggacaaaauacagcuauggagucagaaauauuugugauuaaaacucagcucuggccaggcaugguggcucacgccuguaaucccagcacuuugggaggccaaggugggcggaucacgaggucaagagauugagaccaucuggccaacacggugaaaccccgugucuacuaaaaauacaaaaauuagcugggcaugguggugcacaccuauagucccagcuacaagggaggcugaggcaggagaaucgcuugaacccgggaggcagagguugcugugagccaagaucgugccacugcacuccagccuggcaacagagugagacuccaucucaaaacaaaacaaaacaaaaacaacaacaaaaaacucagcucuaccacuugcuagcugugugauccuaaccaagucagccuacuucuuggagcuucauuuuccucauaugucaaauggagaaaaagaucuuaaucucauaaaguugaugugaagauuaaauuacauaacaaaaauauaguuccaggaacaucaauaaacauuaguuauccuccucuauaaaaauguuucucuagggagcaaaggaguuacagagcagagguagacaagcauuucuuagcugguaaaggguaaagucagaaacauaaaccagguaugauggcucaugccuguaaucccagcacuuugggaggccaaggugggaggaucacuggaagccaggaguuugagaccagccugggcaacauagugagaccaccaccucuaccaaaaccaaaaaaaucagucaugugguggcacacaccugaggcugcagugagcuaugaucaugccacugcacuccagccuaaaaaaaagacagaaacaugcagugaaagguacauaacagaccucauauuuuuagguagcccuugcaaaaagcaaagcucaaggguuaccuacuuuuuuuuuugagacagggucucacuuuguugcccaggcuggagugcagugacccgaucauggcucacuucagcccugaccuccugggcucaggugauccucccaccucagccuccuggguggcugggacuacaggcaugagccacuacauuuggcuaauuuuuucuauuuuuuuuuuuagagacaggguuucaccacguugccuaggcuggucucgaacuccugggcucaagcuauccaccugguuugggcucccaaagugcugggauuauagccaugaaccaccaugccuggccagguuaccuacuuuaaaaggacuucuuuggcugggcaugguggcucacaccuguaaucccagcacuuugggaggccaaggcgggaggaucaccugagaucaggaguuugagaccagccuggccaacauggugaaaccccaucuccacuaaaaauauaaaaauuagcggggcgugguggcagguaccuguaaucccagcuacucgggaggcugaggcacaauaauugcuugaaccugggaggcggagguugcagugagccgagauugcaccauugcauuccacaaugggcaacaagagugaaacuccaucucaaaaaaaaaaaaaaaaaagacuucuuugacuucuugaguuuggguuaagguaucuccaagaucccauagaauucuuguuuaccucuaucuuugcaugcaguauacuguuguaauucuguuaaguuacguaucuguuuucuuuaaauaauaaauaagcccccugcuuaaucuaguaucugguaagagguagaugcucaauaauuugcugaauggaagaaugaaggaaagaaaggagaaaagcagaaugaauccaucccaguaacaauguagugguuaagacuuaacaugagauuuauaauauuuucuuaccuugacugcauaguuauuaaguggaucuuuugcauaugaagcaguauaguaaaccgcaucaccugccucacaacaugguuugucacugguuagccugaagucugaccagcuguccacuccaaaacggagcuggucuuucugcccagccaugaaaaggucuucgcauuuaacagccaguuucuucaaggcaucuguaugaaggcuucggauuuuacccacuacuuccucccgauucucaaguccucgauaaagugcuugucucugcggcuucuggaugccucggcccugucugcaagagggcccacgccggcuggagagggauuccaugcuguuggaaaaucuauccuuaauacugagagugguuaagcuggaaaugcuguuugcugcugaggggacaggucucuccuugcgcaaaggccuuuccaaggagucauaagacucaauguccaguccuuugaguucauagcugauggaagaaccagcacugcuggcaucccaguuggggucgauaucauaggugggauuagccaugacacaaagacuacuuuccauggauuuuuggagguccuuggagauuggcucuguauuggcucuuaugaucaucuucuuuggcagugggggugguguagguugggaagcauugggugcuucuuggucuguuuucccuccaaaggcgauggcaucguccacagcucccuugggcugucguggcugcuugggagguaucauggcugcucuagauugcccuguauuguuuuuaaagcaauaaaaagaaaagaguaaguaaaguuuucaaucuaauuuuauaacugaaacuugagcagaaaugagugagguagccaugggaauguaagaauaagucaacucuuuaguucaaaaugggaaaagagaacaaccaaagaacaaauaccuaaacauugaaguauccaagccuuggugggaacgacaaauaugcauaaugucuuggccuugucuaggaacagggcacugguuugggugaugaguuuuguuuucaaaaaggaaaccagauucuccagucccacccuucagagugcuauauauucaccacaccagaauauuaagggaugacagacacucgaauauacuuggauugugacagaguagagaugauagcauuguggauaaagaaaauacuugggagcuuuauuacaaacagaauugaaacuagcaaugugaccauuagacaggggcucagaagauacuauucuguucuuuuuauuccaaaguuacauuguauuauauauagcauuugucaugcauauaacauuuuccaacacaugaauacaauuucaaaagccaugcuauuuauuuuacuauagagauggauucugacauugcuuaaacuggucuacguaaaagauuccugugauugugguaaggggaacaguguauaugagcagucaacuucuguucugaacacgaauucccaaacucuuaugugauucucuuuuauuuuggugggcauauacauugugauuugagagauacuaucuuucaacaucuuuuauaagcccuaguuagagaaccauucaucugugcuuaguuuccagcauuuaugauuagaaaaagauaaaacacauguguguuugaauauaccuucagggcuuauuguauaacagagagaacacauuauuuuuuaaagacagaaaaauauacaugaaacuucuauaaaggcuauuaaaaauuaguucuguuauuaaaaugaggccucuacucaagaucucagaguuauaaggcucuguuauggguugaauuauaucccccaaaaagguauguugaagugcuaaccccugguaccuaugaaugugaccuguuggaagucuguagauuuaauaguuaagaugaggucauuaggacgggcccuaauccaauauggcugauguccuuauaagaagaaaaaacaccauguaaagacagggacagagagggaaaacacuacaugacauuggaggcagagucuggagugacacaggugcagacuaaggaauaccaagcauugauggccacuaccagaugccagacaaaggcaagaaaggaaucuacccacugucucagagggaacacaguccugcugacaccuugauuucagacuccuagccuccauaacugugagagaauauauuuguguuguucuaagccacccauuugugguacuuuuuuacagcaguccuaggaaacucauacauucuccuacuauuguucauauagaguagaaggugcuggauggugcugaggaugacaaugaauagggguggugguuuguuuuguuaaaaucacguccuugcagcaugucaacgguaagcaccaauauaaucugggauuguaauaguaaguguugcuuaugacagggauaaguucugagagaguuaggcaaucucauaauuacgcaaaaaucauagaguguacuuacacgaaccuagaugguacagccuacuacacaccuaggccauaugguauagcccacugcuuauaggcuacaaaccuguacaacaugguacuguacugaauacugugggcaauuauaacacaauguuaauuacuugauaugguuuggcuguguccccacccaaaucucaucuugaauucccacauguugugggagggacccagugggagguaacugagucagcacaggucuuucccguacuguucucaugauagagaauaagucucaugagaucugaggguuuuaaaaagaggaguuccccugcacacguucucucucuuugccugcugccauccacauacgaugugacuugcuccuccuugcucucugccaugauugugaggccuccccagccauguggaacuguuaaguccaauaaaucucuuucuuuuguaaauugccuggucucguguaugucuuuaucagcagugugaaaauggacuaauacaguaaauugguaccaguagagugggguguugcugaaaagauacccgaaaauguggaagcaacuuuggaacuagguagcaggcagagguuagaacaguguggagggcucagaagaagacagggaaauguggaaaaguuugcagcuuccuggagacuuguugaauggcuuugacaaaagugcugauagugauaugaacaauaagguccaggcugagguggucucagauggagauaaggaacucguugugaacuggagcaaagguaacucuuguuauguuuuagcaaagagacuggagcaauuuggcccugcccuagagauuuguggaacuuugaacuugagagagaagacuuaggguaucuggcagaagaauuuucuaagcagcaaagcauucaagaggugaccuaggugcuguuaaaggcauucaguuuuauaagggaagcagagcauaaaaguucagaaaauuugguuuggcgcaguggcucaugccuguaaucccagcacuuugagaggcugaggcagguggaucacuugaggucaggaguuugagaccagccuggccaacauggugaaacccugucucuacuaaaaauacaaaaauuagccaggugugguggcagacaccuguagucccagcuacucaggagggugagccaggagaaucgcuugaaccucggagguggagguugcagugagccgggaucaugccacuguacuccaguauuggugacagagugagaccccgucuccaaaaaaauaaauaaauaaaaauaaaaauaaaauaaaaaucagaaaauuugcagccugucaaugugauagaaaauaaaauaccauuuuucugaagagaaauucaagcugguugcagaaauuugcagaaacuugcauaaguaacgaggagcugaagguuaauccccaagacaaugggaaauauuucuccagggcaugucaacggucuucacggcagacccucccaucagaggcccgaaggccuaggagaaaaaaguaguuucgugggccaggcccaggguccccuugcugugugcagccuagggacuuggugcccuguaucuuaaccacuccagccauggcugaaaggggccacuguagagcucaggcuguggcuucagagggugcaagccccaagccuuggcagcuuccauguggcguugagccugugagugcacagaggucaagaacugggguuugggaaccucugccuagguuucagaggauguaugaaaacaccuggaugcugaggcagaaguuggcugcaggggucgggcccucauggagaaccucugcuagggcagugugaaagggaaauguggggucggagcccccacacagagucccuacugaggcacugccuaguggagcugugagaagagggccacuguccuccagaucccagaaugguagauccacugacagcuugcaccauguguguggaaaagccacagacacucaaugccagccccucaaagcagcugggagggaggcuauacccugcaaagccacagggauggagcugcccaaggccaugggaacccaugucuugcaucaucaugacccggaugcaagacauggaaucaagggagaucauuugggaacuuuaagauuugacugccccgcuggauuucggacuuguguggggccuguagccccuuuguucuggccaauuucucccauuuggaauggcuguauuuacccaaugacuguaccugcauuguaucuaggaaguaauuaacuugcuuuugauuuuacaggcucauggguggaagggacuugccuugucucggaugagacuuuggacuauggacuuuugaguuaauguugaaaugaguuaagacuuuaggggacuguuggaaaggccugauagguuuugaaaugugagaacaugagaucugggaggggcaagggguggaaugauaugguuuggcuguguccccacccaaauuucaucuugaauucccacauguugugggagggaccuggugggagguaacugaaucaugggggcaggucuuccccaugcuguucucaugauagugaguaagucucacaagaucugacgguuuuaaaaagaggaguuccucugcauaagcucucucuuugccugcugccauucacauaagaugugacuugcuccuccuugccuuccaccaugauugugaggccuccccagccauguggaacuguaaguccaauaaaccuccuucuuuuguaaauugcccagucuuggauaugacuuuaucagcagcgugaaaauggacuaacacacuacuuguguaucuaaauguagaaaagguacaguaaaaauacaguauaaaagauaaaaaaugguaugcuuguauagggcacuuaccaugaaaggagccugcaggacuggaaguagcccugggugagucaccgagugaguggugagugaauguaaaggccuugcauauuauuaccauacacuccuguagacuuuauauauacuguauacuuaggcuauacuaaauuuauuuaaaaauuuuucuccaauaauaaauuaaccuuagcuuacuuaacuuuuuaacuuuauaagcuuaaauuuuguuuaacuuuauaaauuuuguuuaacuuuuauaauaacacuuagcuuaagauacacuguacacuauuucaaaauauuuuuucuuugggccaggcacgguggcuuaugccuauaaucccagcacuuuggaaggccaagguggguggaccacuugaggccaggaguuugagaccagccuggccaacauggaaaccgugucuguacuaaaaauacaaaaauuagccaggcaugguggcgcaugccuauagucccagcuacucaggaggcugacguaggagaaucauuugaaccugggaggcggagguugcagugagcugagaucauaccacugcacuccagccugggugacagagcgagacucugucucaaaaaaaaaaaaaaaauuguuuuuucuuugugucuuuaugcuacaaaucuuucccuauuuaaacaaaacuuuuuuuuuuauaaacuuuuuuguuaaaaacgaagacacaaacacacauauuacuaguccuaaccccugguacaugugaaugugaccuuauuuggaaauaaagucuuuguagauguaaucaaguuaagaugaggucauuagagugggcccuaauccaguaugacugguguccuuauaagaaaaagcaccaugugaagacagggacaaugaugacaaaggccuacacagggucaagaauaucaauaucacggucuuccaccuccacauccugucccaguggcaggucuucaggggcaguaacacacauggagcugucaucuccuaagauaacaaugccuucuucugguauaccuccugaaggacaugccugaggcuguuuuacaguuuuuuaaaaaauaaguaggaguacacuuuaaaguuaugguaauaguacagaaaaugcacaaaccaguaacucaguaguuuaucaccaaguauuauguacuauacauaauuguaugugcuauacuuuuaugacuggcagugcaguagguuuguuuacaccagcaucaccacaaacacgugaguaaugccuugcgcugugaugucacaauggcuaugucacuagguaacaggaguuuuucagcuccaucauaauccuaugagaccaguguuguuugugcaguccauuguugaccaaaacaucauuauauagcacaugacuauauccauuucccaugcacacuacuuucuucaagaauaucuaagaauuuauauaagcuacagcaauauauauugcaaacucaaggaccucuuuucuccacccaugucauguaguaauauuuuuauaaguaauagaacaauauuaaauauaaacaaacaacaacacacauauauauacacauauaauauauauauaaauugugucuauauguauauauuuagagggagggagggggagagagagagcaagagaguaagagaagagaaaaaauaugagaaugcuaagcuucaaggcggccagagcuuuuguuuuauucacugcuguaaucucugugccaagaacaaggucuagauagaaucaacaauaacaacuucuugaaugaaggaauaaauauuuacuacugaaagacagaaaguaguaaaauuguauagauaucuauaauaaggaaagaaauugaauuaguauuuuaaaaaauucccacaaagaaaacccaggaccagauggcuucacugaugaauucuaccaaauguuuaaagaaguauuaauaccaauccuuugaaaacuuuuccaaaaaauagaacaggaggaaggaaugcuucccaacuugaauucaauggagccaauauuaccuaaauacuaaaacuagacaaagacauaaaaagaaaacuagagacugucuuuuaugaauacagaugugaaaaucuacacaauaugcuagcaaaccgaauccagcaacauauaaaaaaggauuauacaccacaacaaggugggauuuauuccaggaaugcaagguugguuuaacaucugaaaaucaaucaauguaauauaccaugccaauggaauaaagggggaaaaaagcucacauaaucaccuuaauagaugcagaaaaaacauuugauaaaaccaaacaccuuuccauaauaauaauacucaaugaacuagaaacagaagagaacauccucaaccugacaaaggaaagggcaucuuuguaaaagagcuaacaucauacuuaaugauaaaagacuggaaauuucuccuguaauaucaggaacaagacaaggauuugcguucuugccauuucuuuuuuuuucuuuuucuuugugucuuuuuuuuuuuucccagacagggucuuccuuugucacccaggcuggagugcaguggcacaaucucggcucacugcagccuugaccucccaggcucaagugauccuuccaccucagucccccaaguagccaggacuacuauuuuucauagagacaggguuuugccauguugcucaggcuggucucaaacuccugagcucaagugaccugccugccuuggccucccaaagugaugggauuacaggugugagccacugcaccucacccauuucuauucuacguuguacaggagguucuagucagggauauuaggaaagaaaaagagauaaagacauccagauuguaaagaggaaaguaaaacuaucucaucauucacagauaauauaaucguguauauugagaagcguagcgaauccacacacaaaaaaacuauuagaaugaauauaccaguucagcaaguuuacaggauacaagaucaacauacaaaaaccaauucauuucuauacauuauaaaugaaugauccaaaauaaaauuaagaagacaauucuauuuacaacaccaucaaaaaggauaaaguaaccagaaauaaaccuaacaaaacuaguguaagacuuguacuuugaaaacuauaaaacaucgcugaaagaaacuaaaaagcaaauggaaagauaucuuaugcucauggaucagagacuuuauauuguuaaaagggaaauauucccaaaauugaucuacagauuuaauguaaucccuaucaaaauuccaguuagacuucuugcagaaacuggcaggcucauccuaaaauucauauggaaauagaagaaaccuagaguggucaaagucuuuaaaaagaauaaaguuggaaaaguuacacuuuccaacuccaacuuauuacaaaauuauaguaaucaagaguacgugguacuggcguaagaauagaaauauagaugaaugaaauauauuugagagcgcagaagugaacacuuauauuuaaggccaacugauuuuugacaagauugccaaaacaauucaacagggaaagaacaguuucaagcaaaauaaugcuauugaaucccuaccucacacuauacacaaaaauuaacuaaaaauguaugaaaaauuuaaauauaagagcuaaaacuaaaaacucuuagaaaaaacguaggaauaaaucuuugcaaccuuggguuagguaaugguuucuuagauaugauaccuaaaguauaaguaacaaaagaaaaaguagauuggaagucaauaaaaauuauaaacuuuuaugcuucaaaggacaucuuuaagaaaguaaaaaagacaacucacagaaugggagaaaauauguucaaauuacauaucugauaagagacuuauauucagaauauauaaggaacucuuuugaaaaagauaaauaacccaaguaaaaauggguaaaagauuugcauagcuauuucuucaaagaagauauauaaauggccaguguguguggaaagauguuuggcaucaucacucaugagguaaaugcaaacugagacaucauuucacaucuacuagguuagcuguaauaaaacacacaggcaaguguuggugaggauguggagaaauucaaaugcuuauacauugcuaguaggaaucuaaaauggugccaccaucuuggaaaauauuuugguaguuccucaaaaaguuaaacauacaguuacuauuugacccagcauuucgacuccuggguauauacccaagacaacugaaaacauguccaccaaaacuuuauaugcaaauguucauaagcagcagcauuuauaauagccaaaaaguagaaacaaaccagauguccaucaccugaugaauggauaaauuaaaugugguacacccauacaauugacuauuauucaggcauaagaggagugaaguacugauguauguaugcuaaaacauggaaaaaccuugaaaacauggaaaaaccuugaaaacauuaugcuaagugagagaagucagucaaaaaugaccacauauuauaugauuccacuuauaugaaauuuccagaaauauauaaaggcauagagacagaaaguagauuagcuguuguaaggggcugggggaaggggagaauggacagugacugcuaauggguuucuguuugggaugaugaaaaugcucugaaauuagacauuagugaugcuugcaaaauucugugaauauacuaaaacuaacugaauugcacacuuuaguagggugaauuuuauggaauauaaauuauaucucaauaaagaaaaucaacaauccauucuuagaaacaaccaucaauucaguuuccagucuuaucuucucauuccucugugcccuuaacuaaggauguaggggcuuggcauuuacugaauguuuccugugaugguggggucuccuucccaaagcugccccagcccuauuuucucuuggcuaaugugagacgucagaccaugguuuauuuacaagacaacagaaguaugcuuuguaauaaguccuaauuuuucaguugcuuaccuagaccuuucagagaugaagcaccacggagaagguuagaagcagugaauugcaccagcugaggcccuaucauccuugccugacaacugugacagucuccuauuauugcugucuccaguuuuaccucccucaccacacaaaccacuagagagauguuuuucaaacgccaaagcauuucaugacacuucucugcuuuaaaaaauucuguccuaaagaucgucuucaagcaaagaaagugagccuuucaugaucuggccccgauauaccuguuucucgucgcauuuccucuuauauccuaagucagagccaccaaacuacuugcgguuucuccagcacucuuggccaauuuuacgcuuccuuugugcuuugugucuuugcucaugcugauccucuuccaggaauaguuucccacuccucucaucuuuaaauauucugcuucuagggaauauuucuuacuccacuccccagaauugaccuuucuugggcccucagauagacccugugaauauuucucuguaagcacuuacaacccuugacuuguguuccauucugaauucccuacugguuugcucauugagggaauggacugugucucauuuguguacccaagaccaagcaaagaaucugggcugagagcagaauggaauaaauaagaaaacuagaacaugaaccuauucuuaccuauuccagugugggcccuguaagaagcuuuaugggcagccauguucugcccauuucuccaaauuagaagaaacaaaaauaaucacagacaugagagaaauggagaauuccaaaaguaccuuuuuuucuuuuauaaccucagaacugacaagggagagaaggucuaucaucaucagcagcucuuuaaugcuuaucagaggaggugaagaacggcugaucgugugacuuucugccagcuagagaaugaaguucaaacuccucagcaaguuggucaaggcucucugucuuaucuaccacuauuucucaucaacccuuccuaugaaucacucauuuccuguuaauauguuccauauuuuuauuuuuacauuuuugccuuagcaagggugucuguccuuggccuagcucaaauggcacuuaccaaaugaagccuucccuacucucuacuccuccaccucaaacuggaagccacagcuucuuccucuguguucucuuagcacuuuuugcuuuacuaaagcauuuuuagccuuuuauaaaguguguguuuuuacauccccucagaaccugaugugauguaaggcgcacagcagguaugcaguaaguggcugcuggacugagagacagagucaacagaguuggucaucaauucaaaauggaaauggacagccaagguagcaaggaaauaaagauaaguaauguggcuucucuucccaaauagcaggauacgaucuccugggagcuaaggagauuuccacaugagaaucagaaacuuaugcguuccaaaugaaaccacaaacauuccacagcccaugcaaguaggucaagccauucuccuaagucuaaaacugguuugcgcuuuuaguuuuuuuccuccaagaaagacaaguucuccuaacugaauuccaaucauuugggucaauguuuuaaaagcuugguaucuuagcuguuuuuauuuuaaacuuuuaauccuguacauuccugucaagccccugggaccagacaccaagcucagcuuucagcaggccuaauauaacaucacauacucuacauuuuuguggcauaccaguguucuaaacagaaaaaaauagauuguguucuaaaucuugccuugcuauaugcuaaaaacauucuuuuggacaaauauguuugacuaaaccacacucaaaacuuacuuuucucuuuuucugagcuuccauaaucuaccucuuuacuuucuccccacuuaaaaaugucuucaggccaggugcgguggcucaugccuguaaucccagcacuucgggaggccgagguggguggaucgccugagcucagaaguucgagaccacccugggcaacauggugaaaccccaucuccacuaaaauacaaaaaauuagcugggggugguggcaugugccuguagucccagauauucgggagguugaggcaugagaaucgcuugaaccugggaaguggagguugcagugagccaccaucaugccacugcacugcagcuugggcuacagagugagauuccaucucaaaaaaaaaaaaaugucuucagacugacgggcccuauaucauguucuggaaagcaaacaaauguuugcuuaugaccugguagguaaucauuacagucuuagggugcuagggauaaagaacacuaacaaugacccacuugugcaggaguagcaugauuuccugguugaucucucugccuccugucaucucauagguagcucacagaaucuuuuaaaaaauccugauugugccucuacucaaaauucuucaguggcucuccauuugcuacaaguaaaagauaugccuuuugugacccucuuccagacuccuccaggcaaaggcuuucauuaaaccuuuaaauaucugcaucacagcaacuaucaugguccuaagaguccagccccaugucuaucucucccaaagaucagaaguccuugaaaaauacauuaguauucccagcacuuagccugguaccagggagauaguugguguucaacaaauguuugcugaauaaaagcauuaaaacccaaauaaauagaacuuaucuuccuauuuaaacuauaauuucaaucuucgucccuaauuuucuccccagggcucaaaacaaguaauacagaugagaaagagaagggagaacaaaauaagagaccaucgccuccacuagugcauagcggggaauacaaagaguuuauaaaccacacaccaucacugugcagcagccuugucaaaugaauaggguaucucauuggcugaaccuagcgcucagugcaucaucccccuccagcaggcaucagcagcuuaggaggaaggggccuaaucuaccuaggcauuauuacugugcugaggccuaccauagucaaauauaagcaacaacuggcaaaucacaggggauaucaacuucaugccaaacaauaaaacgaaccugauuuccaaagaaaacuuuggguuuagccucaaauaaacagauauaaagaccauuuuaaagaaugucagucguauagcagcuggcugacuuaauuuuuguaaguccucauuaguggaaaccucuccaaaaacagagauuauuuuuuuggggguaauuuaucuacauaauuuaaauacugcacucucucaacuaauucuaguauauggaaaacuauuuuuaaaugggaaugcagcuaacuucgggacagaguguaugauuucuuuuuaaauagaaauaauuacaauuuuaggaaguacaacugcucaaacaaauguucaaagcucucaaccucaguuuuuuauuuuuuaagcaucuaaaugagcuaaaacugugcaauucuuuagccauugguucaaaucauuagcuaugcaguguguggaauaaugucugcucaauaauuauuuguugaggaaaugagugaaugauaauguaauccucagcauaauuuuuuuuaaaaagcuggcauuuauaacaacauuauucuauaauuacaacaucaaggccagcaagguaaugacauucuuuuaaguauauccaccccguaaaauuuaacacuaacaaucaauauuaaugccaaaggaaguucuggagacagaagacuuauguguuuucuuucaguguuugaaggauaaagccuaaaggagaugcucaaaguaaguaaaaugagaaaaugugcaguuucuuguguugaucuauagaaaggaaacagaggcaugguuuacauaacuccuuaauuaggaaaccuauggacgaagccucauauuagaaaaagaaaagccagcugauuaauggagcacauagacuugaaauuuuccuagaugaacuuuccugagcagagccagauuuuccuaaucugguaaucuucuaaagucaaauccaaaagucauuuuuagcucguucacucaaacacauucuuaguaccuacuguguguuuuagauaaugcucuaggauguugggaugcagaaagaggaacaagccaaaaaucgguugaauaaagggagauauuauagaucuuucuaaaaaggaauguagaagauaugaguacuugauuacaaagugauugaaggagcgcuaucucauuacaugcuccugauuuucgcagucugauaaagcagucagauaugccacauuaaaaaaacagugaucucugucuauuuugagauaaacacagaaacacagggaaaauguucaaggucugauucaaacaaauuuuauuacuucuuuggggaaucauuuugggggacagacacccuauaaaauucagcuuggggucaguuaagguguuacagaucagaguucauuaagugaucuuauaugaucaccacccagaguaaaaucaucauucugugaggggcaaccuucuuaaguugucaaguugcauaaagaccaaugugauuuuugugcaacauagaagacaauauaaaucccccaaauaacacauucuuuaaagcagagcuguucaauagaacuuuguguaacaauggaaauguucuauaucuucacugucuaaugcaguagcuacuaucuacaugcggcuacuaggcauuugaaauguuguuagugagacugaggaagugaauuuuuauuuuuauaaauuuauauuuaagaagccauauaugccuaguggugacuguauugaauaauaauucaguuaugaacaaaauaaaguuugcauuauuuacauucaggacaacaagaaugacaucugaauuaauccuggagguagaugccuaaaguaaaaaagaaaaauauauggguugcauaaaucaggagcucuuugugggaaugguucaaucacaacuccuauugcaccacaguggaaguaauaagauggcugagaggguagaggacucacgggagauucugaaggaggguaaucaaggccuauuccaguugaguguuuuuuuuaaauggaguuuuuuaaaacuauauaagaaaugugagaauuacacaacaaauuguccaugucccuuuguuuuguuauaauuggcagaucuuaaggaacuggaucugcacagcugucacuauuugucaccucuccucuguucccuguuagcuaccuuggggauccuguagucuguuuuucauuucacaucuuuggucaugaguugugcaggaagcccacaauauuuuagauuuacauuuuguuguucugcuuauuuaagccauuuaguaagcauuuuaaauccguuccacuuuacauuuucuggcuaccauaucuaacauauuuaaaggagaaggaagccagguaugguggcucacccuuguaaucccagugcuuugggaggccaagguuggaggacugcuugaggccaggaguuugagacuagccugggcaacauagggagacucuaucucuacaaaaaaaaaaaauuaaaaaauuagcugaucauguggugcacgccuguagacccagcuacucgggaggcugggaagggaggacugcuuaagcccaggaguuugaggcugcagugagcuaugauagcgccacugcacuccagcaugggcgauagagcaagacccugucgcuaagaaaauuuaaaauuuaaaguauuuuuuuaaaaggaaaaagaagaguauauuuuuggggagaaauaaaggaauucacaacuaguaaggacuucuauguaccaaguacuucucugccacuagcucuauaaagcagaugucacuauuccuucauuuuggaugaggaaauugaagcucagggauguuaaauagccagcccacaaucaugcaagugggcaaugacacagcucuuauagaaaccuaaaucccauggauccgucaaaucuaucuuuuuuccugcuauaguacacugcuuccuaaaccugcuucacaauguaauuuucagaaacaaauuccacaguaaaaaugaugguaagccuugaauuuuucccccuuaguuucuuccacaucugucaauccauccacugccuuauuaaagaaacaaagaaaagaaaaaagagaaaguggucuuuauggacugguucuggaauauuuaaaaggaucuaaagccauugcguuaggagguuuugcugucuuuuaguuuuuaaacacaccauuuuuaaaaguuaucaagucuuuaaaucauaaaacauuacugaaaggaguaguuuaaaacugcaugcaaaugacuuguugaacguauuaaaaaaggaaauuuccaaaugccaucuaaaauacuuguuucauuaggaaaaauaacaaaacaaaacccccuuagcuuagaacuauuggagucaacuuuauuaccuuuccaaagaagcaaccuuguaucauaauguauuauacccuacagagucaaguauauagacacuugagcacuuaaggaaaacuggacaauaucuuauuggcaucacuuuuuuuuuuuuuaagacagugucucccuuugucacccaggcugcaaagcaguggugcaaucucaguucacuguguccuugaccuccugggcucaaggauaaucuuaacucagccucccaaguagcugggaccacagguacaugccuccacacucggcuaauuuuuguuauuuuuuguagagaugggguuuugccauguugccuaggcuaaucuugaauuccugagcucaagugaucugcccaccuuggcuucccaaagugcugggauuacaggcaugagccaccgugccuggcagcaucacauacuuuuaaaaggaaggcaacagguagagagaaagcuaucuuucugauagggcaucuauaaucauuuuaaguuuuugaaugcaaagugaugauguuuuuuuuaagucuuaaauuuuaugucugaaaguacaugacuucuuuuuuuaaaaaaaggaaaacaguaggagcccuucagcauuuuacaagaauuuagugauuaaggacauuaaagucuaguggcuaagaucgacucgauuccagcugguuaaacuccuacugguucugugacuuuaggaaaagcacucugccucgcuuucuuuaucugaaaaauggggauaauaacucuuaggaugguugugaggauuaaaugagcuaauauauguuaggcacuuagaauauucacagaggcaaugcuuuauuuuuuuucuaccagucuucauaacugagaauacaaugaaauaaaauaauuauuuauuuauuuuauuuuuauuacacuuuaaguuuuaggguacaugugcacaaagugcagguuuguuacauauguauacaugugccauguuggugugcugcacccauuaacuugucauuuaacauuagguauaucuccuaaugcuaucccuccccccuccccccaccccacaacauuccccggagugugauguuccccuuccuguguccauguguucucacuggucaauucccaccuaugagugagaacaugugguguuugguauuuuguccuugcaauaguuugcugagaaugaugguuuccaauuucauccgugucccuacaaaggacaugaacucaucauuuuuuauggcugcauaguauuccaugguguauaugugccacauuuucuuaauccaaucuauuguuguuggacauuuggguugguuccaagucuuugcuauugugaauaaugccgcaauaaacauacgugugcaugugucuuuauagcagcaugauuuauaauccuuuggguauauacccaguaaugggauggcugggucaaaugguauuucuaguucuagaugccugaggcaucgccacacugacuuccacaaugguugaacuaguuuacagucccaccaacaguguaaaaguguuccuguuucuccacauccucuccagcaccuguuguuuccugacuuuuuaaugaucaccauucuaacuggugugagaugguaucucauugcaguuuugauuugcauuucucugauggccagugaugaugagcauuuuuucaugugucuuuuggcugcauaaaugucuucuuuugagaagugucuguucauauccuuugcccacuuuuugaugguguuguuuucuuucuuguaaauuuguuugaguucauuguagauucuggauauuagcccuuugucagaugaauagauugcaaaaauuuucucccacuuuguagguugccuguucacucugaugguaguuucuuuugcugugcagaagcucuuuaguuuaauuagaucccauuugucaauuuuggcuuuugcugccauugcuuuugguguuuuagacaugaaguccuuacccaugccuauguccugaaugguauugccuagguuuucuucuaggguuuuuaugguuuuaggucuaacauguaagucuuuaauccaucuugaauuaauuuuuguauaagguguaaggaagggauccaguuucagcuuucuacauauggcuagccaguuuucccagcaccauuuauuaaauagggaauccuuucaccauugcuuguuuuugucagguuugucaaagaucggaugguuguagauauguggcguuauuucugagggcucuguucuguuccauugaucuauaucucuguuuugguaacaguaccaugcuguuuugguuacuguagccuuguaguaaccaaaaaccuuuguucuuuuggcuuaggauugacuuggcaaugcaggcucuuuuuugguuucauaugaacuuuaaaguaguuuuuuccaauucugugaagaaagucacugguagcaugauagggauggcauuguaccuauaaauuaccuugggcaguauggccauuuucacgauauugauucuucccaccuaugaacauguaauguucuuccauuuguuuguauccucuuuuauuucauugagcagugguuuguaguucuccuugaagagguccuucacaucccuuguaaguuggauuccuagguauuuuauucucuuugaagcaauugugaaugggaguucacgcaugauuuggcucucuguuugucuguuauugguguauaagaaugcuugugauuuuuguacauugauuuuguauccugagacuuugcugaaguugcuuaucagcuuaaggagauuuugggcugagacgaugggguuuucuagauauacaaucaugucaucugcaaacagggacaauuugacuuccucuuuuccuaauugaauacccuuuauuuccuucuccucccugauugcccuggccagaacuuccaacacuauguugaauaggagcggugagagagggcaucccugucuugugccaguuuucaaagggaaugcuuccaguuuuugcucauucaguaugauauuggcuguggguuugucauagauagcucuuauuauuuugagauuugucccaucaauaccucauuuauugagaguuuuuagcaugaaggguuguugaauuuugucaaaggccuuuucuguaucuauugagauaaucaugugguuuuugucuuugguucuguuuauaugcuggauuacauuuauugauuugcgaauguugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucuguuuuuugguugugucucugccaggcuuugguaucaggaugaugcuggccucauaaaaugaguuagggaggauucccucuuuuucuauugauuggaauaguuucagaaggaaugguaccagcuccuccuuguaccucugguagaauucggcugugaauccaucugguccuggacuuuuuuugguuaguaagcuauugauuauugccacaauuucagagccuguuauuggucuauucagagauucaacuucuuccugguuuagucuuggauggguguaugugucgaggaauuuauccauuucuucuagguuuuccaguuuauuuguguagaggugucuguaguauucucugaugguaguuugcauuucugugggaucgguggugauauccccuuuaucauuuuuuauugcaucucucugaaucuucucucuucuuuauuagucuugcuagcggucuaucaauuuuguugaucuuuucaaaaaaacaguuccuggauucauugauuuuuugaaggguuuuuugugucucuauuuccuucacuucugcucugauuuuaguuauuucuugccuucugcuagcuuuugaauguguuugcucuugcuuuucuaguucucuuaauugugauguuagggugucaauuuuagaucuuuccugcuuucucuugugggcauuuagugcuauaaauuucccucuaugcacugcuuugaaugugucccagagauucugguauguugugucuuuguucucauugguuucaaagaacaucuuuauuuccgccuucauuucauuauguacccaguagucauucaggagcagguuguucaguuuccaugcaguugagcgguuuugagugaauuucuuaauccugaguucuaguuugauugcaccguggccugagagacaguuuguuauaauuucuguucuuuuacauuugcugaggacugcuuuacuuccaacuauguggucaguuuuggaauaggugugguguggugcugaaaaaaauguauauucuguugauuugggguggagaguucuguagaugucuauuagguccacuuggugcagagcugaguucaauuccuggguaucccuguuaacuuucugucucguugaucugucuaauguugacagugggguguuaaagucucccauuauuauugugugggagucuaagucucuuuguaggucacuaaggacuugcuuuaugaaucugggugcuccuguauugggugcauauauauuuaggauaguuaguucuuauuuuucaauugaucccuuuaccauuauguaauggccuucuuugucucuuuuaaucuuuguugguuuaaagucuguuucaucagagacuaggauugcaaccccugccuuuuuuuguuuuccauuugcuugguagaucuuccuccaucccuuuauuuugagccuaugugugucucugcaugugagauggguuuccugaauacagcacacugaugggucuugacucuuuauccaauuugccagucugugucuuuuaauuggagcauuuagcccauuuauauuuaaaguuaauauuguuaugugugaauuugauccugucauuaugauguuagcugguuauuuugcucguuaguugaugcaguuucuuccuagccuugauggucuuuacauuuuggcauguuuuugcaguggcuggaacugguuguuccuuuccauguuuagugcuuccuucaggagcucuuucagggcaggccugguggugacaaaaucucucagcauuugcuugucuguaaaguauuuuauuucuccuucacuuaugaagcuuaguuuggcuggauaugaaauuguggguugaaaauucuuuucuuuaagaauguugaauauuggcccccacucucuucuggcuuguagaguuucugccaagagaucagcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuguggcguucucuguauuucccgaaucugaauguuggccugccuugcuagauuggggaacuucuccuggauaauauccugcagaguguuuuccagcuugguuccauucucccugucacuuucagguacaccaaucagacgcagauuuggucuuuucacauagucccauauuucuuggaggcuuuguucauuucuuuuuauucuuuuuuucucuaaacuucccuucucgccucauuucauucauuucaucuuccaucacugauacccuuucuuccaguugaucgcaucggcuccugaggcgucugcauucuucacauaguucucgagucuuagcuuucagcuccaucagcuccuuuaaggacuucucugcauugguuauucuaguuauccauucgucuaauuuuuuuucaaaguuucuaacuucuuugccauugguuagaauuuccuccuguagcucagaguaguuugaucgucugaagccuucuucucucaacucgucaaagucauucuccauccagcuuuguuccguugcuggugaggcacuguguuccuuuggaggaggagagugcucugcuuuuuagaguuuccaguuuuucugcucuguuuuuuccccaucuuugugguuuuaucuacuuuuggucuuugaugauggugacguauagaugaguuuuugguguggauguccuuucuguuuguugguuuuccuucuaacagacaggacccucagcugcaggucuguuggaguuugcuagagguccacucuagacccuuuuugccugggugucagcagcgguggcugcagaacagcgguggcuguagaacaguggauuuuggugaccugcaaaugcugcugccugaucguuccucuggaaguuuugucucagaggaguacucggccaugugaggugucagucugccccuacugggggaugccucccaguuaggcugcucgggggucagggacccacuugaggaggcagucugcccguucucagaucuccagcugcgugcugggagaaccacuacucuccucaaagcugucagacagggacauuuaagucugcagagguuacugcuguccuuuuguuugucugugcccugcccccagagguggagccuacagaggcaggcaggcccccuugagcuguggugggcuccacccaguucgagcuuccgggcugcuuuguuuaccuaaucaagccugggcaacggcaggcgccccucccccagccucggugcugcauugcaguuugaucucagacugcugugcuagcaaucagugagacuccgugagcauaggacccucugagccaguugcgggauauaaucuccuggugugccguuuuuuaagcccguuggaaaagcacaguauuagggugggagugacccgguuuuccaggugucgucugucaccccuuucuuugacuaggaaagggaacucccugaccccuugcgcuucccgagugagguagugccucgcccugcuucagcucgcgcacggugugcugcacccacuguccugcacccacugucuggcacucccuagugagaugaacccgguaccucagauggaaaugcagaaaucacccgucuucugcguugcucaugcugggagcuguagaccggagcuguuccuauucggccaucuuggcucccgaaauaaaauaauuuuaacuaaugucagcuaauaaaaauuuauagagaugccaucaaacaugguacaauuaguaaaaauuaaauauuuuacugaggcuaucaugaaagaaauuuugguuuaauaagaaugucuagaagauauuauaauuucugauauauuaugcugucugaggguauacaguaaguaaacaguacauuuucauuuuauaauaugccucacaaaauaucaaauaaugggaaaaguccaauaagcuguuugaugauaaaaucuguuccaaguugaaaacgguauccaagauaguaguuuagguaaacuauaguauguuuccccuacucccaaaucacaaaaagcuucuggaacuuagaauggaagucuucuucuuacacaauguauuuucaacugcauauggguuguuaugauuguguuucccaaaaagagauauuaaaguauuaucucccacaguguuaccauaauuuucuggccuucuuagggacuccuuuauuuccaaguacacuagcuaguguuagaauuauuuuuccuuagaauaaccugacaaaggaaaaggacaaagaagaaaggagaugagaaaugagguaaaaaaacuucaaugauagaugccacugguuuccaaacagucuaaggauuggucaguaguucauaugaaucuugcuugugcucugcauguaguaguccaggcuacucaccucucuccugacuucauggaagaagagcacugagaaauccuuauucugccucaggcuuugcuuuucagaaggaaggaaaguguguggcacucaagggagacagguaagaagucacugagcauucaaggaagacgagugaagaugaucagagaauugcagaaucuuugcauuggcaggcaccucugaaguaauuuagcucaacccucuuugcagugcagcauccuccucacaauaucucugagagaugguccaucagccucugccuauauaccuccaauaacagggaucuuuacuuuuuugagucugcuugauccaagccagaaaucugggauacauuauagauucuuuacauuauccaaucuuguguauuuuucgucuuaaauaucucucaaaucugucuacuguccccccucccacuaucuuaguugaggccucccuuucucaugccuuugugugauccugcaauaguaucuaacuaccaaauuuccugcuaccaaauaauccacauacacauggcagccugcaggauggauguuuuaaaaaacaaaucuaauuguguuauuccucugcuuaaaaaccuuugauggcucacuaacauaaacagcaaaaagucuaagguuuuagccugaaaugcaugacacuggcuaacucuccacuucacauuucagcaacacuaaauguuuguggugccuacaugcaucuccaugauuuugcucauauuguugucucugauuggaauauucuuucuccccuuugucagcuaguuaaaucaguucaggaauuaucuccagaaagguaucuuuugacacccuccucuguguaauauuaaaaauauaccauguguauaucucuaucacuguauuuauauuacacugaaauaauuaacaaguucaccucuuuccccccaggugagucccucaaagcaguguuaauaacccuuagcacuuggcacagggcucaugggugcagguguuuaauacaugccuaguaaacaucagaacguuuuucugaugugacuuaaaauuuguaacuccaaugguccaaauucugcuucauggagcaauaaaaaccaucucuccaagaaaacagaacauuuggcuaguacagaaaaaggcaaaguuuaaauacuacuuauuggacauuugcacuuaccuaaguugcuguauguugcacuacaaggguucggguccauaggaucugaaaugucuucuuuuccaucuucccuuuccaguucagguagggacaaugcuguugugacugaagugcagccccugccaucuugcuucccaacaacaguucuuggaucccgaggagaaaaauccucuguuacuucaugggucaugugacugaaacaaaucagaccacuugucacacugguauuggaagguucuacuaaaauuuagauuuauggaaggcauauacuucccauaaauguaaauaacugguccuauagucacaauacacuugucugaacacaaggcaguacuucauuuaggcagauacuucuauuuaccuugauucacacauauugagaacccaauuugauagagcagguaugguagccugcaagggaacuugagaauaacagucaaagagugaaacauuuuauuuaggugggagguggugauguuggugguagaaggagcugaauguuuaacuggcuaaagacaaauauacucaaguauuuaguaaaguauuuacuauacuuacuaauuauaguauucuaauacuaugguaaauaucaaguacuuuacuacauaguuuuaauuuauauauaguauuuaguacacacuuuaguguguacuaaaucaggaucaggaauaaaguugagauuaaacuaacugcauaaggaaguuaagccauuguuuuaguagguacacugaggccaggaaggucuuguugccaagagaauagaagcaucaaccuuugccugucugcaugcagcagggaaggcaaauggaaaagaaaguucguagucuaguuaaucucauuuauuaaaaugaaucugaagcauccuccuggcugcauaccaguauaugaccaaucuuguuuuaccauugccugcucauaugcuuauagcuacuucuucccaucuuccccacuccccaaucugccugaacugugccaauucuguugcugguggagaaaacuggccuaguuagaaaaucucaauggacuggucaauuaaauuaauucaaaaucaugcaucuuuaaaguuugcugggcccacugaaaaguauuccuagauuaucacacauucauuagcuauuuuuccugguuucuuuaugaaaaaaagaaagaaggaaggaaaggaaacauauaugauuacagguuauuuguggauuuucaauuggcagugagucauggugacauuuaccaguuucuuuaaagagguacuuuguuugaucgugugccaucagaacauauaucgccuguggauuuaagggaguagaucuaaaggcaaaggaguacccucuuaucaauuuuucauuauggaaauuaugcaugugccuggacagaaaaauaagccuugaugucugcuggauauacaacuucaaaaauauccuuucaaaguuggcagagccagaggucucucuauacugggaauaagcaaugagcuggaaguuccauuaggggaucuggcucuugaggacaguggugagguuggaaggaaucacuuuucuagcagucaagagaguaguauauauaaaggaggccucacacaguaaagcauacugccucuucucgaugggcugcccucggucaucaacccaaaagaggggcuccacacaaaguugguuucucauaauauggagcaccauaaaaucaagauaacaugggggaucuaucuccacgcauuagggaagacaaaacaaagugacacuuccaagacacucagguaccacuucgugucaagaguguauauuacugaguaguuaucaacaugcuucaagaaagggaaaauguuuucuggcaaaaguuaauagaaaccauuucuaguuucaaagcaauaaauauaaagucccuuaaaaauaucagcccccuggccagguucaguggcucgcaccuguaaucccagcacuuugggaggcugaggcgggcggaucacgaggucaagagauggagaccauccuggccaacauggugaagcccugucucuacuaaaaacacaaaaauuagcugggcaugguggugcacgccuguaguuucagcuacuggggaggcugaggcaggagaaucucuugaaccugggagguagagguugcagugagccgagaucgugccacugcgcuccagccuagcaacagagugagacucugucucaaaacaaaaucagcccccacacuugaaagaaaaaaaaauguuaaagcuccagacauuuccugcucuaaagucagcuuuagagguuuccugaauagcuguuucuuggcuccuaaucucuucagacuuacuccugccuucuuucuuucuccaucuccugguuauuacuaaaagaaaguguuccuucccauuugucaaaaaggguuggugaaggguucagaagccacgauuccauccucacuugccuguuuucauccuaggcaaugggcuauuaacaacaaagcucaguuauagugaaaaccacagaaaaaacugcagcuauuaaccuaugaggaacucccugggcccgcugcacauguguacauauaacacagcucuguacucugaagagcuucacaaaauaaaacaugaauacuuaaaagcaagaaauauuagaaaacucacccgcugugcucacuaacacaauuccccauuaaaggaaaauuucacagggccuucucgagucuguuaaucaugcucugacacucagauaaaccauagauuccacugaguucuggagagcuacaaguuaggcaaaccaugagaaaaggcuugauucuguuccuuaauaucacucacugcaccuugacccuuaccuuacugguuuggucugggaaaugugccaaauuaccuuuggggaaccaagcaaagugaaagcuaguuuuauuaacccuuugcaaacuaaggcagcacagccuauauuccagauaaagauugguuuuuaugagcacauuuuaaauaagugcacugguauauuaaaucaucaauuaaaguaauugucaacucuaaagaacuacgcaaauagaguugauaaaaguaaaaucacauggauuugcaaauggaugcuaaaagguuuaaucugcauuuacagugacagcagucucuaaaaggaguaagaauuuaaaaaaugcaucagugauaugucaugucuuaaugcuuaaaggaagaauagcucuuuguaugauuaaaaugauaaaagaggccaggcgcaguggcucaugccuguaaucccagcacuuugggaggccaaguggaucacaaggucaggaguucaacaccagccuggccaagauggugaaaccccgucucuacuaaaaauacaaaaauuagccgggugugguggcaggugccuauaaucccagcuacucgggaggcugaggcaggacaauugcuugaacucagggggcagagguugcagugagcagagaucaugccacugcacuccagccugggugacagagugagacucugucucaaaaaaaaaaaaaaaaaaagauaaaagagagacaggggaaaagggagagguucucagaguuuaagguuagauauaacaauauacuaugacuaaaaaauaaaaaaaauugagaaaaguagcagagaagguugauucagucacuaaauauaaacaacauaaacagacaaaucauucaggaagaaagaaaaaaaggaaaaucucugauuaauuuaucauuaggcacauuaauuuaguaagggaauuuaaggcugggugcgguggcucaagccuguaauaccagcacuuugggaggccgaugcagguggaucaccugaggucagggguucgagaucagccuggcuaacauggugaaacccuaucucuacuaaaaauacaaaaauuaggugggcgugguggcgggugccuguagucccagguaucggggaggccgaggcagaagaaucgcuugaaccugggaggcagagguugcagugagccaagauugugccacuaacacuccagccuggugacagagaaagacuccaucucaaaaaaaaaaaaaaaaaaaaaaaaaggauuuaccauugauuuguuccauauuuggacauaaaaucagaaaacucaaauacuaaagugauacuuuacaaauaucagcuuuaucuccuaacaaauguuuuaccaccaacauuucauuaggagauguuuaaugugauggagaaaacaauaaaaugggaauucgaaccuggguacuguuucucuauugcuuugauuuucugaaugcuuugauuuucugaacaaacuugauggcaucaagaaagaguuaguggaaaaaauaaaaauuucccccauuucauccaugagacagaugguaaaaaaauuauuuagagugaaaauuacaagaaaucugugagaauuucuuauauacuauauguuagcacgucuuaaaauggcaaauaaugaccaguguaucuaauuuuuuuucagccuaaguacaauuugauauugauuacuauaaaacaaaauuguuaagugacaaauggcccacuaagaggaaguuaugguuuuuacauuucugcuauuuuaauucauguugaaacacuccuacuuccguaauaacuaugguguugauaucuagguccuugaucuucagguugggucaaacucugacuuggccuacuuuuuguccugaaccuucagcguuccuucugcuuucacagacagacaacacagaagacaacauaugugugacuauaaauucuucaaccaacuuuccauuaaugaccaguuuuuaauugagauuugguaugucugaccuaauacuuaaaaaaccaugucauaaucuccacaaagacaaaucauuuucugaacaugcagaaugaauauaagguguucaaaggaaauaguuacauuguuacagauuugucuguuauauaaacaaaucccuuggaagguuguaucucaucagucugccauauucauacauaauucaaagcugcagaagcaaucuccugugggaagcucacuugguuuacccaggugguagagauuaaucauuacaccaucuaaugaaauaauccuuuuuuuguuucucugggauauucguucaagacagauuuuuguaaaaauuauguuaaaugucugaguguacuuuuuaaaaaggcaaaucaaauuccacauuagaacaggauaaggccuuuaaauauccaaguauuuccacaauuucaguucaauccuaucuucaaauucaaccaccuucacucagcuucagaugagacaauaaguaaaaucugacuucuagagacuaccugccucuugggacaaauguuauucugaauuccauuuguuagcucuguucagcagguacacaugucucuaguugcccacgacagccaauaagcaaaugugugacuuuuaaaaccuccuuuuaccccgaaaaaucagacuaaagcacauuagaaacaaaacgucaucguuuuguuacugguuuccagagcugcguauuucugggguugcuggggauaacggaacucugcagaugugggaucuacauuaacacaugaaaaggagaguucaaaguuaucaaaucucacaccuuuguaaucuacugaaagggagaaaaaacaaaacaaaacaaaacacucccauuucuuuuugucucucuaccuuuaggaccuccuacgaaugugacauuucuuaaucuuuaguuuccaggucaucaacuugauuuugccacacuuuccaaucauugacauucucagauagagaagugugugucuacugaucacuaucuagugucuccaauuuucugcuaagccuucuguagucuuuaacugaaaauguugaauuucuuauccugaacugagauuaaccuuuaucugauaucugaugaguucugcuaauauuucuaacauagucuggucaaacaaagguagcucuuacuggugugaaugaaguagcuaggucucgagauggggaagacuggcagcaaugugcaaggucuugaaugaacucuaauuuucugaaauuguacagauccacuuuuuuuaaaaaacagacucaaauagcaaauuaaaagugucuuuaaggcaccagauuacaagacaacaaagcauauaaaaacauagcccucuguaaaucacugucacuuucacaauacuaagaaaaauuacaguuuuaaaauccuaugaaauacaaagucagaauggcaucugugcaaauuaacagaaaagaucaauuaauuuuggaaaacagcaauaaaauaugguugccauucucaauaagaauaacauucucaauaacagaaguagcuccuuagcaucauaauuuuggccuugauucacucuaaagaauggggugagauacugauaugcauuuccugaaaaggcaagguauuagaagaaaacacccauagccuucuccaaggggacuaacccaggaaggauguugaacaggcuuucuuucuuuuuuuuuuuuuuugagacggagucucgcucuugucgcccaggguggagugcaauggcguaauuucugcucacugcaaccucugcuucccagguucaagagauuuuccuaccucagucucccgaguagcugggaugacaggugcccaccacgccuggcuaaauuuuguauuuuuaguagagacgggguuucacuguguuggucaggcuggucuugauauccugaccucagaugauccaccuaccuuggccucccaaagugucgggauuacaggugugagccacuacgccuggccuuuuuuuuuuuuuuuuugagacagugcucuguggcccaggccggagugcaguggcacgaacucagcucacugcaaccucugccucccggguucaagcgauucgucugccucagccucccaaguagcugggacuacaggugccugccaccaugcccggcuaauuauuuuguauuuuuaguagagaugggguuucgccauguuggccaggcugaucucgaacuccugaccucagguaauccgccugccucagccacccaaaguacuuggacuacaggagugagccacugcgcccgacccuuggaacagccuuucuggggccccggacuuuuuuucccuaaugcccagaagcaauggagaagcaagucagugcaccuuuuuucacuuuccucuuaucucccucugcucuuugagucagaguagggagaugcugagaaaugauaacauacacuuaacuccaaaaacacugcaggcugaccgaggaaauggauguagggcaggaaugggaccuauagguacucagaacacccagcuacucagcacugcacaagcugugcauuuuuccacuuaauucaugaaaacucuucaggagguagcuacaauaauucucauuuuacagaugaggaaacugagauugaaagaaguuaaaucaauugccuaaaauuacauggguaguaagguggugguagaguugggaucugaauagauaccaugcaacucuaacguaaauguuccuuccaccacacuguuaagauaaggcaagcuuggcauacugcagaaacccagcaauaaauacuugauugugaagaugaagaaauaaaacugcuuuuacuuuuaguuagaagaaaaaaacagcuauuauugaaagguaggguauuaaugauuacagauguauuuuacuuuugaaaauccuaaauaaacaaaccaaaaaaguuaauaauuuacauuuccaaaaaaauuuuccuuaaauugaagcugcucuagcuauagaaugacuguguuucuagauauuuggcuuccuaauaauaaucacuaccaccacuaucccuacauuuaccgaaugcuaggcacugugcuuaaauaucuucaaacaauaacacugaguaaggcuuauuauucccauaacagcaaauaauaauaguggccaaaauuuacauagugcuuauuaugugccuguuuuaagccaugcuuaucaaaaguggggcuauugacauuuugggccaggugauucuuuguuguggagggcuauccacauggcaggauuauaacagcgcuucuugccucuaccugcuaaaggcuggauguuggaauuacccccucccaguugugacaaccaaaaaagucuccagacauugucaaaugugccccgggggggaaucccaucccccuuuaagucucacaacaacuuacuaggcaggcuauuuucuguguuuuauaaaugaagaaauuauagcccagagagauuaaguuacuugcuucagguaacacagcuaguaacugguggagcugagauucaaacccuguagcuuagcucuaaguguuuguccuuuaagcaguuacauuauuugcuucucaguuucuagaugagaaaacugguaagcagagcucaaguaacuuauccaagaugacacuaaugugacaaaagcaggauucaaacccaggucucggugacuucaaagucuacguucuaaaauauuaugccaauggcuaccaaacuuucauguaccuaagaauuaccuggggagcuuguuaaaauugcagguucucagcucccaucucuagggauugauuuaauagcuuuggggcauugcccaggaaucugcauuuauauacuccaggugaugcaguuggucccaggaacacauucugagaaacuauuuuucacugccuuccuccuccagaaagaacacaagaauaaguauacaagcagcaaggugugaaaagugaauagaaaaauuuucuucagaagugauauaagcaggaaagggcaaauaaaauaauuugaauagucacagaugagaaauucauaaugaacuaugaaaaagcagggaggggguaauaauuuggaaccauuccuaaccuucugagguuuauucuuagucaguuuacuucucugggauuauauuaccucccaaaaggaaaagaaacaaagcugucugaagacuaccccauucugguacauauaaacauaaccauacuguaucauuccaugauuacgauaaaguaagauauuuaucaguuuucucuaaaacaugauuauuuaaaaauuuaacaguaaggacuucaugaacucaucuuaacuuuaggaaaaaugugucagcaaauguagaugugauuuuuauaagugcugauaguccagaaguuucuuuacagcaaaauaacaugugaucaggagacagagcagcuauuuucagcuucuguuuucaauuauuuucucuuuaugagaaguagaaguuugaucuuggggccaguuucguccuaagcaugaaaagacaacuuugauaggauucucuuaguaaaaaggagagguaaugcaaauuuuuuuucuuuuucauuauacuuuaaguucuaggguacacaugcacaacgugcagauuuguuacauauguauacaugugccaugucgguuugcugcaucaauuaacucgucauuuacauuagguauuucuccuaaugcuaucccucccccaugcccccaccccacgacaggccccggugugugagguuccccgcccugucuccaaguguucucauuguucaauucccacuuaugagugagaacaugcgguguuugguuuucuguccuugugacaguuugcucagaaugaugguuuccagcuucauccaugucucuacaaaggacaugaacucaagggagagguaaugcaaauuaagauauaacuggagcauuagcauuaaaacaauugaagcuucuaacugaauuuuccagagagaaggacaugacauuuuaccagucuaagaagugcugggauuuucauuuuccaugccauauguacaugcacauaugcaugugcgcgcgcacacacacacacacacacacacacacauauuaauaggccuauauugguuacuauagagaguaccaaaccuuuccaguauuuggcuggaauggcuguaugucauuaacaugccugacaaccacagacaaaucugauauuauggcuuaccagggguaagcgaacuucuguaaaaggccacaugguaaguauuuuaggcuuugugggccguguggucuccacugcaauuauucaacccuguuguagcuugaaaacagccauagacaacauguaaaagaugaguguggcuauuuuccaguauaacuuauuuuacagaaacagguaaacaaguuggaucuggcccaucggccauaguuugccaacuccuggucuacacccuugaacucuggaguggauuagggggcucucaggauugacuccuggauuacugaggaauacaguuuagcuauguaaggucuuugagaagauccaaaaggacuuggaaggguaaaggaagguugauacagaugcauagcauuccuaagugugcaaagaaagguaugucaaauucagucugccuguccaaaccagaaguugggguuuggacagaaucccagcugugcuagacauaguuggauuccugagaugauucuggaaguccuaaagaaacgacuuacaucguaucccagauguacaugccgggggucuuugcuaauuagcagcaugaaauucaggggugguagauuuagaaagguuagcuaaaggccauucaggcagcaaaugauacccuuaacuuuagcuggaguguuacuuuuauuuucuuaaugucuacauuagauuuuucucauuagaaaaaaacuguuugaauuaaauuuuaguucauauuuuagagauggugagaagggggccuugcuauguugcccaggcugaacuugaacuccugggcucaagugauccuccugccuuggccuccaaguagcuggaacuacagaugcacacuacuaggccugguugaacugaaaauuuaagcacagguuggcaauaggucuugucaaccaaguaugaaaacaauuauuuacguaagagugagacugagugucuaaacugggcaauuuguguugggagguauucuuacauugaggaacauaauuuggacacagaauuuaugccugaaaacuaaauuaacaugcaaguaacuacggcccauuggccauaguuuuaaucaauaaccaaguguuauugguuaaauaacacuaagauaaccaugauuuuagucacuaaccaaguguuuaccaccacagcuuauugaaagaaccacuaaaaaugguauuugucaagaagaaggaaacugaacccagaagguaggaguaaaaugaagaggguacuuggcuguucuaaagcgauuagguuaccaggggcaagagauuaggcagagagcucaaucaggaaauacauuaguaaacaggucagagaugaugguaguuuggaccaagguaguagaagcagagguuagagagaaguagauaauuugggauauauuuuggagguugaaucauccaacauuuuggauguugggggugaaggaaacagaagaaucaaagaugacccuuaauuuucuggcuugagcaacugaaugaauggagggccauuuaccaagaagggaagaguugugauggaacagauuuguagggaaaaauuaagaguucuguuuuggauauguuucauuugaaguggagauaucaaguggaaaauugcacaugauucuugggggaagagaucagggaugaagauaauagggucauccgaauauuuauaguuuuaaaauuuuugauacccgaugauguuuagccagggguuagcuacuaggguuuaaagaaccccuuuuucauauaugacuauaauggaaauaaaaaguugcuucaagauaauggggggaagugaauagaggcagagacagaacaagauugguuauaaauugauaacuguugaagugugguuuugugguaaacggugguuuacuauacuagucuaucuacuucuguacauguuuaaaauuuucaaucauaaaaaguuuaaaauaaaaugaaaaaaaaagagaggaccaauuuuaagauagucccaauuaaaagguaauccaguagaacugauugcaaagucaauauuauaaacaaggcacuuagaagaaaaggaagccagaauaacuagagguucaugaauaagaggauaagauuaagcccaaaauguuaggauuaaaagguaggcagaugccacauauguagggccuucuucaguguggggaguguggggauauaacuagauuuacauuuaagaaagaguagguggcuguucucagaauagauaucagggggcaagauauuaagcaaggaugauauuaaauucugguuccuuaggcauaguuuuguaaugaggucaacuccuauugcuagauauuaugcugacguuuuacagauauuauacauuuaguacucaaaauauguccguaagguagguauuauuauucuuaugguauagguagggaaacuuuagcucagagauacuaagucaaaaguuacaacuacucaggguaagucagaauucaaaucuuuggcuacagugcuggcauucuucccacugugcaguauuauucccccaugugauggacaccaaagaguugcagaaaugguagguagguagguaccauuuuaaaaaugauaguugagaaauuccuaacuggucacagaccagauuaaccaccaaauuaguuucucugaauccaaacuugccacauagaaauggugccuggguacacguucuugaacuaaaauuugacccacuagugucccaucuucuaaccuauuuucaauauuagugccagaaaauauuuuauuaaaaaaaucaugcuacuuucccgcuuaaaaacuguuuccucuacaaaaucuacaagauaaaagccaaacauuucaacaugucauuuacagccugucucagcacuucucaaacuuuuuggucucaggauugcuuugcacucuuaaaaauugagaaucacauggacuccuauuuguacagguuauaucaacugacauuuaaaugagaaacuggaacugagaacaucugaaaauaauuaauccauuuuauuuuaaaaaaaacuuguuuuguggcaacauagauggaacuggaggacauuaugcuaggugaaauaaugccaggaacaaauguuaaacaccacauguucucacucauauguggaagcuuaaaaaaaaaaguagaucucauaggaguaaaaaguagaagagagaauacgauaggcuggaaaaaugggggaagaaaaggauaggcagauauuugucaaaggacacaaaauuacaacuagaugggagaaauaaguucuaguguucuauggcacuguaggaugacuauaguuaacaguaacauuauuauauaguuucagauagcuagaaggaggauacugaauguugccaacaugaagaaaugauaaauguuugagauaauggauaugcuaauuucccugaucugcucacuuuacauuauauguauugcaacaucacuacguacaccauaauuaagugcauuauguauaauuuaaguauuaaauaaaaauuuaaaaauuaaggaaauaaacccaguaaauaguaccuaaauaauauuuuuuucaaaucuuuuuaauaucuggcuuaauagaggacaacugaauugccuuauuugcuucugcauucaaucugcugugauauguugcuuugauuaaaguauaugaaaaauaucuggucucacccagauucauaagcggaaaaaggaggaguauuuuaauagcuuuuuagauaacuguagauauucuuugguaccauaccagaauuugauaagugguaguuucuuaaagguuaguugcaaugugaaaucugaaaccauaucaauaaacuuuuuguacucaguuacauucaaagccauugaucuaucuugcaguuugaauggauuuuacucauguauaauuuuauaauaucaugcauuggguuauuuggaaauuauugguuuacugaguuaaugcagauccucuaaauguugacauauuucauuauauaauacuuuuaaaaguuugcaaauucaaccaucaaucucaucagaagaauguuuaaguauuaggaagcuguugaggucaugguggcagauauaaguuuuuaaaaauucuuauuucugcuuaaaaauuuggauuuuauaucacugacaacaaauacaguuaguuguuuuccuugaaguaauagguuuguuuuguucauucuuaagaaaauaucugccaaacacucucagauuugaauaaccacaguuugucugucaguuguucuuucaaggugguucaugaaagagggggcuaguucagcuucacaacucaaacuauuucacaaguauuuuucuuugagaaaaccaucauacuuuguuacacagcagaaguauucuacguguacuucccauuuaauuacgcagaauuuuuaagaagacagguacuccuggguugagauuuaauuuacuucaucaccaagggaauucuuacagggucucacccugucacccagguuggagugcaguggcgugauuaugguucacugcagccuugaccuccugggcucaaacgauccuuccaccucagccuccugaguaccugggaucacaggcacacaccaccaugcccagcuaauuuuuaaaauuuuuaguagagacaaggucucauuauguuaccuaggcuggucuugaacuccugagcucaggugauccuccugccucagccucccaaagugcugggauuacaggcaugagccacugugucuggcccaccaagcacauuaagugaaacucacuuaaaaacaacaacaacaacaacaaacucuccuaguacaauauggugccauggcuuugauuuaugcuaagaugcaaguaguuuuaaccacuguuguuuaugcaccaacaaugcaacugucaacacaaugaaaaagacaagugucuuuguauuauaaaaauaguaacguuggcaugaucacuaauugaccuuacauggaccauacuuuaagaaccaauggacuauuuuuaaaauuuaauuuaaaaaauuuuaaauuaacaaauaauaauuguauauauuuaugggguacaaugugauguuuugauauauguauaugcuguagaagauuaaauaaaguuauuaacaaaucuaucaccuuaccuauuuaucuuuuuuuguggugagaacauuuaaaaucuacuuuuuuagcaauuuugaaauauguacuaugucauuauuaacuauggucaccaugcuguacaauagaucuuuaaaacuuacucuuccugucuaacuggaacuuuguacccuuagcaaacaccucuccuuuccccaucaaccccaccucacccaaaagccucugguuaucaucguucuauucuuuccuucugaguuugaauguuuuacacccacuggauuauucauuauccuuuucuagccacauguccugcuucuguuugccaccaaccucaccucugugacuuugcauauauuguugcuuuggccuacaaugucuuucccagccagcuggcaaaauccuauuugucuuuaaagaucugcuuuggauuuuauuccugagaagucugcauuaagcugaauuaaucacucugaacacauuguuuuagcauuuauccauugaggguagagggccuaauaacauuuuuaagcagucaaugucugccagacccugggauaagcuuuuuauauguuuucuaaugaaauuuucaaauuacuucuaugugauagguaucuuuauagccuuguacacugaaggaucagacacauauuugaaguucaacccaagcccguuauuucaggauaauguuucccccuauuuguuccagggccugauggcaaauacauggcacaguuaagacacucaauuuauauuuccuaaacaguuaaauaaaugaacuuaguaacaaucuaaucccauaaugaagggcucuauaaaguuccucaucuuucagagccuggggucuggccuuuaguacaguauuuuuucguuuuucauucuucauuccuuauauacaguuuagacuugaaauauucauuuauuuauagaaaaacuguauuuucauuucuuucagcagugagcucccagccguggggugguaauuuaaugaucacacugccaucaagccugaaacacaaauguugacauuugaugguaauguuuuccuuaucaaaguugcuucaaguaaauaccaaugguguauccaaguaaaugaggcaauuauugaaaaagcaaaugguauauauuuuucaaugugcauauucaugcuuuaaacuuuucaaaaaguuaaaaaaagcuacugaauaccucuuuuucuacuuagucugggacauuaugaaaugugaaaacuccaaugugccuuaaagaaaaguuuaauaucucccaagguaauuuacagauucaaugccauccccaucaagcuaccaaugacuuucuucacagaauuggaaaaaacuacuuuaaaguucauaugaaaccaaaaaagagcccgcauugccaagucaauccuaagccaaaagaacaaagcuggaggcaucacgcuaccugacuucaaacuauacaacaaggcuacaguaaccaaaacagcaugguacugguaccaaaacagagauauagaucaauggaacagaacagagcccucagaaauaacgccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaucuaaaaccauaaaaacccuagaagaaaacccaggcauuaccauucaggacauaggcaugggcaaggacuucaugucuaaaacaccaaaagcaauggcaagaaaagccaaaauugacaaaugggaucuaauuaaacuaaagagcuucugcacagcaaaagaaacuaccaucagagugaauagacaacccacaaaaugggagaaaauuuucacaaccuauucaucugacaaagggcuaauauccagaaucuacaaugaacucaaacaaauuuacaagaaaaaaacaaacaaccccaucaaaaagugggcaaaggauaugaacagacacuucucaaaagaagacauuuaugcagccaaaagacacaugaaaaaaugcucaucaucacuggccaucagagaaaugcaaaucaaaaccacaaugagauaccaucucacaccaguuagaauggugaucauuaaaaagucaggaaacaacaggugcuggagaggauguggagaaacaggaacacuuuuacacuguuggugggacuguaaacuaguucaaccauuguggaagucaguguggugauuccucaggcaucuagaacuagaaauaccauuuaacccagccaucccauuacuggguauauacccaaaggauuauaaaucaugcugcuauaaagacacaugcacacguauguuuauugcggcauuauucacaauagcaaagacuuggaaccaacccaaauguccaacaacgauagacuggauuaagaaaauguggcacauauacaccacagaauacuaugcagccauaaaaaaugaugaguucauguccuuuguagggacauggaugaaauuggaaaucaucauucucaguaaacuaucgcaaggacaaaaaaccaaacacugcauguucuacucauagaugggaauugaacaaugagaacacauggacacaggaaggggaacaucacacucuguggacuguugugggguggggggagaggggagggauagcauuaggagauauaccuaaugcuaaaugacgaguuaaugggugcagcacaccagcauggcacauguauacauauguaacuaaccugcacauugugcacauguacccuaaaacuuaaaguauaauaauaagaagaaaaaaaaaagaaaagaaaaaaaaaaagaaaaaugcuaacaaauaaaguuuuacauuuuucaaaaaaaaaagaaaaguuuaauaucucaaucacugcuuuacucagacuauagcauguaucuuuauaaugguggugagaccagcaguucuaagugugacccaaggaccagcagcaucaguaucacccaggaacuuauuagaagugcaaauuaucaggacccaccccagaccuacugaauaaaaaacuccagggguggggaucagcaaucugugucuuaacagcucucuagaugauucuggaacaugguuaaauuuaagaaccaaugggcaaaugaacugugcuauuuggauucauggauguuaacuucaaaaaacggauacauuuuggaagaccugacuggccuauguauaaccuaauugugaaaauaaaagcuguauaguaagaggucugccaagcccagggccugggcugcccucaagccuauauaccguggcaugcagccaaaggagagagucucuuuccacagaaagaagccgaacauuucuugacuaugccuucuaagauguggauagauacacuacagugguacuuaaucaggaaugacaccauguaagaacugucuaccauucccuccuauguaacuccaaccauuugcuguuuaagcugccucuuuucuaaauaaaucaggcaccugaaauacauguuuuuuuuugagauggaguuucacucuuuuugcccaggcuggagugcaauggugugaucuuggcucagugcaaccuccaccucccgguucaagugauucucuugccugagccucccaaguagcuaggauuacaggcaccugccaccacacccagcucauuuuguauuuuuaguagacaugggguuucaccauguuggcaaggcuggucucgaacuccugaucucaggugaucugcccgccuuggccucccaaagugcugggauuucaggugugagccaccacacccggcccugaaauacauguauuuuauuacuacuggaguacauucugucauugaauaccuuaccauggaauauaacauucaacuaccaaugacaagacuguucuuucuaggacuaccauccuaguugcuuuguuacuacauggauuuaaggaaaacagagacuuguuagcauuuugacaacaauuuggagguauguaaaaagcucauuuuaguaaagaauguguauaaaacuuccuagcauuuugcuaggaaaaguaaaagcauuaaguguucacuucauuuuuuauuauacuuuuauaaagaaaaacggguaaaucugccccauccaucagaauuugcuauguuuguaagaaagaagggcaggcccuucuuucuuuacuucuuacuuuaaguaaggagggagaaggacucagaaucagaugaauggaguacucagggcauaucuuuaagaauaaaaaggacaggaagcauagggaaaucauccuauuagucacaaacuugggauaaaaguuccuuguuuuuacuggcaguuaauucauuuuguuuacaauauaaauaagaaagaaaaacuuaggcuuccuaaacauauguauuuaugugaaugauuacaagugagaauauaacaauuuuuauugaucuuguguuuaagaaugcaaaauuauaaggaggauacaugcuuuagaaugagagaucgagguuugaauuccagcucugaaaagcacuagcuuugugacucuguucaauucuuaacuucccggguuuucaguuuccucaucugaagaauauagcaaauuuauaaggauuugagauaaauauuuauuauauaccuugcacagaauaggugaucaauaaauaguuauuaagguauucaagaaaaugaaugccuagagaacugauuuggguaugcaaucugucuagcugaacugaauauuauacuacugggucucagucucaauacucaacuucuccuauuucacccacaugcuaaauaacuauaaauugcuugcuuaccacccuccauuuuuuuccacaacacuuggaaggaggacagaaagagacagcaauaaaaaaacaaauauucccuuaaaauaaguaaugcauauagagauaacaccuucauaaaaaacaaaaagaauugcuggaagagcuuuauuucauuuacagugagggaaagaacaguaccaccauuuauucauuugauccuguuucuuccucacacuaccaucacauuccaaaacaacacauuauuuauugcuauuaagguguuauggauuugcuuuucuaugcuaaaguuccucugcauucaccagaaugcaguaggcuacuuaagccaaagauccagggcuauaaaccuuguucagugcaguaagaucacuuuaauacuauucuaaucuuggaaugcaguuauaaagauagaugauggccacagagugcuacuuacaaacagaaaugguucuuaugcaaucuuaaaagauauaaaaaacuuagcaccugaaaauguguuaaaaaauucccauauucuuccagucuauuuuacauaccugagaaucuuuuuaggaaucugugauggagaagaaugacuccucuucuucucugaguccuguaguaaugcauucucugcucuacccuucuccaugacugcugccuggucuguccuagccuugcucugauccacacugagcuggccuugagcagggucgcaccuguacaugaagacaauggcugguuucucacuggacucuccuuucgccucugugaaccagugauggcgcugaacuggaggaggaggcagcaugugaaugacugugccauccaggcccaccaguuucccuuucucucgcucuuucucuuugucauccuccucaucuguuuuccgacggcggaagaagcuuuuaaaugauauccagcgcuuagguuuugcaucagcugcccgccugcugccuucagagugcaaaacugauucagcuucuguugaccugguagggcugguuggcuugguccaguuggugaaaugccucugcaaaagguuaccugcaugguaaggagaagaaguagagcguggcgggggaaagggagcugguggcucacuuugggggcuagucacuaauuuggagggagagggggugacuggcuuuauggaugggucuuucuguacuuuggugguaggacugucuguggucugaggugcuucagccucaccacuaggcugagauguaaagagagauuugggccggacuggcguacucuuaggugugcucuuagcaacaucagcaucuggaggaauggcauaaagcucuuccacacugcaagcuuuagggccagauugagguguuucuggaggagacuguggggguuggauugaagccacaaucugagaaagcacugugcuugcuuucucucuggugcugcugcugcccaccaucugagacuccugagugccuucuauuuuggccacaggcucuugaguggcucucuggaucuuugcuggggagcuguggcuggaacuauagcuucucuguggugaagacugaccucuguugagacaguuguuaaacucuugaaccuucugagccacugagccccuuuuaugcucugugcuguuugaaaacccuuuaguuugaagacagucagugguuuugcuagugguguuaucaggcacuuugcuuucuguuucuauuucuucauaaguauggcuuauuacacuugugguuuuuuccuucacugagaguucuccacuuguucccagaaaacuuuuguagauagcuagauugucauaugcauuuggauugauaacaaugggaacuuugauagcauuuuuggaacuccgagcauaaguuggcucgucaugaaugauaauuggaaaagguggcauaccagcauuguuauaacuauuaaauuuaauuucagacaaauuaggugacuuaacagggaugguuuuggaggaaauguuuguagcugugggugauguaggugcugauuugugacaguuuuuccuuggaggaacauuugguccaguuccacuaguaauuaguucuacuuuagguaucuuuugucguggacuggugcuagaaguccauacuucuugguaucgaauugcacuggauuuuuggaaaugggcacuuauuuguccuggugucaaugaagaugauguaacuggagaguuuggaguagaggaugagcuuuuugucuuggggcuguuaacagggcccucgaggugcucacuggccauggcugcugacacauccacgacaguauauggcuugcacaauggcuguuccagguucacaacucgguaagguuuugcuugcucuucuguggggacaagguuuaugguuacugcuugcccagcaacaucuguagaggcuuuacuuucuuccuucucaguuuguacagcaaucuugccaucuuucucuucuaaucggagagcaaggacugcuuugugggucucuggaacuuuuauugagcuuuuggaagccugugaugaaucuuuauccugauuauuacuagagggacuuucauaauugggcucaauuuccuucauguccuuagaaucuccuggguuaccaggagauaaucccccauuacaaaucuucugggauaaacuacuggcugucucagaacgugauucuucuguuaaagaagaaucuggugauguggagucagaugacaccaugcucugaaugcuuccuuguccauaagagaccacagaauuuuccucauaaccauucaggauuucaucauagcugucaucauaguccacagcacagauucucugcagagacuuguuucgcagggggaugguauuccauuuuuuguccacaaagaaucgaacaggagacaauguguuugcucugaaguuggcaaagcgagguugcccucucaugcgaaucuccauggccaacagcucuucaucacucucaucccaacucucgugcuccuccuccauguuacugaaaaguacauccucuucacucuccucgccacuggaaaacucuggguaacagaaccggcccccuucauuacuaaucacuucugugcucccacucagaauaacaugcuugcccugaguuuccuuuaucccaccuaucaugcaacuugguggaagcuuucuuuccaaugaucguuuauagcaaucauuuauucuucccaagaauguuucucuggaguuuguuucauuuccucuuaucugaggggcaguauccaagccugcuaucuccuuuaacacuucaguuaguccauuauuguuaucugacaucuucuuugcacuaucauuauugccauaaggcuuaggaacauggcuaauuccuucaucaucuucauuauuauuguuaagugguuucugacucaaggcagcucuguuucgguuccacccuaugaugacagguuuguucucacaguguucuuggaugcuaagcucaccacauauacuuugcccaucugccacuaucauagugggcuucacagcuauaguggguuuuuuagccacaggaggccggaaauugcccguguuccugaugcggugguuguuacugugauuggcauuaguuuucacauugccaugggugaugggugccuucucagggucugggggaagcuggugcaaacuuuuagguuuaaagcaauucuugcauucaccagguuuccaaacauguucaguaaagguguuacaagcagacauuuuuaaaaauagaacuucacagacaaugcuuuucuuucagugcaugacaaaacuuucaucuguuaguuuucacuuccccuauguguuacagcagcucuucuaagaaugaucaaucuguggaggggaaaagaagacaaaaaaucugaaugaaaaaggcacuaugagacuuaccauuauuagugacuugaaaaaacugacuccauuccuaaacuuuuccuuaaauuaaaagacugagagcuaaacuaauuuguguacuuuguaauuucccuuuagccaaucagcauuuggaaagugagcuuuuuaacuauaauuuuaugcacucuuaucuauccauacauaaucuucagcuugaugucucuguugcaaugauucugugaccuucccucccagaaaugccuuugauaccacuccuucuguuauccaccaauuucucuaacacuucccagcccauuauagauuccucuucuuccaccuacccuugaauguuuuagacauuucguagacuccucaaacucaaugcauugaaaaugaagcuucggggcugggugcaguggcucaugccuguaaucucagcauguugggaggcaggccaaggugggaagaucccuugagcccaggaguucaagaccagccuggcuaacaugauaaaaucccaucucuaaaaaaaauauaaaaauuagcugggugugguagcacacaccuauaguuccagauacucaggaagcugaggcaggaggauuguuugagccugggagguggagguugcagugagcagauugugccacaguacuucagccugggugacagagugagaccuugucucaaaaaaaaaaaaaaaaaaaaggcugaaaaggagaccaggggccagaucaugcaaggccuuuuaggcuuuuaaagauuauagaguuuauccuaagagcagugggaagccacugaagggucuugaauaggggaaacaacauaauccaauuugcauuuuaaaaagacagcucugaccaaaacccaugaaauucuuacguauauaaguccaacaaaauauguguaaaaucuagaaucuauaugagcaaaacuauaaaacacugauagaugaaggggggaagaagggggaaagguaagcaaauuauagcccagaggccaaauguagcuuauuccuguuuuuguaucccaagguuaaggaugcuuuuuauguuuuuaaaugguuggaaacaaaucaaaacgagaauaauguucugcaacaagugaaaauuauaugaaauucuaaauucaguacccacaaauaaagcuccauuggaacgccagucacacucauuuguuuacauacucauuugccuaugguggcuucugugcuacaauggagagaugaguagcuaugaaaugugugacacacagacuguaugcuucacuuuuacugcuuuguggcacucuacaaauugcaggauuuccacuggugcaucuaucagcugugugaaauuacauuuuucaaagauaauacauaaaauuauaaaauaaaauuaugaaauacguaaaauuucauuacagauaugaauuaauagaugaacauuuguaaucaauuuugaugagaggaaguacuaacuuugaacccccaucaagcacaauguuauccuccccaaaauggaauuucauucuucucacuagcaaaccucuguuauaaaauauuguaccuaaauauauuuugccuuuuaucaaaaacauuugccaaaaaaaaaaugacaagagaaugaagacaaaccccagaguaggagaaauuaugugaaacauucauaucugacaaaggacuuuguauuuggaauauauaaagaacuuucaaaacucaacaaaaagaaaaacccaauaaaaaacagguaaaagauuugagcagacacuuaaccaaauauauaugauuuuugaucuuuuuuuuugagacaggaucucacucugucacccagucugguguguagugguaugaucacagcucacugcagccucaaccucccuggcucaaucaagccucucaccucagccucuggaguagcugggacuaugggcacaugccacuaugccuggcuaauuuuucuauuuuuuuuauagagaugggguuucuccauguuguccaggguggucucaaacucuugggcucaagggacccagcugccucggccuccccaaaauguugagauuacaggcaugagacacugugcccagccaaagauacauggauugcauuuaaacaauauaaaaauuguaaauauaauuuacaauauuuauaauauuguaguaaauaaaauuuauaauauuguaaauauaauuagccacauggaagugcaaauuaaaacuacaaugugcuaccacuacacauuuauuagaaugguuaaaauaaaauuaaaacaaaaacaacugaugcuagcgaggaugugaagcaauugaaacucauauauugcuggugggaauguaaaugguucagguauucugaaaaacaguuuugcaguuucuuauagaguuaaucauaaacuuaccuuggagcccagcaaucccacuccuagguauuuacccaagauaaauaaaaacuuuuguuuacacuaaaaccaauacacaaagguuuacagccaaaagcuggaaacaaucuaaauguuagguggcagugguuacauaacugcauacauuugucaaaacucacagaaccggcagguaggcugggcgcgguagcucaugccuguaaucccagcacugugggaggcugaggcggguggaucacuugaggccaggaguuugagacuagccuggccaacauggugaaauccugucucuaccaaaaauacaaaaauuagccaggcauggugguguaugcccguaaucuuagcuacucaggaggcugaggcaugagaauugcuugaaccuggguggcggagguugcagugagccgagguugcauugugccacugcaccacagucuaagacaaacaaacaacucauagaacuacgcacuuaaaaaaagugaauuuuacuacauguaaauuuaccuucaauaaaccugacuuuaaaaagacagcucugcugcuauguagaaaauggacucgggaagaacaggacaggaggcuuaaaagacugacauaggcaaacuaagaucugaugaggaucuggauuaggauguggugucagggaaggcagagaaagaugcaggaaugacuggauuuugaagaguaaaaaguauugagguuuuagguuuauguauucaaaugauuauggagccauuuacugagaugacaacauuggaggaggugcaacuuuugaagggaagacuaugaguccauauuuugucacccugcauacaagacaguauaugaauuuaggagucugaaacauggaugagaauucugugguucuccucugcuuaggaauuacuaguauagagauauuuaggccgaaaagaaaauagugagcugaggagguggccuuggugggugaaccagggagaaggggcuacuuccucuccccuaacugaaaacuaacagccaaggugugaugacacagaagccagaugaggaaaugucaugaaggagaaagacaauaacuauuucaaaugcugcugagagguaacggaaaaugaggacuuacauacaugcccauuggacuuggcaacaugagcucaucugugaccuuagcaugaacuauuugguucagugguggggauggaaaccagacugcagugaguugaagagugagauaauagagcaaugguagauaacuuuuggagaagaguaggcaggaaggagaagcaagaaggagcuaggaggauggggguccagaaaggauuuccuuauuuuaagaugggaaaaccuagauaauguugaaugguaauauuggggaaagauacaggccagggugagaggcugaaaaaacaggaaagaggaaagaaucacaauacuuagaauguuaaaacugugcagguuucuaauucaacuguguuuuauggacaaaggaaucgaagccuagaagagacagugacuuuccuaaggacacacaguaaauaagaaagacccagaacugggacucaaggcuacaacuaccuacaauauguuuuguuuuuaccuuuuuugguagauguuuuuuucuuuuguuguauaugcucacuguggaaacucagaaaagcauaaagaaaauagaaaccauauguaaacuuauuauucagaaguaacuuuuauuaacaguuugggggcaguuccugucagucaccaagaauuuaaauuaaaaaauucccuguguacuuagcacuaugcagcacugaauacaaaaaagaauaaggcaucuuggcauaauaucuuguuaaccaaguuaaacagacucugauaagagugggauuaaguuuucucuuuguaaguaguacaauauauuugcuuuuucaaagacuaguagauaauaguaaaaauaauuccccacuuugaguaaaaguaaguuaauucagucaaaagauggcuaagcugauuaacagcuaucacuuaucaacagaauagccaaaugagacucaccaggaacaccauuugcuuaugucaguguugugugcacuaggaacccauguugcauaugacauucguuuacaaguuuguguccaucuguauucaucugguuuaaaaccgagacacuuauacauauguaacaaaccugcacauugugcacauguacccuaaaacuuaaaguauaauaauaaaaaacaaaaaacaaaaaaaccgagacaugaaccaggcaaacaccuuuagcaagcaccagauggagcugcugucuaagccacaaaaccuuaaccacgagggcuucauuuuaaacacuaauuauauuuggagacaaagaggugcacuuaaagacacugucaaaacuauuuuaaccuacaacagucucauagagggggaaucuguaccagaugcaggucuguccaaagagcaauccuuggguuuuacagccuuugugaaaugacuucaguggcaaucaauaacuagcagcuuucccugcucaacaccaacgcuccccaaaugggaaacuccagucuccaaaguuaugcuugagaaauaagaaaugugucuccugaggcacuuacacaaggaaauaaaacagucuauccuggugucuucuauuuauuugccagaacaggucugauacagagcacccaaauggaauguuugauaagaaaagcucauuuaccuccacauuccuuauaaucucaaagcaaaucuucuagaugaaauagucuaugggagaguuuaauggcugaagcugccccuaggagguagccaggauuccaugaucuaaaauccuauuucauauuugacaguuuucaggaccaaagcccuucaggcuauagauuaagcuauucaagaguggccuauuucacuucaagucaugacagcuuuuuaagaaccuauuacuguuuuuuauucucucuacugccauacaaugacaauaauuaguuugcuucuaguccaacaguuucaggcagauuugauaccaaaaaaaaaccccacaaaaauacaaaaaaacaacaaacaaauccacaauggauuucaaucuugaaauaaacuggccagcagaaagagcuggagcuccucaagcuggauucaauuuccauuagugaagaaaaggaaaguguguaggugggagauuaaacaccauauauacagcauuuccuaaaggcacccaaggagaaucuguuaauaauaaaggaggauggagaaugaacugcuaagcuccuccaauucugugacucccgaagcccaccaucucucuccauaaaaucugucacauugccauggaggcagagucaagaauccucacugcuguacgugggcuuuuaaggacacucucagugaggaucuauugccuauaugucaucccacauauuaguccaucuccaggaugcuagggaacaauuuacaagucaagguucucacuaggcuuuuguuaaagaacaugugggucacuuaaaaaaaaggaaaggaaaaugugacaaccauacccacgucacuguucccaaccuuuccuucuuccacagugaaaaaugcugaccugacaccucaaccagcugccaaacucuucaguauaugacuaaaaggguggggagaggaagugaaagcaaagcugcaggaagaaguuuugcagaagauaaaacacagcuuaaauuugguacacaaauggaaauuccaugaguaaaagggacuuucuugagaucugacugaaaaaaaaaauuaucauuccuugcuaucacaagaacaugagguucuccuaucuaaagaagaaaccaaaguaaaaucugcuuaauuuuggaaacuuaaugaaaucuccagaagcccauccaguuccaauuguucuaaccacaacaguuuuucuaacaguucacugcuccugucacaugguagucaucucaggauaagaaucauguaacaacaaaugcaccccugcaaagcagcaccgcucaguuccaacuaauuuuuaaauucaaacucuuugacgaaucaguuaacuacuacuaauaauaauuauuauaaacuugguaauaacuaguuauaagauuagaaguuccaaaauguucccugaaaccacuuuagaccccuauuuaagaagguauacaucagagaagaaguuaaaguauuaucuaauaacagccaagacuccauagucuuuuauaguuuuauuuuauucacaagcuuuuucuucugcuuggaauguauuuccucuaaugcuguuccauuuguugaaacccuauuuauccuucaagaugcaguuuaaauuuuaccucugugaugaaguuuugccuaacucgauuauaccacauuguuuuguaauuauguaaguccccagaaggcaggucuaaguguuuuuccucucuauaucucuugaauuguuuggaauacauuggauacuaaauaaauguuuucacucaagaauaauucuaguuagcauuuacuacuaaguaccaggcccuuuacccauaaaaacucauaauucggccaggugcgguggcucaagccuguaaucccaacacuacauuuugggaggccaaggcgggcagaucaccugaagucaggaguuugagaccagccuggccaacauggugaaacucuguccauacuaaaaauacaaaaauuagccaggcgugguggugcgcgccuguagucccagcuacucagaaagcugaggcaggagaaucacuugaaccugggagggggagguugcagugagccgagaucgcgccacugcacuccagccuaggcaacagagcgagacucuaucucaaaaaaacaaaacaaaacaaacaccucauaauucucacaaaacucuaugauagacauacuauuauuugcccuacuuuacugaugaagaaacugaaacuugcccaaggucacauagcuaguaaauggcagagccaggaugaaugcaugcaugcacguaugcaugcauaaaugguauagcuucauggcaucuggaggcugcuuuaaacauaaacauggcagugucugaaagacaguccacacagcagcagcagcagcagcagcacuguccaccauaguggaauuccaccaugaaugaagaaguguaagaaauaggcacacccacaccuuccccuccucagcucuaagaugaucaguccaggugcucacugcagaauaagccagaaggaaacaaacaggcauaaacuuagcuaguaggcugucucaaaguuguguuuuuuguguuucagaguguugaggaaguaauauuacgaggcaaauuaagcaugaucuuucauccagcucuccaagucaggaaccacucugauuuggaggggccacugaaguggcugguugagagugaguuggugagauguugcuaucagucaccuugcucuguuccucuucuccauugcccucaaccucagagccaacugccaagugaagaaagcuggacugcaggcuaaauuagggagucacagcugauugagaugugagaagacagggaauaagaaagagacuaaauaagggcagagcaaaauucaaauaagagaaggugggaaaaaggaaauugggaaggaaggagaaauaagaaaauaguuaaugauucuaagaaaaauccugcuugaauguuuauagccacauaaucagagugagcaaugucauuuucuaccacucuucacucauuuuuggaggcuuuauugucuuguguuacuuuauguuuggcaggaggcauuauuuuuccaauuaaaagaaauuuuaccuuucccagcuauagaaaagagugaacaauacauacuguaaaacauuuauaauuuagacuuuuaaagggaaaaaguacuucuaaauuaaugaaagucugaauuacacaauacuuugaagaaguauagauuuauugcuuuugaggaaauaccauaauaaacuagucuuuccuagugcagauauuuggaccuguucuaauaaauaaguuggaauuauuuucuuaaugguuguaaauacauaacuuaaaaugcagucaaagaauacuucucacacuggaaucugggauguguuuucaagggucuaugaguucuccaaaagagcugaauauuaaacugaaaguaaaguuuacaucuaaaauaaacuaauguaaacacaggcaggaucauugcaauggccauauuaacuaagcacagcaauauaauuuccaggacuacaaauaccuuucuguuucuaauaugagcugacaccaagcacacuacuuuaacuguaagaaauaaugagaaaagaaaggcucacuuaauauguagaugauacaguucuaccaaguaaagaccaaaaugacaucauggugcaaccacuguguauuguaccaaucuugaauuuucaauaccguagaaagaaauguggcauaagaagacagccaaugguaaugaaaacugcaaagaaaacuaggguggcuggcagcuccuuacccacacaguaagcagcaauuuaguuucagcaaaacuucaucuauuauauuaaauugcuguuaauuugcauuucauuaguuuugcaggguuuuuuuguacuuaacuuucaaauuuguuuuauagcuaaaugacaacuauaagcauaaagaauuuauaccuaacuuuauguuuuuuguauuuaaguaaaauuauaauaauguacgucaacacugacagagcacaguuauuuuuuucaguuaaaaggaggucuauaaauuaccaaaguuugaaaaguagugcuuaaaaacaauaaucucuuaugucagguaagcauuccucuugugaucuuauucacauuacuaauuugcuaagaaucuguuaaaggaguauaauaacuaccgucaaacaaagcucuuaugaaaaugaauuaagauaaaauauauaaaaugccuaacucgaaggcugauucauaguaagcacuuaauaaauauuaguuauuuucuccuuuuauuaaauuucuacauccagcggaggccaggaagggguaugaucccucuaaucuccuccacacauauccacaccccaucuugacauaccaauugggcacuugggaagcuauuucaaugggaacacuguuaacuaugcuuagguuagacuucaguuaucauggaugauuuaauugaaaguuuuagcugccuuguaaaccuguuuaagacuuauugcuucuacagggaaaacauacuccaaguucugagcaagugacuugcaaggaaacuuuagcauuccaucuuggacuuguguuuugcaucaauuucaagagaugcugucagauucuaucaggaaggaguugcugagcaauaagguaaugugauacuauugugcuuuaagaauucagguggaaauggaaagaauauauugacaggaggcaaggugaaagguaauguaguuguuucaacuaguauaauacuaguccagagaaggccccaaacuaauauaguggcagugggaauuaacaagcaggggcugaugugagaggcuaaauugauaauuuuuaucaaccagugggauaauaagagugacuaaagaugacccuguggucuguauagaucaaaacccaggaucaguuucccagagauauacugaaauguggacaaucaagcuagcaccaacugcacuacuuuaacuguagaaaaucaugagacagaugauguccgaauggaaauaacaaacacauucuaaaacaaaaugugugauuuaaaauucuucccauugagaaauauccagaucuuuaauuacuauuuacuuauguaaacuugacucuaaaccuugacugcaagugguuuagugagagcaguaaagaagaugcaggaugcugagguggaugagagagaaaaugaaaaaggcaaagugacaauucuuuaguuaguuuuauuuuauuacagaauaaaguuagaaaaaugagacuuggguuuaguaacugaagugaugaggccagugauggaccaugaaggaugggaacuguggccagggcauucgagaacuccagaugugcaugagcacaugacaauagguuuccacaggacuguucucaagaaaacagcagaagcucagacucuggggaguuacuggauauuaauauacaaggagaccgcagucugacagaggaaaaacuaaacuaucccccaauaaaaauaugcugggucuuaauucuccucaucagugagauaucuaccugugguuuguaucacuggacuacuaaagugagcccaaacaccucccaguggaaagugagagguggaaugccagccauucuugaagaggugcugggccccuggcccuugugggugccagagcacuaggaguauuuccauuccuaucguaaccacucaccaauuaggagaacccucagaggcacaaaucaacaacacucaaggccauugcuaauaagauuuguaaaaacagacaacuuaucaaacucucuaggccgaacgguccuuaccuuuuuuuuuaaaugaaaaaaaaauucuuuauauuauacaaguaaucagaaaauaaaaauaugcaaaaagcaaugaagaaacccccaaaucugacuacauacucuucugugucuuuuuucuguacacagaucaagguguauacgcacagacacacagacauauuucacagaaugaacaugcuguuugguaacaagaguaccuuuaaagucuuuccccaaauuuacaaucuauucaaaacauuauauacaugcaaauuuggguuaaaauaccauuuugaauuauucaaacaaauuuaacaagagacaaaugaaguuggagucagagaucuuuaauaaccugaaacaaaaauaauucucacauauaagaaacaccucuucucuauggauauaguuaucuggcaagauuaccuauucaggauacagcugaaaacuagacaaaguaggaaagcaccuuuuauaguuucauuuauagacucauuuuacacacaaauuuaauuugaucagcuuaaauuaguuuuauugaucuuguuuguacagaaauaaaggugaaugcucuacuuauaauuuaaugaauuauagcugucucucucaggcugccuuauuuguauauccccuauccacuuuacuaugaaccaaaugagacucuaauguuaauuugaguggagauacguguccaccgcucuuuuaaaaaagguacccaaauguccuuuccgcaauuacccuuuuaaaaagacugucaaccaggugugguggcucacuugaggucaggaguucgagaccagccuggccaacauggcgaaaccccgucucuacuaaaaauacaaaaauuagcugugcacaguggugcgcgcuuguaaucccagcuacuugggaagcugaggugggagaauugcucgaaccuggaaggcagagguugcacugagcagagauugcaccacugcacuccagccugggugacagagugagacucuaucuuaacuaaacuaaacuaaacuaaacuaaacuaaacuaaacuaaacuaaacuaaacuaaucuaacucucuagccaucucuucugugaucuugucuauucccaaauauuuaaggguggaacaacuuuccagaguuugccauauaacauauacuuuauaaucuauauuccagaauuauaccucuugcuccugucgucugaagcuccagacuucggcugccuacuagaccuuuccaaacacaacuaauuacaucuuuccuccaaaacacaguaugcucaaccuuuuucuagguaccauaacaguaaaugguaucaaaacauuggcagacauucagacugggucaacuuuugacuccuccugguccuucucaugcuauauccaaucaauugucagguuuuaucuuuccuaaucuguccucucccuuugacccaucuagcuauaacuugaguccuggauuuucauugcucuuugucugaaauacugagauaguauauuuugugucccaguuccucuaaaauacagcuccuuaacuacuuuaacucuucauaaagccauuaauuguucucaguugcauauauaauacauuuaaacuccuuagaauaaaauuuaaugcucuuugugaucugcuacugacuuaccauuuuuaaagcagccauuaucuccuccauguccacucauauagcaauuguucaaaauccuauagaucuuuugauccuccagucaaauuuuaauuccccugugaagucucacauccuccucuuagaauuaacugcucccuuccccagauucccaucauauggcuuuugcauaccuuacuccaccccccgacccccacuagucuuagcuccuugagugcaggagauauaucuuauucagucuuggcacuguauguuucuugaacagaugaauaaaugaugcucugcuaucugguuucauagaccaaaauaacuuagaaggagacagcagcauucagacagaaguggcaagugacaagugacuaccugacagcaaagggggagaaagaaaaauacaagaaccaaacuuaagaacugaaaaagcuuuuccaugugggcaaauagcccuauaucccuuaagggcaucacuauauuuuagaauagcacuguaauugauguugacaccaauuacagcaagauagcaagaaaauaguaaauuauguucgggguucuguguuuaagaagggaagcaaacaacuaaaaugugaaauguauuuuggaaagauuuuuaaacaacuuauuuuauuuacuauaaguuuauuuaauuauaaaauaauuacucuuuauagaaaacuauaaaaauaaagacagagaaaaaaagcacccuaaaucuuaguaugcauuuuaaaaacaauuuaggucacauaagcaccaaaugacuauucaaacugaaaauauuuuaaugcuuaaagagcucaaacccacaguuauccagaaacuuuggccaacuagaauucauucuuucaaaggaacauagagaacuaaaauuuuacuguaucauuaaaguuauuaacccaacucuccugucuuaacuagugacuggaaaacgaugagguggggaggagaugaggaaguggggaacaauaacaaaagauaaaaaauagaaggugagagaaaaagaaaugaacccaaaauaaauaaaagguaggaggacaaucaagacaagugagaggaagaauagaaaaacagagagaaagcauaauaucugagcagacacauucagaaaaaggacagcucuucuuucauuuuccccucucuugacuucuuuuguucuaauugacuucaggcugauguguguaaccuuagaugcaugcugaauuccaaugaaguccuccuacauguauacuuuauaccaaaaccauucaguuaaaaggauuuuaauuggugugcaccauucccugcaauuucaacauuuuaaaaaugaauagucucacuaaguaccagauggugacauguacuaauuaaucaggccuauucaaugaaugagcauauuaaaaugaaugcaccuauuagacauguguugccgacgcuccauccugaggaagccuccccucaaaugagugcccacggaaggugcagauuuacugugcaauacucacaagugucuucugcaauuauuugcaguagcaaugccaucacucuugugucucccuccagaucacucaauauuucaugcuaagcagcuggugagccuugcuaucccuguauaaucuguuuaaccuucguaagcaagagccagcuaaauauugggucuauaguguuucuacuaaagagaagaucuuacagacucaucaaggucauuuguuaaauggacaaugggugaaggacagaucaaaugaggcucuugauccaacucccuuccuccucaauuugucugucagccggugaaagccugagcacugcuagcugaaggaauaaaauagugcaaauggcaauccugcacgacagguugccaugcucugauuuuccucaaauguuguuagcauuggagagaaagguauauaauaaccuacugguaggucucggaauccuacuagguacucuuuuuugaaugugacagaaaucuuagaagucauuaguuuucuuagcuccucauacucaucacucuucuauuuuauacuaucuuggaucaacauaauuucaaauguauucuaauaguaggaaauuccccaaaucucucuaaauuuacugagaaacacugguuucuuauuuguugaaggcacugaaaacugagcagcugauuagguagggagacagcaaggcauacauaaaacaugggcuuuggagaaaaaaggguguugugacacaugcauguuaacugguauacagcaagcacuaacaaauguuaguguuuucccccagauaauagcaaaugguaggaaaaauaaucaacuuggaaggaaacaucacugaauaacagccuaaauaugauuacuuucagagaaacugagagguuauaauagaaaaugugauuuuuugguauacuuuaaaaauuaaaaacaauauacuuuaaccuucuaagacagcuuaauuaauuaauuaauuaacuaauuuacagacagggucucacucugucacucaggcuggagugcaauggugcgaucauggcucacugcagccucgaccuccccagggucaggugauccucucaccucagccuccugaguagcugggacuacaggugucugccacuaugccuggcuaauuuuuuuuuuuuuuuuuaagauacaggguuuugucacauuucccaggcuggucucaaacuccugggcucaagugauccaccugccuuggccucccauagugccgggauuacaggcaugagccaccacacccagacuaaaacagcuuggaagacagaauuuugagacauuugugcuuguuucugauacauggcaauagauauugcuuaaaaugagaauaucacccaaaagaaugcuuagggaaggauagccaaugacagaaacaacaaaauuuguaguuaccagaaaagccuccuucaugacaaaggccauuuuauuacuuuccuugggaucuugccuaaaaacaagaggugaaauuuauauauuauccaaacagaauuuaauuaauuuggacauaauugaaaguccaaaauagcaagaacauauucaucaagagguuucuaugcaaugauuaaauaaucuuuugaaaguuucuguuacuuuggucuaauaauuuuugauagauuucuguuauuuuuaaauuuuugguucuaccuuuaccuuuuuucuaccuuaauaauauuuugauacagcaucuagcagagaaguagguuuuuauaagagucuuguguucugagauaagacaaaacccaggaaaacaagacaucaaaaccaaguguaauuccuagcccaaacauuuaaaagaaaccauguuagggaacuaagaacucugacuaacugaaaggaaagcaaugauuuauaauaaucuaaguagaccacgacaauuuucagacuacaguugacccuugaacaacauggguuugaacugcgcaguucaacuuacauauggauuuuuucaauaaauauauuggaaaauuuuauggugauuugugacaauuugauaaaacucgcagacaaaccauguaaccuagaaauauuaaaaaaauuaugaaaaagauagguaugucaugaauacauaaaauauauggauaguauauuuuaucauuuacuaucauagaguauauacaaaucuauuauaaaaaguuaaaauuuaucaaaacuuaaaugagagaaauguaaacaaauguaaagauguaguauuaaauaacugcauaaguauaugaauaaccacauauuauaauacauacuauacuacuguaauaauuuuguagccaccuucuguugcuacugagguacacucaaguauucuaucugcuuaaaaggccaugcgaugcuaaucaucuccacaugaacaguucaucucuccaauaaauuguguauuauaguaaaaagugauuucuugagguucuuguguauuuaucauaucauguuuauuuuuagugcaaugcuguaaaccuuaaauaacacauaggacccauaugaaaugccaccagugaugcuggaggugcucccaagaagcagagaaaaguuaugacacuuuaagaaaaagcugaauugcuuguuauguacuguaguuugaggucuguagcuuuaacugcccaccauugcaagauaaaugaaucuagccuaaggaccaguauaaaaaacagaaaaugaaguucaugagccaucaaugcagcaaggcuagcaggcaugaaaaucuugcauuuuuugagaaauaccuuuuuguaucauauugaaaacagcauuuguaugggugcaggauugcuauaagaaagguauacuuagagacuguaauauuauucaagaaaaagugaggucauuauaugacaacuuaaagcaaagggaaagugaaggagcuagagaauuuaaugucagcaaaggaugguuugauaauucuagaaaaagauuuggcuuaaaaaaugucaagauaacaggagaagcagcuucugccaaccaagaggcagcagauaaauuccuagaugcuauuaagaaaaucauugaggaaggauaucugccugagcaggcuuuuagugcaaaugaagugcccuauuuuguggggggaaaaagccaccaaggacauuuauuucaucuauuuguauggaagagaaguaagcaccaggauuuaaggcaggaagggauaggcuaacucgacuguuuugcacaaauguggucagauuuaugauugggacuaucccuaucuauaaagcuaguaauccccaagucuugaagagaaaugauaagccccagcugccacucuuguuuauacagcaagaaggucugaaugagaacccuuuuuccagauugguuccaucaaugcuuuguuccugaagucagaaaguacuuugccaguaagagacugccuuuuaaaguucauuugguauuaggcaaugucccuggccacccagaauaccaugaguucaacacuguagauaucgaaguggucuacuugccaucaaacacaaugucucuaauucagccucuagaucgggggccauaggaccuuuaaggcuuauacaaaguuccauguggaaaggacugccaacauugugaaagagagcucugauagagagaacaccaugaaagccuggaaggauuaaacuguugaagaugacauuguuguuacagaaaaaguugugaaagccaucaagccccaaacaauaaauuccucuggaaaacucuguguccacauguuguacaugacuucaagggauuuaugacagaguuaaucaaagaaaucaugacagagacugcggauauggcaaaaauaguguaggguguguguguguaaaaggugucgagauauggcucuuggagacacugaagagcuaauauaccucacaucagaagaauuuacggaagaugacuugauggagaugacugcuuccaaaccagcgccagacaaugaagaugaagauguagaagaagcagugccagaaaacagauugagguuagacaauccaguagaaggauucugacgauucaagacugcuauugacuucuuuuacaacauggacccuucucuaugauacaggcacuaaacuaaagcaaacaauggaagaaagauugguacuguauggaaacauuuuuagagaaauaaaauagcaaaaaaauucagacaaauuacaauauauuuccauaaaguuacaucaagugggccuaucuuuccugccuauuuccaccuguucagucucuucugccucugucacccuugagauagcaaaaccaacccuucuucuuccuccuccucggacuacucaacgugaagacaagaugaaggccuuuaugaugauccacuuucacuuagucaauaguaaauauauucucuuccuuaugauuuucuuaauagcauuuuuucuccagcuuacuuuauuguaagaauauaguauaucguacauauagaauacaaaauaaguguuaaucaacuguuuauauuauugauaaggcuuauggucaacaguggucagguuuuugaggagucaaaaguuauaugcagauuuuugacuguguguggggucagcaucccaaccucuacauuguucaagggucaacuguacauucuaaaauucacuacucaauguauggucuguagccccagaccuacugaaucauaaucuacauuuuuacaagaugcccagguacuuuauaaacauauuaaaguuuaagaagcacucuacugaaaaccaccaaguuuuaucaaacugugaauauagcauaguagauucacauuuuacaguuuaaaaguccccucaauuugaaaaccauauucaauaucuaaaaggcuuuuguuuauuuauuuugaaaaucuacucauuucagaacuacugacaacaaaauuagaggaggagauaaacugaauaaagggcauauucaauagaaacuuuaauguuagcaggugauuguuucauguuugaaagaucuuccauuagggucaaacgugcuucaugucauucugcuugguagggaaaugguuaaauuucuucuuucuuucuauauuuuuccuucuaacuaauuuuagguaguacauauacauauagacucauacuuuaccauaacuuaccucuggaguaaaauauauuauuuaaaaaauuucuucauauacugugaugugagcucuuuaucaacuauguagaugcuaccaaauguuuuagcauuucuccucagauuuacaugucauacacuaaaugcaucaaguugaguucaagcaacucaagacuaauguuauugauuucagggaacagauuaguaaaaagggguucuaccacuccaugucuuuccaacuuuaagacauauaucaacccuuaguuuuacuguauaaauugauaagccuuugugucuuuuuuuuuuuuuuuuuuuuuuugagauggagucuaacucugucacccaggcuggagugcaguguugaaaucucagcucacugcaagcuccaccucccggguucacgccauucuccugccuccgccucccgaguaccugggacuacaggcacccgccaccacaccuggcuauuuuuuuuguauuuuuaguagagaugggguuucaucguguuagccaggauggucuugaucuccugaccucgugauccuccugccucggccucccaaaguacugggauuacaggcaugagccacugcgccuggcccaagccuuugugucuuaaugccacuguuuuccuauuuccaaacaucacaggccaaaguggcuaaucaagaaacuaaagauuuaccucauaaaaaaaugaucauuucugccucccuuugauuagucaaaggcucuuucuaguguugauaugcuagauauacugcuugaaguucuagcauaucccaaauauugcuuuuucaucauuuugguauaucauaugggaaaagcuaauucagaguuuguuuuuauguuaauauauucauggccacauuccaaggaaugccuagcaccuuggaauacagccugucacuuagcuaggggcauaaaugacuaacucagcauuguaucuuaaagacagaagcagaagcagaaucuccaacccuaacuguguuagaugucauacuuagaucacacuggcucccuuugugcaucugauucaucugcuuuuugucaaacuugguauucauuuuagacuccaauauuguuccaaaucaggcuaagcuuuaauauuaaagcagucuucuaguuaaagcugccuguaaucuaagacugggugcagucuuagaugcaguuucacauuuagucuuuuggaugcaguuucacauuuagcuauuuaaaaccucuauguucaagaagcaucauguuuucugccuggauuugugggguguugcucaauugcgcaccuugcaauuuagcacuagauuauuucucagauccuugaacaacauggguuaggagugccgaccccucaugugauaaaaaaucugcauauaacuuuugacuaccacagaaccuaacuacuaauagccugcugcugaccagaagccuuacucauaacauacaguugauuaacacauauuuuguacauuguauguacuauauacuguauuuuuacaaaaaaguaaacuagagaaaggaaaauguuauuaagaaaaucaucuuuggggcugggugcgguggcucacaccuccuguaaucccagcacuuugggaauccgaggugggcggaucacgaggucaggagaucgagaccauccugguuaacacggugaaaccccgucucuacuaaaaaaaauaaaaaaaaaauagcugggcauggugguaggugccuguagucccagcuacucaggaggcugaggcaggagaaugaugcgaacccggaggcggagcuugcagugagccgagaucaugccacugcacuccagccuaggugacagagugagacuccaucucaaaaaaaaaaaaugaaaaucaucuuugggaggccgaggugggcagacugcuugagcucaggaguucaagagcagccuaggcaacauggcaaaacccugucucuaccaaaaauacaaaaauuaccuggguguggcagugcgcaccuguagucccagcuacuugguaggcugaggugggaggauggcuuaagcccaagaggcagagauugcagugagcuaugaucauaccauugcacuccagccugggcgacagagccagacccugucucagaaaaaaaaaaaaaaaagaaaaacauaaaagaaaauguauuuaugcauuaagugaaaguggaucauuguaagggucuucauccucauugucuuaauguugaguaggcugaggaggaggaagaagaguagggguugguuuuggugucugaagaguggcacaggcagaagaggagguggaaggggacguaagagaggcaggcacucacagcauaacuuuuauugaaaaaaaucugcauguaaguggacccacgccguucaaacugguauuguucaauagucaauaaaacauagagacaauaaaaaucugggaaauaguagcugugaaaauuuaaaaaucauuuauauuauugcuugaauagguaggcaaagcagaauacaaugaugaaguuuuauucuuguguuuuaaaaucaagagcacaacccaaagaauaaacacaauuuugaugaagagcaaaauuggaggacugacauuacccaacuucaagacauacuauaaagcuacaguaaucaagacaguaugauacuggcaaaagaacagacaaauagaucaauggaacagaacagauagaccagaaacagauccauacaaauacagucaauugaucugacaaaggaaauucaguggagaaagcauagccuuuuucacaaaugguacugaaacaacuggacauccaaaaaaaaaaaaaaaaucucaauacagauacuauauccuucacagaaauuaacucccagugaaucaauggccucaauguaaaacauaaaacaauaaaacuccuaaaugauaacauaggagaaaauauagaugauggugaguuuagugaugacuuuuuagauuugacaccaaaggcaugauccuugacagaaagcacugguaagcugaaccucauuaaaauuaaaaacgucuacucugcaaaagauacugugaagaaaaugagaacacaagccacauagugauacgaaauauuugcaacacguaucugcaaagggacuguuauucaaaauacaaaaauaacucuuaauucucaacaauaagaaaaugaacaaccaauuuaaaaagugugcaaaagaccugaagaaacagauaaagacaauauacagauagcaaauaaaaagaugcaccacaucacguuauuagggaauugcaaauuaaaacaguaagguaccacuacacaccuauuagaauguauaaaaucuacaauagugacaaaaccaaaugacagcaaggauauggagcaacagaaacuuauccauugcuaucgggaaugcaaaaugguacagacccuuuggaagacaguauggcaguuucuugaaaaacuaaacauaacucuuaccauacaauccagcaaucauacuucuuggcauuuacccaaaagagcugaaaacuuauguccaaacaaaaccugcauguaaguguuuauaggagcagcuuggguggugagaggagcagcaguguccaggcagcccagcuucacaaaggcucucauugcgccgcagccugcaggcaccaggucauacccuccccacugccaagaugcccaacugaaggaagagcccaaggagauuggccugguggucagcuaaaucugcuccugcaaaaguggaaaggaagccaaucccagcacuuugggaggccgaggcaggugaaucacaaggucaggaguuuaagaccagccuggcaacauggugaaaccccgucucuucuaaaaauacaaaaaaauuagcuuggaguaguggugagcaccuguaaucccagcuacucaggaggcugaggcaggagaauugcuugaacccaggaggcagagguugcaguaagcugagauugugccacugcacuccagccccggcaacagagugagacucuguccaaaaaaaaaggcagcaggaaaggacaaaucuucagacaaaaaaguucaaaaaaagggaaaaggggaacaaagggaaaacaggccaaaguggcuaaucaagaaauuaaagaagauuuacgugcagaaaauggaaagacuaaaaacgaggcauguccagccuuugaugaagccagagagaaagaagccaagucugauuaauaucuuauaacaugucuuaucaguggucacuauuucucuucuuguacaauucagaggaauauuuuuaucaacuauuuuguaagugcaaguuuuuuuaguagcucuagacacauuuucaagaagcauggaaucccaucucaucccauuuuuuuuuuaagaucaaaugccuuuuuuuaaaaaaaaaaaaaaagaaguuaaauaauuugcuaguuuuugguacaacagaagaugguguaggauauugaguuaugggaggcucugacugucuuggguuucagcuuaacauuccauagaugaaggguuaguuuuaggauauaguuauauccuauaauacaaagcauacuaacuggcaauauggagccacaguucugcauuuaaucucuugaacauuuuaaauuacuccuauucccauguuguuuuauagcagaauugauuccuaaagaaaaauacuccuggcucauggcucuccuuaucagaauugugugcacucuguaacaucuuugguuguggcaguccuguuucccuaauaacuguuaaugugcugugaaagaugaaaacuuugaguauauaguguauaugcuauuaaauugugaauugguaggauguauguaacagcuuaugaacaugugaagaugcuugauagccaguacuugauagccauguaaggaaacugccuccaaauuuuaagcugggaagucacuggaauaacuuuauuauuaauuauuuuuuauuuuuuuuauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccccaccccaucacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguucguuccaagucuuugcuauugugaauaaugccgcaauaaacauacaugugcaugugucuuuauagcagcaugauuuauaguccuuuggguauauacccaguaaugggauggcugggucaaaugguauuucuaguucuagagcccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauagugguuuugauuugcauuucucugauagccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagacgaguagguugcgaaaauuuucucccauuuuguagguugccuguucacucugaugguaguuucuuuugcugugcagaagcucuuuaguuuaauuagaucgcaucacacuaccugacuucaaacuauacuacaaggcuacaguaaccaaaacagcaugguacugguaccaaaacagagauauagaucaauggaacagaacagagcccucagaaauaacgccgcauaccuacaacugucugaucuuugacaaaccugagaaaaacaagaaauggggaaaggauucccuauuuaauaaauggugcugggaaaacuggcuagccauagguagaaagcugaaacuggaucccuuccuuacaccuuauacaaaaaucaauucaagauggauuaaagacuuaaacguuagaucuaaaaccauaaaaacccuagaagaaaacccaggcauuaccauucaggacauaggcaugggcaaggacuucaugucuaaaacaccaaaagcaauggcaacaaaagacaaaauaacuuuaaaaaagaacugcaacacauaagcuuuuuagauucuugguacguauguuaagaauuguguacaaauugagauaucuguggacugguccucaacacaaccaacaaaaucucaauuaugaaaggaaaaaugcuuacaguaguuuuagucauaauugcuaaaacuugaaguaaggaaagugaauggacaaacugugguauacccauacaacaaauacuaucuaaugacaaaaaugaguuaccaagccaagaaaagacaaagacauagaagaaccuugaaugcacauuauuaagugaaagaggccaaucaaucugaaaaggcuagauauuguaugauucuaaauauaugacauucuggaaaaugcaaaaccaaauguugagauaguaaaaagaucagugguugccaggaauaagggggaacggaggaaugaauagguggagcagaggggaauuuuagggcagugaaacuauucuauaugauacuauaaugguggauacauuacacaguugucauuauacauuugucaaaccucauagaauguacaacaaaaagagaaaauccuuauguaaacuauggacuucgguugauaaagggguucuaacaagaaaaccauguuuuacauuuccaguuaggcuuccaauuuuucuuucaagacucucacagugcuccugcucagcuccaggcucauacaggucuaggaacagguugggcuaaaaacggauccaugcuacucugaaauaagggacaaggcucugaguguggcuuuuccccaagacuuucaacagaguuggugagaaaauccaacauuaagcaaacugugcuuugcaucugcccgucaacuuaaaucuguugcuuuuaucuuuacagcuacuauauacagugcuucagguacuacuauguaugacgcaucuuuaauucaauacaauaaucuugaggggcaguaacuaucaucauuuuaguacauuuuaauaaaauggcggauugaagauauucaauuccuugugcaaugcuauaccacuuuuaaguaguaugcugggauuugaacccaggccugacucauuacaaagucccacucaacucuaugcaaucaugcuguuucuauaaucuuugguaaccacauaucuucucuaguuucugaucucaggacaucccauuccucucuguacuugaccacucccuugucuagagucacuaguaucuuugggaaaacgauaccgucacucucaguauuguuuccacagaacuuauaucagugaggccagcaacuuccucuuagggcgaauauuauguucaucuuuuccucuacuuucuuaauuacaaugcuuacauuaacuagaagaacuaugaauucuaggcaauguuguauagggaaaaaacaccauucuuucugccaaaguaaaaaagcuaggaaaaugaaacaaaaaaaccaaucuucuauuuagaauaaaacaauauaaaaugauggguuauaaaacagcuaaagccuaaugugugaaaugugugaaaauaccugguuuugguaagacagaaauacuuaacuauagagaacuaacucacuggugaaaaacugaaagaauggccuaagaaaaauaggaagucaugaccaauuauuaaauaauaauauuugucuuuaccaccuccauuacugcuuuguauagcagcaauaaaacauagauguuaucuaaaggguuucuuuccauuguacuaauuuuugaaggacuaucuccagucuguucuuaacuauuuuuggaaguuagggaagauuugucuacagacuagcaaguaaacugacaguauagauucaacuacuuacuggcauaauggaaagccaggaaaugaguguugaaaaaaguucuauacaaagaaaauugaaaccagaucuaaaaaagucuagucuaagauaacccuuuuaugucucuuuuuuaauauaaaagaaaaaaauuguuugugacauauaagagaggauauagaaaguccaagauuuccauauauguaccuucagcuauugagucuaaacacuagcaaacggagauuuucaaaguaacccgaaugaagucaagacacugcauccauuuuauccugggcuuauuucuuuauccuucaggaaaagaugucuuuuauaccagaaacuaucaaacaagcuaacagauggcaagggcacugaaucaagucuaauuuggguugaauucaaauuugauuaucuagagacaugaaagcaauauaccuauauuagcaucagauguguaaugcugauaaaaauguuauggaaguaugauacagcagagaacuuucuggacuuaaaagaucccuuugggcuaacuaguuagaaaacucuggcaaagucacaaauuccuucugccucaggauccuuuaccugcacaaugggaugauaauaacuggucuuccuuucugugagaugcugagaggauacaauggaauauuuuuaaaauuuuuucuucacugggugugguaggcagaauaaugaccccacaaagauguccaaauccccagaacuugugaaauuguuaccuuauauggauucucccuuagagccuucugaaggaaugcagaccugccaaaaccuugauucuagcccagugaaacuuauuucauauuuccggccuccugaauuccaagauaauaaauguauuguuuuaaacaauuacguuuaugacaauuuguuacagcaguaauaagaaacuaacacacugaguuuggucucagcucugacacuuucccuuucuauguaucccugggccaguuacuuaugucuuugaacuuuaguuuccucaucuaucaaauaagaauuaacaauagcaacuaccaguuguuacagagaucaaauaggauaacuaagugcuauagcauaagugauuaaaaaugguaacuauccuuauauuuacuucuuauguuacacuaaggcaauauaaugcaauuauuuuuacacaaccuacauucaacuuauaguuuccauauauaccagagauguauauuaaagcuucuaucacuaaaguuauugguaauauauugauggacaagucauuaguuuguucuugcagaucauaaaguugaaguucuuuuagaucucaaaguucccaaagggaagaagcaauauauauguaauucauuugaaacccagcauuuuaaauccaguaaaaaguccauuuuaaauccaguaaaaagucaagacucuacacugauuuuguccuuagauuaccuccauauccuucaggaaaaagugucuuuuaaaccagaaaacuuuugaugaccaaagauaaaauuuaaauaggaaucugaaggaauaggaagagaaaucauugauuaagaaaauaaauucaggcugggcgcaguggcucacgccuguaaucccaacacuuugggaggcagaggugggcagaucaccugaggucaggaguuugagaucagacuggccaacauggugaaaccccaucucuaguaaaaauacaaaaaucagccagguauggugacagguaccuguaaucccagcuacucaggaggcugaggcaggagaauggcuugaaccugggagguggaggaugcagugaaccgaggcugcaccaaugcauucuggccuugugugcucagggcgacagagcaagucucugucucaaaaaacaaaaacaaaauucacaaggaaguuuaaugauuuggguuuuuagcaauauucagcuaguuuaugucaggaaugauuaucuccaggguuuucuacuucuagaucugugcuauuuuauuacaguagagaucagcaaacuaugucccauggguaaaaucuggucugccaucucuuuuuguaaagaaaguuuuauuaaaacaggcaaacacauccauucacauacugccuauaccugcuuuugugcuacaaaggcaaacugaguaguugcaacagagacuaugcccuguaaaaccuaaaguacuuaaaauuggcccauauacaagaaguauacugucccuaguguuacagcauauuacuucgcaaggcauguaagcuuauuuuaucuuauaagguguuucaaaacaauagauuuuuaaaaugaacuuucagcaaacuauuaaguuuacacaaauaaaggaauacuguggcuugauguaccauauaauauuaaacauggaugaaauucuggguaguacagguucuacggcuccacuaagauaccauggaggugaguucaauucuggcuaaauaauguugauuuauuaacagcaaaaucacucagcauacaaaugcugagcaaaauaaaauaaugacuuaugacugcuauaauuauuauucaauaaaagugacuguaggccaggcacggcaguucacgccuguaaucccagcacuuugggaggccgaggugggucgaucaucugaggucaggaguuugagaccagcuggccaauguggugaaaccccgucucuacuaaaaauacaaacauuagccaggcaugguggcaggcaccuguaaucucagcuacucaggaggcugaggcaggagaauuauuugaacccgggaggcacagguugcagugagccgagaucacgccacugcacuccagccugggagaaaagagcgaaacuccaucucaaaaaaaaaaaaaaaaaaaaaaagugacuguaaagauguuugaucauaauuuauauucaaaauuuaucaugauuaaaaaugcaaaauacuguuuccuucucugguguuuucauaaaacauuuauucauuauuauuuacugaguuccucaucuuauccuuuuauaagacucauacauuauguuuucuuuaugaucaaguaugggaaagaacuaauaacuauuggauaugaagauguucuagaaacuaaaauauauaaucauugaauuuucaaaauaaacuuauaaagaaagauuuuucauuuccauuuuauagaugaagaaacagacucagggaaagugaacauucccuccaagguuaagcuauuaaagccauuagggugccuaagcugggaauucagcccagguuuuuuaguggccaagguucucuuuuuaguacuuuuccuaauucauaauaucucagauucaaugaccucuuugguauauuugguauagaacuguugguccaguuaacuacuuguucaaguuauuuggauuuaaagcuccuuuugagaaaauaaaaaauuagccuugcuuacuuggggaaguggaauagcccuaacuuucggaaaaaagguaagucagucuccuaaauuuuaaaauaaauaucaacucugcuauuuauacaauugugucaucuaaagcacauggaucuccucuggacucaacaagacaaaauacagacauaccggagacucauaacagaauuugauaaaguuuuauucaaucaauuuucuuucuaaaguuugcuuguuccuauucaacauaggccaaaggacauuuuauuuaucugcucccuucacuaaacucuauacuuguauguaggucaucuauaaacaacaaaccagggcaauauuaucucaaaaguccuaugaaaaagucauaaauuaauucagauuuaauguuaugagccuggcuuuuuauagagugauaugagaaacaucucaucagagagcauuucuagcucuuuuacaaaaccccagcuugagauaucugaauucuuauaccugaugucucuuauauaaagaucaauguaauaccuccuaaaguucaguguuagcaaaagugaauuuuucauuuauuagcaauaaacaucuuuuuaaaggaacacauaagcuugaaaucugaaaaaaaaaucuuuugaauaaagaaaauucugaaagaucauaauucccuaagaugaauguauucugaaagcaguauguuugcagucagaaaagacugaaauccaauuaacuggaacccuucauuaacuggaauaauguucuaugcaaugcuuuugagaaaaggaaauagaaaaagacaugcaaaaauuaggcuuugggagaaucaagguaaaauaaaaaauggucccuauacacaaagaaauuagccuaguaggggaguagaaauuuauacauaaaaugacaaaacacagaaaaugauaauuaggacccuaagauuuacagauaaagaguucugggaguucagagaucauuucuacauggcuuccaguagaaaaaauaaagguuuugaaaacagauggcagccggacgcgguggcucaugacuguaaucccagcacuuuaggaggccgaggugggugaucacgaagacacgaguucaagaccagccuggccaagauggugaaaccccaucucuacuaaaacuacaaaaauuagccaagugugguagcaguugccuguaauuccaucuacuugggcagcugaggcaggagacucgcuugaaccuagguggcagagggugcagugagccgagaucgcaucacugcacuccagccugggugacagagugagacucugucucaaaaaaacaaaaacaaaaacaaaaaauagguggcacaaaccugggcuuacaugaugaacaggauuuauuuauuuuccuucuuguuuauuaagacauuauuuacauacaauaaaauucaccaauuuuaaguguacaguuugauaauuuuuauuauuuguauacaauuguauaaccaacauaacaaugaagauauagaacaauucccucacucaaaaaguguccuugugucccuuugcacuugaucccuucucccuaacuccuggccucaauaaccacuuuaaucugcugucagucacuauugcuauuccuuuucuagaauuucauauaaauagaauuauauacuacauaguagucauguuugacuugccucacuuaccauguuguuuuugagauacauuaaucuuguguguaucauuauuucgcuccuuuuuauggcuaguaugauuccauggaauggauacaccacaauguauucuucaccaguuuucagcuaucaugaauaauauuauuauaaacauucaugaacacauuccugggugggcauguguuuucauuucaguuggguaaauaccuuuguaucaguccauuccuauaccucuauaaagacauacccaagacuggguaauuuauaaagaaaagagguuuaggcugggcgcgguggcucacgucuguaaucccaguacuuugggaggcugaggugggcagaucaugaggucaggagauggagaccauccuggcuaacccggugaaaccucgucucuacuaaaaauacaaaaaaaaaaaaaauuagccgggcaugguggcgggcgccuguagucccagcuacucgggaggcugaggcaggagaauggcgugaacccaggaggcggaacuugcagugagccaagaucgcaccacuacacuccagccuaggcgacagagcaagacucugucuccaaaaaaaaaaaaaagaaaagaaaagagguuuaauuggcuuauaguucugcaggccguacagguuucuguuucuagggaggccucaggaaacuuacaacuguggcagaaggcaaaagggaagaaagcacauauucauauggccagcaggagagagagaagugaagaugaaggugucacacacuuuccaacaaccagaucucucaugauaacucuaucaugagaacggcaaugggggaguccuccggccucaugauucaaucaccucccaccaggccucuaacacugggaauuacaauucgacaagagaauuggguggggacacagaaccaaccauaucaaccuuaaaauggaauugcuaggucaaauggugaguggcuuaacuuuauaugguauuaccauauugguuuucaaagcuguguaccauuuuugcauucccacuugcgauauaugagaauuccaauugcuccauaaccucaucaacacuugguaucguuggucuuuugcuaaaauucacauuugucagauaagugauguuaaguguccccccaugugcuuacugaccauucauauauuuacugugaaguucauguucaaaucauuugcccauuuuaaauuggguuugcuuacugaguuguaaaacuucauguauucuagauacaagaucuuuaucacauaggcuuugcaaaaauuuacucccaguuuguggauugccuuuuuaauugucuuucgaaaagcuaguucccaauucugauaaaguauagcuaucccucagugucucugggugauugguucugggaccccugaggaugcucaaguccuuuauaugaaaugguacaguaauugcauauaaccuaugcacacucucguauacuuuaaaucaucucuaaauuacuuauaacaccuaauacaauguaaauaauuguuacacugcacuguucagggaaugacaauaaaaagucuguacauguucaguacagacacaaccaaccuuuuucagaaaaauauuuucgaucugugguugguugguugaaucuacagaugcagaacccauggcuacagaaggcccacuggacauuuaaacgauaacuucuuuuaguuugugcuuuugauuaucuuuuucuuuuuuugagauggagucucguuauguugccccugcaccuagccaaugaucuuuuaaagaaauuuuugccuaacacguguaacaaacacauuucccuaugguuucauguacaaguuuaauagcuuuguuaccuguagauuuaugaucaauuuugagauauauuuuauauuuauauuuauauuuauuuuugucaauaccagacuguuuugauuacuacagcuuuacaguaaaucuugaaaucaaguaauuugucuuccaacuuuaucaaaauuguuuuagcuauuuuaggcuaucuucccauauaaaucuaaaaacagcuuguccauaucuucaaaauaccuguugcaauucugauuaaaacugcaguaaauuuaugucuauuugaggaggauugccaucuuaacaauuuuugaguccucugaucaaugaaacaguacacugcuccauuuauuuaggucuucuuuaauuucccuuuggaacguuuuguauuuucaguguguaagucuuuaauaugagggaucuucgaaaaguucauggaaaauguguauuauggaaaaacugcauggauuuucaaauuuuucugcaccaaauaaacucauacuaaguugugauagcaugucugaaugggaucuaguuuaagguguuaagaagaauaagacaucaguuugaaaagagucccuaucagagaaacauuaauucugcuaaaauugaagcaagaacaaacaucaacuuuauaguaaagcuuggguggaagcauggugaaguaacugaugccuuaugaaaguuuauggggucaaugccccaaagaaaucaguaguuuacaaauggauaacuucuuuuaagaagcgacaacacgaugcugaagauaaagccugcacuggcaguccauucacacuuauuugugaggaaaaaauuaaucuuguucugcccuaauugaaaaggacucaugauuagcagcagaaacaauagccaauaccauagacaucuaauuaguucagcuuacacaauucuggcugaaaaauuaaaguugagcaaacuugccacucaacgggggccaaaaccauuacuccuagaucagcugcggacaagagcagagauuuuaauggaaauuuuaaacaaguaggauugagauccugaagcguuucuucgaagaauuguacaggagaugaaacacggcuuuaccaguauggucuuaaagacaaaguacaggcagggugcgggggcucacaccuguaaucucagcaccuugggaggcugaagcggaucauuugauccuaggaguucaagaucagccugggcaacauagggagacccugccuauacaaaaaagaaaaaagagcugggcaugguggcaugcaccugcagucuuagcugcucaggaggcugagguggaaggaucacuugaguaugagaugucgagguggcagugagcugugccacuguacuccagccugggugaccaagagagacucugucucaaaaaaaaaaaaaaaaaaaaaaaaagggcagguuguggggagcacaaaguacaguugaagcaauagcuaccaagauguggaaaugguccauucaaagcaaaagugggcugguagacagcaaaggucaugacaacaguuuuuugggaugcucaaggcauuuugcuuguugacuuucuggagggcaaaagaaugauaauaucugauuauuaugaguguuuugagaaaguuagccaaagcuuuagcagaaaaaugcuugggaaagcuucaccagagaguccuccaccacagcaacguuccugguucauucuucucauuaaacaagagcaauguuuugacaguuuucauuaggcaucuaccucauaguucugguuugguuccuuccgacuucuuuugguuuccuaaucuuaaaaaaauugggcaacucauuuuuauucaguuaauaauguaaaauauaccgcauugaugugguuaaauccccaggaccccagguucuuuagggauagacuaaauggcugauaucacugcuuauaaaaguguuuugaacuggauggagcuuuuguuaauaaauaaaguuuauauauuuuuucauuuccacaaacuuuuggaagucucuucauauuuuuuguuaaauuuauccuaaaaaguuuguuuuuugaugcuacuguaaauggaauugcuuaaaauuucauuuuccaaauguguauugcaaauauauagaaaugaagugauuuuugucuauugacuguguauaaugcuaccuugcuaaauuuauuuuaguaucuuuuaaaaaauuccuuagcauuuucuacauauaugaucacgucaucuggaaauaaggcuaguuuuaauucuuccuuuccaaucuguaugccuuuauauuuugccuuauugcacuggauaagucuucuagaacaauguuaaauaaaagugguaaaaguggacauccuugccuuguuccugacauuagauagaaggcacugagcuauucaucaucaaagaugaauauaaugcuaucuguagauuuuuuugguagauaaccucaaucagguugaggaaauuucuuuauaauauuaaaguuuccccauuacuuugauacaaacauuuuaucaugacaaaaugucauuugacuuugucaaauguuuucucgcauuuauugaaauaaucauguuuuuuuuuuggucuccuauauucuauuaaaauggugaauuauguugauagauugucagauguuaaaccaacacugcaacccugggaugauuuuauuauucauuuuauuuauuuaguuagcuaacauuuuguuaaggaauuaugccucuauuuucaugaggaacguuggucuuuaauucucuuuucuuuuuuuuuuuaaagagauggggucuuacuauguauccuaggcuggaauacagugguuauucacaggcacaauuauagugcacuaaagccuugaacuucuaagcucaagugauccuccugccucagccuacugaauaacugggacuaauggcacacaccacugcacucagguauauuuugcauuauuuuuuuucccaguuucucuuuucugauucacuagaccagaaaggcuauauguuuuuccaugugugggccauugcuacccauuucacacugcacagacugcacuuaguuccugguugcaaaugagugugggggugguguggagaaaggaaugacauacuaaacugcucaaggaaagguaugaagguaagaaaucauaugaacagugagaugcagugagaugaacaauaauauaauuugaaguuaggauuaaaucauguaaauuguugaauaccagcuagaucuaagaguauggcuaaugaaauauauauuuuagacagaaggauaacauaaucauaucuauauucuaaauuaagauuaauauauguauacuguauauaaugaauugcaauacagacaaugacuggagguaggagaauaauaaagaggcaguuccagaagugcaggugggagguaaugagguuuuaacuaggcuagcggcagaaagaauagaaaggaaggauuggaaaugagaugauucagcaaugauugaugaccccgaaauuuuucaauaaucugaauuaucacaaaaagauaagauuuuuaaaguuauuuggagggaguguacacauuguuuauuuaauagugagggcuauuauacaagcaaaucaauguaaaauaaucccuuuauauguaugagcauaguuaauuugguaaacaacagacaauuacauacugugaucauaaggacuuuaguaucaguuaccauauagcagguacucuuuagucaggauauaccuauauaggugcuaaauuaaaaaucaaccuuauaucucaaauuuacuuccuaguagaguguaacgcugccauaauugcaagccuaauuaugggguuguccauacugcagucccaucaguacucauacaccaaagggucgggccugugaagacuggaaaaagaauaaaauaucuuuugauugagauacuacaagcaaaaaugacuuucuggcuaccauuacugcaaagaacaaaacucaacugaaaacaauauguagcaauuaaaaaguacucauuaucuucaaaacacacuuuuuaacuaauugagacucuaaauucauugguucuacuauaauuuuauacccuaguaauuuuauaugcuaaaauucauuuauuaauaggccauacuuuaguugaauaguuguuaaauaauuuuauuuugacucauaugcaaauuuuuaaauacauauugagaagcaugcagacaucaacauuuccucccucuuccacaaaaagaauuuacagauguuagcaauuuagguaugacaaaagcaaaagauacuuuguuuuucaaaguggggcaagacgggaggaagaaaagauggucauaauuagcuaguagauaaaagaguaaaagugugcuccucaaugaaaagacugucaguuaaaauucuucaugagaaacuugguaaaaaaugaugcagucuugguaaaauuauuugguuuuagagaguugauuaacaaaaauguacuaugcauugagguuugauuuacuuaaaaguugcaacuuuuacucagaagcuucaaggcauuucagaaaaaauuaaaugucuuuuaaaaguugccuucuuaccacuuagauguuacuugacuacgcaauacaucccuuuuaucaacauaugauuggagcugauagguauaugagaaauuaccugagauaccuuaguaaaauuaauuauaauguugccaauacaauagcucacuacaauucauacaagcuaaaauucaaaaaaaaaaaaaaaaacggugaggaaccaguuaaucaucuaucaaacugcuuuuaaaauaggcaauauguaucaaaacauccccaggcaaaaaaaaaugaaacaaaguaaaagcaaacaaaguacauuaaaaauucacaugucuuuuuaucuugcaauuaauuucuaggaauuuaaaggaaggcaaugauauguucaaugauuaaucuauaugcacgaauaaguuuccucagauauuucuuauguguuuuuuaugacagggaaaugacaaucuauaugucucauagacaguauagcgauaggagagaauauuauaguuauugaaauggagaugauuacuuaguugaaaaauguucauaaaauauuacuagguuuaaaaaguagauuagaaacuaaauacagacaauccuaguuuugcuaaaaacaauguauauaaacuuaauaaaaaagauugaaagacuaauaaauaacaagauauugaauggaaauguaugucuuccaaguauucuacuaugaggauagaauucauuuaauauuuauuguuuucauaaucagaaaaaauaaguucgaguuacuaaaaaacuguagcauaugcccuuuacccacaugcaauguacucuagauauucuaggucugaugguuauacauaaacuuuccacucugucauugcagucgugaaugagcccagcaaagaucauuuuaacaucuaucacguggucagucacuugggagggauuauauaaaauuauuaugaguuuggggaccuaaaugauugcccuguuguagaccaacacuaaaguaagacuauggauguccuaggcaagauuucuucucuagaggugaaaggguagugcauuaaccagguuuuauauuaaaugucuucaucauuugugagcagccagaugguugguaauacguguagauauuuugaaacauaggcuggcugauuucaauuagcuuugaagugagacaaaugauaguauugcuaagcccagggguacugagagaauauuuucuuacagaugaauaucccaucaacuagaguucccauuuauauaauauagcuaauagguuauccuggaacacaugugcuguuggaaaaaaucucuuuuaugaagcaccuaacugggcaaacauuuuaggcacacuauaagaaaaccaguuaaugugagagagaaaaaggaauuuaaaaaccauuauagccuauaugcuuguauuucagaauguacuaagaaguuuugugaaggauuuuggcugcaaauaaaaauacuucugugauaaucugcaggaauuuugggccgaaucaaaggcucugccugaaaagauuacuaaccaaacaaauguuggcuugcccagguuuagcaugcaacgccaauuuuaagucgugcuccucaaggugccagcuguguuccugaugauucuccucuauacuauacucaguaaaagaguacaguaagaaugucacuacuggggcauaucuuggccucaaaaauucaggugaguuaggauggaauggaauuaauucuuuuuuuuucuuuuucaaaauaaaguugaggaucuaaaauuuuucugaaucacaggaauucuaauggacauucagaagaaugauuugacccaaguuuuccaaaggaaacuaaugaauaauuuuuuaaaacaugaaguagaaacauaaaaaaaugaaaacauacauuuaaccuuuuucuuucauagaaaacaaaucacaaaauuuguuucuccuucuuucucucuucuuguuugcugccuuacaaaugaaaugccucacacugagaaaauuaaacaguuuuuaaugcuuguuucauuccacucagugacaaggauguuuguuauuaacuauuaaaugccuacuauaaugcagacaguauacuauccaaguguuucauauauauuacugcuaaucacuaauuaucccaaugaucuuaugcauuuuacagacuaaggaauuuucauuuuauuuugauuuuauagacuaaggaauugagagucaaauaaauuaaguaacuugaccaaggucacacagguucuacugcagaauccacacuccuuucacauaaugauaguuaagugggaaaaucucuguuaaucaacuggucuuggugauugauuuuucuugcaagcagaaacaaugaaaggcucuucugggucccuucacuauagcccucuggacaaacuccagacaaagccugcuggaacuccagagaaagcauggagcucccacuaauaaaagggcaugucuuccagaggcuauuuucuuugccauagaaagcauagcauuaugaaauaguucaaaauggcaaaauaaagcgcaaacagauuuaaucuuacaggcaaaaagucaaacagaguaagaagacaggugacacagguaacaaggacaacucuuuagacuucugccacucaaaauacaguccacgaacuagcagcauugguaauaccugcgagcuuguuagaaaugcagugucucaggccccacuccagauuuagaaucaguccaugcuuuaguauguauaugaaaauuugagaagcaauaauuuuaauuauaauuaagucacuagugacuaaaugacggccaaaacuggucuaaagagcuagaaauuagccuauagccaacaaagcuuccagaaacaagauauucuaaugcauuucccucauuugauuaauacuguaaauugugaauucacuugcuaagagcccuuuugaagcaaacuuggaagucaguauucuauuauuucaguucuaccugguaagaacuuaguuucauuugcaccuuucacucacucacucauagcuuccacccaaguacaagcaaagcagcagcacauguuuaguagaguuuuaccuuagaguaaucagagccaagauauguuuuguggggauaaaaugcauuuguaagcaagagcugucuucaucaaaauucaagguuuuccacaugauuuaacuaucauagcaagcaaucuggauauuaccccacaaaacacauuugugugugugucgacaguagucucuaauacuguggcuaguggaaaggaguuauggauuauuuugucaagacaaaaggucuuguaaaaauaacuuacuucucuuaaauagcaagccaauacucaaacuauuagacuagugggaagaaugguaaugcauuugaccauagagagaauacuuaauuaaaucugcuaagugauugaugauacuaccacuguccuguuauauaaacuaaaacaucaaaucacuguuggaucccucucuucacugaaaacaguagcucugccagauaguuaaaaacaauuucuggaaauaucugaccagaugaugaguuaauuuugaaggaaaccaauagccucauuugagagauuuuuuuuuuuuuuuuuuuuuuuacuuauuuauugcuuacaucuguuagguuuagaaaacacucauauggaacaacaaugaagacugcugucaaaaucugucccuuugguuauauuuuaagagaauccucuuuuaaacaaauuuuauucauuuucuuacuuuuuuggacaggguuauucuuuaucucucauaauaauuuaaaauaucugaaucaaaauccucaaaauguuuacaaaauaaguaguaguuuuuuuuuuucuacuuuaagaaucuaaccaaaggaaaacaaauucagaccaaaagacugagauauuuucugguuucuaauuagacucuucuacuuuauaaccuuguaaacuaacauucuuaacauuccauaacaaaaagggcugaaaaaagguugguucacacagauacuaucauaaugcaggaaaaggauuuguguuagaauucaauguucacauuaaauaaaauuuucuuaauuaucugguuuuuacuaauacacuguucuuuugucugauggugccuuucuuucugugcuuucuuuucucuugcacugacugucaaccuugcuuagaagagggcugauuugucucugacuuaucagaugguuaaagucugccuuauuugaguaagcucuuuaaaaaugcuguuuuagaaaggucaauuaguucuaaacaaagauauucaguucaguaagcaacuccuauagagacacuuccuacagagauaagccaauauuuccuguugugcucuaguguacaaaggggcaaaggaagcuguaagugaaugcacacuguaucagcuggaguccccagaauuuauaauuucucacagcacuuacgggagauuuccacugagcuccuacaccagcauuuucuagaauuuugcugaauuauuucauuuguauggagagagguguuucaaaauacauccaaucuaucaugaaaucuggaugauuuuuuuucucuguggugauuuuugguuuugcccaucucuuuccauuuccacagcugcaccuuucacgucuaguuuguucugguggucuccuaucuaaugucuuugccucuagguccucccacuccauccauaugcaaucacaaauacaauguuccucaauuaauuucaucaugugacuugcuuguucaaaaauuuuaaguagcucccuauuuuucagcauaucaaacccacauuucuuagcuuagguuucaaaauccuccacauuucaaaucaaugguuauuuugcagagaagaaaacggaggcacuuugaaguaacuugcccaggguuacauaguuagaggaauugagaucucagcucaggcaaucucauuucagaguuuaggcuuucaaguaucacacuacauuauuccuguuaagagucugguguguaacuguuauguugcaauugcauuguauuugucuccagauauuuccccaaccacauuauucugagacaguacauuucauuuguauguucacacaaaaccuauauauagcagacaauuuauuucauuaacuggugcuauacuagaauaguuuuucagauaaaccauaaugccaagcuugcaacugcuuggagucaaagaucgauaaagauauaggugguuaaaacuguuuccaucuauuuauauccucaucugcugcaguuucugcuuaaaaauaguugugacaugaaauuuuccuauaagguguucugguccagaaguaagcaauggugaaaucugagcaagacuuucuacagauguguguguguguguguguguguguguguguauaauuuauauauauauauauauauauauauauauaugacaauucuagaaagaaguagaaaggguacaccaagcaugaaguuauguaaucucuaacacucguaauguuuacauuugaaauaguuaauauacucucuguuuuucaauauaugacgaaacacacagucauaaagaaauggccccuucacugagaagauauugugaauguguauuucauaagagaaugcagcuagccauagucuuguuaaaugcuaggcaaaguucauguaaaugaaauguuuaugcugagcauuacgcucuaaguauuuaaucgauccuuaaccaagaaaaaaaaaucaaugcuuucuuuuuaauucugucagucacagcaacugaaaauaaagggauauauauauauauauauauauauauauauauauauauauauauuacacacacauacacacauauauauguguguaauguaauacagacaggaaagaccauuaccaggaaacagaacaauaguucucuuuucucuuguggcuuuuugcauuacauuaucaguuaaacauucuaaagauauuucaagaaaaaaaaaaaacccugucuuugauauuugaucugagauguuugaaaagaaaaucugaaacauuaucauuuacaaauccagacacugacaacauaaacauauaaagaugaaguugccaugauaacgaauuagguauucauauguuucacugacaaaaauccauuguucuaugguuuugcaacuaguaaguuuaugucccaaguucaugauauaccaguauaucuguucuuaacauaagacaaugaauaacuuuguaacaggguccagaaauaauuagccacuccagagaguguuguggaauuugaaaaccgagaugccauguauuuucucugacacuauuuucugaauaguccaaauaaaaacuuggaggaaaguucaaagcccaaaauaaaucugucucacgaaaagauagcuugagaaguucugcauacucuucuggaugcagaaaagagcuacugugagaaacaccucacucuucauaagucaagaugaaaacugaggauaaugucaugcuaccagaauaacaauaguuaccacuuaacauaugccaggcacuuuuuaucuacuguuuccuuuaaucccucuacuuccuuauaacguauuaccaccccuauuuuauagacaaggaaacugaaguucagagagauuucgugauuugcucauagaccuaggacuggaucauacacuuagaucaugguaugucugaacucuggacuuagaucuaucuagcuccagagucuacaauucuauuuuacuauauggcaguuguccucaaccuuuagugccugucacaaucaucuguaaucuuuauuaaaauacagaugcaugaguugcauucccauagauccuaagccagcaggucugagagggggcucaaacaucugaaacaguucagguacuucugauguauaucaaaggaagagaacuuguauuuauuacuagacuggaaaaacaaaaauggcaaucuagaauaaguuuaucauuuuguaauuacuuguuuuucagcaaauuuaccauucuuauuacauauuuuguaggcauccauuaaaucaucccauuuucuaauacaugauaucccuaaacaaauaagggggguggaguaguauaaguaacacagaggcacauugacuauaguaggaagaucaaacaggggcugaugguuuucuacccauaauaugaaaaugaacaacauacagacaggaaaaguagaaguaagagcaauauugcucuaauauauuaauauagcacauacuuaggauuagaccaagaagaauaaaaccaaauaaauauacagaaaacaacaauuuagaagaguucugggcuuaaucuucagaaguuuacaauuuauagaaaugagauuuaaacacuuuagauacaaccaucuccaaaauguuuuaugcuguuuugcugcagagaauaaauaagaaaaaaguccuaugauuuaauaauuuuucuaguaaauauauuuuucucuuaagaaaaugaggcugggcacaguugcucaugccuguaaucccagcacuaugggaggcuaaggcaagaggauaacuugaucccaggaguucaagaccuuccuggacaauauagcaaggcuccaggucaacuaaaaaaaaaaaauuagccugguaugguggugcucaccuauaguuucagcuacuugggaggcuacucaagagaaucacuugagcccagggguucaagguugcagugagguaugaucacaucacugcgcuccagccugggagauacagugagacacugucucaaaaaagaaaaaagaaaagaagcuaauauucuacauauauauuuuaucuauucauaaauauuuguuggacacuuacaacauauaagguauuuuacuacuuuuuuauuauuucuauuuuuuauuuauuauuauuauuauacuauaaguuuuaggguacaugugcacaacgugcagguuuguuacauauguuuacaugugccauguuggugugcugcacccauuaacucaucauuuaguuacuucuaaucuuuuaccaguugcauuauaauaccacgauucucauguucuaacauuuaugaacauguacuuucgagugggcucacaaaaauuauaggguggcuagcaggccuguucugggucccuaugggucaucaaagauaugaguugacaauaaaaucaaguuagauaauuugcuuuggccuggaacuugugcagagcuucugaugcaggacuucauuuaauaaaguuugaccugcaagggcccuuaauguugccugguccacaguccucaucaaacagaugaagauauuaagguguaaagagagagaacaacuggauuaaaauaucacaccuuugcccagaacuugcugcucuuucacagucuagcacaaacccugagaggauggguaggucccaggcagggcccaauuaugacuuuuaugggcuuuugauacuugucuuuuuggugcuuuccccauuaaaaaaauuaaaaacuauacuuuaugacuacuuugguaugaagacaaauauauuaauguuauauauuaaaauacuuuguucaacaguaaaagguauuuuccuucuaauuuuaaaagacauuaaguauuuucaugugccccuaaaaguauugaggacucuagguucuaaugggauaagcuagcccugguuucagguccuucauuugacagucugaacagcauuacucuccucuagaagacuuaguucugccauaggggacucuuuauguggcuucucuaugacucaggauguauuggcccuagaaaguuuggccuuuuauuaucaggcuacuccagagguucucauuccagcagccagucaggaccuacuuccccauucugaaccaggcaguccccuagaaaaccauuccaagagacuguggaguacucaacagagaucagguaccaagucccugggaaagaaaacaaucuccagggccucaaauaagauauaccuuucuuaaggccuuucuacuacauuugaaaaaaacaugaggcagagcacuucauugaaguuuagcaccuuucacaauguggcuaguaauaaccugcagagacauccuuacucuaagaacacaaugaagauuuucugcacuagguaugauuuuguuuccaauacauucaacugugugaaaggcuguaucauucauaaaauggcaagcagggaacaaauaacaaauuuccucuauuuacccaauuucagaaaacugccaucuuaaagcagaauuuauuauucucauggcacucaucauucuuauggguuuuacuuuaggguccccaugcaugaggcucagcucaaguccucuccucuccaguaaaucaacauuaauaacuucucucaugaccagagguaucugauuccugaccauuuuuguuacaugcauuccucuucuuuagcuguuucuuucuuuucuuucuuuuuuuuuuuuuuugagauguaguuucgcucuuuuugcccaggccagagugcaauggcacaaucucggcucaaagcaaccucucccucccggauucaaucuauucuccugccucagccuccugaguaacugggauuacaggcguccaccaccaugcccagcuaauuuuguauuuuuaguagagacgggguuucaccauguuggucaggcuggucucacacucucaaccucaggugauccgccggccuuggccucccaaagugcugggauuacaggugugagccacgacaccuggauuucuuuagcuguuucuaaccuuugauucaacaaauauuauuuugugauuaauaugugccagcuaugacaugguauauacaaagauuaguaaaacaagacaccauucucaaagagauaauuucaagugagggggagaauaauauaaaauauaccaauauuuaagacagggaaaacauuauaaaugcuauuauaaaauacuuauugggugaaggaagugucuggaaagacaucaugcaagugacagcauuugagauaagucuuuuuuuuuuuugacacggagucuugaucuguugcccaggcuggagugcaguggugcgaucucagcucaaugcaaccuccaccacagcuguucaagugauucuccugccucagccucccaaguagcugggauuacaggugugcaccaccauaccaggcuaauuuuuguauuuuuaguagagacaggguuucaccauguuggccaggcuggucucgaacuccugacucaagugauccacccgccuuggccucucaaagugcugggauuacaggcaugagccacugugcccagccugaggggagucuuaaugaggacagauuacucagaauuggaaagaagguggaagagaaacagcacagaagagacacagaaacaaugagugggaucuauuuaucaaacaacaagaagugagcugggcacaguggcucauaccuguaaucccaccaauuuggaaagcaaggugggaugacugcuaaaggccaggaguuugagaccagccugggcaacacaaugagauucugucucacuguggcgggaggaucacuugaguccagcaguuugagguuacaguggacuaugauuguaccacuacacuccagccuaggagacagagugagacccugucucaaacaagacaaaacaaaacaaaaaaccaaaccaaccacaaaaacccaguaagaagcauaauuugguuuauagcauguaguacuaguaugaagaaguaaaaaccaaaaauuaggggauaauauacacaucuaaaaggaaaaaaaaagaucugagacuuuauuguguuuaguuuguauucucuauaggaccagcccaguguuggguguaauauauaauauuugaugacugauuuaagcugucauaaaaagcaucaacaauguauacaauaauccaaaggcaucuaauaaucacaguaaauaaacagugauaugagguacuugaaaaaaaggcccccaccaaauucauaauaaaacagcuacaguuaauugagaauagaugugggggaaaccauucuaaccuuucuugcaauauaaauucaguaguuaaaaaaaguauaauaggcuccacuaauuucaugauguuucuucagugaagcucagaaauaaaugcuacauauaaguggguuucaauaaaaaaggaaucucuacugguuuaaccuacucuguccacuuuucaucaagucuuucaagacaggugcaaauugaauuuaauaagaaaauugcaauagcuuugcaagcaaagggaaguagcuaaaauuagacaaaaguuuuacugagaacaaguugcacuugcagaauuagguauaacucagguaauuaaagauaacaucuucccuuugguuaacugcccaaaugaaacugaaagaucagaauuuucuuguaaguaaaaaaaaguuuuagaguauaauuuucuuuucagauauggucaaaaacuucaaauuugaaaaauaaauauagauucaaaccuccagaaauaaaugacagguuaaauauuugaguaauuaauugcauaugaaauuguaacauauggagguagaaugcaacagcuguucaucuaauaauauauuuuaaaagcuaaauuuauaugagaauaauuguuacacucauuuccuccaagcaguagucuauucacuacugaagucuugauaaucaguaucuuccuacacacucauacaaauucauuuucuuaaaaguacuucugacuauguuuaaauagauauacagugaaauuugaaaaacaaaacaaaacaaaacacagguauuacuuuaauacuacuauuaugacccaaagcaauugugaagguuucuucaagaguggcccacagcccacaggaaucauacucaccugagauguuugcuuaaaauguagaggcuuacuccaacaauucuuggaucucacugagauacaaaaucauugcccuuaucauuuuaaucaguauucucacuucgcucuuuacccauauuaaauuccaugaacaaucaucauguuuuccauuuugcaaacacucucuugacucuccuucccugucuuuacuaguaaaaugccaacccaaccaugagcuuacacuaagccugcuucugagcagaugaacagugucaggaaacacacacacacacacacacacacugugccaacugugcucacuuaaaauuuauuaucacaaaucucaaauggggauuuaacacugucagauacagaauccaaucacuucuuucuauauauuuaccuuuccauuuugagauaagaguuucaccaaucuucuagucuucucaaaucucuaacaucccuuccccaggucacucgcuacuuagccucauacuucagcggaaaaauagauccaaccagaugaauuucaucucauguuccccaaaauucuaccaaccuaacugcaucuacucucacacacacugccuuuucuaccuuuacaauggaagaaguguuaauguucuucuuuaaggauaaccuuucuacuuguggccaggaucucauccacuugugacuucucaaggaauguucuugaaauaccuuucuucucucucuguuuuguuuuuagauggauucuugcucuugucacccaggcuggagugcaauggugugaucucuauucacugcaaccucugccuccuggguucaagcgauucuccugccucagccuccugaguagcugggauaacaggcaccugccaccacacccggcuaauuuuuuguauuuuuaguacagacgggguuuuacauuguuggccaggcuggucucggacuccuaaccucaagugauccaccugccucggccucccaaaguacugggauuacaggcgugagccaccgcacccgguccuuuuuucucuuuugcaucaucaguuucuccauuccagauaauucccacuaguguaugaaugugccauaaucccauucauccuaaaaaacaaaauaauuuucccuuguacuccgguuucccucuaaguaccacugcauuucuccauuaccuucuaaagcaaaacuacuuaaaaagagugcccuucacuuucuaccuuccauuuucuccucaauccacuuaguucagguuuuuguucccaucaguucaacaaaacucugcuaauuaagguguccaaagacuguauuuccccuaagaccacuggcuaauucucuguucucaccuuaucaaaccuuuuauuaucauuucauauaguugauuacuccauucuuccuggaguauuuccuucucuagcuucuggguuaccacacuuuucugguuuucuuuccaacucauuguccaguuccaucuuagccuauuucauuggcuucuucaguacuagauuucucaguguuggagugaccaaaaauaucccuaucuuccuuuucccaucuuuauccauucucuugcccuaagggauuuuauccaauccuguguauaucaucuaauuuauauucuuauuacucccaaauuuuauuuccaguccauuucucuauuuugaacucuaguauuuuuuguauaaccgucuucuugacaucuccacuuggauaucacacuuaacaacaguuccuucuuauaauuauuaauucagaguuuuuaccauuccuuauuacaauuugaauaaaacauauuuuucugaaaacuacccauuaugucuaagcauucauguuuauuuuauuaaaccucucuuuuuuuugaaagacauagggucucacuuuguugcccaggcugaagugcaguggcaugaucauagcucccuucugcuucaaauugcugggcucgagugaugcucccaccucagccucccaaguagccaugacuacaggugggugucacuguaccuggcuaauuuuuaaacuuuuuguagagaugggaucuugccaacuugcccuggcuggucuugaacuccuagacuugagugauucucccaucucaggccccucaaaguguugagauuacaggcaugagccacugugcccacacagcauucacauuuauuacuguaaaccuuaugcauaaaaguucuuauaauuuuacaaauuucuguaguuuuaguuaugcuuccuuuuuaaauuaccaauaucgauuaauauauuuucuuucuuuuucagacuugccaagauuuaucuauuuuauuuaucuuuuaaugaacacugcuguuggauuucugcauucauccuuauuaauuugguccuuuauuuucuuugaauuauuuugucauucguuuuaaaaaucuuuaacacaauuguuuacuuauuuaagcaaauaauuuaauuuuuauaaaauaaagcaugcuuccaugaaaaauguaagaaauacauaaaagcacaaaauaguaaaaggaauaaaucaaccaaugucccauuacccagaaagaaaagguguuaauauuaguggaguaccauuccacacaucucucuaaguauacacagaaaugaauggaugaacacacagaauuggagagauacugagauuacagaaaauuuuuuuuuuaauuuaaaaaaaauuuguguaagaucauagcucacugcagacuugaauuccugggcucaagagauccuccugcuucauccuccugaguagcuaggacuacagguauggaccaccauguccagcuaauuaaaaaaaaauauauauauuuuuuugagacagggucuugcucuguugcccaggcugguccugaauucuuagccucgagagauccaauccucccuugagaacuggaucaaggggcgguuuccuccaugcuauucucaugauagugacugaguucucaugagaucugaugguuuuauaagcaucuggcguugcccuugcuugcacuuccucucuccugucaccuugugaagaaggugccuugcuuccccuucaccuuccaccaugauuuuaaguuuccugcagccuucccagccaugcaaaacugugaguaaauuaagccucuuuccuucauauauuacccagucucagguauuuccuucuaacaaugugagaacuggcuaauacaauaaauugguaccaaggucacaggggacugcuguaaagauaccugaaaauguggaagugacuuuggaacuggguaacaagcagaggauggaacaguuuggagggcucagaagaggacaggaagaugugggaaaguuuggaacuuccuagagacuuguuaaaugauuuugaccaaaaugcugauagugauauggacaauuaaguccaggcugagguggucucagauagagauaaggcuugggaacugcagcaaaggugacucuugugcauuacgccuguccuagagaucuguggaacuuugaacuugagagagaugauuuaggguaucuggcagaagaaauuucuaagcagcaaacuauccaagaagaagcagagcauaaagguuuggaaaauuugcagccugaaauguaauaggaaagacaaacccauuuucugggaauaaguucaagccagcugcagaaauuugcauaaguaaugggcagcugaauguuaaucaccaagacaauagggaaaaugucuccagggcacgucagaccuucaaggcagccccucucaucacaggccuggaggccuaggagggaaaaaugguuuugugggcugggcccaagguccccccugcucuaugcuguguuaagacauggugcccugcgucccagcugcuucagcuccagcauggcuaaaaagggccaaaguauagccugagccauugcuucagagggugcaagccccaagccuugguggcuucccuaugguguugagccugugggugcacagaagucaagaaaugagguuugggaaccucugccuagauuucagaggauguacagaaacacucggauauccaggcagaaguuugcugcaggggcagaguccucaugaagaaccucugcuagggcaguguggaaaggaaacgugggguuggagucuccacacagaguccccacugggcacuacuuaguggagcugugagaagagggccaccauccuccagaccccagaaugguagauccacugacagcuugcacugugcgucuggaagagcggcagacauucagugccagccugugaaagcagcugggacggggacuguacccugcaaagcugcagaggcaggacuacccaaggccaugggagcccaccucuugcaucagcaugaccugaaugugagacguggaaucaaaggagaucauuuugggacuuuaagauuuaauaauugcccuaucguuuccgacuugcaugaggccuauagucccauuguuuuggucaauuucucccacuuggaauggguguauuuacccaauuccuguucccuccauuguaacuuggaaggaacuaacuuguuuuugacuuuacaggcucauagguggauggaacuugccuugucucagaugauacuuuggagucgggcuuuugaguuaaugcuggaaugaguuaagacugggggacuguuggaaggguaagauugucuuuugaaaugugaggacaugaaauuugggaggggccagggauggaaugauaugguuuggcuguguccccacccaaaucucaucuuaaacuguaguucccauaauccccagguaucauaggagggaccuggugggaagugaugggaucaucggggcaguuucccccaugcuguucuagugauagugagugaggucucaugagaucugaugguuuuauaagggggucuucuccuuucacuuggcacuuuuccuuccugcugccuugugaagaaggugcuuugcuuccccuucgccuucugccauaauuguuaaguuucuugaggucuucccagccauguggaaccaugagucaauuaaaucucuuuccuuuauaaauuacucaggugugagcugcugcaccuggcuagaaaauaauuuuuuuuaaagugggcuuauacuaugaaugcaguuuuuacaauaaggagauuuaauuuuacaugaauuaaacagaagaaacaaguaacacugaagauauuaguuacuuuuggauaaauguuucacuaaaaaagauuguaaauccuaaaauauuucuacaagauaaaguacaaaaaguuauaaaaaugauuaaaaauuuaaauuucucuaauauucuaagaaaugcauuaaaaacuguaaauuucuucugaguaaauuuugacaccaucccacagguuuucauauguagggcucuuggcaucauacauuucuaaaauguuuguuauuucccauuuuuacuuuauuuuauuccugcuauuuaaacuuuuuuuuuuuucaaauauccaguuuuaccuucuguggucugugaacauggcgccuauaauuuucuuuuaauauuuguuuacauuuccuuguguuuuaauauuugaucaauuuuugugacuguuucuuguauacugaauguuuaucucuacauaucaauuacauuaagcucauuaacugcucauguuacauaaauauauguauuuauuuuuuucuacuuuguucugucaacuucugaaagaugugugcuaaaaucucccacuaugaucuugguuuuuaucacauuaaaaaaauuauuagauuucuucucuuuaugucaaagcuauauugcuaagugaauucauaucuauaaaacaauuuaccaagaugauaaugaaauaucucuucguuucuuuuaauugaaugaguuuuugcuuugaauucucuugcuaugccuacuacuuuuuauuugccugauuaaucuuuuucucaaccuucuagucuauguuuuaugugcuccuuguaaacagcaaacauuuuucaaacugauuugagaggcuacccuuuaauaagugaaugcaaccauucuacauuguauuucuauuucucauguuuucuuauagcuucuguauuuucuuuuccagcuauaugcugccuuuacugaauuuucuauguuccauuuuucuuucucccuaaugguuuugaacgaaaauauuguuucuuuucgucuaguaauuaugcuuaucaugaguacugcaugucuaaaaaaugucaguuuuauaauuugggcagguauugaacucuuaaguacaaaauuauuuucccaaagaauuuuaaaauauacuaucccacuaucuuuuugcauccagcauuaguaauuauaggauuauugcugguugcuacucuuucugucuauccucagugucucucaacucgccuuuuuuuucuuccuguuuguccuuucuuuugaauugcuaacuucaaaaagcucuaaaguuuucuuuuuugaugaaugcagugucauccugcaugucucugaggacaguaauuauauuuauucuaaaacucuuguuuugcuuucuuuauuaacucuuaucccuugggcauuaguucuuccauuuauauaguuugguacucuccuucaugauauuaguuuucuucaaauauuuugugauucuggguugugacccuaucuuuuuuggacuuuagagauauccuauuagucugugauggcuguaugugauuacaguagcaugagucgggggagaaagaugugccaccggguaguuaaaauggauaguuaguguucuagggguuuccuaucuguucuggauauugacagcauugggaguacucccuuggcuuuuaaaucacccaaauuucuuguuuuugcaugucaaacaccaagaaaaaacugugaagguagggagagguaguucuacaugucuccuuguccaggaggcuagacauaaagaauccccaaauagccauucauaccuuuugcaguauuccaguccuacacauauuuuagauuauaguucuuaucugcauucuaaugccauuuaucaagggcucuccaugguuuuuggaaguuuugcuguuuccuaucacaguuguauuuaauugguacuauauauucuauagagagggagaggaggauuauuuuuaggaauguguaguagcaaggagagguugcagcauguucucaauguaccaucuuguacugaaguuucaaauagauauguuuuggcagagauaaauggacaauauuguacauacuuuuaagggaaaaugugcuuuuuuacuauacguucccuucuacuaaaauaugaucucauaauaguaagaaggggguguuuauccaguaguuucuaacucuagaugcacauuacucaaauaucaaaguguaaccccagaaauucuauuuuaauugaacaaggguaagaaacacugguacaguagcagaaaaacugcagguuagggaucagacuaauuugaguucaaucaccacuuacuaaauuauaugacuuuaggcaaaaacaacauuuugagccuuaguuucuucagcuguaaauuggguuuacaaaauuguggugaggacuagagauaauauaagaagagagacuaguaucaugcauggcaaacagcauaugcuuauuaaauguuagcucuucuaaugcuauguauaaguaaguagaugaaaaacauggcauaaaggaagaucaagugaaauaggaugucccuucauacgucaaaaucuuacaaugacuaaaauuuaauuccagaugucacaggagcugacaaucauuaccagauuuacaaacugagcaagauuaugggauuuacagaguauuccugucacauauuacauaccuccugggcucuuuuaacauucuucuuucaaugcaucuuucaaagaccacucucuaggaaaucacacaacugcucaauuccacauuuccaaauuugagagaguaaaaucugucaauaauaauggcaaccuaauuauauguuucuguuuguauuuuuuaaaauacuaugacaaauagaugagcacuuuuaaguugcaggaaauaagaauaacuagaaagcuguggaucccagaaauuaaagaaacuuuagugucuuccaggcaggaaauuauccaaaccuaauuacaaccagcuggagacagcuccauuuucaggaaugcuuagauacuagcaaaacacagugaugcccauuugcugacaaguaaaugcucauaucuuuaucaucugugucauucagaaacauucauaugccacuuggcaaaacaacuucuuaauagguaauauucauugaauucuuauaaaaguuuuaauucauuuccaaauacaacuauaauacuucacuauuucaacauuagagaaaaauuauuuucucuuguuucuuuacaaauguuuuguuuggcuggguguaguggcucacaccuguaauccaagcccugugggaggccaaggugggaggaucauuugagcccaggaguucaagacaagccugggcaacacaggaaguccgucucuacaaaaaauaaaaaaaaaugagccugguguaguggcuugugucuuuagucucagcuacuugggaggcugaggugggaggaccugcuugagcccuggagguugagggugccgugagccugggcaauagagugagacccugucucaaaaaaaaaaagcuuauguuuauaaauuauuaaugaucauauacauuaaacaauauggccucaguuuuaaaaacuuuauuguaaaaguaaaucuacggguguaaucauaguaaaacugacaacaccaccuucauuuagagaccuaaacuaaaccuuaagagggcccaacucuggcugaauucaauauauauuaacauaguaagucugacacuaauccucaaaaacaaauucuguggccaauaagcacauggaagaguauucaaugucauuauucuucagugacaugcaaauuaaaaucucaauucugaacagucuauuccagaagaggaagauauacuucccauucauuuuaugagaucugcuucaccaugaugcuaaaaucaggcaaaauguuugguauaauuuguuuggcagaaaaaaaaauuuaaaagaggcaaaacaguacuaaaaaaaucaauaaaaacuauacaccaauaucucucauaaacacaaacaucucaacaaaauguuccuguuguauguaaaaagcauaaugcaucacaaccaagugcgguucauccuggaauauacagaaaguccaaaauuuuuuuuaaaaauccauaaauguaaacuacuauauuaacagcucaaaaaauaaaauccauaugaucauaucaauugauacggaaaaucugacaaaauccaacagccauucauaaugaaaacucucagcaaacuggaaauagaagggaacuucaacauaauuaaagggcaccuacaaaaaaacuacagcuaauaucguauuuaauagugagacugacugcuuccuccugaaaagggugcaagacaagaaugccuauacuaccaucauuccuguuccacguauccugaaaguuuuagugcaauagacaagaaaaagaaguaaaaggcauauauauuggaaaggaaaaaauaaaacuguaccuauuugcauaugacaugacuauguaugugaaaaaucccaaggaaucuacaaaaaacuucuuagaauuaauacguauuuuaagauugcaggauacauggucaacauagaaaaaucaauuguauuucuauauacaagcaauguacuaauagaaaccaaaauuaaaaaaaaauaacuuucagaucagcuccaaauaaaaaaaaaauuuaaauaaauccuuggguauaaaucuaagaaagccaaguauaggagggguaugcugagaaccauaaaaugcuaauaaaagaaaucaaagaccaaaauaaauggagagauagacuauguucaucaacuggaagacccaacauaguaaagaugucaauuuucuucaaacuaauccguagauuuaauacaauuccaaucaaacucccgcuuuuuuucacugaauaauauauaacaaauauuuuuccacaucaauauuuuucuauaauauuucaaauagcuauacacucaauuucuggauuuauccuaacauuaauuaaccauucuuuuguacuugauguugaauucuaguauuuacaguauguuccauauuucucuauuauaaacaggguuuaguaaauauucuccuaauucaguauuugcacacaucuuuauuuccuuaagguaaauuguuagaaguacauuuuuuggaucaaacaguaugcacauaaauacauauauauuuaugcauguguguguacauauauauuuuaaaguuuugauaauacauguuguuaaaaugcccucuagaaaggucuuucaccuuuuaaauuuugacuuaaaacuuaacuccucugaaaagccuucuccaauuagccuuuucccaccaaucucuauuuggucucauuaaauuacuguaucauuuauugcacuauuuaaacaauuacugcuuuaauaagacauuaagccucuaggcuaucugcucaaagugcaugucuuugaggaaauguaacaggagaaaauacacaggaugauaaacugaugcgcuaugaaaucgcuaacaaagguggcaugaaaggauaaaguauuagaguuaagaggguaucacuuuuuuuuccacaaaaggggucuauucuaauuguuuuuagauuuuccuauuuuuaguuugugugcccauuaaaaggcaguaguugcagguaugguuugcauuuucugucuuauccuuggaaucaguuacugaaaaaaguucaagcuauggaaaauuuugucaaauucuccauauccucaaaauccauguaugcuuucucuagaauucuaucaugccucacuuauaacacaugaaauugaagucaacugaugucuuccaacaggaaaguauaacaaucauucagaaacacugccuauugugccuuacucuacuuaugaaaugaaaucacauauauuaaauaagaaacuaucaaacuaugcauauucagcauuugacaucacucacaauuagccuguaccaauuaacuaggcccaacauugugaauauguuucaauuaagaaaaauuaauuaccccuguuaauuaugaaagucacaaugggauugugcugcuaucuuucaggaauuauuugcugagaaaugcuuucccuaguuuauuucugugcuuccaguauaugauuuuaaaacauggcagccaguguauugcuagauucuugcaaauauuaagcaaauauacuaaagcaggagcauauuuuacauaaccauaugugucagacuaaauuugagccaagaacaagaaugaaugcaacucauaucugauuuauauuugacaaauacagagauaucauaagcuccuguuuugaaugccuacauguuguuuccauggcaacugcauaaacauuuuccucauaaaacacagccaucuucauucuuuacauccgauuauuuauuucuuuccacuuucaggaaaaagccuaauuuauuucccaggaaaaaucgaucaaugauuuucuuaaucaguaggauuugaacaguagguggcacaguuauuuuuauggaaaaacaauuuccaccaacgcucuugcuaugugauagaaggccgagggaaaauaaaaguaguucuugcuuuaaggaaagugugacuacaagcuacaaugaauaauccuucaaagagggaugagaauguguauuagaaacccacagaugggccaggugugguggcuuacgccuguaaucccagcacuuugggaggcugaggugggcagaucaccuggggucgggaguacuagaccagccugaccaacaugcagaaacucaucucuauuaaaaauacaaaauuagccgggagugguggcacaugucuguaaucccugcuacucgggaggcugaggcaggagaaucucuugaacuugagagggggagguugcggugagcugagaucgcgccauugcgcuccagccugggcaacagaagugaaacucuuucucaaaauaaaaaaaaaaaaaagaaaaagaaacccacagaugguuggcaaaagugaucacauucaacuccuacuucucuuuuccacaucuguggaauaugaugaagacuccuuuaugaaaaaaauuaucuuucauuccuacagaguuugguagucuuaaaaaaaauaccuuugcugugugauagagacuguauagaauggcuagcaacuacaggcaagagaaagacuagcccacuuuaaguagaucaaaugacagcaaaaggaggauaaaaggaaaccacaucagguuguuucacuuuaucuauuauuugagacugagguaauuaucacagauuucaguggcagcagauggaagagaucccauauuggaguuuagcuaucaaauuaacaacaauuucucaaaguccucaaagggacaguggaucuauuaacauuuuucagugcucagaauacuccagccuuuacuucccuucugcacuuggagcucauugggcuagcuagggaagccaauagggaugaauauagguauuuacugcccucuccucugggcucuccugguccaacuauaauagcauuuaucaguguuuuguuauuacuuauauaugauuuccucaagggacuuuucuuuuucuuuuuuuuuuugagacagacucuugcucugucacccaggcuggacugcaguggcacaaucucggcucgcugcagccuccaccuccuggguccaagcaauucucaugccucagccucccaaguagcuggaacuaaaggcaugcaccaccaugcccagcuaauuuuuguauuuuuaguagagaugggguuucaccacauugggcaggcuggucucaaaacuccugaccucaagugauccaccugccucagccucaggugugagccaccauacuuggccucaaaggaccuuuauaacacccucccaaucuaacaaaauguuaugugaauuguaaggugcugaauaagcuaguggaauaaaagaauauuuauucauaauguauacacauuuucuacaauacauaaugccucucagucaaaacacugaacuguuccaauaauucccccuaccacuucaauguuucaauucucuucacagucuuauuucuuccccuacuucuacaaagugaaucucuuaauaaucuacucuuuuucauuuauuuccaaggccuacgucaagguauaggccaaguaucuuucguauguuuuuguuuucggucuuaaauggaugccuauuaccugggcaugguggcacaugccugccaucccagcuacuuuggaggcugaggugggaggaucaccugagcccaagaagucaagguugcagugagccaugaucaugccacuauacucuagccuaggcaacagagcaagacucugucucaaauaauugaaaaaaaaaaaaggaugucuaacucuucuuguaccauuucuugaaaaaacuaaucuuuuuggccaggcauggugccuguaaucugagcacuuugggaggccaaggcaggcggauugccugaggucaggaguucaagacuauccuggccaacaugaugaaacccugucucuacuaaaaauacaaaaauuagccgggcgugguggcacacaccuguagucccagcuacuugggaggcugaggcaagagaaucacuugaacccaggaggcagaggcugcagugagccaagauuuuaccacugcacuccagccuggccugggaaaccgagugagacuccgucucaaaaaaaaaaguaaaaagaaaaaacucaucuuuuuucauagauuaccucugcaucuuuguuaaaaaucaauugaacauauguguguaucuauuucuggacuauuuauucuguuuuacagaucuauuuacccuuuuaacgacaauauacugcucaaguacugcaguuugauuaguaagucuugaaucagguagugugagucgucccacuuuguuucuauucagaauuguuuuuggcuuucuaguuccuuuaccuuuccaaaaaaauuuuagaaucagccugucgacuccuauaaaaaaauaccugcuagacuuuuuuuuuuuuuugagaaagagucucacucugucgccaggcuggagugcaguggugugaucucggcucacugcaaccuccgccuccaggguucaagcaauuauccugccucagccucucgaguagcugggacuacaggcgcgugccaccauucccagcuaauuuuuguauuuuuaguagagacaagguuucauuauguuggccagaauggucuugaucucuugaccucaugauccgccugccucggccucccaaagugcugggauuacaggcgugagccacugugccuggccccugcuggacuuuugauagggauuuuauucaaucuauagaacaauuugagagagcugacaucuuaauauugacuaagcaugguggcucaugccuguaaucccagcuacucaggacgcugagguaggaggaucacuugagcccaggagguugaggcuacagugagcggucuggaccuccagccuggguggcggaguaagacuuugucacaaaccaaaaaacaacuccaauauugacucuuccaauaguugagcacaauaucucuuuacugggauuuucuuugauuauuuucaugagugcuuuguagauuaucagcacagauguugcacauuuaaaaaaauuuacaccuauguuuuuguguuucauggugcuauuauaaaugcuauuguaaauuuuauaauuucaauguccaauuauuaauuguguauagaaggaccaggcaugguggcucacgccugcaaucccagcacuuugggaggccgaggugggcggaucacgaggucaggaguucaagaccagucuggccaacauagugaagccugucuauacuaaaaauaaaaaaaauuagcuaagcaugguggugggugccugcaauccuagcuacucaagaggcugagguucgagaaucguuugaacuugggaggcagagguugcagugagccgagaucgugccagugaacuccagccugggugacagugugagacuccgucucaaaaaaauauaguguauagaaauaugauagauuuuuauauaauuauuuugaauccugugacuuuacuaauucaccacuuaucauuaguucuaguacacuuuuugguagauucucugggauuuugugcauagaaaaugauuucauuugcaaauacugagagcuuacuucuuccucuucaaucugcauuccuuugauuucuuucauuuuucuuuuuuugcuuaacugaacuugcuaugacuaccuugucuuguucucaauuuuaggaagaaagcauucacuuuuucaccauuaaguguuacaucagcucuaugauaguuaucuuugcccuuuacuaggcugaggaaauuccuucaauuccuaguuugcugagauuauuuauuaugaauuaaugcaguaucuaaccacugaguaauuauaugggucauaugggguuuuuaauuuuuuuuuucucuuuuuucuuuucuuuucuuuuuuuuuuuuuuuuuuuuugagacagagucucacucugucgcccaggcuggagugcaauggcacaaccuccaccuccuggguucgagagauucuugggccucaacaugccccagaguagcugggauuacaggugugugccaccgcaccuggcuaauuuuuuuauuuguuuuuucaguagagacaggauuucaccacuuuggccaggcuggucugucucaaacuccuaaccugaagugaucugccugucuuagccucccauucauuuaauuuauugauauggugaauugcauugauucauucugaagauuaaaacaaccuugaauuuuugggauaaaaccuacuuucauaaugcauuauccuuuuuacauauugcugguuuugauuugccaauauuuucuugaagauuuuuuugucuaugccuguaguuuucuuucuuguaaucuauuugacuuguuuugauaucacaauacuacuaauuuuauaaaaugaguugggaaguguuaaaucuucuuuuauuuccuggcauaauuugugcagaacugauauuauuaaauauuuccuugguaguauuaauuuuguuuuuuuuugguagagaugggguccuugcuaugcugcccaggcuggucucaaacucuuggccucaagugauccucucacuuuggcuucucauagugcugggauuacaggugugaaccacugcaccuggccaaucuauuauuuucucaagugagcuuugguaguugagaugagguuguggagucagacaagcuuagcuguaccacuaaauagucauuugauacuggacaauuaacuuugagaaugauauccucauauauaaaauggaaauauuaauaacaagagcuaugucaaacagauuuguaagguuuaaagauaauccguauuccguugaaugaauauuuguguccuccucaaaauucuuaugcugaaaccuaauccccaauguguugucauuuugagguggagccuuuggcaggugauuauauccugaggacagagaccucaugcaugggacuaguaagaauccuuauaaaggagacuccagagagcucacuugccccuucugccaugugaggacacagugaaaagacaccaucuaugaaccagaaagcagaugcacucaccagauacuaaauaugcugguacuuugggacuccccagccuucagaaccaugagaaauaaauuucuguuguuuucaagccacccaguuuaggcccaauggacuaagaauauuaaaagugaaucucaauguuucauauauaguaagcacucaguacacauuauuacuacuauauuuuauuuuauuuuauuuuauuuuaauguuaaguuauuuuugagauggagucucacucugucacccaggauggagugcaguggugccaucucggcucaccgcagccucugccuccugguucaagugauucuugugccucagcuucccgagucacugugcagaugugcaccaccacuuucggcuaaguuuuguauuuuuuuugguagauucgggguuucaccauguugacuaggcuggucucaaacuccugaccucaggugauccuccugccucggccucccaaaguguuggguuacaggcgugagccauggugccuggccuauuacuacuauugaaauuuuuuuuuuuucuggacaaauugcacauaggcuucccuauaaaaggaaaguuuuccuaaaugaaggcauuguaaauaaugcuuuaaagaccuaucaaguguuaugaguuuaagauuguagacagagacagauaucaaauuauucuuugucuguaagaauauacuccccuacccacaaaggccauaauuuucagcuaaugaaauaaacuuagauaaaacuauuugacucaaucuuagcauuacauagcuagaauguuacucuuuaaauuuuagcuucuuuaguggccaugauaguucacaccauuaaaaaucuaaauuucuaguugugcaaauuagaaauucugugaauugcacaauuagaaaucugauucuauucucucuucaaagucacgguagauuauaaauuuuggacacaaccagcuuggauggggccagaaaaauauguaaauguagauggucugcuauguaccucauggauguguuauaugauuucugaacugggcuaggugggagaaucagugcaguuauuuuacaguauagagagaugaaguucuuaucaaaucuguuucuugauaauauuauaaucuugaaaacaaacuggucuugaacuccugaccucaggugauccacccaccucggccucccaaagugcuggaauuacaggugugagccacuacgccuggcccugaaacagauauaauuaaauagguacacuuaaaucaauaacagagagacagggaaaucugaucacuuucuauguauuaucucaccugcauaaguuaacacuuaacacuuuaauuucugcaguguuuuaaaaguuccuuucuucaacaaaaaaaauuuuuuuuaaauaguugagaaccagaaagaauuuacuggauauuuuagaagggugaauguggccacaugucuaccagugacaagggcacaaaaaagcuccaauaaugccacaaguagagguuuaacccacaauuagagauuuuuuuuuaaagaaaucacuguuaagauauauauauacauauauauacauauauauguauauguauauauauacauauauauacauauauauguauauauauacacauauauauguauauguauauauauauauauauauuuuuuuuugacagaguuucacuccgucacccaggcuggagugcaguggcaugaucuuggcucacuguaaccucugcuuccuggguucaagcaauucuccugccucagccuccugaguagcugggauuacaggcaugcgccaccacacccggcuaauuuuuguguuuuuuuguuuguuuguuuuuuguuuuuugagauggagucucgcucugcugcccagacuggagugcaguggcgcaaucucagcucacuguaagcuccaccuucuggguucacgccacucuccugccucagccucccgaguagcugggacuacaggugccugccaccauaccaggcuaauuuuuuuuuauuuuuagcagagauaggguuucaccauguuagccaggauggucuccaucuccugaccuugugaucugccugccucagccucccaaagugcugggauuacaggcguaugccacugcaccuggccuaauuuuuauauuuuuaauagagaugggguuucaccauguuggucaggcuggucuugaacuccugaccucaagugauccgccugccuuggccucccaaagugcugggauuacaggccaccgugccccauccaagauauuuuuaaucaagguuaauguuaguacagggaagaauaauuagaacauucauucuuugguauauaauuucuccugucucauauuuaccaacaugaaacagguucugcauuccuuagaauuauuagaacuagaacaugaugcuauuugauugacuuuucauaucuccugcauuucaaagcaagaaacuaguuucgguccaucauacccauucacuaucaagacauagugacucaagcaaaugauuaucucucaaaaucaaauuaguagaaauccaaugauuaagaguuauaauuguucacuaggauuucaaguaaaaaauuggaaauauuugaaucuuuacaaaacaugcauugaaauaauucuggucuaggacuaagaggauuuaagaaugauaaaggaucuuaagccuucauauaauugcuuucuacacuacuugaaaucaaauaguauuuucaauuucacaagaagaaaaaaucuuauaauccuucaaaauuucccucuccuuuacuauuuuggauucuuguccauuuuauaacucccaauucuuucgaaaugauuuucaaaagguagaaagaaagaaaggcaaaagaguaaauaaagauuauauuaaaauaagaucucuagaaacuagaugucaaguaaggaaaauaaaacaagaaauaaaguucaaaaaauaacaccaaaaaauccuuugcauacugaauaggaacuacuaccuauguugcuugauuauuucuaugaaacgaaaaaauaauuguugaaggaugugagguaggaggcgggacuuuacuccagagguggggcucagacacuggaccagauacaggacuagcuaaaauggggaugucaggggggacagcagccuucaaucaugccaugugaauguacuguugccauggcaacacccagaaguuaccgccucuuuccaugguaaugacucagugauuacuacccuuucccuagaaauuucugcauaaaucaucccuuaaucugcaugcaguuaaaggaagguauaaauaugacugcaaaacuguccugagcugcuacugucugccuacaaaguaccccugcucugcaggagcagucaaagagcugugauaccacuggagcuguaacacugccuguucaguaaagcuguuuucuucuaccucuggcuugcccuuuaauucuugccuucgcaaagccaagaucccucaugggcuaagcucugcuuuagggcucaccugcccugcaucagauggacuuauaaauauacuaguauuuuccauauucuuucucaaauaaucuuacauuucuaaauuaaguuuauaacuaggggaaaaaauucuuuugagcaaacauuaaggaccaaagccugguuaugcuaaauaaguuauaaaauguucagcuuuaucuauaguuuggcauuuaaguuaaacauuuaaacuuaaaaagaaauucuuuccagucaucuaaaauucuugguggaaauguaacauguuaggagaauucugcuuacuauuuaaaucugaagcacuucauucauucuggugacaaaggugguuuuagcagcuagcaaaacauuccuuccaaauuucaaggugcuuugggucuuuccaagaugaauguccuuucuuccuugccucucauuccuuaauuucugaagauagcaauguuuacugcaagagaaaaaaaauagagcaaaacuggagaguaauauaauuucaaauauauuggacaucuuuucuuagauauuccuaauaucacccucacucaacaguuauaauucaucuaauucauuuaaggaauaucuuuucuacuuagguggagacacgcauagaaccucacacacucaagaccuccccauggcauaccaaagaaccaguaacuuacaagaaccgaaagagcaccgaugcacuugagauuuucuaagucuucauuugauuguuuuuguagagacuuauucuacuggaaguauaugaauacuaacucaaugacaagucauuaaacucgaacuuuauaaaaauaugauucuaagggccacaauguccaacuucaguauaaagaccucucuaaaauauugaaagcagguaucuccaaauguaaauauuucacuagccacuuugcaguuuuaguuuaggcucaaguaugauuuuuaauuucguuuuuaaaaauaucacccaaaauuaaauacaugucuaccuauuucugauucuugagcaucuaucuuauacauguucaaaacugacccaaccccuaauuuguuucacuguaacaccaaacacaagaaaaauaacugaguuauuguauacuauauacaagaggauguauauagauuauaugcaaacacuacauuuuauauaaagaaccugagcaucugugaauuuugguaugcguuggggggggggugguccuggagccaaucuccugaggacacaucaaggaugacuguaauuccauuuauuauaauauucuuuugcuagugugaucauauauuauaccucuacauauauuacaaaaccucauaaugauaccauucaacuuuuguuuuaaaaagucagcuuucuuuuaaagaaagugacagaggaaaaacaaaaagccauuuguauuuaucaccuuggugguauucauuucuuccuguagaacugaguuuccaucugauaucacugccuuucagcuuagaaacucuuaguaguucuuauauuguaugucuauuaacaauaaauaucuaaguuuuuaaaaugugaaauugucuuacuuuaccuucauuuuugaaugauauuuucauuggauauugcauugugaccuaaagguuuuguuuuuucuucauccuuacaacuuuuuacuaaugucauuccauaauuuuuugucuucgauuuuucugauaagucagcugucaguaauauuauugcuauccuguauuuaaugcuucuuuuguuuucuggcuauuuugaagauuuucucuuuaucuuugaacuuuauuucuauuuuuuugagauagaguuuugcucuuuugcccaggcucaagugccacgauauuggcucacugcaacauccacccucuggguugaagcgauucuccugccucagccuccugaguagcugcgauuacaggugccugccaccauaacuuggcuaauuuuuguauuuuuaguagagacagcauuucaccauguuggccaggcuggucccaaacuccugaccucaggugauccaccugccuuggccucccaaagugcuagaauuacaggugugagccacugcgccuggccuaucuuuggacuuuaguagugcgacuauuauaugucuagauuugauuuucuuugcauuuauucuacuuggaguuuacugaccuucauucugugaguuauguuuuugcccaauaugggaaauuuuuagcacuuauuucuuaaaaaaaaauuguucuaucccauauucucccuuccucuuggggauuccaauauacauaaguuugacugcuuauuauuucacaggucauucaggauauguucuuuuauaaaaauuuuuucucuuuauucuuauuuuuuauuuucuaaccaaguaagcagcaaugaguauuuauuauuuuguuuguuuguuuaaaaggcagggucucacucugucauccaggcuggaguacaguggcaugaucacggcucacugcauccuugaccuccuaggcucaagcaauccuccugccucagccucuugaguagcugagacuacagucacacgccaccaugcucugcuaauuuuuacauuuuuuguagaaacugggucucacuacauugccuaggcuaguccugaacuccugggcucaagcuaucuucccaccacagccuuucaaaguacuagaauuacaggugugagccaccaugcccgcugacauacuuuuauuuaugcauccuucuagucaaccacauaugaauuauauacuuaagaacuacugugugaaaggcaguguucuaaguaguagagaaacaauaaaaaugcaagaucucugcucucacagaguuuacguuuaccuucuaguacagaaacauggacaaauaauaaacugauuucagagaucuucaaugcucugaaaaaaauaaaauugacuguuacaaagagaaugggaaggugaagaugcuguuuuagauagcauauaaacuaaaacucucugaggagaugaugccaaguugaaauugaauaaaaugagccagacauguaaagauuuaggaguagaauuuuccagauauagggcacacauguauuaagauaggaaggaguaccuaaugcuccuagaaaaaauguuucuaaauuaucaaaacaacgaauuaacaauuugugagaagauaucuugaauaucauaccaguaccaugcccaaaauuuaaaaauuggccugauuuuaaaccuauuaauuauuuauuccuguguaauaacaacaaugaaauaacaauuauuuaaaauuguuaacuuauuuuacuaacaauggaaauucuguuuggguucugacucuccauuuauuccaagcuucugccgguaccaauccuuauuuuuauuucauauuugaaaacaaaaguucuucucucccugcauuagaaaagaaagaaguuaccuuucuguuuuauuucuugacaauguuacaacguuuugggaaaacaucaugaagacaugcaaacaagaaaaauauucccaaaauaugcggccauaugcaacuaugucaccaaccauuuaugaugcaauagcagcacucaccuaaauuaaaccuaagcccuuucuuccagaacauucauaguacuggauuuuggcuacugguaaagaacaacaucaacuauacaccuuaaggaggaaggaaagaaaauacacuuaugguuauaaaccaugaaaugcauaauaauucuucuaaacuagggacugaauuaauguuauggauauagcaccaaacaaaauaguagggcauauauuucaauccugcuucagauagauauuagauaacaaauucugagcauucuaacaggggacugaccaguaugcuaaggcacaucagguagaauaaagaaaauaugcuuugaaauguauuuuguguuguaacuggguaauagggucaugugaaagacauuauagacacagguaaugcagaaaagaagcuauugucucaagauugugaacuaagaggaaaaaaauccaagaucuuguagguggggauagcaugaaguuaaauauaaggugaagggacuuucuguucaugaguacccagacaacuucauccaaaaaugacuaaauucaggauaaagaacuauguacuaauuugggaacauuaauaagauaagcauaauaaaacaaaaauagggaggaaggaauuagccuugcaugacugaaaaauauaaaaugugcaggcuugguaguaagauaaauuagacacuagccucaacuccccaacuggcugaagaaacucagacacuauaaaugauuucaaaccuuugacacuauauaaucuuucaaagcccuacaggcuaaaauuggugugaucuuauuuacucugcuauuuaacuuaauaguagcgaauaguuucagguaaaaaaaaaaaaaucauauagaauggaaauacaauggucuacuaggaaucugauagcuuacugaggagauuuuuaaucauaaaguaaggguugucaagccuuuacccauaggucaaauacaaccugccaccugcuuauauaugguuugcuagguaaaaauaguuuuuacauuuuuaaagaguugaaaaaaaucaaaaggagaauauuuugagacauaaaaacuagaugaaauucaaaugucaugguccauaaauaaaauuuuaucagaacauagccaguucauuuguuuauauauugucuauggcuaauuuuuuuuaaauuuuauuauuauuauacuuuaauuuucaggguacaugugcacaaugugcagguuacuuacauauguauacaugugccaugcuggugugcugcacccauuaacucgucauuuagcauuagcuauaucuccuaaugcuaucccucccaccuccccccaccccacaacaguccccagagugugauguuccccuuccuguguccauguguucucauuuuucaauucccaccuaugagugagaacaugcgguguuugguuuuuuguccuugcgauaguauacugagaaugaugauuuccaauuucauccaugucccuacaaaggacaugaacuccucauuuuuuauggcugcauaguauuccauggugcauacgugucacauuuucuuaauccagucuaucauugauggacauuuggguugguuccaagucuuuacuauugugaacagugccacaauaaacauacgugugcaugugucuuuauagcagcaugauuuauaguccuuuggguauauacccaguaaugggauggcugggucaaaugguauuucuaguucuagagcccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuguucauguccuucgcccacuuuuugaugggguuguuuguuuuuuucuuguaaauuuguuugaguucacuuuagauucuggauauuagcccuuugucagaugaguagguugcaaaaauucucucccauuuuguagguugccuguucacucugaugguaguuucuuuugcugugcagaagcucuuuaguuuaacuagaucccauuugucaauuuuggcuuuuguugccauugcuuuugguguuuuagacaugaaguccuugccugugccuauguccugaaugguaaggccuagguuuucuucuaggguuuuuaugguuucaggucuaacguuuaagucuuuaauccaucuugaauugauuuuuguauaagguguaaggaagggauccaguuucagcuuucuacauauagcuagccaguuuucccaucaccauuuauuaaauagggaauccuuuccccauugcuuguuuuucucagguuugucaaagaucagauaguuguagacaugcggugucauuucugagggcucuguucuguuccauugaucuauaucucuauuuugguaacaguaccaugcuguuuugguuacuguagccuuguaguauaguuugaagucagguggcgugaugccuccagcuuuguucuuuuggcuuaggauugacuuggcaaugcgggcucuuuuugguuucauaugaacuuuaaaguaguuuuuuccaauucugugaagaaagucauugguagcuugauggggauggcauugaaucuauaaauuaccuugggcaguauggccuuuuucaugauauugauucuuccuacccaugagcguggaauguucuuccauuuguugguauccucuuuuauuucauugagcagugguuuguaguucuccuugaagagguccuucacgucccuuguacguuggauuccuagguauuguauucucuuugaagcaauugugaaugggaguucacucaugauuuggcucucuguuugucuguuauugguguauaagaaugcuugugauuuuguacauugauuuuguauccugagacuuugcugaaguugcuuaucagcuuuaggagauuuugggcugagacaaugggguuucuagauauacaaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaauguuuccaguuuuugcccauucaguaugauguuggcuguggguuugucauagauagcucuuauuauuuugagauacgucccaucaauaccuaauuuauugagaguuuuuagcaugaaggguuguugaauuuugucaaaggccuuuucuccaucuauugagauaaucaugugguuuuugucuuugguucuguuuauaugcuggauuacauuuauugauuugcguauauugaaccagucuauggcugauuuuuuaccguaaagguagaguuaaguaguuguuacaguaacuaaaugccuacaaagcccaaaauauacauuauuuggcccuuuacagauaacacuuaccaaauuucuaauacaaacuacauucaagauggcuauuugcuaaaauuuuagaauucauauuuuaaaugacuagaucaaaugguuuauuuuaguccuuacacucugguaaugccauuccuucauauuucuaaugaauguuaauaauuuuauauuuaaaauuaguaucucauaauagagacaauuuuuauauucucaagaaaucaauuuuccugauucauaaaauuuauuaaguaugauauauccuuuucuucugaucaguuucugauuuaaaguuuguaaugggcucucugauuugaaaaauaaauaauaguucccauagcagacacaguucauuuauaacaauacugagaaaaaguacaucaauggauaaguguuaggaaacaauuucuugggagcuucugaauucugcaaagguguuagccuuaaaaccuauucuacaauaauucaacuucugcuucugaccaugagggauuaaacaguuccaggaugauccucucaccauaaacaauuagaauacagcauaaaauacuggaaaggacuauuuucagacacaggcaaugcaguauuaugaucccuaagaaaacagaaauaaggggaguccuaccagcaacucaggcucucagccagaaagaaauuuaccacuucaguagagggaggaagaauuuacacagagccuggcaaucuuguuuacuuggagagauagaaaaaagugcaaggaggccaagaaggcuagaauuuauggagcagaauuccagagaagagggagacagcuaaaguaaucugaauaaggguucuccugagcauuuagcuagauaaaaacguuacauuaagaaggguaaaauuuuuuuugagaccagagaaaaacaucuaaggaaaaaauguuaccagauaguugcaauacaaagauucucagagcugacauaggaccaagaauucaacaagcucccuuccgcaagaagagagaaacccaaauauacaaagcaaucagcaggguccccagaagggacaaaucacugagugaggggcccuagaauaaaggccacucuagauaugccugaaaggaauguuuaagccuagaacugaacaaacuaaucuguacuuaacaaaaaugcuuuucaggaagaaguccaacauucuuuaaagauauaaaacaagauuaaggacucaaauauuuaaauucauaaauauuuaucauuuaauaaaaaaauuacugaacacaguaagaaucagggaaauguggcccauaaccagaaaaauaucaaucaauagaaagaaacccagaaaugauagaaaugauagaaauggcaggcaaagacauuaaaagggcuguaauaacuaugcucuauauucaaagacauaaaugaaaaaagcaauauaauggugacagaaauagaggauuuucaaaaagaaccaaaaaauaacuucuagagauaaaauauauagagacaaaugaauauuucacuagacagauaagcaguaguucauacacagaagaaaaaaagguggagccaagauggccgaauaggaacagcucuagucuacagcucccagcgugagcgacacagaagauguaugauuucugcauuuccaacugagcuuugaagagaguagugguucucccagcacgcagcuugagaucugagaacggacagacugccucgucaaguggcucccugacgcccaaguagccuaacugggaggcaccccccaguagaggcagacugacaccucacauggccggguacuccucugagacaaaccuuccagaggaaugaucaggcagcaacauuugcuguucaccaauaucugcuguugugcagccuccgcugcugauacccaggcaaacagcaucuggagaggacccccagcaaacuccaacagaccugcagcugaggguccugacuguuagaaggaaaacuaauaaacagaaaggacauccacaccaaaaccccaucuguaugucaccaucaucaaagaccaaagguagauaaaaccacaaagauggggaaaaaacagagcagaaacacugaaaauucuaaaaaucagagcgccucuccuccuccaaaggaaugcagcuccucaccagcaauggaacaaagccggauggagaaugacuuugaugaguugagagaagaaggcuucagacgaucaaacuacuccaagcuaaaggaggaaguucgaacccauggcaaagaaguuaaaaaccuugaaacaagauuagacgaauggcuaacuagaauaaccaaugcagagaaguccuuaaaggagcugauggagcugaaaaccacggcacgagaacuaugugaugaaugcacgagccucagcagccgauucgaucaacuggaagaaaggguaucagugauggaagaucaaaugaaugaaaugcgaguuuagaaaaaaagaauaaaaaaaaagaacaaagccuccaacaaauauaggacuaugugaacagaccaaaucuauaucugauugguguaccugaaagugacggggagaauggaaccaacuuggaaaacacucugcaggauauuauccaggagaacuuccccaaucuagcaaggcaggccaacauucagauucgggaaauacagagaacgucauaaagauacuccuccagaagagcaacucuaagacacauaauugucagauucaccaaaguugaaaugaaggaaaaaauguuaagggcagccagagagaaaggucggguuacccacaaagggaagcccaucagacuaacagcugaucucuuggcagaaacucuacaagccagaagagagugggggccaauauucaacauucuuaaagaaaagaauuuucaacccacaauuucauauccagccaaacuaagcuucauaagugaaggagaaauaaaauacuuuacagacaagcaaaugcugagagauuuugucacuaccaggccugcccuaaaagaacuccugaaggaagcacuaaacauggaaaggaacaaccaguuccagccacugcaaaaacaugucaaacuguaaagaccaucgaugcuaggaagaaauugcaucaacuaacgagcaaaauaaccagcuaacaucauaaugacaggaucaaauucacacauaacaauauuaacuuuaaauguaaaugggcuaaaugcuccaauuagaagacacagacuggcaaauuggauaaagagucaagacccaucagugugcuguauucaggaaacccaucucacaugcagagacacacguaggcucaaaauaaagggauggaggaagaucuacuaagcaaauggaaaacaaaaaaggcagggguugcaauccuagucucugauaaaacagacuuuaaaccaauaaagaucaaaagagacaaagagggccauuacauaaugguaaagggaucaauugaacaagaagagcuaacuauccuaaauauauaugcacccaauacaggagcacccagauucauaaagcaaguccuuagagaccuacaaagagacucccacacaauaauaaugggacacuuuaacaccccacagacaacauuagacagaccaacgagacagaaaguuaacaaggauacgcaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcaguccucagcaaauguaaaagaacagaaauuauaacaaacugucucucaggccacaguacaaucaaacuagaacucaggauuaagaaacucacucaaaaccacucagcuacauggaaacugaacaaccugcuccugaaugacuacuggguacauaaugaaaugaaggcagaaauaaagauguucuuugaaaccaaugagaacaaagacacaacauaccagaaucucugggacacauucaaagcagugcguagagggaaauuuauagcacuaaaugcccacaagagaaaccaagaaagaucuaaaauugacaccauaacaucacaauuaaaagaacuagagaagcaagaggaaacacauucaaaagcuaguagaaggcaagaaauaacuaagaucagagcagaacugaaggaaauagacacauaaaaaacacuucaaaaaaaucaaugaauccaggagcugguuuuuugaaaagaucaacaaaauugauagaccgcuagcuagacuaauaaagaagaaaagagagaagaaucaaauagacguaauaaaaaaugauaaacgggauaucaccaccgaucccacagaaauacaaacuaccaucagagaauacuauaaacaccucuacacaaauaaacuagaaaaucuagaauaaauggauaaauuccucgacaccuacacccucccaagacuaaaccaggaagaagcugaaucucugaauagaccaauaacaggcucugaaauugaggcaauaauuaauagcuuacuaaccaaaaaaaggccaggaccagauggauucacagccgaauucuacuaaagguacaaggaggagcugguaccauuccuucugaaacuauuccaaucaauagaaaaagagggaauccucccuaacucauuuuaugaggccagcaucauccugauaccaaagccuggcagagacacaacaacaaaaaaaagaauuuuagaccaauaucccugaugaacaucgaugcaaaaauccucaauaaaauacuagcaaaccgaauccagcagcacauccaaaagcuuaucuaccaugaucaagugggcuucaaccugggaugcaaggcugguucaacauacgcaaaucaauaaacauaauccagcauauaaacagaaccaacgacaaaaaccacgauuaucucaauagaugcagaaaaggccuuugacaaaauucaacaacccuucaugcuaaaaacucucaauaaauuagguauugaugggacguaucucaaaauaauaagagcuaucugugacaaacccacagccaacaucauacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaaccccauugucucagcccaaaaucuccuaaagcugauaagcaacuucagcaaagucucaggauacaaaaucaauguauaaaaucacaagcauucuuauacaccaauaacagacaaacagagagccaaaucaugagugaacucccauucacaauugcuucaaagagaauacaauaccuaggaauccaauuuacaagggacgugaaggaccucuucaaggagaacuacaaaccacugcucaaugaaauaaaagaggauaccaacaaauggaagaacauuccacgcucauggguaggaagaaucaauaucgugaaaauggccauacugcccaagguaauuuauagauucaaugccauccccaucaagcuaccaaugacuuucuucacagaauuggaaaaaacuacuuuaaaguucauaugaaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacacugcauaucugcaacuaucuaaucuuugacaaaccugagaaaaacaagcaauggggaaaggauucccuauuuaauaaauggugcugggaaaacugucuagccauauguagaaagcugaaacuggaucccuuccuuacaccuuacacaaaaaucaauucaagauggauuaaagacuuaaacguuagaccuaaaaccauaaaaacccuagaagaaaacccaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaacaaagugaauagacaacccacaaaaugggagaaaauuuucgcaaccuacucaucugacaaagggcuaauauccagaaucuaaagugaacucaaacaaauuuacaagaaaaaaacaaacaaccccaucaaaaagugggcgaaggacaugaacagacacuucucaaaagaagacauuuaugcagacaaaagacacaugaaaaaaugcucaccaucacuggccaucagagaaaugcaaauccaaacugcaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggcucuagaacuagaaauaccauuugacccagccaucccauuacuggguauauacccaaaggacuauaaaucaugcugcuauaaagacacaugcacacguauguuuauuguggcacuauucacaauagcaaagacuuggaaccaacccaaauguccaacaaugauagacuggauuaagaaaauguggcacguauacaccauggaauacuaugcagccauaaaaaaugaggaguucauguccuuuguagggacauggaugaaauuggaaaucaucauucucaguaaacuaucacaagaaaaaccaaacaccgcauauucucacucauaggugggaacugaacaaugagaacacauggacacaggaaggggaacaucacacucuggggacuguugugggguggggagaggggggagggauagcauuuggagauauaccuaacgcuagaugacaaguuagugggugcagcgcaccagcaugucacauguauacauauguaacuaaccugcacauugugcacauguacccuaaaaguuaaaguauaauaauaaaaaaaaauaaaaauaaaauacaauaaaauuuaaaaacuaaucaaagaaccaaauaauuuuacuccuagguauuuacuccacagaguggguaucaucagaggccuaguacgaagcugaaacucccaacucggcccagaacaggcgccuccugccaagugucacuggaggaugauuaggacccugaacuuacuccucuaccugacaguaaugaggcaacauccuuucccccugccaggauacuauuuaaagagaccugccaaaacagaagacuuaaaugaaaugcaaaaucucaugacauaauguccaaaaugucuagguuuugauugaaaaccauuugccauaucaagaaucaggaaaaucauaacuugaaugagaaaagacaaucaauggauaccaacaccaagauaacagacauaagaauuauuuuacaagggaggaaaaaugguagauagaaggcaggacuaacuucagcucccaguuggaugguuacagcagcauguagagacccacaucacgaacuucugcuccaacaacuaccacaagaacauaccaggaaagccgagauaauccacagacccuuugaaggagcuggauugcugcuguaggcucugugggacagccaaggaacucugagucagcuuguuuucucaguggggaggcuuguagccuggggcaaguucucagcccuccucacugguugccuggaaaucagcucuguguuguuggugggggugggggcaggggcacagugggagugggaccagccuuuugggcagugggaugcaugggagcugugugaggacucuggcugccggcauucuccacuucccuggcaaccugugugaugcagcagaggcagccauaaucuuccugggaacauaacugggaacauaaucuuccugggaacguaauugcauuggccugggaaacacacccccauccccuacagcagccacaucccugcccaaggagagucugagcucagacacaccuaacccuguccacaucugaugguccugcugguagcugaagacgaaggauauagccucuugagaggucuauggucccaaccuucuccucauccucccuauacuaccacagcuauuaugcucuugaaagcaccaccuccuaucugaaggccaaucaacacaaaaccagcuuguguaacaaaaauacaaccaggaacccucauaguauccacuucaugccccugcuaccuccaccagagcagguguugguauccauggcugagagaccugaagacagaucacaucauaagacucuuugcagauacuccccuguacuagcccagagccuaacagcucugcuggguggcuagauccagaacagaaauaacaaucacugcaguuuggcucucagaaauucccaucccuaugggaaagggaagagcaccacaugaagggagcaacccgugggacaaaagaaucugaacagcagccuuugagucucagaucuucccuuugauauaguauacccgaauaagaaggaaccagaaaaacaauucugauaauagacaaaacaagguucuuuaacacccccaaaaaaucacacuaacucaccagcaauggauccgaaccaggaaaaaaaaucucugaauugccagaaaaagaauucacaaagucgacuauuaagccaauagaggaggcaucagagaaaggugaaguccaagaaauaaaaaaaaaugauauaggauaugaauggaaaaaucuccaguguaauagauagcauaaauaaaaacuaaucacaacuucuggaaaugaagggcacacuuagagaauugcaaaaugcaauggaaugccucagaaauagaacugaacaaguagaagaaagaauaucaaguuugcagacaaggcuuucgaauuaacccaaucugauaaagacaaagaagaaaaaagaauuuuuaaaaaaugaacaagccagacacaguggcucacgccuauaagcccagcacuuugggaggccgaggugggcagaucacuugaugucaggaguuugagaccagccuggccaagauggugaaaccccaucucuccuaaaauacacaaauuagcugggugugguggugugugccuguaaucccagcuacgcagaaggcugagguaggagaaucacuugaaccugggaggcagaggacgcagugagcugagaucacaccacugcauuucagucuggaugacagagcgagauuccaucucaaaaaaaaaaaaagaacaaagcuuccaagaaguuugagauuauguuaaaugaccaaauuuaagaauaauugguguuucuggggaagaagagaaaucuaaaaguuuggaaaacauauuugagagaauaauugaggaaaacuuucuuggccuugcuagggaucuagacauccaaauacaaaaagcucaaagaacuccugggaaauucaucgcaaaaacaucaccaccuaggcacauagucaucagguuaucuaaaaucaagaugaaggaaagaaucuuaacagcugugaggcaaaaguaucagguaaccuauaaagaaaaaccuaucagauuaacacagauuucgcagcagaaacccuacaagcuagaagggacugcaauccuaucuuuagccuccuuaaacaaaauaauuaucagccaagaauuuuguaugcaacaaaacuaggcuucauaaaugaagaaaagauaugguauuuuucagacaaacaaaugcugaaagaauucgccacuaccaagccagcacuacgagcaccgcuaaaaggagcucuaaaucuugaaacaaauccuccaaauacacccaaaucgaauauccuuaaagcauaaaucucacaggaccuauaaaacaacaacacaaugaaaaaaaaaaaagguauucaggcaauauauagaacgaugaauagaauaguaccucauaucucaauacuaauguugaaaguaaugggccgaaaugcuccacuuaaaagacagagaauggcagaauggauaagaauucaguaacuaaguaucugcugucuucaagagacucaccugacacauaggacucacauaaagcuaagguaacaggguggaaaaagauacuccaugcaaaugggcaccagaagcaagcaggaguagcuauucuuauaucagacaaaacaaacuuuaaaucaacagcuguuaaaaacgacaaagagagauacuacauaaugauaaaaggucuaauacaacaggaaaguaucacaauccuacauacauaugcaccuaacacuggagcucccaauuuauaaaacaauuacuacuagaccuaagaaauuagauaggcaacaacaaaauaauagugggggacuucaauacuucacugacagcacuagacagguaaucaagacaaaaagucaacaaagaaacaaugggcuuaauagacauuuacauaacauucuacccaacaacugcagaauauacauucuauucaacacauggaacauucuccaagacagaccauaugacaggccacaaacucucaacaaauuuaagaaaaucgaaauuauacaaagcacucuauuagaccacaguggaauaaaauuggaaaucaacuccaucuacacacugcuuuaaaugugucccagagauucugguauguuguaccuuuguucucacugguuucaaagaacaucuuuauuucugccuucauuuuguuauguacccaguagucauucaggagcaggcuguucaguuuccauguaguugagcgguuuugagugaguuucuuaauccugaguucuaguuugauugcacuguggucugagagauaguuuguuauaauuucuguucuuuugaggagugcuuuacuuccaacuauguggucaauuuuggaauaaauuagguauugaugggacauaucucaaaauaauaagagcuauuuaugacaaacccacagccaauaucauacugaaugggcacaaacuggaagcauucccuuugaaaacuggcacaagacagggaugcccucucucaccacuccuauucaacacaguguuggaaguucuggccagggcaaucaggcaggagaaggaaauaaaggguauucaauuaggaaaagaggaagucaaauugucccuguuugcagaugacaugauuguauaucuagaaaaccccaucgucucagcccaaaaucuccuuaagcugauagcaacuucagcaaagucucaggacacaaaaucaaugugcaaaaaucauaagcauucuuauacaccaauaacagacaaacagagagccaaaucaugagugaacucccauucacaauugcuucaaagagaauaaaauaccuaggaauccaacuuacaagggauguaaaggaccuuuucaaggagaacuacaaaccacugcucaacggcuaagcucauaggcuuaggauugacuuggcaaugagggcucuuuuuugguuccauaugaacuuuaaaguaguuuuuuccaauucugugaagaaagucauugguagcuugauggggauggcacugaaucuauaaauuaccuugggcaguauggccauuuucacaauauugauucuuccuauucacaagcauggaauguucuuccauuuguuuguguccucuuuuauuucguugagcaggauguaggcaugggcaaggacuucaugucuaaaauaccaaaagcaauggcaacaaaagccaaaauucacaaaugggaucuaauuaaacuaaagagcuuccgcacggcaaaagaaacuaccaucagagugaacaggcaaccuacagaaugggagaaaauuuuugcauucuacucaucugacaaagauucuguauccagaaucuacaaugaacucaaacaaauuuacaagaaaaaaacaaacaaccccaucaaaaagugggcgaaggacaugaacagacacuucucaaaagaagauauuuaugcagccaaaagacacaugaaaaaaugcccaucaucacuggccaucagagaaacgcaaaacuaaaccgcaaugagauaccaucucacagcaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggaucuagaauuagaaauaccguuugacccagccauccauuacuggguauauacccaaaggauuauaaaucaugcugcuauaaagacacaugcauauguaugcuuauuguggcacuauucacaauagcaaagacuugguaccaacccaaauguccaucaaugauagacuggauuaagaaaauguggcacauauacaccauggaauacuaugcagccauaaaaaaagggugaguucauguccuuuguagggacauggaugaagcuggaaaccaucauucucagcaaacuaucacaaggacaaaaaaccaaacaccgcauguucucacucauagguggcaacugaacagugagaacacuuggacacaggaaggagaacaucacacacugcggccuguuguggggugggaggagcggggagggauagcauuaggagacauaccuaauguaaaugacgaguuaaugggugcagcacaccaacacggcacauguauacauauguaacaaaccugcacguugugcacauguacccuagaacuuaaaguauaauaauaaaaaaaaaggaaaucaacuccaaaaggaaccuucaaaaccaugcaaauauauggaaauuaaacaacauguuccugaaugaucacugagucaaaaaugaaaucaagauggaaauuaacagauuauuugaacugaacgauaauagugacacaaccuauaaaaaccucugggauaagcaaaggcagugcuaacaggaaauucauagcauuaaaugccuacauuguuaagucugaaggagcacagacaaucuaaggucacaccucaaggagcuagagaaagaagaacaaaccaaacccaagcccaacagaagaaaacaagcaaccaagaucagagcaguacuaaaugaaauucaaacaaacaaaaaaauacaaaagauaaauacaacaaaaagcugguucuuugaaaagauaaauaaaauugauagaccauuagugagauuaaccaagaaagaagagagaagauccaaauaagcucaauuagaaacaaaaugggagauauaacagccaauaccaaagaaauacaaaauaucauucaaggcuacuaugaacaccucuaugcgcaugaacuagaaaacuagaggagauggauaaauuccugggaauauacaacccuccuagauuaaaccaggaagaaacagaaacucugaacagaccaauaacaagcaacaagcaugaaaugguaauuuaaaaguuaccaacaaaaaaaguccaggacuagauggauucacagcugaauucuaucagacauuuaaagaagaacugguuaccaguccuauugacacuacuccagaagauacagaaagaaggaauccucccgaaaucauucuaugaagccgguaucacccuaauaccaaaaccagaaaaggacauaaccaaaaaaagaaaacuacaaaccaauaucccugaugaacauagaugcaaaaauccuuaacaaaauacuagcuaaacgaauccaacagagauaaaaaagauaauccaccaugaucaaguggguuucauaacagggaugcagggaugguuuaacaucugcaagucaauaaaugugauacaccacagaaaaagaauuaaaaacaaaaaucacaugaucaucucaauagauugcacaaaaagcguuugacaaaauccagcaucccuuuauguaugauuaaaacccucagcaaaauucguaaagaaggaacauaccuuaagguaauaaaagccaucuaugacaagcccacagcuaacacuauacugaauggggaaaaguugaaaguauucccccugaaaacuggaacaggacaaggauguccacuuucaccacuucuauucaacauaguacuggaaguccuagccagaaaaauuagacaagagaaagaaauaaagggcagccaaacuggcaaagaggaagucaaacugucacuguuugcugaugacauaaucauauaccuagaaaacccuaaagacucauccaaaaagcuccugaacuaguaaaugaauucagcaaaguuucaggauacaaaauuaauguauacaaaucaguagcccugcuacacaucaacaacaaccaagcugagaaucaaaucaagaacucaaccccuuuuauaacagcuguuaaaaacaaaaacaaaaacaaagaacuuaggaauauacuuaaccaagaggugaaagugaaagaccucugcaaggaaaacuacaaaacacugcugaaagaaauuauagaugacaaaacaaauagaaacacaucccauuuucauggauggguagaaucaauauugugauaaugaccauacugccaaaagcaaucaacaaauucaaugcaauucccaugaaaauaccaccaccauucuucacagaacuagaaaaaaaauccuaaaauucacauggaaccaaaaaagagcccacguagccaaagcaagacuaagcaaaaagaacaaauuuggaggcaucacauuacccaacuucaaacgauacuauaaggccauagucaccaaaacagcauuguacuggaauagaaacaggcauagagaccaauggaacagaauagagaacccagaaauaaagagaaauacuuacagucaacugaucuuugacaaagcaacaaaaacauaaaguaggaaaaggaaacuauucaacaaauggugcugggauaauuggcaagccacauguagaagaaugaaacuggauccucaucucucaccuuauacaaaaauccacucgaaauggaccaaagauuuacaucugagacaugaaaccauaaaaauucuagaagauaacauugggaaaagccuucuagacacuggcuuacgcaaagacuucaugaccagaacccgaaagcaaacgcaacaaaaacaaagauaaauagauggaacuuaauuaaacgaaaaagcuucugcacagcaaaagaaacaaucagcagagaaaccagacaacccacagagugggagaaaaucuuugcaaucuauccgacaaaggacuaauauccagaaucuacaaggaaccaaauuagcaagaaaaaaaaaaucccaucaagugggcuaaagacaugaauagacaauuuucaaaagaagauauacaaauggccaaaaaacauaugaaacagugcucaacaucacuaaugaucagggaaaugcaaaucaaaaccacaaugagauacuaccuuacuccugcaacaauaaccauaaaauaaaauaaaucauaaucaaaaauuaaaaaaccaaaaauaaaaaaacucauaaucaaaaaauaaaaaaacauagauguugguguggaugucaugaaaaaaggaacacuuuuacacugcuggugggaauauaaacuaguacaccacuauggaaaacaguauggagauuccuuaaagaacuaaaagcagauuuaccauuugauccaacaaucccacuccuggauaucuauucagaggaaaaaaaaggucauuauacaaaaaagauacuugcacaugcauguuuauagcagcacaauucaaaauugcaaaaauauggaaccagcccaaauauccaucaaucaauaaguggauagagaaaauguggcguauauauaccauggaauacuacucagcaauaaaaaggaauaaaauaauggcauuugcagcaaccuagauggaacuggagaccauuauuccaagugaaguaacucaggaauggaaaaccaaacauaguauguucucacucauaaguggaagcuaagcuaugaggaugcaaagacauaagaaugauacaacgaacuuugaggacuuggaggaaugauaagagggaggugagggauaaaagacuacacauuggguacagcguguacuucuagggugauaggugcaccaaaaucucauaaaucaccacuaaagaacuuauucauguaaccaaacaccaccuguucccccaaaaccuauugaaauaagacaaaauuccaaaaauaaaauaaauauguacaucuugguaacguacagucaauccuuaaacaacauggguuaaaucaaguggguccacuuauacacagauuuuaagaaacaaaugaggcugggcaugguggcucaugccuauaaucccagcacuuugggaggccgaggcggguggaucaugaggucaggagauugagaccauccuggcuaacacggugaaaucccaucucuacuaaaaauacaaaaauuagaugggugugauggugcgugccuguaaucccagcuacucaggaggcugaggcaggagaauugcuugaacccgggagacggagguugcagucagcugagauugcagugcagccugggcgacacagugagacucugucucaaaaaaauaaauaaauaaauaaaauaaaaaaauuuaaaaaaaggaaaaaagaaguaaauguauuuuuuuaaagaaagaaaaagaauuaucucacaaggauuuuaaggcagccaccauuaaaaugcuucaacaggcaauuaccaacacguuggaaacaaaugaaaaaaacagaaagccugaguaaagaaagucucagcaaagaaauacagaauguaaauaaugaaauuacaaaaccaaaauuacgauaacugaaaucaaugucaguggauggguucaauagcagaauggaugugacagaagaaggaaucaauguacuaaaaauaaaacaauagaaauuugccagucugaacaauaggaagaaaacaaacuaaaaaaacaaacagaacuuuggugacucgugaaacuauaauaaaagaugaauauucaugucaucagagucucaaaaggaaaggagaaaaaggacagaaaaauaauuugaaaaaauaugaacugaaaaguucucaaaagacaaaaccuacagauucaagaagacaaguaaaccccaaacaguguaaaccccaaaucaauccaggccaaaacacaucaaagucaaacuucugaaaacugaagacacagaaaaaaucuugaaagcagcaacagaaaaacaacauuuucccuagaggggaaaaacaguuuaaugacaguaaauuucucauuaaaaaccacggaagccagaaggaacuggcacgauaucuuucaggugcuaggagaaaaggcuuguuaacucagaguucuuuaaccagcaaaaauauccugcagaaaugaagaaaaaaauaaaaauauuuauagagaaaggagaauuucucacuagcagaucugcucuaaaagaauaaagaaaauucucuaaacagaaaggaaaugaaaaaagaucucggauaauccaggaaucguggauaaugaggaaggcaggaugacaggaggaggaaaaauauguauaaacacaacagauuccuauuccacuugaguucuccaaauuauguuugacuguugaagcaaaaauuauaaugcuguaugauaugguucaaaauguauguaaagaaaauaaaaccauuaauacacauaaaaauauauauaaacaugcauguaauauacacauauacauauauuagaaacauauaaaaauguuaagauaauuaaaugggggggacuaaagggagcaaaaguuucuauacuuuacuggaagugauaaaauguagcaucaccaaguagcacuguaguacagccgacuaugacuuguuacauacaaaauguaguaucuagagugaggacaaaaaggccauauaaagagauauacuuuaaaacacugaauucuaaaagguauucaaguaaccugcaggaaagccagaaaaacaaacaaacugugacacauccauaccauggaaaacuaacuauaucagcaauaaauaggaaugauucuugacaucucaacuuagauggaucucaagggcauuaugcugaguaaaaaaagccaaucucaaagauuuuauacuacaugauuccauuuauauaacauucucaaaaugacaaaauuauagagaugguuaccaagggugagggauggugaaagggagugggugugugugugacuauaaagaggcagcacagggauaucauuggguuaaggaauucuguaucuugguugcaguguugguuacaugaaucuacacaugugauaaaauaccaaagaacgauauacuacucacuuuacaccaaugucaauguacugguuuuaauauuguucuauaguuacauaagauggaacuaauaggggaaacucggugaaugguacaguaaauaugguacuucucuguacuauguuuucaaauucaugugaauuuauaauuauuucaaaauaaaaaguuuaaaaagugaauuaauucugugaauuauuuaagagcucacuaauaggaucaccauaccuguaaguaaauauuuuuguucuaauagaaaaaaauuauagcaacuuuauucauaacagauaaaaacuggaauuaagaaaccaaucugaaaaggcagcauaguguaugauuccaacuauaugacauucugaaaaaguuaaaaccauggagagaguaaaagguucaguggguugccaggggcuggagaaggaaaagggaugaauaggcagaaugcacaggauuuuuagggcagugaaaauacucuauaugauacuagaaugguggacagcugucauuaugcauuuauccaaacccauagaauguacaacaccaagagugaacccuaauguaaacuaugggcuuggggugauuaugaugucucaaugaagguucaucaauuguagcaaauguaccauucugguggggauguugauaauagggaaugcuauacgcucgugggcacgaggguaugugggauaucucuguaucuuuuucucaguuuugauguugaaccuaaaauugcucuaaaaaaaugaagucuuuugaagaaacacuggaaacgaaauguucaugaacaggugauuaaguacauugugauauagucauacaauggaacacuacucagcaauuaaaagaaugaacuacuaauacacacaacauaugaauuucaaaaaauuaagcugagagaaagaagcuagauucaaaagaguacauaauaauucaauuuauaggagcaguguaaagaagaagcagggagaacgacccccagacugaccaaagcccacauaacgcaccuauguccuaccacaucgccagcaccaugcccaagagaaaggcugaaggggaugcuaaaggagauaaagccaaagugagggacaaaccacagagaagaucugcaagguugucuacuaaaccugcuccuccaaagccagagaccaagccuaaaaaggucccugcaaagaacggagagaagguacucaaaggagaaaugggaaaagcugacacuggcaaggaggggaauaagccugcagaaaauggagaugccaaaacagaccagacacagaaaggugagggugcuggagaugccaagugaagcacgugcauuuuugauaacuguguacuucuggugacuauacaguuugaaauacuauuuuuaucaaguuuuauaaaaaugcaaaauuuuguggguuuuuuuuuuuuuuuuuugagacagagucucacucuaucgcccaggcuggagugcaauggcaucaucucugcucacugcaaccuccgccuccuggguucaagccauucucuagccucagccucccgaguagcugggauuagacacacgccaccacaacuggcuaauuuuuguauuuuuaguagaggugggguuucaccauguuggucaagcuggucuugaacugaccucaagugaaccggcugccucagccucccaaggugcucgugugugcguguguguguguguguguguguguguguguguuucaaagcuaugcuguuagcacacagaacacuuacuguuguuuuugggggaaggggcauaugucacuaauagaaugucuccaaagcuggacugauguggggaaaauaccuuucccuucuagcuuugagagacuucuucuuggaucucaggaggagggauucccugacuuagauacacagggccuccuuggcacaaaagccugugggauggaaaaacaaauuuguuuuuauguucuuuucucccuuuccaccuuucagcauagacuuaacucccuuuaacccagacaucugcugggaucugacccccaauaauugguuaccagugugucagacaaucuggauguuccagugauaccacugagauggagccccucaaaggagcagugguuccauuuccagauuguggaucuucagauaaauucugucauuuucauuucacuuccugagucaggaucggcucgugaaaaguuguuaaacaacauucuaaaugugaaaugucaacccucacucuaaacuuucccuguucagagcaucacaugaagacuucacuggguuuauaguggcuuucugauuuuugguaguucauugaagaagggaguuugaaaguuguuguaugcuguuaaugauuuucugcccauguccugccugaaauaccaugauuauuuauggaagguaucuuuaauaaagcuggauacaguuuagcuaggaaaaaaaauuccauuuauacaauauucuggaacagguaaaacuauagugaugaaguacagaucaguaauuguuagauguagggagagauuuugaccaaaaagggaaagccagaaguuuucuagggugaugggacuguuuguuuccuguuuguagugguaguuguauggauccgaacauguguuaaagcucacagaacuuauguuaagucaguuuugggccgggcauaguggcucaucccuguaauccuagcacuuugggaggcugaggugggaggaucacuugaggucaggaguucgaggccagccuggccaacauggugaaaucucagucucuaguaaauacacaaaauuagcugggcauggaggcagucaucuauaaucccagcuacuuaggaggcugagguacaagaaucgcuugaaaacgggaggcggaggcugcagugagcugagaucaugccacugcacuccagccugggcaacagagugagugagacuccaucucaaaaaaaaggucaguuuuacuguauguaaaucuuaaaaauuaacaacaaaauaaaauaauuucccaucagaacuuuuuaaauucuaucuucaauuauuuaauagauacauaaaguguauucuagucuuaguucuguuaccaccuauauaacacuugaggauguagcuucacacccuuaguuucacuuugcaaaauguaaggggauaaucaaaugauuuccuuuuuuuuuuuuuuugagccuuuucuuauucuaaaaccuauuccuauuccauguuucuguuaaauuuuuauuauuuuagaauuaacaaggaacacaaaauauuuuaauguacucaaguugacuccacaaacuuccuucagacagugugggcuggcuugcaauauucuucuuauugguuuuaugugaucuuuuaugagcucuaaacauuugaccuuacuuaguagcuuuguuuagaugauuauuagauagcacucucaucuuuggaauaaucaggcuucugacuauaagagcuguacaagauuucuauuuccuggcugggcaugguggcucacaucuguaaucccagcacuuugggaggccgagguagguggaucacuugaggucaggaguuucgagaccagccuggccaacauggugaaaccccaucucuacugaaaauacaaaaauuagccagguggggugacaccgguaauccuagcuacucaccuguaaucccaggaggcugaggucagagaaucgcuugaacccaggaagcaaaggcugcaaugagccgagauucgccauugcacuccagccugggcaacagagcaagacucuaucucaaaaaaaaagucuauuuccuuuauuauaucagaccaugucuauauuugcuguaaaaaaguaugugaacugccauuucugccagccaaaugaugccuauuguuauuaauuuuuauaagacaugguauucauauugcuggagaaaagaaaguaagccauuguuacugaauucauucaauauaaucaaaaaaauuuuuuuaacccuacauagaaaaucuggaguccccaaaucuuuugcaaagaucuucauuucuccuauagaagagcugcagacuagcaauguauuauacuaccaaaucuuauauuaaaauguucuguuuauauauaagaauaagcaaagcuauugaggaaguucauacaauuuaagaaucaaauuuaauaacuuccuagaaaacccucauugcaauuagcaacuuuucauuuaaauuuuuuuggagauggguuuucauaaaagaaauaaaaagacccaagagcaaauuauuaucucuuucaacaauacucucaauuuuguacaggagaauaauuuuugaauauuuaugaaaaucauccaaauuucucacauugagaauuaagaaaaauaaacguggcauacauaagcuaaugaaauauucaauaacuacuugaauauuuauacuuacuugguacuauuuuucuccgauaaauucaaauaacugggcaacucaaaguggacugaucuuacaaaugcaggccaacagauucuguaauucuccuuuauuaccuauacuucuauuuuuuaaaacucugaaucaacccauuuaauucuuucaaauacagcaugaagaaauaaaacgaagcccugagcuauaucuaaucauuuaauugcuaagcagcaauacacuuacaaaagaaaaaaccaaucaauauuuccauauaauucuaucaccauguuaaacuuuaaaauaacuuggucaagaaggaagcuauaaaucaaauuuauuuccuguguguuuagaucacacacccaaauauacacauacauacauauacacacaaaucaacagcuccauauuucccuuauugccauccugagguuuacugaauaugacaucaaagaguuccucgaauuuccauacaucuaagaacuuaucucauuuuuagaaaauauccuggcacagaaagcagacuacauagaaauaaaucuacauuaaaacuaaauaaucaauggcuaggaaaaacacuuaauuuaaugcuaacgaauuugucaacaugacucauuaaaaaaaauuuacuguuucagcaauuucuuuauugaaauaguuuaaaaaguuaaaaggcuuuguguauuaaaaccaugccuucugaaucacaaggccauccacguguacaaagggaaugcuuuaauaagaaugggacaccagccuggaagccuggcuugcuugcaguugacucuagaucaggaauucuuuaagccuaaagccaaacaagagaaacucacaaaucacaggaaaaagcccagucaucuugaaaaauuccaaacccucaguuaaaugucauaacuuuuuuaugaacacuaaaucacaaugggccaaugagaaacuaacaguaguccuuaaaaugacuacagucuggguuagcaagacacaaucauauuauaauagguaaaauuuaaugaaacuguguuaggaguuugaaguuuccaggaaacuagcuccugaguuaucucaaaacaaaaaccaaaaaauuaauuacuaugaaggguccucuucaucuuuuccuuuaaggcaccauuaaaaaguggcuguaaaaaaaaccuuugcauauguuuugaagucauacauagagcugagaauuaaaaacuagcucuauucaagucuguaucaaauaucauuuugaauuccauggaucugugauggcaugaaaauggguacgcaauaagagguggagcucuguagggcagggcaucaggaaagaacaucagcagcugggcaagagaaucuuauaauggacucuuaagaaaaacagacuucagaaaggacauaauacauuuuucuucucuaaaauaagucaaaucucaaaauguugcuuucaaauuuuguuguauaucaacuccauccuuugcuguuuuccuuauuugauuagaaccaucugggagauccuccuuucuuuuauuaguucuacagaaaacaugcaguuaaucaucuuaaaaaacacuuuuuaauauagaacaacuggagauuguauuaaugaucaaauuuucauaucugcagagaaagcaccaucauaccauguggucuagaaagucaguuucuuuuaaaggaaagacaauuuagaaaaaaaaauuguacaagaaaaacugcucauacccacauacuaguuuuaaaauuauuuucuuuccaauuaaaaaaauacuaaaaaguuacacaguuguagcucuacaacuacaaaguggaaauaaaaaagaaaacccacuucaauaaaggcaaugaaauaauuaauuuuacguacagcuuagcuucccaugcuuauuuauucauuuucaaaguauccuuuuaaauuaacugaaauuuuccuuagcucaccuacaauuuaugaauacuuuauuauaaaguaugauuucucuuugcauuagucaggauaacguaugugguugauaaacacaaggauauuaaaagucaauuaugcuuauucuuaauccaggaauaaaugaaaaccaaaauuaaaucaacucauagaccuuauuacuugccacuuccuuaccucuuuguuacuguuauuuauauagcuguagucauuacuacuuucauauuagaaaauguuuguuucuccuucuuggauuuuuucauaaaucauugaauucucacuuucucacaaaaugguacuucauugaaggauguaauuagucucacuaaagcaagaaaacaugauaaacuugguugagagucacagagucacuuagucuagcccagcuauaugaccaauucaaucuggucauguaaacaaugaagagaaugauauuuaacccacaagaguauggugaugaggcucacaugagauuaauguauguaaagagcaaagagcuuugaaauguuuacagugccauacaaaugcgaaggucucagucucaccaucuucacauggcaggauucaaugaagugaucucuaaagacuuaucucgcaaccaaaaauucuuagcuauucacaugugaagcacauuuuaaaaaucuacugauaggauaacuguauuacuguaagggacuuauggaacaaugaagucaaucuucucaccuuacaaaauguaugaaaacagguuaagauacuuguagagcacaugagucaguaggaaagcugggaauugaaagaacccagaucugagccccaccucaaaguccuuucuaucauauguugcuguucacuauucugugaauuuaaaaucucucuucaccauaggaucauguaaccuaaauuacuuuuucaaacugguuacaaugaaaagcuuguuaagauggaaauauuauuuuggugaggcgauuuaacugcuaauaguugaauuaagaaugcuuacaaaugacacuaauagcaaaaggagcucagacuaaauuguccagcuauuuguuugguuuguguaauauuaaauuuuaagucagcugggugugguggcucaagucuguaaucccaguacuuugggaggccgaggugggcggauuacaaggucaggagaucaagaccauccuggcuaacacggugaaaccccaucuucucuacuaaaacacacacacacacacacacacacacacacacacacacacaauuagccaggugugguggcacgcaccuguagacccagcugcuugggaggcugaggcaggagaauuacucgaacccggaaggcagagguugcagugagccaagaucacgccaccgcacuccagccugggcgacagagugagacucgucucaaaaaaaaaaaaaaaaguaagucaauagacauggguuuacaaacccuaucuaaccuuucccaauacacgguuuugaaucugcuuuugguacuuacuagcuaugugaucucggacaauuugcuuauuucuuuguuuuaaagauuaguaugucaccuggcugucgugaauuaaauaaguuaguucacguuaaguccuuacgauagugucuagcacauaguaagugcuuauaaacguuaguucccaucucuaaucuuccaaacuuuugaggaauagagaauacucucccccuuuuuacuucaucagaaaguaaaugaaauaaauuccuuaaaugaaaguaaauuccuuauaugaaauacauauguccuccacccucuacuucaauaaucagcaguugcacaacaacuaaaccuaaauaaaauagggaacauugugacauaauggaaggcaaauacgguuuggagucagcagauaugagucugaaucccaacuuaacucuuuaagagcuucugaccucaagcaauuuaccaaaccucacaaaacuuuccauguuaaaaugagauugcuaucuagcuguuuauaauuuugucuuucauauucauaguuaaguugcuaaucauuugauauccccuaugucauuuuuuuuuauugcaucuauuugauucuucucucuuuucuucauuagucuggcuagcggucuauuuugcugaucuuuucaaaaaaacagcuccugcauucauugauuuuuugaaggguuuuucgugucucugccuccuucaguucugcucugaucuuaguuauuucuugucuucugcuagcuuuugaauuuguuuguuauugcuucucuaguucuuuuaauuucgauguuagaguguugauuuuagaucuuuccugcuuucucuugugggcaucuagugcuauaaauuucccucuauacacugcuuuaaaugugucccagagauucugguauguuguaucuuuguucucaaagaccauuugguuucaaagaacaucuuuauuucugccuucauuucguuauuuacccaguagucauucaggagcaggcuguucaguuuccauuugguugugcgguuuugagugaguuucuuaauccugaguucuaauuugauugcacuguggucucagagacuguuaugauuucuguucuuuugcauuaguugcaaauaguuugaaaagagcaugucuuauucaccuuuaucuccuccauacuacuauggcaagguuuaaaauuauuagauuuuugcugaaauaagacaggagauuaauaaaagagauuuaagaccagaauaaacauguuacauuauggaaagaaaaaguacaaaccugguuuaauuggcuccaacucugggcauuauguuguugcuuccuuuucuuuccuuacaaauggaucucaaguauucuuuuccuauuagaagaugcaaaguggggaagauauauuaauaaagggcauuugaaucacucuuuaaaacugagcauucuuuaauucaccauaaagcagaaucaaacucuuacuuauucuauuugaugaacuuauuuuuaagcuauaaaaucacuaagagguguuuuaauugguuaauacaacagaaacauuauaggcuuaaguagccaaaaaguaaacauauauuauagugcauuaaaauaaauuuguuccuuacuucaaaaaauuacuuucaaagaauagcaguaccucugcuaaagauaacuucacuauucagggguugcaugaaacaguguaguuuauuauaauacauuacacaaaaauacuucugguuccuacaguucuuaaccuuuuggguggaaggugaguggugaguuauauaaaacuuugauaauccaaaagaagcuauaaauugcaucuucauaaaaauguguacauaugcaucauaucuugcauauaauuuuaguugagucaugaaacccagucauguacccuguagaucucuaaaaccuguuggcagacucuguucuugaguuucuaaaaaugaacagacuuaagaaaaugaagaaauagugacccagagagaugaaaaagauuaaaagggccacacuguacucaggaagagaaggauguucaacuaccauauuaauccacauaagacugaccaugcaaaauuuacaguaaaucagugccuucgggucagaguaauucuuaaaacaaaaccagaauaggagacuucauggugccuagcacauagcagcucaugaaaugauacgaauuaaaaaauauuugucaaguaaugaaaauggauaaaauauaaaaacgcaauuuccaaguaaaugaaauguuuuccagcugaccaaauaaguggcaaacuuaaacguuuauuaucuacuacauaacauuauauaauauccuacuauucaagaaugcuuaaauugugauucaaaaaggauaaaguuguccuccuuuuaauaguaauuaggcaaagacauagaacuucuuccuucccaguuuccuuuuuggguuccucuuuuucccuuuccuccuaggguucaguguuuugcccacuucacacucuacucacauuuucuguauuccuccaggacugggaggaacucaaaugaaaacccugaauccuaaccuuucaccugagccucagacuccuacauccaguuguuuguuggauguuucuaacugaagguacuauaggcaaaaacucaauauaucccaaaccgagcuguucaucuuuuccuaaaaucuguuccuuuuuaaagucccugucacagcagaacaacagccccuuaacuucucaagcuaaaaguugggcaaucaucucacacuucaccagucaucuucaauucuuauugauuucuacuuuaaacacuuuccaagucuauuuccugaauuccaucccuauuaauaguaucuaaauccaaguuaucucucaauaugaccaaaucaguaaccuaacucaucuccccaucucuaauuuuauccuaccucaaauuuauuuacauacuucugccaacaugauugguuuaaaauaaaaauuuugccacaucaagcacuauaucaaacccucauuaugccaaacucuucaaagcaacccagcacuaacagaauaaaguccuuuauucaaagaauaaauguccaaguaugacauauaaaguccucaaugaccaggcucauaccuaucucuucaacuuuauuuccuaucucccacuuuauugcaccacugacauacugaacuauuugucaaucccauauauucucaugcuguucucuuugccaguauaucuuuaccuaccuuccacacauaggaaauucuuacuuauucagguacaagaucacuuucucuggaaacccugaccacagcauacuucucuacaccaccaagcucacauaucauugcaacaagcacucaggagauauuuaacugaauauuaaugaaacuacacaaacuaaugacaaagcagcauacaauuuauauacauaaaaccagugagaagggaaacuaaauggauuuuaguaagucuuuuuggagaaaaggucuuaaccugguggauccaaggaguaauuguucagauuguugaagagaagaaauaaaaguauuucaaugaggcugggcgugguggcucaugccuguaaucccagcacuuugggaggccgaggcaggcggaucacgaagucaggagaucaagaccauggugaaaccucaucucuacuaaaaagacaaaaauuagccgggugugguggcgggcaccuguagucccagcuacucgggagacugaggcaggagaauggcgugaaaccaggaggcggagcuugcagugagccgagauagugccacugcacuccagcaugggcacaaagcaagacuccgucucaaaaaaaaaaaaaaaaaaaguauucgaaugaguaaaacagagauggaaaugaacauucauaggaggcuaagaagacauguauugcaagguuuggaggaacaguaaacagcaaauauaaauuaacaaauacagcuaucccuauaaagagccuuagauacuauaaccaauaauucaccaaagaccuucaaauauuuuuuucugaaaccauauggcaaaguugacauuuagguacuauccuguacuuucauuagagauauauuagagaaauauuuucaucuuuuagucacuucccugcauccuuauagguuuaagaagguauccccacugaauuagcacuuacugaagaacuuuacauaaaauucucaaauuauaacacaucucuauauugcauaauaguuuacugaaauuagaauaagguaacauaagacucuauuucaauuaggucaagggcugguuaaucuuacaaaacagucuucaauacuagaacauuagguugcuccaaauaaguagggaaagugaaaauauaguauacuugauguuaaauucacagaggauuucaacugcaaauacuuugcuuucuaaaugcaauauaauuaaaaagcaucaauccuuaaacuuaaauacacgaccgggugcagugccucacgccuguaaucccagcacuuugggaggccgaggcuggcggaucaccuguggucaggagcucgaguccagccuagccaacauggugaaaucccaucucuacuaaaaauauaaaaauuaguggggcaugguggcacaagccuguaaucccagcuacucaggaggcugaggcagagagaauugcuugaacccgggaggcgaagguuacagugagccgauaucgugcacuccagccugggcgacagagccagacucugucucaaaaagaaagaaagaaaccaaaacaccuaagauaauacacuagucauagugcagaagaauaaaucuaugagguauuuccaugugaagagugaauacuaaggucaucuaccaaaaauaaggagaaaaagaugcuguuauaauuacucuuuuuuuuuugagacggagucucauucuguugcccaagcugaagugcaguggcaugauucagcucaccgcaaccucugccucccaggcucaagcgauucuccugccucagcuucccgaguagcugggauuacaggagccuugcaucacacccagcuaauuuuguuuugagacagagucucacucuguugcccaggcugaagcgcaguccacaaucuuggcucacuacagccuccauuucccggguucaagcgauucuccuaccucaaccuccagaguagcugggauuacaggugcccagcaccaugccuggcuaauuuuuguauuuuuaguagagaugggguuucaucauguuggcuggucucaaacuccugaccucaagugauccaccugucuuggccucccaaagugugggauuacaggcaugagccacugugccuggcuaauuuuauauuuuuaguagagacaggguuucaccauguuggccaggcuggucucaaauuccugaccucaagugauacacccgcuucagccucccaaagugcugggauuacaggcauaagccaccuugcccagcuucuucuucuuuuuuuuuuuugcucaguugcccagacuggcagacuggagggcaguggcgugaccauggaucacugcagccuccaccucccaggcucaagcaauccucccgccucagccucucugguagcugggacuacgggugcacacuaccaugucugaauaauucuuuucuauuuuuuuuguagagaugggguuuugccuuguuacccaggcuggauaacuacucuugaugacauaaaaucuacuguuugcaguaaagacagaaagcauucacccuaauaccuuaguuagaagacuacagaaucagucagaagaagaucaagucagaaacauaagcagcacaaauaaaucagccaccccaaacugaagaaucucuaaauguaggucuguaucauuuuuauuuuaagcguuuaacuauauagccauauaagacaauaacaaaggcauauuuucuauaccaaggaacaagaugauuaggaaacagauauaugcuaacaagcacagaaucacuuugaaguguaacagucaaugcaugggguuguaugauggcuuguccuugacuuuguaaaugccaauucccugcuuucagauuugcagacaguaaaacgugagauacaaagcugaauguuaauuuucaacauaacacugauaugucagaaaguagggguaauucucauucucacauaauaccugucauuuuaaaacaccccuacugauaugaaccaacauuugugaaugaaagguuaaaaaaugcuuuugagcugucauauucaagcaaauugacagauauaaaugcacacacacacuagucuucgauuaugaaaucuccucacacauaaacacuauuauaaaauaaauuucuuuaagagaaaagcgacugauaauguuacaagcuugcuaaagagaauaacaucaaccauaaaagaaacuggcggcccaccaauaugaugcugacaaccacauuaugcucaagugugcuauagaggaucauuuaaaugcugucaaugucaccuguacuccuucaauauuccauuuuaugaaaaaccuucugacuuaaggaauauggaaucauccaucugguguaaaacagcaaacuguuuucaucuuguaugcauuuauuuuucacuaaaaaagagaguuauggccaggcgcgguggcucacgccuguaaucccagcacuuugggaggccgaggcaaguggaccacgaggucaggagaucgagaccauccuggcuaacacggugaaaccccaacucuacuaaaaauacaaaaaauuagcccggcauguuggugggugccuguaguccccgcuacucaggaggcugaggcaggagaauggcgugaacccaggaggcggagcuugcagugagccgagauugugccacugcacuucagccugggcgacggagcaagacuccgucucaaaaaaaaaaaaaaaaaagaguuauauauuucuugugaucacaauuucaaguaaaauuaggacuaaugcuuacacuguacaaauauaaggguuauuuguaaaagaguagcagauuuucuacacaugcacacacacacaaugauucuuguuaucugugguaguuaugguccauuaaauugucacaaacacugaguuagugaacacugaaccacugcuucuagggaaaaugggaaagaagguuagguuucuaggagccucuggucacaacauuuucaucaacuagccaacacauaaccuuguuuuaucuguauuucuguuuaaagacaccuuacuuaauauauauuuacucauuaacacugaaaucauggcugaaagcauaacucaugauugagagaagcuuacuuaacauacauauuucuugcauagauauaucacagcuuucuugcacuuaggaauauuacacagcacuuugggacaacacugggggccauuugcuuaaaaaagcaaaauuaccaaaaaaaaaaagcacagaaaaugugaaaaauguggcauuaaguagacugcaaaagggauguuuguuuauaguauaagaaccgaaacaagaaggcagaguaucaagaguaucaccuuguccaacuacagcugagaauuugcacaucaggugacucaaauuuuuuuaccacuccgagcgugccugcaaauuauuacaaaagcaccguaaguacugauuuagggauuacagauaaauuuuaggaaguaggccaauuuggaaauacgcaguuagugaauaauaaggauuaacuuauguauguauaugaacguauaugaauacuuacauauauauagucuuauauauaugaacuugugacauaugacauacguagcaggaaaggcaaguuauagaacucccuagugugagauucucuuaugauccaguucuauaucuccacuuggcacaaugaauacucuaccugaaugaccuaucagcacuucaaacuuaaaauacuaagcucaucauaugcccuuauuccaaaccagucuucugcuguauuacucuaauccuggcaucaucacaucuauucaagucauucuaugacuaucucccuucuccacauccucgccaggcaccaaaucauguugauucuuccccugaauuaucucuuaaacuuaucucccccugccuaaaaccacuacuguuaucaccaaaugccuuucuaauuacuugaaccauuggcaguuuacugccuucccucuuuaucucauacuccaaaaauguuacugccacuguucucuuuuaaaaacccaaaccuaaucauauucuucauuuccugguacccauguaauaagcaccacauuuuuugauauauauguccauucaugauuuggcaccaagccaucuuuuuagaaucauacugacacucauaccugauaaucacuauauuccagccacaguaaucuauuucccccucuuugaauaugccaugcuuuaaaaaacccuuuacacauguuaguccucccacuagaaaugcucuuuccauucucuacuugaccuuaaagcuucugccaaugcuaccuccucuuugaagccccuccaacgcuggccacguuagucagucuuccaugugcuuccacaguauuuucacacacuuuuauuauagaauuacuuaaacguaguuauaauuacuaagagagaaagugcaagaauguaaaagguuaacuaaauauugauuacuauuauaacuaggugauguggauuuguuauauuauucucuagucuaguguaugcugaauuuccauuauaaggaaguaaaaaauauagagacagaaaauauuugucuacaauuaauugaagcucugauuuauguaugacuuuaaaaaacagggcauuauuuuauuuccccccaaacaaaauguccagagguagguagucuaggauuaguacagaggcugaaggggucaucaaguccaaggcucuuucuaucuuuuugcuaaguguguugauuuguugcuucaaagcuguuugcuuuagauauaagcauuaccucugcauucauggaaggaaaaaggacagugccagucacacauuuacccccaaaacaggagaaacaaaagcauuuuuccagugcccucagcaaauuuggccuauaucacacuguccauaucugcuggauaagacaacagugucuugauggccugaucucugaaagcugagacuggcuuugugcuuuagcaaccaauccaguaccuagaacacacagguacuuugugucuacugaauguaugagucuaauaaaggaaacuacaguaaauauauaacagaagaacucugcuuuuauaauuuuauuuaaauaauauaaaagguauuuuaaaaauuauaaguacuaugcaaauaaagauuuguauagcaguuugacaucuacgauuaugaaauaauauaccauuuuacugcucucuguaaagauucagaaagaacauuaacaaguuaucgagaggucugaauuuuugucuaggcaaaacauucaaucuuccugaaccuugguuuaccuaaaagauaaugcuuauuuauuucucaggguuguucugagaauaaaggaaauauaacaauaugaaugcacauugaaauguguaaaaugcgauaaacacaugcauuauaaacacaacagcccuuccagguccugaaaggaaauuugcagucuuauguaguaugcauagagcaucuggcauaccaauaauaugaauuaaaaauuaaacacuaucaauaccuaguauagaugcuggacauuauaauauguaugguuagaugaguuuuugaacuugaucuuuuuucuuucauugcuauaggaaacuaaacuaacugaacugauauuuauaccucauuaaggaaaaaaugcuuuauaacauaaaucugguuucucauugcaaugauaugauauauacaauuuaaaaaggagaauaugaaaaauaaaauaaauggguuaauacagaacaguugacaucaaaucucaauucaacaauuaauauuuacuaccaauggaugaauggcacugauguaagucaagguccuaaaguacuucuaaauuaaaucgaguaauaaauaaaacaguagaagcauugaauauuaguuucccuuuggcuuuaauaaccuugacuaagcuuauaaaaaguaccacucagggugaccuuauggcucauguauauaugcacaggccacagugguagucagaacuaguucuauaaaugauaacaugauggccuguucucuugaguuuuuacuaagcuguguaggucuucauuuauaagaguguuauauuaaaauaagcaugguauauacaacauaaaacaguugccaauacuaaggaagagaaaaaaagacauuuuaaaacaaaaaaaauccuuauagacuauuacagugagaagugaucuucacuuuuacuagauuuguggacuacggaugcuuugaagaacauggucuuuucucaagucuuuuaaauuaacucucacuucucaaauauucaacuaucucaaccuuauuaauaaagccucaucauacucugauucauuuaagcagaaacucuuuuccauguagguuaccauggaauuacuugauacugaaaacugauucaucuuaaugcaaaacacuaccucaagacuguaggccaguaaauuccaacacaguauuacauaaugcaccaucaacugaaaaauuccaaacaguggaucagacuucuuaucuuauaguugcggaacaucuauuucaacaagaaguaaaacauguccaaacaguaagaaugagcuuauguuuuauagcuauauccacccaguuucaacuacauagauuuuuguuuauaaacgaggggagaaagaauguuucucuuccuguuuuaucugcucauauagcuucaucagcuaaagcuucaacagugaauauuucuucuacaaagaaaauuuuggguaccuggaauaagcaagaaaugauacgucaaugugcugauguuucuaaaauuaaaagauguaagugguauuuuaauauaaagagcuauuucaaauauuuaacuuuguagauggaaaaggaaguguauuaauuuaaagauucacugcuguuuaaaauauuccccuuauuuucuuucaauaaaaacuaaaaagaagaggggaaagaaaggcacuaagagagcaacguagacagugaaaaugagucacuagggaauaaagagguaaggaugccuuaucuucuuuggcucaugaauuacccuuaccuaaaaugguaaaggagauuugauuauaugaauauugaauuauuacauaugcccugaaauuauguacaucuaauauguaucaauaaaaauaaauaaaugggaccaggcgagguggcucacgccgguaaucccagcacguugggaggccaaggcaggcagaucacuugaggugaggaguucgagagcagccuggccaacauggugaaacccccaucucuacuaaaaauauaaaaaauuagccaggugugguggcaggcaucuguaaucccagcuacuugggaggcugaggcaggagaauugcuugaacucaggaggcggagguugaagugagccaagaucacgccacugcauuccagccugggcgacagagugagacucugucucaaaaaaauaaauaaauaaaagaaaauaaaugacaaauugaaaaaaaaguaaaaugcagguaucuaaaucugaaaauugaaauaaaauaaaauaaaaugguagaggacgaguuuauccuagggcagauuauuaacuaugaucuaggauuguucuuaggaggucucauguuuaaagaggcccauauuuuucuuuuaacacugaaaaauuaagaaaauauuaaaaaugaagaaagggauauagggagagaacgagacaaaggagggacaagcacacacacagaacuuuggcccaaaguaccaaguacuacagcuuagagaaugccccaggagaucaaucacugucacauuaugacaucagagaucaaaauucccguuuagucuaaaaugaccaaaauuggacuuaaucagaaguaaucagcuguaaaauaugcagaucugaaagguucagacuaugcuccacugucauucccaguuaggauaucaaauugaauuugcaaguuuagaugauuuguauuugcuaaaauuaggucucaggauacacagagaaugugaaaugcucccugaagcagcugacuugauauaugcucugaggaaguacuacugccauucacagaaaaaagcauauguuucauagcagcuacuuuaaaaucaauguuuucacugccucugauaguaacagaaguaaaauauuuguauuucaaauucacuccaagcugaaaauuuaaaaaaugaaucuucuuauaaacuuguguuggcaaaguauacgcuauuaacaccugugacugccucuuccccaaagcauaugucacuucagcugacauaacagcuuguccuccuuggaggaauucaaucaccucaucaauaguacuggucaagcagaugaaaauauuucucauggggcaguuuaucuuagugcaauaagauguuucuaaaacucuuuaaaaucuguaagcaugugaaaucuggugaaaccucauuucuacuaaaaauacaaaaauuagcugggcaugguggcacgcaccuguaauccuagcuacucaggaggcugaggcaggagaaucgugugaauccgggaggcagagguugcagugagccaagauggcgccacugcacuucagccuggcaacagagugagauuuugccucaaaaaaaaaaaaaaaaaaaggccgggugcgguggcucacgccuguaaucccagcauuuugggaggccgaggcggguggaucaugaggucaggagaucgagaccauccuggcuaacaaggugaaaccccgucucuacuaaaaauacaaaaaauuagccgggcuugguggcgggcgccuguagucccagcuacucgggaggcugaggcaggagaauggcgugaagccgggaagcggagcuugcagugagccgagauugcgccacugcagucugcaguccggccugggcgacagggcgagacuccgucucaaaaaaaaaaaaaaaaaaaaaaaaaagaaugucacaguauuucaggucaagucacagcaaauaaucugcccucugaucuuuauuauuaaugaaaaaaaaaaguccuauagcuucuuuuguuugguauccuuaauuuuuuuuuuuuuuuuuuuuuuuuuuuuuuuuuuuuuuugagagguagucucgcugugcugcccaggcuggaaugcaguggcacaaucucggcucacugcaagcuccgccucccggauucaugccauucuccugccucagccucccgaguagcugggacuacaggcgcccgccaccacgcccagcuaauuuuugguauuuuuaguagagacgggguuucacuguguuagccaggauggucucgaucuccugaccucaugaucugcccgccucugccucccaaagugcugggauuacaggcgugagccaccacgcccggccgguauccuuaauuucaacuuugaggagacccaacaacuaucucuuaccacauuucuuaucuagccucaaauugcuggacgaaacauaauaaauuaaauggugcuuuaaagauuauccuuucuaaaaauuuuuauucacagaguccacaggccuugagaugucaaggaucauaguuuagggguaggaaaauaguauacuuggauuuauucuauaaauucuauuguguaauuuucuuuuccucaucucuggcagguucuccuaaguuaauguacaaaaucaagcuccuucuacaccuccaaaaaacugucccuucucuccguuuccuuagcguuaccagggccuagcgguagcuaaacuuccacuccaucaagcagcaccuaggcagaggugccuagguggggagaaggccaacuggcacuaccauauacccucuuguggguacaaaguggugcuaguuggcccucugcccucuaaucccugugagacccagcuggaugcuaaacuuucacucccacacuuggcaaugcaacaggccaacaaaaagcaauaacuaccaaaucucacccaauauaaaguuuccaagguuauuuauaagauucuuacaauaauucuuuccacaaucucuuucuucuagaauugauuuuuuaucaucaguauuucccuuuaauaucuuaauuuucuucaaggucuggagauauuucauugaucagauguauucuuaaugaaugucuccucuuauccacucaacucacaauggcuuuuauugaaagcuuuaaaaauuaauuuuaaaaauaauuucaaacagaaaaguucaagaaugguuuuuuccccaauuugaaaguugcugacauuaugucccaucaucccuaauaacuuguuuauaauuccucuaaaaauauucucccaaauaaccauaauacgaucaucaaaauugacaaauuaacaaugauacauuacuagccugugaaguuucaccaauuauuccacuaaugucuuuuguagcaaaggcauccaauaggguauuaugagauguauuuaaucgucaagugugucuagucucuuuaaaucuggaauaguucuaaaguuuuuccuugacuuucauaaucuuuaugaauuugaacauuacacacuggguauguuguagaaagucucucaacuuggaauucucuuuucuuccaaauuagauuucaguuaugcauuuuugaaagaagugucauagaaaugcugcuguguuccucacugcauccuaucagcuaggaaucauggaauuagaaagaucacugauuacaauaauuggcaaauggugaucuuuccauuauuccuuuucuucuccccacuaauuuauuagaucacuguggucucaugaguuccuauuuuauucaaagagcuacgauuugauaguaugacuauuuagucugaugcucaaacuguucaagaauuggccagugagugccccuucaagguggcuucugcauccuuuagauauaauccccucauucuucgagcucuacuuuacuuucugguacagggagauguguccagcacaucuugucuuaugcuuucccugucccagcccuagaaucagucauuguccaagaaacccuagcaccuacaccuuccugggcccugucuuaaaacuuuuagacugaauuauucaggaaggaaggucaguaauacgaaagccaaagggcuaauuuguuuagaaugaauaacugcacugacuucugcuguagcugaagaggucuguuuucccaauggucucaucugccuugaacagcaagguugacuacaggauguuugaggaagagaggaguacuguuaguaggcaggcuuccuccaacagauaauugccaaaguaagaaaacucuugcuuuugagggguggaauauucugguuucauuuuauucccaggaaagguaucuauuccuuuucuuucuuuuuuuaaaaauacaacuuuuauuuuagaacagcuuuagauguauagacaaauugugaagauaguacauagaguucccauguauccuacacccaguuucuccaauuacgaacauuuuacauuaguaugauaccuuugucacgauuacuaaaacaauauaaauacauuauuaacuaaaguccauauuuuauucagguaucuucaguuuuuccuuaaugcccuuuuucuguuucaggguccuaucuagggcaucacauuacauuuauucuccuuaggcuagucuugguugugacaguuucucagaccuuccuuguuuuuuaugacuguauucguuuccuguggcuguuauaacaaauuaccauaaauuugauggcuuaaaaaaccaguaauuauuuauuuauuuauuuauuuauuuugagauggagucucccucugucacccaggcuggagugcaguggugcaagcucggcucacugcaaccuccgccuuccagguucaagugauucuccugucucagccuccagaguagcugggauuacaggcaugugccaccaugcccagcuaauuuuuguauuuuuuaguagagaugggguuuugccauguuguccaggcuggucuugaacugcugaccucaagugaucagaaauuuauuuauuuuuauaugguucuagagacgagaaaucaaagaaucaaguaauuagcagggcugcacucucuuagaagucucuaggggugaaucauuccuugacucuucuaacuucugguggcuguagggaucccuuugcuuguggcuauaucauucuaaucucugccugacuucacauggcauucuccucugccuguuaucuucugugucuuauaaggacaccccucauuggauuuagagcccaauagauaauccaggaugaucaucauaucaaaauccuuaauguaaagacaucugcagaggcacuuuuuacaaauaagaucacguucacaaguucuagagguuaggauguggacauaaucucuuaggggagcggggaucaucauucaacccaucauuauuaccuugacaguucugaggauuacuggucauauguuuugcaaaacugugauuuauuugauuucucauuagacugggauaauguguuuuggggagaaaaaccacacagguaaagugucauuuucaucauaucauaucaaggauacacgacaucucuguugaugcugacccugaucaucuggcuugagguacaauuuaucagguuucucuauuguaauguuacccuuucuguacugcacucauugaaggaaagucacuaugaacagccuaauguauggaguggagaguuuugccucacuccauugaggguggaaugucuaaguaaaucauuuggaauucuuuugcaugggagauuuaucuauucccucccaaggucaacaucaaccauuuguuuauaucaguaaagauucguagauauuuacuuuauacauuggauuaugauccaacaauacuuuuauuuuguugcucaaacuguuccagcuuuggucauugaagaacuuucaguuggcuccuguguccccuugacauacuccuaucguugugucuuguuuuguuuuuuugaguacuuucuuauuuucugucacuccggaggcuccauacaucuuguauauuuccuaccccagggcuagaaucagccacuucuccaaggaauccugauuccuaacauuggauaacccugacuucuacuccccaagaucugaggacuagguaugauaauugcuacuggaguuucauugcuucuaguacacauugacuuaguguacauuguaaauauguacacuaaccugugcauauacauauaucuauaaacauuuccauaugcaaccauguguaucuauacauuaagcuaaaugaguucauaucaaugucuccaacaugaauccauuaccacauggaucauuuuagccucucauugcuuaccuguaaccaacacuacaacagugaaaaacguggcuucuaacaacugccacccauuuucuuaauuguucaauuccaguauacaugcaugguaauuucaacauuauuaauccauaccuuguuccccaugggacagaacuuuaucaguagaguacagggcuuaugcauaguuccuuuaguuuaaaguaaguacgguaagacuaaacagucauacagaugccacucauuuccaaaguuacuuagauuagcaacuuguuucuucacucccuucagugagauuauuggauacauuuauaauacauuuagacucuuuugccacauuuugcauuccauccuggaaacucugaccuccuaaauaaguuuucaaaaauuuguacacauuaagauccacucuuucugcuauaaaauucucuggguuuuggcaaaugcuuaauaucuuauauucaucaucacaguaucauacuuaucacccuaaaaaaguccugguuuuucaucuauucaaccuucccaucaacuccuugcucccaagucccuggcaaccacugaucuuuuuaccaacucucuaauuuugccuuuaccagaaugucauauaacuggacucacagagcauuuucaggcugaucucucuaacuuggcaaugugcauuuuuaagauucauccaugucuuuucaugauuucauagcucuuuuuaguacugauuaauauuucgcuauaugaauguaccacaguuuauccauuuaccuacugaaggacaucuuggaugcuuccaguuuugguaauuauaaauaaagcugcuacaaacauuuguguacaggucuugugugaacagaaguuuucaaauuaguuggguaaauaccuaagagcauaacugcugauuugcaugguaugaucauguuuaguuuuauaagaaacugccaccaaaguggcuguaacauuuuacauucucaccagcaaugaaugagaguuccuguuacuccuguuacuccacauccucaccagaauuuggucaguguuuugaauuucagccaauugcugaguagugguaccacauuauuguuuuaauuugcaauucccuaaugacacacaauguugaccaucuuuuuaagugcuaauuuugccaucugcuuaucuuccuugauggggugucucuucagaucuucugcccauuuuuaaauuggguuauuuucucauuguugagucuuaagaguucuuuguauauuuuggauucaaguguuauauaaguguuuuacaaauauuuucuccccauuuauagcuugucuuuccauucuuuuaauagaguauuucacagaaguuuuaaauuuuaacuaagucacaacuuaccaauauuuuucuuucauguaucauucugauguuguauuuuaaaaucuuuuaccaaacccaguaucauauauguuuuccucaauaaguuuuauguuguauauuuaggucuaugcuccauuuugaguuaauuauugcauaaauuauaaggucugugucuagguucaguuuuggauauggacauccaauuguuccagcaccauuuauugaaaaugucaucuuuuguuaaaaaucaguugacuauauucaugugaauuuaucuuagacucuccauucuguucuauuaaucuaugugucuauucuuucaccaacaccauaguaucuugauuaucguggccuuacaguaagccagguagugugaguacuacaacuuugccaauuuucuucaguauuccacugacuauacuagguauuuggcuuuccuuaugagcuuuagaaucaguuuguugacgucuacaaaauagcuugcugggauuuugauuugggacugugucaagucuauagaucaaauuggaaagaacugacaucacaacaauauuauuucaauccaugaacacagaaucucucuccauuucuuuagaucuuguuugauuagugcauuguaguuuuccaccuauagauaucuguacguauauuuuuuaucagugccuuacaguuuucuaacuguagcuccuagcuccuguauacauuuuuuuuuuuuuuuuuuuuuuuugagacggagucucgcucugucucccaggcuggaguaaaguggcgcgaucucugcucacugcaagcucugccuccuggguucacaccaucuccugccucagccucccgaguagcugggacuacaggugcccgccaccacguccggccaauuuuuuuguauuuuuaguagagaugggguuucacuguguuagccaggauggucuccaucuccugaccucgugaucugcugccucggccucccaaagugaugggauuacaggcauaagccaccacaccuggccaauccuguauacauuuucuuucauuuacaccuaaauauuucaucuuugggagugcuauuguaaaugguacuuccugggauuaaaaaguuuuagaacaacuuucauauacaaaucaccuagccuacuuggacuugagguuuccuaucuguacaauguggaucauuccugcaugcauuacuguaaagggcacaaagaugaaguacagccugggcaacagagugagaccucaucucuacaaaagguaaacaaaauuagucaggcaucuuugugugugccuguagucccagcuccuugggaagcugagguggaucucuugagcccaggagguugaggcuauaguaaguugagauugagccacugcacuccagccuggacaacagagcaagacccuguuucaaaaaaaggaaggaaggaaggagggaagaaggaaggaaggaagggagggagggacggaaggagggagggagggagggugggugggagggagagauggagggauaauauaacaauauauggaaaaauuaugaauaaauuagaaaucacuaaacaaauauaauggccauuaaauccacuguccuccauauaacaacaaggaaacaaaagagcagagaaauuaagucauuugauaaaauuuuauuaggggcauggaacaacugaaaguccacauagcagcuaaaggauauuaagggaacaaaauuggccagaggcgaaggucuauaaagagggguggaaagguauuuagagaaccagagcucagacugaauuacauauguaaugaggagccacuaaaaguuccugaccaggacaaaagaagagauaauuacuauggaguuuuuuggaaauuaaucugacugguggauaggguggaauaaaacagagaaugaguaggacauggggagaacaguacagucuccgugcuauaguuaucucucauuaucuguggggaauugguuccaggaccccugugaacacuaaaaucugcagaugaucaagucccuuacauaaaauggcauaguauuuuauauaaccugugcacaucuucccgcauacuuuaaaucaucucuggauuacuugcuauguaaauaguugugauacuguauuuuuauuuguguuauuuuuauuauuguguugcuauuuuuuauuuucaaauauuuuuaaucugugguuuguugaauccacagauaugaaacccacggacauguaaggcugacuauuagguuacugcagaaccaauuguggcuuuugccauuacuuuuaauaauagauuagggucauggcaagaauuucagaacaugaaagguacuuagacauauaaaacccaaauuuuauauacacuguagguuauucuuacuagcaaagauuaguacauauggcacaacccguuuugcucuccuuguaauggcaguuaacgugcauuuuugcuuagucauuucucuuuucaguccugaauuuuuaaaaguauauuaagaaagaugauggaggaagacuaauuagucaggaagaguuuaaaggacuaagaguuuaaaggacucaguaagaccucuuaaacaauucaaguucuaaacccuccuuuggacauaacuauggaaauucugagaauacuuuuguccuuucacuuuuauaacacuugcauuguuuuucagaaauuauuugguuuaccugcauacacuauuuccuggauaaggcaacuagaaaaaggcugauagaugcaggauacuuuccuaugccaaucagaauuaaaguguauuucuaguuccagagaaagaauaguuauaaucacuuaaaaucccaggaaauggccaugugauaaaauuuggcauuuacguuuugaacugccuaaucauuccuuuuauagacuggcugaagguuacuuugucuuuggcauuuucuuuugucucggcugcuuuccucugucauccagggcucaguuucaagguugaaauacauuaugauaaucacagucaaccaaaggcaucccaauuccaaacucuccauaacuugaugcuuuucccaucaauuuuacuucaguuaaaaggccaguuaaaggaagaauguaugaauaaaucugagcuuacaagugcuauugccaacauuaccucacagaauaaggcuuuuuauuaaauuugcugucuuuccacuauauuauacauuagaaacauaaacauguacauaaacaucuuuugaaauuaagugacuccccuuuagaaagcugaaccuucucaauuaaagguuccauauguuuuaccuaaauaaguuauugcccauaagacuaugucaaauauuucuauuacuucauauuuccucaaucacuucucucuuaaagccaaugaagaaaaacagcaaauggaaacauaaauuauuuuuauuauuaaaccauaaguaaccuucaugcauuuuucaacuagagauucaggacagaaaccaugaccaauagccaagccaagucccaggucugaugcuuacuguaucugacauuaaguguaucacagcuuauuuggaccuuagcuucucuauguguaaaaugaggggacuggacacaauguuugguuaaaccgucuuaaguaagcauaaacaacugaaacuucuaaacuucuaaugcugacauuuucacaaagaacauagaguccuuuugaaaacauuaccagaauaaaagaucuacagagaucuacugucguagauaacaaaggaaagagaagcguaaucaaucgauagauacaaacauuuggguuaauaaaauuuuagaaucaucacaaaagccuucccuuagcuuccuuacuaaccagcuuuugccuucucuuaacaaucaguuuauuuauaaaaaccacuccucuucaggaggucuuaugcuaacuaccuccucuagguuuccacuguauacaauuuccucucuaucaaggcauuucaacaagacuauaaacucuuuccuuauuugugcuuguaagcuggaucauauagaguaaauuggauuaugcauuuuagcuuuugcauguacuucccccucucaacaaaagggauacaauuuggaaaggaucuggcaaauaguccaaguacuggaaaagagaacccugcucucuuugauccugcucucaaauuuugaguauauaggcugggguauuuaccugguaaacucugaggaggaagacucagugggaaggaaucaauaagaccucuucaacaauucaaguuuaaaucuuccuuuagacuuaacuaugggaauucugaggauacuuuuguccuuuauuuaguuacaggcuucauaauacuuaguguuaggaauauacuagcugcuuaacaaauguugaaaacagaauaaauaaaagguuaaaaauuuaagaauuaacacggcacaauugagcuuuucagguauacuaacagauauucaacagaauaaauauuuuaaaggcuuuuuaauauaagcuuucaucuaauaagcaguuugaaguacuagaaagagcacaggcauuaucauacacaucuaugugacuuaaucucucugagcuuccuuccaugucuucauuuguaaaacuggaaucaacuuaguuuacagaguugcuauaaagauuuaagcuaauggacaggaagcaucuauuaguccaugcccauguaggcguuugaaauauauauggcaauauuaugugacuuauuccucaggguaacuucaggcuuaauagagauaaaaccuuuuccucugugcuuuacuuucaacauaccccucauuuguauuuaagucccuucugaucacauuccaguuaauaaauuucaguuauguaugcuucucccaaaugucagcuucauuacaaguucuauuaggaggaaagcuuuccauacuuuaacaguagagaaaaaucaguuuugauauuucauuacuuuucugaaguccuagaacaguaauaauauuuaugacacugagcaccgagguuuacgaagcaguaaauagcuuuuguggcugauuaagcaucucuguuucacuucacauacucugguaccacaggcaucaccccuuaauuaaaugcuugcuaauguugcacaaggacuuuucuugguccuguaccuuucaacaaauguuacaaugagggagaagaaaaaacaagcuaaauuauugagaugcuguggauacuaaaaguucugcucaaagcugggucaauaacaugacaucaugaaaaaguuacuguauacaauacaaaaucaaagccaaaaaaaauccaaaaaaagcaguacuuuggaaagauucuauuugaaaugucugcauuucaggaguaugaguaaaaccacaaacaucagguaaaaggaggagcauauuccuuuucccauguuugcugcauauaaaauaauuaguauaaagucauuuuauaauuuucuuugauauuaauacuuuagcaccugaguggcuaaagaucagaaaggaacaaguuugugccauuaccaaagaugaauaugucuuuucucauuuauggagguuuuaucccagaguaagauaaaggaaaaguaaaaagagaaaccuuagaaaccccugacaaauuaugcuuaggacuuugaaguucauagaaaguucagcggccaccauugcuuuugacucuccuaauugaagcaaguaguaaaucuguauucugcacagacagaaggaaugacauauaaggcugccacaaguuuuauaauuaaugacagaaugugcauuuuccagcaagggaaaaaaaaaacaccuuuacagcuuccagaaaaucaacaaucuacauguggugguugcaaaaugcugaauacauugcauuucuaaaauuaaacagcugaucacagauugaaaaugauaguaauaugcaaauguaaugguguaauaaagugaaggaaguggucacacauuacauaaauaaucaccuauuccaguuuccuucaacuauccucuguccccacccuuuauuuaauccaccaaaaaagccuaaauagcuuuuuagaucugugagcuaaacaccaaguaguauuucagucucacaacuaauuugucauugcauauuuuuuauuugccauaaaaaacuauuaacuuguuuuauauacaaucaccuuuauuauuuauacuaauagaaaaggacauaguggugaguaauccaaaacauucaaacaaucaaaacuuuaaauauucaaacaggacaauaaaagaaccuuaagucaugacauaugaggaacuguggcuauucuuccuggagaaaaacuguuuagggagaacaugguagcugucuucucauaccugaguugucauuucacaaacagugcuaagaacccaaacuaguggacuaaauuuguaaggagacagguuucagcucacuacauggaaggaagacaaucucuuauguaugggugguagagaacacucagaaaccaacugacauugaauagagguggcuggacuaaaacucaguaacucuaaagccucuuugaaugcuugagccuacgacuuugugauauauguuuaaacuuauggccaaaucuggauguuuuucaggaguucaugaagucauacaaaaguuugaacuaauagguuuaagucuggggucccugagucacuccuuuuacaagucucuuauguuccuagcuuggucauagcacuguuuaagcagaacuuaaauuacuuagaacuuuucugaacaaaguaaacugcuuucucugcagguuucauaucaaagcacaaaaaauaaaccacaacuaaaaauuagagaacaaauggcuugggcuguaaaaaagguuuugagcaaaagaaccuagggugcugacaagagccacauuuaaguaguuugcaccaugaaguccaaacaggacaggagucuaaugagaugagugaaaugaccaguugcauacaagugaagguuucuagaagggcacaugcagaaaagcuacuuuuagaugggagcuacaaccaauguugaaaauuaaaugcaacuaugugcuugucagcuugcucuacuauauaaguuuaugcaaaagacauggaaaguaaaacauacaacaaaggaaucugaccuagaccuggcuuggggauaaccuaaagaagcguugagaucugaaggaugaaaucuaacugauaaauguuucagacaggggaauaccacaugcaaagguucugagaugacagggagcauaguauguuuaaagaacuaaacaaacaaacaaaaacccaaugaggcuugagaaguaaguagauaggaacaaaucuaugcaggacauuuuagguauuaguuuacagccuaagaucauuaggaaaccagagaacauuuuuuaaacacagggccauaaugaucagaucuguaguuugaaaaaucacuggauacugguuaaagaauagauuucacaaguuauuaaaguaggugcagacagaccauuuaaauagguuauuaugaugguagccuagaacaaaguggugguaaugaagacggaaguagaugaauucaagaggcaucucccauaugauaacugccagaguuauuaugcaauaacagaggcuggguacaggaauucuugacagggauagguugagaauucagaaguuuucugaaugaccagcucuaagucuuaauuaaggucuaaaaggcauugggaguaguaagaauuucaggguugaaggaauguucggaaauaaaugaggacauagaaaauuaaaggcaggccgggugcaguggcucacgccuguaaucccaacacuuugcgaggcagaggcggguggaucacuugaggucaggaguucaagucuagccuggccaacauggcaaaacccugucucuacuaaaaauacaaaaauuaggcgugcuggcggguaccuguaauccuagcuacucgggaggcugaggcagggagaauugcuugaacccaagaagcggagguugcagcaagccaagauugcaccacugcacucuagccugggaaacacagcgagauuccaacccccccaacccccacaaaaaaaaaaaaaaaaaaaaagaaaaagaaaacuaaaggcagaaguuguuaaacguuuggaaugagauaaggugugcgucugguggggggcacuguguaaugaggacagugccauaagguggagcuggauagccacgcagguucagauccuggagggcuuucacaagagaaaaaauuugaacuuuacacuagagacuaugcagagccaauauacaauuuuacugaagagaaaaacaagauuuuaaagugccuuuagaaagacugccuaguuaguaguguggggagggaugaacacugggaguagggauacuagguaugaagaguuguaugaaucaugugagagaaauuuaugacagucauaauuagugcaggaguaaaggaaauaaagaaaacggaccaaaaaauuuuuacaagguaggaaaaacagggcguggggaguuagagaaaauaaagggacuaguacuacuccuggguuucuguucugaaacuagguaaauagugaaacuuuuugcugacacagagaauacaauaagaaaaauagauuacaguaacagaugacagguaacugcgaccaacuaagugacacauauuacuauauuccauuuuuaauuauaguuacucauguaauuauccuauucuguacaucauuauuaaaccuggguucagagaguacggagccaauacugacugauaagaguuucuuucuuugugcuccauuuuauggaggcuuacacaugguaggucuucaacagguauuuuauaaauaaacaaauaacaauucugccaaccaaauaaauaacugaauuggcuaagacuauguguggggcuacacucacagaaaaaccagguaacaacaauuuaaacacacaggauuuuauuuuaggcaaucagcagucuggggcugggcagaccaggaaugguuugacugcaggucaucaaugacaucacaaaacaaaguccuucuauccaucugcugugcauucccucgaauuuguuuucauacucaugaugaaccuccaggcaucaguuccauauuccuggcaggaagaaggcugaaggccuaaaaauaucucccauaagguuuugauuuuugauuauggaaagaaagcucuccccaguggacuuguacuuacaugucccuggccagcacugugucacagggccaacccuagcugaaagaugucuaaagggagaaggaagggaaggacaagguaguuagaaauggauaaucagugagccaaaauacauuuaacaugguagaauuuauauuuggcuuaucagaagccuuuuaaaauaaaaggaaaaaccagaaguaggaauagaauauuaagcaaaaacaaaauaauaucuagauuuugguuucuuacacuauucucuaauaaaaggaaggcucuuuggcaaaaauugcuauuucuagggcuaucgcaggaaauacacaagauaaaccuggggcauuuuguagugucagaaaauuuuuuaaaugcuuaaauacacacacaaaauaugguugauauggguaugucaaaggggcgcaggaggcaacugaaagaacuuccaaugguuaaagcugaaacaagaugagcaauaaaauaaaguaauacuggauuaaaauccaaaguauaaaauaagucuucaaguucauaccaauauaaauaacuaaguaaauaaaugaggaagaauaaacaaauuuccuaggcagaauaaucaaauaguuuauucacuucuucuaggaagugcaaccuaacauaggcugugcacaaagacuuccuuuuauuuuauuuauuuauuuguuuauuuugagauggaguuucacucuuguugcccaagcuggagugcaauggcgcgaacucggcucaccgcaaccuccaccuccuggguucaagcgauucuccugccucagccuccugaguagcugggauuacaggcaugcaccaccaugcccaguaauguauguauguauguauguauguguguguguguguguguguguguguguguguguguguguauauauauauauguauguguguguguguguguguauauauauauauauuuauuuauuuauuuauuuuuaguagagaugggauuucuccauguuggucaggcuggucucgaacuccugaccucagauuacccacccaccucggccucccagagugcugggauuacaggugugagccaccgugcccggccaagacguccuuuuaaagaguaguauauggaaagaggggaaaagaauaacuuuacaauggagaaaccuggcaaacacuaccuuagccagugagcaagguuaacaucaacagcgauaagucaugcugacaguauauacccuugauaugaugugaugagaaugguacuuuauuucuguggucuuccuuucaaaacuugugucacugauguauuuuaaaacuuuuguuuaaagcauuacaguauuuuucugugaccaucaauuaauaugaggguuuguguuauaagaguuaaagcauaugcuaucauuguauucuuuaagaaccuuauuuugauaaaauguaaauuuguugaacccugccacauuuaguauccccacccucaaauccuguuccaaugaaaaaaguaaaaccugauacgaaaaaaaaaaaauucaguuaaccuauuuugggucuguaggcugaccucaacccuguaauauaacccauuacaaugaauuuucuuuuuuuuuaagacagaguuucucucugucacccaggcuggagugcaauggugcgauuucagcucacugcaaccucugccuccccggguucaagcgauucuccugccucagccuccugaguagcugggauuacaggcacauaccaccacgcccagcuaauuuuuguauuuuuaguagaggcaggguuucaccaugcuggucaggauggucucgaacuccugacuucaugauccacccaccucggccucccaaagugcugagauuacacaugugagccacugcguccugccuaaaacgaauuuucuagaugacugaauaacaguaguccucugguaggagauaaugacuugguugauggccuuaauauacuacuuaauuacuuaagauguuuauuaauagaaugauaaauguacagaguaacguauaagcaugacauacuuuugcuuuccguaguuucauguaaagaaaaaaacuugaaaauaguaauaccugacgacccaugggaauaacagacacuggggagguaggguguggagugggagcaagagcugaaaaacuaccuacuggcacucugcucacuaccugggugacagcaucauccguaccccaaaccucagcaucacacaguauacccagcuaacaaaccugcccauguguucccugaaucuaaaauaaaaaucgaaauaauuuuuuuaaaaaagaaaaagacaacaguauuacccaugggacaaaauuuguacuaauagcaagaauuauuuugugucucauuuagaaacaauuugacuuuuguuccaguguuuaaacuuugacaaaaaugguuuugaauagaucuuuauaaccugaugccauaaauacaagauucucugauacuuucauuuaauauaucaauauugggccuaaaacaguauucuguaaagcuuaaauugguauuaacuaugaucaucuugaugucuacgauagauaauaaacaaggucauacauaccuuacuaaacaacuuugguuuuucaccaacauuuuauucuuuaaaagauucagacuaacagaguuacuuagcauuucgagucgugugcuuuauuuagcaagugaguaaaaauauuggaauauuuaaguauuugcauaaaaaaucaaaugguaguguuuuguaaucucuacuguauuuccuauuaagguuuuauauauuacuuucccauuguuccugaauuuguuaucccauauauaaacagaaacacggaugaguaaaaaaaauaaaaauaaaauaaaaaauaaaaaaauaaaaaucaacaacaacuauauauuauauauguacaggaaaaaaacccaugagucuaaucaugagaaaaacauuggacaaaucacaaaagagggacauucuacaauaucccucaccaguacuccucuaaauugucaagaacauaaaaaauaaagauuaucagagaaaucaucacagccaagagaagaauaagaagaccugaaaacuaaauguaagugugguauccuagauggguuccuggaacacaaaaaugauacagguaaaaacuaaggaaaucugaauaaacuaugaauuuuagcuaauaauaucaauauugguuuauuuauuguaacaaaugcaccauaagauguuaauaaauaugauaggguacguguguauuggggggagggcauauggaaacucuuguaccaucuucucaauuuuucuauaaaucuaaaacugcucuuaaaaagccuguuuaaaaauucaauagcuaacuguaaugccaccacaguauuaacacugugagauauauuuuaucaguuuuguuuuucuuuacgugcauguguauucacauacccaacagguuuaguuuuucuauuuuagucaaaugauaaauacauguucaccauagaaaaauuagaaaauagagacuuuuaaaacuucuguaaugccaucaccacaaauaaauaugauugccauuuugacauacagccuuccagcuguauauguauauaucuauuuaucuauguacuauuccuucaucacccauuuccugauucuuacauaaacauacuuagauuuuaucacaaaguuauuuucucuggaaaauucucccugguucccaaagcagguuaagucucucuaauaagcacuuacauagcucccuguacugcucuuuccuagugcuuauaacauuuguaaucaaauggucaauugagaaauuaaucaucauuaaugccugucuucccacaaaaauguaagcuucauauauuauucaucguaguuuccccaccauggugccuuaaacacagcaaguauucaaugaauaauagcugacgaaaugaaugaauacuacauguacacagugaaguaacaacauagcuauuaaaacuauauguauaccuauggaaaaauguucaacauagcuuagcgaaaaguaagaugcagcugggugcaguggcucacaccuguaaucccagcacuuugggaggcugaggcaggcagaaaaccugaggccgagaguuugagaccugccuggccgacauggcaaaacccugucucuacuaaaaaaaauacaaaaauuagcugggcgugguggcgugcaccuguagucccagcuacuuaggaggcugaggcaggagaauugcuugaacccaggagguggagguugcagugaaccaagauggcaccacugcacuccagccugggugacagagcaagacucugucucaaauaaauaaauaaauaagaugcaaaacaauacgcacagcaaauucucauuuucuguuucaauaauaacaaaagcuuacuaugugcauagaaaaaaaauacaacaaagaguucaaaaucguuaagucuggguggggaauuucaguaaguuuucauuuccuaguguaaauaucugucauguuucaauuuuuauuaaguaugcauuauuuuuaugaacagaaaaacaaagauaaaauaugccuucauuauggaaaaauuagaaaaggcaauucuuuucaaaaaaacuaaacaacuuguuauuaucaaucucauuauaccagacacaaucaguuaauaauucaguauauuuccuuuuaauuuguaccuugcacauuuauuuuuguuugacauacuauagguaaauuuauauuuugacuuuuaugucucauuucauccugacaauuaccuuaucagggagacaaccuuuggccacaucagcagcagcacaaaugaguugaaucaugagcauguguucccagagcugguuaaaaacagacagaagaauggggucuccugacucucagucuuucacuccucguuagcccucacaguucagcaacaaauuaucaaaguugagauaucauauguacuauaaaaugacugaauucaaauugaacagcucuacaaguuuaaucacuuuuauaguauuucaaauguucauauaguuaggcaaauguuuauuguagucuuagaaggaaagauaucuguaauuacuaaaaagaacaccaaccagcauaacuauugauauacguaacaauuuggauagaucucaagggaaucauguuggguguaaaaagccauucucaaaggcuauauacaaauacuguaugauuccauuuauauagcauucuaaaaaugaugacauuucagaaauggaaagcagauuaaugguugccagggaccaggaauuggcagggggagggaagauugaggguaacuauaaagggguagcauaagggagaucuuuguagguauggaacagcuuuguaucuugacuauuuugauaguuagacaaaucuacacagguaacaaaauugcaugcaugcaugcauacacacacacacacacaaauguauauaaacuagugaaaucugaauaaggcuuauggauuauaccacugucgauuuuacgguuuugcuauuauaauacaguuuuguaagauguuaugauuggggguaacuggugaacaguagacaggagaucucuguauuauauuggcaacuuccugugaauauuuaacuuaaaaguuuucaaaugggcaaaaaggauaaaugacacaaaaaccucauaauuaacccuugccagaaaccccuuauauuaggguuucauaaauguuugaaacacacaguaguaaaugugugggaagaaaaauaccacagaggagaauuucuaacagagcuguccaacgacagagugggaucucaggcaggcaguaagcuucucacuggagguaugugaacagagagaaugauuuucugaagagggauaugguaagaaugacucauuaauuuauaaguuauaauuuauuagucauaaauuauaaauuaauguauaacuuauaaaauauaauuuauaauuuauuaauuagaauaaauaccuauucuaauucuccuuuaugaauuuagcaaacaugcgguauaaguaacacaaaacccacucccucucuccccagcuugcaaucaugucagaugcuaauagaugacaccccuccuuaccacauguccccuauaaaccuccuaauucugaacaggugcuucagguagcuacuacagucggaguuaguauuugcuuuccugaaccacgaaccaccuaacaauguggucaauguucuacaaacucucugaagauggcaaaaguauaaaaugcuaauucaaaaguaaagcuuugccacaccuugcacuagaaccaagaagacaaccuaauaggauccaaagaagacugucuccagcuauaacaauauucauaaucacuaugauauaauacuuugaaauuuaguaacuacucugaucuaauguccuacuagcucuuaccuuuuaaacuauucuuacagaaaagguggauaaauuauucuggucuauaacaggugaaauucuggcaaacggaagguaagaaauaauuugccccaaauguaguuuaaaaaaaaaaaaaagcgugcccuagcaccacuuauaaaacucaaggcuuuaaaucuuuucagugaucuacaaacaccuuucuuuaaaaaggagcaaaauuguugaagaaaauaucaaauauaaggaaaaauaaguguauacugauuauacucauuaucucugaaguaaccaaagaguuaaucacugauuuuuaaaguucuuaaauaaaagaaaguaaacaaaaacugguuguaacugccagacaggaaauuucuguuggaugcagagaagauucuaggaguagcuugugaugauaauggaaaagggcacuuuggcuaauagacagaccuagaacacugagauaaaagguucucugaaguguuuuacuuuuuaauagguuuuaaggaauaagaacaccaaccacuucaacuagccaauauauaaaauaaaaauauugaauguggaccacuguuuucuaauuuugugcaccaucaaucccucuuaaauaguucuaccccacaaggcuaucuguucuaauguuauaggccuucuaauaccaaauuuauagaugcacccauuuagagcagugcaaauucaucgcuguuucuggcaauaucacuauggaugaucuuuuacucuuuguuuacuuucuucauuugcaaagugggaagcugcucccaaugaaaaauaucguuaaaaggucaacuacaaagcagaaccaacaugagauuuuauuauaaauaacaaaaugccuucuuuguaacaaagauauucuugugcuuuaaaauuuacuuuuguuuuucucuuaguaaucaucacugaaauugcuaauauaugauguagaaguaaagagcuucugaaagauucuccuaggcagaacuggcugccuccuucagucauccaggauuuuuggccuggugaccuuaguuucucuuuauugcccagugucccuguuaccugaccuccuuaguuccucuuuacucccuagugucacuccuaccaacagaaaucacuugguacagaauucaauaauaaaaugucuauccccaccauacuguaauuauuugcauauauagcugucucccccacugaccuccucaagaauaaaacacucuaucucauauauuuuauaucccuagugcugaucaugaugcuuacaaacaguagacccuggggaaaaguuuauuaaaacauugaguaaugacuaccaaacucucuaaggagaaaaaauuccacuguuuacuagaaucuuacuuccaagguuuucuagacaaaauaaaauagaauauccacaccaacaauuuaugccuugccuugguaguucauuguuuuucguaucugggaguuaaaugaccuuaucuagagcagcuaacugagccucacauuucucugugccaaaguuuaagacuuuauuuauuuuuuucccccagcauuuuuuuuauuauacuuuaaguuuuaggguacaugggcacaacgugcagguuaguuacauauguauacaugugccauguuggugugcugcacccauuaacucgucauuuaacauuagguacaucuccuaaugcuaucccucccccgucccccacagcacaacaggccccagugugugaugucccccuuccuguguccauguguucucauuguucaauucccaccuaugagugagagcaugcgguguuugguuuuuuguccuugcgacacuuugcugagaaugaugguuuccagcuuuauccaugucccuacaaaggacaugaacuccucauuuuuuauggcugcauaauacuccaugguguauaugugccacauuuucuuaauccagucugucauuguuggacaucuggguugguuccaagucuuugcuauugugaacagugccacaauaaacauaugugugcaugugucuuuauagcagcaugauuuauaauccuuuggguauauacccaguaaugggauggcugggucaaaugguauuucuaguucuagagcccugaggcaucgccauacugacuuccacaaugguugaacuaguuuacagucccaccaacaguguaaaaguguuccuauuucuccacauccucuccagcgccuguuguuuccugacuuuuuaaugaucgccauucuaacuggugugagaugguaucuccuugugguuuugauuugcauuucucugauggccagugaugaugggcauuuuuucaugugucuuuuggcugcuuaaaugucuucuuuugaaaagugucuguucauauccuuugcccacuuuuugauggagauguuuuuuuccuguaaauuuguuuaaguucauuguagauucuggauauuagcccuuugucagaugaguagauugcaaaaauuuucucccauucuguagguugccuguucacucugaugguagcuucuuuugcugugcagaagcucuuuaguuuaauuagaucccaauugucaauuucggcuuuuguugccauugcuuuugguguuuuagacgugaaguccuugcccaugccuauguccugaaugguauugccuagguuuucuucuaggguuuuuaugguuucaggucuaacauuuaagucuuuaauccaucucaaauuaacuuuuguauaagguguaaggaagggauccaguuucagcuuucuacacauggcuagccaguacucuucagcaaauguaaaagaacagaaauuauaacaaacugucucucaggccacagugcaaucaaacuagaacucaggauuaagaaacucacucaaaaccgcucgacuacauggaaacggaacaaccugcuccugaaugacuacuggauacauaacgaaaugaaggcagaaauaaagauguucuuugaaaccaacgagaacaaagacacaacauaccagaaucucugggacacauucaaagcaguguguagagggaaauuuauggcauuaaugcccacaagagaaagcaggaaagaucuaaaauugacacucuaacaucacaauuaaacgaacuagagaagcaagagcaaacacauucaaaagcuagcagaaggcaagaaauaacuaagaucagagcagaacugaaggaaauagagacacaaaaaacccuucaaaaaaucaaugaauccaggagcugguuuuuugaaaggaucaacaaaauugauagaccgcuagcuagacuaauaaagaagaaaagagagaagaaucaaauagacgcaauaaaaaaugauaaaggggauaucaccaccgaucccacagaaauacaaacuaccaucagagaauacuauaaacaccucuaugcaaauaaacuagaaaauccacaagaaauggauaaauuccucaacucuuacacccucccaagacuaaaccaggaagaagcugaaucucugaauagaccaauaacaggcucugaaauugaggcaauaauuaauagcuuaccaaccaaaaaaaguccaggaccagauggauucacagccaaauucuaccagagguacaaggaggagcugguaccauuccuucugaaacuauuccaauuaauagaaaaagagggaauccucccuaacucauuuuaugaggccagcaucauccugauaccaaagccuggcagagacacaacaacaacaaaaaaagaauuuuagaccaauaucccugaugaacaucgaugcaaaaauccucaauaaaauacuagcaaaccgaauccagcagcacauccaaaagcuuauccaccaugaucaagagggcuucaucccugggaugcaaggcugguucaacauacacaaaucaauaaacguaauccagcauauaaacagaaccaaagacaaaaaccacaugauuaucucaauagaugcagaaaaggccuuugacaaaauucaacaaccuucaugcuaaaaacucucaauaaauuagguauugaugggacguaucucaaaauaauaagagcuaucuaugacaaacccacagccaacaucauacugaaugggcaaaaacuggaagcguucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaaccccauugucucagcccaaaaucuccuuaagcugauaggcaacuucagcaaagucucaagacacaaaaucaaugugcaaaaaucacaagcauucuuauacaccaauaacagacaaacggagagccaaaucaugagugaacucccauucacaauugcuucaaagagaauaaaauaccuaggaauccaacguacaagggacgugaaggaccucuucaaggagaacuacaaaccacugcucaaugaaauuaaagaggauaccaacaaauggaagaacauuccaugcucauggguaggaagaaucaauaccaugaaaauggccauacugcccaagguaauuuauagauucaaugccauccccaucgagcuaccaaugacuuucuucacagaauuggaaaaaacuacuuuaaaguucauauggaaccaaaaaagagccugcauugccaagucaauccuaagccaaaagaacaaagcuggaggcaucacgcuaccugacuucaaacuauacuacaaggcuacaguuaccaaaacaauaugguacugguaccaaaacagagauacagaccaauggaacagaacagagcccucagaaauaaugccacauaucuacaaccauccgaucuuugauaaaccugacaaaaacaagaaauggggaaaggauucccuauuuaacaaaguuuaagacuuuagagacagacaaugagauccucaggacaggaaacaugucuuauuuaucucuguacuccuaauacuugguuauggaauaugcgcucaauaaauguuugcugagugaaugcauuauuaaauugauccacauugcugggugugauggcucacgccuguaaucccagcacuuugggaggcugaggcggguaaaucacuugaggccaggaguuccgagaccagcauggcccacauggugaaacccccaucucuacuaaaaauacaaaaaauuagcugggcauaguggugggugccuguaagcccagcuacucaggaggcuaaggcacgagaaucacuugaauccagaaggcggaggcugcugugagcugagaucacaccacugggcgacagagugagacucugucccaaaagaaaaaauaaaauacuguuuuuauaccagcuaaaaacaauguauuaggcuguucucacuuugcuauaaagaaauaacugagacugaguaauuuauaaagaaaagagguauauuuggcuuauagugcuguaggcuauacaggaagcacagcagcaucugguucugggaaggcuucaggaagcuuacaaucauggcagaaggcaaagggggaggaggcaucacacauggcaaaagcaggagcaagaacggauaggaggugccacacacuuuuaaaugaccagaucuugcaagaacucucucacuauugugaagacaguaccaaggggaugguacuaaaccauugaugagaaauuugcccccaugauccaaucaccucccaccaggccccacauccaacacugaugauuacaauucaaugugagauuuggauggggacacagauucaaaccauaacaaacaacuucuaauaucagacccacaauccauguaaaaaaaacuagacauauuugucucacuaguguuuauacaguaauuugaagcaaacagugauguaucaaauugaauucaguucuuaggucccaaguagagugaaauauaaagauaauguggaaaagaaacaaaaacaaaaaaacagcuagaauacauucucucaaaacccuucccuuggcugggugugguggcucaugccuacaaucucaacaauuugggaggccaaggugggagaauugcugagacugaguuugggaccagcuugggcaacauagggagcccugucucuauaaaaauaaauuagccaggugugguggcacacaccuguauucccagcuauucaggaggcugaggugggaggacagcuugagccugagugguaggcuacagugagcuuugaucgugccauugcacuccagucugugugacagagcaagaucccaucucaauaaauaaauaaauaaauaaauaaauaaauaaauaaauaaauaaaauaauuaauaaaacacuuuuuccuuggugugaccauggcaaauagguggaacucagcugucaagcgcuuuuauauagagaggguaaauuagcagugauggggccacugaaaagccagaaacaguucaucuccuuguaaaguuuccauuuucuuggcaaaugaaaguucccaagaguaagugcuaccuuucuauuuuggaacugauuuuaaaaaagauguuucugaggucuuuggauuuaguuucucuuaauaauauacaaaccaaauuucucagcugauauauuuaaugaugauuuucuaacugggaucugaaaauccagcugugccauacccacugcuuucuuaugccucucccucuuagugacuaagauucuuugauaugaauuuaggucauccugaaauauaauaaauuuugguuaccuuauauaaaguuaaaguuggagaauggacuaagauuuuaaaauagcuacaaauguaaggugaccauauaaauauaacagagaacuaguacaaauuuaaaaaaaaaacauaaccauagacuacucuaacuucuaugauuuagaauccagcaccauauaguuugaauuuguuuacuaaauguucuaaauuguaagagaaaucugaucucaaauaaucuccauagacuauaagcaguuaagucuccccauuugcuaagccauuuuagccaucuaucuugaacaauuaacuucccccuccugcuacucccuucccccaacacacagauucaucuuuggauuuuaaagaaugacauaaugaacuuucacauuagggucuauuaacuuugauaaaggagaugcucaaaaacaucaauaaacacuuucaacuacuaucuugugaugacaaaccauaauacuuggucuugauaaucucucaaauagguaaguaaagccagaaauuuuaaauuaggagaaauaaaagaaaggacauaaaauaucuccaaagaaacagaaaugccaaaaucauuuuaaaacauucguaagaaugagaauacacauuuucuacugucauaaaucuaacaaagcuaaaaagcucucuucugagacucccucuccuuauuucggucugcacuuuccaucugaugacagcauuuucuggauacaaggaauauuucucucaucacagaaacugccugacuuguaaucuaagagaaacaaaaauaauucuuagcucuuagauccaauauccuagcaauguugaaaaaacaacucccuaagauguuaagauguuucugaaacugauugucucucauuuuccaccaaacacagaauuaaucagggucuauauucuugauacuauucuauuuaggaaacagcuugacaugugggauauacauauauaaaaaaauacuggugacaaagagcucgugcuauaggcaggcagacagaagaaaaccuaucucauguaccauauuuaaaaucuucagaaauuaaguuuagcaagguaaaauaaucccaaaagggcccacuauuauuugccucaaguaaacauauucaacaacaaaccacauccaaaaauacuuagcagccuaugauguuugacuaucacuuaaagcaaggcuuuagaauauguaaagaaaauccaaacauuucugauacuuaccugcuuuccaaaguaacuaauaauaccacuggacaaacuacacuuugaaaagaccauaaaugaguaaccuggauuuuagaaauaagaaaauauucaaaguuuucauacuaaaaaguauucccagaugauugucaacaugaugguaauuaguauauuaauguuuuaauaacuacgaaaucaaauauuuggauguuagguugagguugucucugcacucaucagauuaugguucuaaauaaaguaaaucauuguuggggcaaggguauguuuaaacuggaaucagccaguuaaauaaagaaacaacccaaugaaucauuguaaauuccuaugccaauaagauaaaaacucacacuuggcacuaauguauucuaaacaucugucuguauuucuuuaacacucauauuucauguaaauaacaagcagauaacuacgaaacaaguucucuuuuauaauguauauaaauauauaugacaaaagaucaauauuaagcauuaguggaacauuauaucaacaauaauaaaauauacuaagaccuaaucuuccuuuuuaacagaaaagaagaacuaguuauagaucauuguuguuguuguuuuuuuaacgugaacccugaaaaacuaaaacacuaaaccaaauguaaaaaaagaaaauccauacccaugcuagauuuuccuuuugauauaauuagaaucauuacaaauacuguauaagggggaaaaaaugcaacguuauugcaauauccaaagauaaagugaugaaaauuaaggaagauacucacauuuugaagauuuaagaauuaauugauaagccacauuauggaagaagaaggaaaaaaaauaaaaaaaccuuagucaaagcacccugaaacggcaacagugcaugcugacuucaaagaugccuccaauaucacaaauaauagcaguagcucaacucccucacagcuucuugacaaccacuacucugaagucccaauggagacuacucugaucugauaauggauccuucacucuccaauggcaaaagaucacuuuacaguauaccacauguauuuuaauccauugacuggcccauuaguacauaaauauuuuuaaaagcuuuccugauaugauccucaauuuccccuucaauaaaaaagaaaguauaucuaccuuauauaguugugaggauuagacaagguauacaaagcuucuagcacaaggaucuugcaggauauucuggcacaaguacuuauuuugaauguaccacaaaacuguauaauaagcauuuuuugaaagaauggaaaaaagcaaggccucgacugaagcucugacaccaugcagaccaaauuuaguaacugacauucuuuucauucaccauuaaaagugcucuuuauauaaauuaccuuaaacuguaauaaaauuaccaaagguucuauucgauaaagaagacaaacaaaauauaaaggaaggaaaauagaaagaaguaauacuuauuggcugccuaccauauacuaggcauaaugcuagaggaacacuguaagaaauccauaauguagucugauuggugaggaaacugaggcucucacagcuauucaugcagcuauuacaugacaauguugggauucaaccuggucugugugaaggcaaagucuauuuuucuuuccacagugccacacacaauucacagaaaagugauggaaaaauucaaaaaacauaagcauuauaaaccacauaguuguuuuuggagcaaaggaauuauuuucacugaaacauucaggaagcaacaacaaacacauccauccuggaucacuaaaaaacuaaacugaaaaucuacaugccaauuagguaaacaaagaaaaacaagucaaacaugauaaaacauuuauccaccacauaaauugcuuaguaggcacagaaagauacagaagguauagaaagcuuuagauuuaguucauguauuacauuucguuagaaucuacagucuaagaugauauauacuuucucuauuuucaugaaaaugaaacaaagcacauuuauuuuuaauuaaugggcuaagauacaaccaacaggccaugaaguaauuuuguuguuuauagaacaagucccacuacaaaucugcaauuuacuuguaaaacaugauucagaaccaaaaugcagagcaaaacaaaauuuuaucuuguccucucuucaugucaccuggagggguucuucugagaguaaaaagccagaaucucuauuuucuaacuaauauuacaggacucaaccuuaccacugaaagcaaggauuacuauuauugaccaacagaacacucaaguuaggcuuccagauaauuaaggguuuuguuuuguugauucguuguuuaggaaugcaaucaaauccagauugucuauagccaugucugaauuccacccugaauuuuaauccccucucugccaaccagcaugcucuggaccacuagaccucacaccuaaguuagaguaagcagguuuaugagugucuuacuauuugguguaaucaagcaaaucagaaagauaagucagaggaaaaaaaucauauuuucuaauaauacauacaaaugauuuucaggaaaucaaugauauaccucucauucauuagcaaggaugaccuggacaugaccauucuguugaacuauauugcacaguuuuucaucacugaguuauucugcauuagugaugagguaagaacagcagaauacauaagaaaaaauuguuccuuauggcauugaauuuaucaauauaugaaaguggguuucuagaguuuacagaggaaaacaagaaugacagggaaaaugcugaauacaguccucuguagugggggaaaaaaguguaauuuccuuccuugaucaauuacacuagucaguuaacuaauaucuugguucuaauuuaagagcuggaccuauucacccucugaaucacaagacagaagugacuaccuaauauuaaaaagaaaaaaaaauucuuaaaauuuuaaaugcacauaauacucugaaaucaagaaaaaauacaaaaaaguagaagucacuuuaguuuuuuuuuacugcuuuuaaaauaauauagaaauuuugaaaaacauuggucuguauaaagaaacacaaaucacuagcaauacuaccaaauagagauuaacuauugacauguugauguacguauuucauuauuucuuuuaacaaggcuuugugggcaagaguuguaaauccagaaucaaacuacuucucaucauuggucuaagcuaccaucaucucuugacaggguuauuacaaucaccucuuaucuccaugauuccauaacagcuccucuccaaucuauucuacaccaaaccacuaaaaagaucuuuuaaaauaucagucauauuucaucccucugcucaaaacccuacaauggcuucucaucucaucaaugugugaguccaaagugcuuacaaaagguccuacaagguccuccauuuucaccccuaaccuccacuucucucacccuguuucccauacauucuccucccugguuuaacugugcugguuaagcugaccuccuuacucuugcuggaauacacacaguucccuccacaaggaauacucuuaccccagauguaaacauugcucucuuccucccuaacuuucuucaggucuuuauucaaauauuuuucagacacuucccugaccuaugguauauaaaacggcauucucucccuuucccucccuuggugcaccuuaucacccuacucuguuauauuuuucuccaauuaucaccaacugacaaauuauuuguucacuguucucucucuacuaacuagaauguaaguuccaugaaggcaaagaaaugaccuguuuuguuuuuuccucacucagugcucuaucucuugguuccaaaacaauuccugggauacaguagguacuaaguauuugugagugaauggcugaguaauuaggaucaaaguauaucuaaaauuuacacucaacuuuugucauuuacuauuagcauuccuaauuauugcauagcauuccauuauagacauauacuauguaguacauugaaucaauuuucuauuuuauuauguuuaaaauuuuuacuuauuuauuuauuuugagacgaagucuugcucugcugcccaggcugaaguguaguggcaugaucuuggcucacugcaaccuccgcuuccugggcgcaacugauucucaugccuuggacuccccaauagcugggacuacaggcaugugccaccacgcccagcuaauuuuuguauuuuuaguacacacaggguuuugccauguuggccaggcuggucucgaacuccugaccucaggugauccaccugccucggccucccaaagugcugggauuacaggcaugagccaccaugccuggacaauuuucuauuuuaacuauuuagguuguuucuacauuuacuguaucauaaauauccuuguauacacagaauaucuuugaaauacaugucuuccugcacagcucugauaauuucucuaggauaaauuauuuuaaguacaauuguuggaucaaaaaguauuuagaucaugaaugcuuuuauuuauuuauuuacuuacuuauuuuuuuugagauggagucucauucugucgcccaggcuggagucaguggcacgaucucagcucacugcaaccuccgccuccuggguccaagcaauucuccugccucagccuccugaguagcgugggacuacaggcucgugccaccgcgcccagcuaauuuuuguauuuuuaguagagacagggucucaccauauuggccaggcuggucuugaacuccugaccuugugaucugccugccuuggccucccaaagugcugggauuacaggcauaagccacugugcccagcacucugaaugcuuuuaauacauuuucuaaacugcucuagaggcugggcgagguggcucacaccuguaaucccagcacuuugggaugcugagccgggcggaucacuugaggucaggaguucaaaaccagccuggccaacauggcgaaacugucucuacuaaaaauacgccacugcauuccagccugggugacacagcaagacuccaucucaaaaaaauauaaaaauaaauuuaaaaauaaguugcuuuagagaauagcuaguaauauaagcuuacauuucuccucacuaacaaugcauaugugaguccuuuuuugacaaaacacaaaaaguugauuuuuuucccccugaaacuaaacaggaauaccuggucaccauauauuuuuuguuuguugaaaaauuuuuuggccgggugcgguggcucacaccuguaauccuagcacuuugggaggcugagaggggcagaucacgaggucaggagauugagaucauccuggcuaacacggugaaaccucaucuguacuaaaaauacaaaaaaauuagccaggugugguggcgggugccuguagucccagcuacucgggaggcugaggcagaagaauggcaugaacccgggaggcggagguugcagugagccaagauugcaccacugcacuccaggcugggcaacagagcaagacugagucucaaaaaauaaauaaauaaauaauaggaaaguuagaggaaaauauaaauuuuauuaguuaauggacagugguuguuuccaagcacccugucccaugguggcauuaucauuuuuaaaagcuuuaccaaucugguagauuuuaaaagguacuucauuuuuuuuuaacgguaccuuauuauuuuccauuucuuuguuuacuaaugaguuugaggaugcuuucccacauuuaucaguagauuuuaaaaggcacuucauuuuuuuuaaugguaccuuauuguuuuauuauccauuucuuuguuuacuaaugagauugaugaugcuuucccacauuuauugguugauuuuguuuuccaugacaaacugcccuauucaugacugcuccuuuuccuauucaggcauucauuucuuauugacuuauaagugcucuucauacauuaaagguguuaaauuuuuaucacauggcauaaauauuccuucauauuugacauuugccuuucaauuuuguugaugguauuugauacauaauuuuuugugcaacuaaaacacuuuauuuauuuauuuauuuauuuauagcaaagaggucucacuuuauugcucaggcuggucuugaacuccuaggcucaagccauccuccuuucucagccuccuaaagugcugggauuacaggcacgagccacugugccggauucaaucacuuuuuguguguuauuauuuguuuaauuuugcauuuagaagagcacuucuauauacaaccaacaugcuaucaaguuagaaaccaauggugguuuugugguuucuaacugaguagaagucuggguauuuuuucuucuuuuugcuuguauauuucuuuucucuaacaacuauauaagcuuaucuaagaauaaauauuuucuuaaacauuaaaaauagaaaauaauuucuccacuacuugauuauauauuuacacacacacauuuccuuauguuuuuauucuauuuuaaaauguuuucauuauuuuaaccaucugaaaucuuagcucauggcaugaaguacaacucuaguuuuauauucuugugauaauuuuaagucaauauucuuaccacuuuuguuuacuaauucauucuccuaaugaauugaaauggcuucacuaucauacauuaaucuguauuauuuuaggacucuaccuuguuccauucuuagucaauaucauaugguuuuaaucauugcagauuuauaaaaaucuucuaauauaugguggugcaauuccaacuucauaaugcuacuccuucaaaaauuuucuuuuaaacuuauucuacaacaauuucagaccaauuuuguuaaauuucccuauuucaucccacuucugaaucaaaaauguuaauuagauuuugauuagaauugcaucaaauucauagauuugggaagaauuaauauaagacugaguccugcuuauuagaaacauguuuaaucucuguacuuauucaacucucuuuauguuauccuguaagguuuuuaaaaaauaauuuguacuuguuuuaucguuucuaaauacuuaagagauuuuuuuucuccauuguaguuuccaacuagguauuccuugaauauugagaaaguacugacuucaguacauuuagacguaacuaaccacauaauuuuaguucaaauaggcuuucagguaauuuuccuagauuuucugguagaucacuugugcauaauaguaaugcugucuucucuuuugaaaugacugcccaaccauguaguguuucugguccugacaccagaaggaaggccuuuuauuauuccaggaagaagaaauauuuuccagaugaaggucucccaucuugccaggcuucuacuuguaccugcuuauccuuguuuccgagaaguagaggagauuuagucagauuuauucagcaucucuuccacucacgacccaggcaguuugcucuuucaugcgagaauuuauggguugguucucuauaccuccaucaacucgguuccuuucauauugucucuagcauaaaugccuacaauuacgaaaaguccagcaggaaauauuuucauauuuuuauuuguauuacuuuuggaucagcaucauuuccaucuauuuuuuuaacaaugugugugcuacaucucucucuuucugauauucuugcuguuuguacaauacauuuuaucuccugaccugucuuccuuuugucuuauuuugucauuuugauuuauuuuuguagugucuaauuugcuauucacugcauccagagauuuuaauuuggcaacuguauuuucaugccuucagaauccugucagauugcuuccuuuuuauuacugauauccagcuuccccagguuuaaugacuaaaccuuuuugagaacacaaaucucaacagauugcuaguugagcuauccagcaaucugaacaggguuugaggcaggaggguugguagcugggaacuuagugacuaggccaccuauguggacagguuucuucuagggaggugcuauaagcaaacucuagaucuauaaacaguguucacaaaugcuucuggucaaagagccaagagagggauuuaaacacugugcuuuguaggaacaugcauuaaguuuacugucccucccaacuuaagaguccucucucagaaagauucuccuucaggggcuccuccucaauuacuucuuucauuccaggaccauaagcaaugcugccuaacaaagauuauucuggguuuucuggcaugaguggcauuaagcucuagcuucuaauacacaugcaguguuuuucccauucaucuauguaucuaguggucuuuuuaauggaaauuuagaugggugaagauaggaaacuuuuuuuucugcuauuuugcccaauacuguugucuguauucuuaucacuauacaucacguugaugcuuacuacuuuguuucaagagacagggucuggcuuguugcccagguuggaucacagugacaugaucauagcucacugcagccaugaagucugggcuuaagcgaaccgccugacacagccuccugaguaucuaggacuacaggcgugcacuaccacaugcagcuaauuuuuugcugcuguuguaaagacagggucuugcccaggcugacccauguugcccaggcuggucucaaacuacugaccucaaauaauccucccacuucagccucccaaagugcucagauuacaggugugagucacuguacacagcccucucacuacuuuuaauuaauccaugcuucuagguaaugguuuccaaucuccauuuuaccaauucaaagagacuugacaacaugccauccuucccaccccaaucauugcacuucaggaaacaaaugccacaauaagaacaccuaucucuuucugggaaaucuuuuaccagguuagguauaaugauggacuaguaggacuccaaauggucagaguuaauagacccagguaucucugugucuuaauuuuugaagguaagauaacaagaauaacagugccauuaaaagacugcuaugaaagacuaaacagugagugccaacuucucugagaugaagcaaaggggucucuccaaaagacagaugagcacaagaccugcaccuacuuguucuacaaccacagagcuucaggggcagagaaucagccucauucauguuugcauuccaagaaccacaaugggcacaaagaaucuaaucauuuacaucuugcagaacuaaacuguccacauggcugguaggcagaguuacuugcaacgagggcucacccucauauucucucaccaaaaagcucucauuauagagacguuuacuaggaaccaaggcagcuuuuccacucaggagucccuucugagugagggguuaaugguaaccuacuuugguuuuauauuauucacacauaaauaauuuggccguuugcuaaucaugucuauaaaagcagcucuucaguugcuuguugcuuguugcccacaugaaauauagagucugugaauccucaugcacugcucaaagcaguaaaaacuaucuagucauccuacagagcaaucuggcaauaccuggugaacuuaauaauggacauccaacaacagaucaaucacauucuugauuauauaccucuauaaaauaaaaugaagauuaucacugcaacauuauuaauggcacauggaguugaauacacccaagugccaucagaaaaauguauaaauaagacaaauacacaguauacauggauaagaguguguacaugauauaauacuguauagcagucagaaguaaugaaccagaauugcauauagcaacaaaaauagauuguuuaaauauagggcuaaaugaaaaaaaaaaagaauaaaaugggauguacagaccaaggccauuugugaaaauuaauaaccuauauauauauguacuaaacacuauauaauauuuuccaaagauauagaaauauccaaagacauaaauuaacuagauuauaguagguguuuauggaggaaacagaaugaguaaagauaggaaaaagagaagacaacaaaguaaccaaucaagaugcggggcuagcccucaagaugccaacaguaagaagcaucauuauaaccuaccugugcccaugaaguuugagaagcagguagaggaguaaaagaaguccaaauaaacucagccaagacaagauaauacagacaugaaagcuccacuagggaaaaaaaaaagguucuaaguaugccaagacaagaaguuuauuuugaaaggugccaggaaugguauuucauuuauuugagaggagaaaccaucagugaauauuuauuuuaaaaaucaagaaauaaucauugaagauuauaauaauguaaaguaacuacaugaucaaacuaagaauuugaugauuucucugaaauuaauaggucuguaacaucauccagagauuaaucugaauucaucauccugacauacaaagauccugaacacaaaauaccaaacagaagauaagauguagucuggcagagauuccacaccaacagaauuuuuaacuuucacuuaccucagagauaugcuacaaaaccuuuaccauggauuaauucccaugaaugagaugaaaucuaaaaccauggcauaugcaaaaaauuaacccggaaaagucauuugucaguaacccuuuauuauuauagcacaguuaugaacauagugucacuagaagaagagcuggggagacaaaaucuggaacacauuuuauacuugaggaagacagaauggaaaacgcuacuuuagcguuucaugcaauagagcuaagaagagcaaggacuuaagaaaaaaaucaauucccuugucauauuagucuguucucauuaaauuacagcuaaaucugucaauaauuugggggugcugauagaaaaaaauaaucugaauuggaaguaccaucauaccacuuucuggaaccuauaauaaauuaucuugagguaaaaagaggucauuauuuuucaaauguguaaagcaguaaaaauuugagcuuuuuuagcuauuggacucaaacuguauaccaaugaaaggguaaauaagcaaugauaaucaaaucagcagugacagauuagcauggacaauuaauacagcagacaaugggaguagccuucucuaaagacugcaauccuguaugguucagauuuaauuuaggccacagaagauucugcaaacaucugcuuuugcuggaugaaacuugcugcauucaucagcauaaauaauuagguucaacucaucccaucccaagcaaaaucaagucacuuuccucuugcugagggaggaagcuaugccuuuaccuccaccuugaauugcacagauuaucugaugaaaucuauaaauugugcucucagaaacugaugcuuaaagaaaaucugugacuuugaaagagccccagaaagaaaucuacaaaagguacacuccccaacuaacagcacauuuuguaaaaauuaaguauuucuacaauagcuucuguugaguauucuuaacagacuagcuauggaacagcauauuaacaaucuaaucucaauuguauauacauucuaaaaaacauacaccacaugaaaaaucuuuaaaaaaaaaaauauauauauauauauauguaucuagcuauuuagaaccaauuuaguaaggcucuacaaaaugaaucccacaauaaaauuuaaagauaugucuuuaaaggauugaaaaacuuaaccuucaggucagaacuaaaucauaguaaauuccagaaaaccaugcauuucuaucuaagcuaauguaagaaaccaugauaaaauuaacacuuauaguaaauugauuauuuaacauuaaauugcuuuaaauuaaaauguuuuuccuuauaguaaaaaagugucuaaaucucaaaaacaaugcugaauuuugaaauaaacaaguugcagaaauacauguaauguuaagaugaaauuuuaaaauuuguaaauugguuauuucugagaaggggagagggaugagauaaggaggaauucacaagggagggucucaacugcauugauuuuacaaucuguagauuaauaagguaaaauguuaagacuuuuuuuuuuuuuuuuaaacggucucauuaugucgcccaggcuugaguaugguacugcaaucaugccucacugcagccucaaccuccugggcucaggugauccuaccaucucagccugcgggguagcugggacuaaaagcacaugccaccacacccagcuaguuuuuuuguagauaugggguuucaucauguugcccaggcuggucuagagcuccugggcucaagcaauccacugccuuagccucccuaaaaguaagacuugauaaagccauuugguaaguacuuuagauacaggucauuauauuaguguuuauaucuaauuguauguucuaaauauuuuauaauuuuaaaaauguaaaacaaaauucacacaaaauuaaauucauacauaauuaacucaaaauggauuauacaccuaaauauaaaacauaaaacuauaaacauuuuacaagguaacacagaaaaacaucuaggugacuuagguuugacaaugacuucuuagauucaacaccaaaagcacuauccaagaaaaacaaacugguaaguuggacaucauuaaaacuucugcucugaaaaagacauuguuaaugaaaagacaagucacauacugagagaaaauauuugcaaaagacauaucugaaaucaggauguuaucuaaaauauacauagaacucaaacuccacauuaagaaaacaaucugauuaaaaagugggccagugaucugagcagacaccucgucaaagaagauacauauaugaaaaauaagcauauguuaagaggcucaauaucauauauuauuagggaacugcaaauuaaaacaaugagcuaccauaaaauacacuuauuacaauggcuaaauucaaaacacaacaccaaaugcuggcaaagacauggggcaacaggaucucucauucaguguugcugggaauacaaaaugaugcaguaacuucagaagauaguuuggcaacuucucacaaaguugaacuuagucucacuguaugauccagcaauugcauucugauuugagaaccaauguccacacaaaaaccugcaugcaaauguuuauagaaguuuuauuucuuaacugugaaaacuuggaagcaaacaagauguccuucaauagguauggauaaaguguauuaaguccacucauugggauauuauucaggaauaaaaauaaaugaacuaucaaaccauagaacauacaggaagcuugaacuaacacagauaagugaaagaagccaucugaagagacuacauacuauauaauuccaacuacaugacagucugaaaauggcaaacuuaugaaaacagaaaagaugaguaauugccaaggguucagcggcgaggaaggaggaaugaaugaauggagcacagaugacuuuuccagcagugaaaauauucugcuugaauggaauaucuaccauuaccacuguaaucgcagauagaugcuauuaugaauuugucaaaacucaugaaacuauacaauauaaagagugaaccacaguguaaauuauagacuuuacuuuaaaauaagggaucaauauugguucauuaauugaauguaccaccauucuguuucaaccauaacaguguauauuguaauucaauucuggcacuaaccauccaguguuaguguagacccuacaaguuaaaggguaugaucccaaacaauauugcucuuuacuuuagaaaccagcuggacuucaggagucuccagaccaccugcacucugaccaacuagccauaaauucagagguuuccaugacucccucaaguucagaaauuggccagaaagauuuacacaacucaggaaaguacuauacuuacaauuauagcuuuuuuuuuuuuuuuaauacagggucuugcucugucaccaggcuggacugugguggcacaaucacagaucacugcaacucuugaucuccugggcucaaacaauucucccaccucagccucuuaaauuauaacuuuacuauaaaaaauacacauaggacaaggucuuagaggguccgaagugcagaguuucuaugcccuuuccccaugaguuagggcacuuacccucccaguacaccaaugucuucaccaaccaaaaagcucugcuuggcugggugugguggcucacaccgccuguaaucccaguacuuugggaggcggguggaucaucugaggucaggaguuugagaccagccuggccaacauggugaaacccugucucuacaaaaaauuuaaaaaucagcugggcauaguggcacgugacuguaaucccagcuccucgggaggcugaggcagaagaaucacuugaacccgggaggcagagguugcagugagcugagaucgugccacugcacuccagccugggugagagaguaagacugcaucucaaaagaaaaaaaaaaaagcuccacugagcuuugguguucacaguuuuuauugagggguuauuacauaggcaugauuguucaaaucauuagccacacgacuggacucaaacccuccuacucccaccaggucaggcuggccuaaagucccaaccuucuaaucacaugguuguucuuucuggugacagcucccaucuugaagcaaucuagggguccaccauaaguuaccaaguuuacauaacaaagauacaccuaucacuucagaaauugcaagaguuauaauuuccauguaaaaaagucuaagacaaagacaagacaaauuauuuauuguaccacaagcauauuaaugcaagauguuaauaagggaaacuguguauggggauggggagcucuguacugucugaaguguuuguaaaaaucuaaaacugaucuaaaaauuaagacuuuauuuuuuagaacaguuuuagauuuuuacaauaaauaaaauuuaagaaauaauaauauuacaccucaaugcagcugcauuaaguuacauugauuuaaaggacuuaagggcuuuuaguaaucuuuauaucuccuuagcccagcaguaugcagaacacaaaacaaccauuuaaugaacaguuauugaaugacuggcuucauuucuuucauuaugguaaaaaaaaaaaaaaaaacacacacacaacauaaaaucuucaccaucuuuaaguguacaauucaguaauguuaaguauauucacauuguugugaaacacaucuccagaacuuuuuuaucaugcaaaucugaaacuuauacccauuaagaauuccucuucccucucccuucagccccugguauucuacuuucuguuucuaugaauuugacuacuucagauaccucauauaaguagaaucauacagcaugucuuuuuuuuuuuuuuuuuuugagacagguucuugcucugucaccuaggcuggaaugcagugacaugauuacagcucacugcagcugcaauuuccgggcucaagugauucuccugccucagccuccugaguaguuggggcuacaggcaggagccaccaugcuuggcuaauuuuuaaaaauuuuuuuguaggaaaagggucucacuauguugcccagacuagucuagaaguccugggcucaagcaauccucccgccuuguccuuccaaagugcugggauuacaggagugaaccaccacaccuggcuugcauaugucuuuuugugacuggauuauuucacuuagcauaaugucuucaaguucuuccauguuguagcauguaacaggauuucuuuccuuucuaaagcuaaauaauaucccacuguauguauauaccucauuuuguuuauccauucaucugaugauggacaucuggguaccuuccaccucuuagcuauuauaaauaguguugcuaugaacacggguguguacauaugucuuugagaauuugcuuucaaugcuuuugaaaacuuacucagcaguggcauugcuggaucauaugauaguucuauuuuuaccuuuuugaaaaaaugccauacuguuuuccauagcagcugcaccauuuuauauucucgucaacaacaaugcacaaagguuccaauuuauccguguccuugccaauacuuguuuucuguuuuguuuucuuuuuccuuuuucaauaacagcuauccuaauagguguaaagugguauaucacuguguuuugauuuggauuucccuaaugauuaaugauguugagcaucuuuucauguggucaugacuauuuguaucuuuggagaaaugccuuugaucauuuuuuaauugaauuguuugguuuuuuguaguugugaguuauaggaauuuuuuuauauucuggauaucaaucccuuaucagauaugugauuugcaaauauuuucucccauucuucauagguugucuuuucacucuguuaauaguguccuuugaugcacaaaaguuuuuaauuuuaguaaaguccaacuuacuuuuuuuuuuuuuuuuuuuuuugagacggagucucgcuccguugcuuagguuggaggggaguggcacaaucucgucuuacugcaacguccacccccuggguucaaugauucuccugccucagccucccaaguagcugggguuacaggcacacaccaccaugcccggcuaauuuuuguauuuuuuauacagaugggauuucaccauguuggccaggcuagucacaaacuccugaccucaacugaucugccagccuuggccucccaaagugcugggauuacaggugugagaaaccgcgccggccuuaucuauuuuuucuuuuguuaccugugcauuugguguuauaacuaagaaaucacuacaaauucaaugucaugaggauuuucuccuaggacuuuuaguuuuagcuuuuauguuuaggucuuugaucaauguuggguuaguuuucuguauguggaauaagguaggacuccaacuucauucuuuuuucauauggaaauauaguuuuaccagcacgauucguugaaaagacuguccuuuccucauugaauggucucgccacccuuguugaaaaucauuugacuauauaagcaaggauuuaguucuuggcugucuguuuuuuuguuuuuuugagauaagaguuucacucugucgcccaggcuaaagugcaguggcgccaucuccgcucacugcaagcuccgccucccggguucacgccauucuccugccucagccuucugaguaguugggacuacaggugccagccaccacgcccggcuaauuuuuuguauuuuuaguagagacgggguuucaccauguuagccaggauggucucgaucuccugaucucgugauccaccugcccuggccucccaaaguacugggauuacaggcgugagccaccacgccuggccggcugucuguuuuauuccacugguuuauauaucugucuuuaugccaguaucacacuacuuugauaaccauaguuuuugcaguaaguuuugacaucaggaagugagagaccuccaacucuguucuucuuuucaagauuguuuuggcuauuugcaguuccuugagauucuacacaaauuuuaggauacauuuucuauuuuuacaaagaagucauugggauuuugauagggaucuaauugaaucuauaaauugcuuuggguaguacugacaucuuaacaacagugucuuccaacccaugaacaugggcuguuuccauuuacuuaugucuuaauuucuuucaguaauguuuuguacuuuucaguguucaggucuuccaccuccuugguuaauuuauucauaaguguuuuauucuuuuugauagaauuguuuucuucauuucgaaaccauuuuuggauuagucauuguuaaugauuagaaauacaacugauauuuguguguugauuuguauccagaaacuucgcugaauuguuuuaauucgaaccuguuuuuaugaaaucuucaggguuuucuacauauaagaucaugucaucugcaaacagagauaauuuuacuucuuccuuucuaguuuggauaaauuuuuuuucuuuuucuaauuguuguggcuaggacuuccaauacgauggugaauauaaguggugagagcaggcauccuugccuugucccuggaucuuagagcaaaaccuuacaguuuuccaccauugauuaagauguuaguuguggcuuuccauauauggccuacauuauguugagguaguuuucuucuacucuuaauuuguugaguguuuuuuaucgugaaaggguguuaaaucuuguccaagguuuuuuccgcaucuauugagauagauuguguguuuuuugcccuucauucaacuggauagcuuuguaaggcauaucucauucauucaaaaacaaaacuaauacccccauuuugcauaguuucucuuaauuuuuguaacaaaacauuuaaaacagaauuuagugacacaaacucuuugaguuuuaugaaagaccagagguuuugaaaagauaaaaaggagauauugaguagaaggcggcuuuuaaagggagaacauugcacaacuagcucagacugggaauuacaucagauaaaaccuaccaaaaaggaucaaggugaaccaacacuucauuugauaacacugcggcauacaucaauauacaacccagaauugguauacuguuuauauaacacccauugauuaauagcacaguagggaacuuagaguuaacaacaauuuacuguauauuucaaaauggcuaaaauaauuuuuuuuguauucccaacacacacaaaaagauaaauguuugaggugauggauaucccaauuacccugauuugaucuuuacacauuguauacagguauuaaaguauuacauguauccccaaaauauguacaacaauuacauaucaauaaguaauuuaaaaaaaucaaacucauuuaaagccuacacauacauauuaauuauagcacauagcaauggcaaaggucuaucauggucaaaaagaauacaacugaauaaauuaauaccuggggaaaugaaauggaaaagaaaucaaguaguauucauucaaaaaugccugucccuuuccauagaguuaaucgaaggcacaacgacuaugccauaaaccaaaguuccaaccaagagucaaagcuauauuuuauagaauugccacuuuccucaccaauaccaauaaauaaauuauuaaaucuacccuuuuggcauaauaaagucauuucaauagaacuaagagugccacaguuucaaugucaucucuucugaaaauaaauguugcugucuugacucagaauucaaauugcagcagcaggucauuauuuuguucuauucuauugacauauuuuaacucauuuuguaaaccuggaauuuguuccuguucuauaaucccagacagaaaaauguuuaugagaaggcaauuucauuuugcuaggaugacagugaucagucccuugggggagaggccaacucaagcaggacugaagcagcuguuagaagccaauuuuccuaccugcuaauugcuuuuaugacuaggauguacgggcucagacacccaccuggcaagcagaaaauagauggaaacagucacaucucaagagguuuuucccuucuucuaaaagaauucaacuaggagacaaaacagcgaagaaacagaaaaaugucaaaaauacaaaaauauuaauugcaaaaacauuaauuguaucuuccugacuaccaaaaggaaaaugaaaaagaaugaaaagacauuuguacgaauagcugguagaaaaaauauucauucauuggucacucaguaaauauuuacugaaaugccuauuauggcagacacuacuguaggugcuagagauacagcaguaaacuagacacaaugucccuuuguccccaucagaggagauuaaugagaaauaacagcuaccaauuagugaucugguacuaagaggaaaacaaaacgcagccauguaauaaagugaguugagaagcaccaauuuacagugaguugucaaggaagccucuuugaagaggggacauuuaagcugagacuuaaaugacaagaagaauccaguaaaccaccagucugagggaagaccauuccuugcagagggacaaggaguagaagacuugcaaguuggaauaaacuugguauauucauagaagacaaaagaaggccaguguagcuggaguuuugugaacaacguuaacaacggcagaagauaagaucucuucaaagugccacggccauuucaaaguuaucugcugagaagauaaaaauaaaacuaugacccacgaacuauucauggaaauucacuuuuggacuaguaaugaccaccaggaaaccuucaacaaaaaaaagauaagcaugaguugagaaaugccacagaggaagagguuucugaaucagaaagaaucggcaucagaguacuggcugaaucagugcugucaggaaccucaaaagcaauauuguucuagauaagaucaacaucuagggcuggcacaccuggacaaggugauaucugaggcuuauaauaggaaccguuaaagcacagcacucauaaaugaacuccaaucacaaaggaauguuucuggauguauuuguccuaauacuuguuugaccuacacauuugagauagcccagagacuuuaaaaaaauuuuaauguaaauaacaaauauaacaacauaaaacaacacccuccuaaaacagaaauuuuuagaaauuacagaaaauauuuccauguuuaaaacucuuccuagguuacaaaauaaauuaggaguuuuuuaaaagaaaaaaaauuuagugaguguauagaucaucuguuuuccuucuauagcaagcacaaaacaguguuuaaguucaaaagcaucuacaacauuaaacaaugcuacauuuaaaaauaaaauauaccuacuaaaaaaaaaguagcucaccuuaauugaaggauaaacuuuauuuuuaagcacugaaugauucccaaacauacuguauagguugcauaaugcuaacaagacauuuuguaauagugcuauaauguuaaaauucccaaacuaugcacauggcuaucaaauauaugcacuuuucuacaaaaacauuuuggucagacauuauucaucuagagaaaaaaagaaagaaacaacaauggagaucaaaaacuugcucuacaugagguauauggcaaugugucuucacuuaagccacaugcuaagaaaaaaaaaaaaaaaaagaagacugggaucagagacccaccuguacuggaaucccaccucucacacuaauuagcguacaacaucccugagucucaauuuuccucaucaguaaaaugagucucaugccaccuacucuuacaagauugauaggaauauuaaauaaaacagguuaaauuuaaaggaaucccaucuuauuauuugguaauuacacuauaagcaagggaaaugucuuuaaaaaacagcugauuuuuuaaaaagaaaaaauaauaaauaauagguuguaaaagcuaaacacaauguaaacaauacucaaguugaauauacaggccaaacuccuuuauuuuaccuaugaagaaauaaaagcuuggcaagcuuaagugaccagcccagaguugaaaaagcaggcagaaaaagggcuaaaaucuugcuuaauuccuaaaugugguauacauuuuauagagcacuuucauguauaagauccaauugauguccaugauaaaauaguuaaucugacucacgggaaaacccaaggcaccaaagucagccagcuucuuaguuauagaacugugacuaaaacccgaugaugaauaucuuuuuuucuuuuuuguuuuugugggggagggggcgggcagguggggguagagugggggucuaacuguguugcucaggcuggucuugaacuccugggcccaagcaauccucuugccuuggccucgcaaagugcugggauuauaggcaugacuuaccauguauggacuaugucucuuaaaauagagauuuaaagccuuucuuacuuauaauuuaacuaauacaaaaaaaugccuuagcaagcaaucacaauuuuauucagucaauaauuuuuuuuuuuuuuuugaggcggagucucacucugucgcccaggcuagagugcaguggugugaucucggcucacugcaaccuccaccuccuggguucacgccauucuccugccucagccucccgaguagcugggacuacaggcaccugucaccaugccuggcuaauuuuuuguauuuuuaguagagacgggguuucaccauguuacccaggauggucucgaucuucugaccuuacgaucugcccgccucggccucccaaagugcugggauuacaggcgugagccaccgcgcccggccucagucaauaauuauuuuuuaaagucacacuacaaagacauaaauguuuccauguuguauuuaagagagucaaucaguuuaacauaaaaauguucauaauaggagcaaauuaaauugccaaagacacauuuuuaggccuauuucccaaagcucaauugauauuggcuuaauauaauguagcaagacuuacuuuuauucuguuuguucauagauuauuuaaaccagauagguggguuacggagucacugaauauaugcuugaguaugauacugaauccauguuucuaucauuaaugacucuaauauucacguacuucaaaauuacuuaaucaauccuuuacauuguccuuucuucacguaggauuuucaagcuaacccuucuauaaguaggucaaucauucuuagacuuaaguugagaugauucacuuucacaaauaauuagguuacaaauacugcauuguuuugcagcugaggggacagccaggcuggaaaacuaauuaaaagaaaaggauucaaguggagaggagccaacugaacaauaugguaucuaaaaaacagacacauuuacaauacauguuucugagugucacgaagaaaauauacaucugcuccauauuccaaauucuuccuuuaaaaaggaucaagcauuauaggaagauuucuagguuuaagaagaagacauagaacagcaauguaggaagucagggcucagccaccaugauaguuuucagaucauuugugcaaacauaauaagagcauacccccaaauaggucucuguucaaagccacuucgaaagaugugaaaaugcaugcacaaaaguaaucucugaguuuugcaacuacuaacuggcaacacuguuguuggguaggugagaacacaaaagaacaauaaaucaauacacaaauuaacaguaaccacucacacuaauuucauaugaauuagaagaaucaauauauaauuugggugggaauccagcacucuugaaauagucauggccagagaguaucaucaaauuaacuacuuagcucaguucacaagacuucauuugugcucagcaaggacuaucacugaauagggaacagccugaauguagcaagcuuuccacugaauuaagauaguguauauaucuuaagguauguugcuugucugucuucuaagaauuuuuuaagcuacauuugaaaaaacaugauaauacaauugugagucuccuuaguguuaaauuuauaauuagauaggcaaaauaguaaguauauguguguuagagauucaaguaaaaaaaaaaaaaaaacaaggcccagcuugugacauagcaucacuacagaucccccuacagcucaguucccuacagcuuccucagccauagcucuaaacaagccacagaaaucagaaugaucaugcugaagcaccuuauggauuaauaaagacagaucaauucuguauaaccuauuuuguuuuuuauucaaauuaucuaaaauugauaauuuguaauuggcuguuaagaaacauaaucaauuacuggagcacuccauuucucaaucaccuuggauacgcaggcauuuacuacaaacauggcccucuauuuagagcaauucacauguaaagcacuccauuaauuacacucuucauucaauacacaucuauuaagcacuauuguguacuaggcacuauugguauuagagaaauaccaugcugaaucaaaucagccccugccuucagaggcagaaggcuuugcuuacagacaugcaaacauuacauaaugagacaagugccauaacaacauguauacaaaccacuauggaaauacacaaagggaaggacuuaauucuuccuggggaggugaagaaaaaaggcuugucagacuaccuaauauuuaacugaguguuaaagggucaguauaaguuuguuugguagauauacuagagguuguucaugagagaggaugugacagacccacagccugugcaaaguugggagggcagaaaagaguacuugcuuggaaagacaauagagcucgguaauagguaagaaugaaaaaguaaguaugaucagaaugaggcaggaaaauauggucuggaggcagggaacauaaagccaauuuacacuucagcuauaauaggaaauauccucuccauaggguauaugccguaaaugacuuuguaacuuuaccucauccucuucauuuacauagggcguaccccaaguaaaggguauuuaaacucaugaaaaacuccguuaacagggccuuugagcccguaugcucaggcccacucccacacuguggcauguacguucauuuucaauaaaucccuucauuccuuccuugcuuuguuugugcguuuuguccaauucuuuguucaaggugccaagaaccuggacacccuccaccguuaacgagaauagggcacagagguucuccaacaggccauguuaagacuuuaucuugaugaaaauguggagcacugaaaaguuuugaacacgggugugguaacaguuugaguuuuagacaauuauuuccgggcauacaagaaaaggacagaccagaaagaauaaagucuaaagguaaugaagucugguagaccuauuauaagauuauuaaaaucagccaggugugguggcucaugccuauaauaccagcaauuugggaggccaaggcgggaguauagcuugagcccaggaguucaagaccagccugggugacauaaggagaccccaucucuccaaaaauuuaaaaauuggccaggcauggugauacaugccugugguuccagcuacucaggagauugagguguaaggauugcuuuagccugcagugaauuaugaucaccacugcacugcagccuccagccugggugacagagcaaacccugucucaaaaaauuauuaaaaucacuacuauccuuagaucaaggcaguaggauuugguccuccuagccauaccucucccccaggaagugagcagugcagagggccaaaucgaagugccuuacucgaucuaucuccagaaaucacuuucuaucuaccugaaaccccagaacucugcucaaauggcccugaguccacuuccaagacagguccucauucagauacacgcaccacuaggccugaaggggagaugagggacagcuguugagaggaaaugggggcuauggagagagccuggacauuuugccaaaauuuaaaaauacauacauuuuaaauuuaaaauauauauacuuuagaaauaugucauuuuuuaauauauauaaaacuacaaauugagaauuagcaacuucauaccauacucaugaauaacugaauauuucugccuagaaaccuaagguuguuuaugauauagaguauuaaccugaaauuuuuaaaaauuuaauguuucaagaagauuugaaauaauuauuuaacagacaaaaaauauuuucccuauaagacagacauacaaaagucaggaucaacuucucagaaagucaaagcaauuugaagauagaugugccaaacagguguucauaacagcuuuguuaaaaaaaacaaaaaaagacauuuagugaaggaucaauguguggacuaaaggcacauauuugcuauacacaaaugagcuaauguauuguacugcucuucucauuagcuacagagaugcauuacccucacauuaaauacucagugaguaaaacacucuggcaagcaucuguuggcuaauagcaaagaaaaccaugaacccucugaggccaauuuccauccagcugcaagcauggaagcagcaaacacaugcacugcuuuucaauaucaaccccaaauaaccgugaaaaagaaacuccucggcuauucuguggcaaaggcauuccaaguaucgaucguguaugcuaaacaagacacuuggaaaaaguuaacucccuaaauccaggcuggcauuuaacuugcuuguuaccaacagacugugguagaagugacacugagugacuuccaagguuaugucgagaaaagccaugcagguucugggacuaaguuugggauggcugcuauacagcaacguugccagacagaauuugguaugugaaacugggaugcugacauaacaaaaaccuaaaagaugcgacacugguuucaagacugggugguggaccgaagcuggacccuggcuugaagagccugguagaaacuauugaaaaggaauuaaaggagaguuaaauguuuucagaaagaccuuguuaugaaguggcagaaaacuuagcaaaacuguugccugcaguaagguaaaaaaacagaaaauguugguaaugaacuacuacuucuaccuaagguaauuucaaagcagaauguccaaacugucaacugguuucuuuuauauguauaauauaagguaaaaaaagagaugaccuaaagaagaaaguacuuuuccagcagaauuuaggggaaauacaaagaagucagcaauugcuggguccaaaaauaaaacuauuucucauccacaaugucucccagcagagaaugcucaaaguaagaaaaggucugaggacaaagaucaaacauaggaugcagaaaagaaaaaucucaucucaagguagagacgaaagccaaagguguuacugugaaauccuuuguuacauuucucuccugauuucuucuucaugaucuucuucccaguuccuuuuucugcacuuguccacuaaaucuaaaugucccugaggauuuuguccucaaucccgggcaauuccuucuucaaucacucucuaaaaucuauuaaccucaaaaacucucucucccuuucaagccuccaccucccucuaagaacagcagacagaucuguacaucuccacucaacuaucucagagaaacaucaaacuaaauauuacaaaauccuaucuuccacuccaaaaguuccuucuauaccugaauacacacuggaaaggaaacaaauagugccacacccauuaaauugcccaacuugagagucaucucugauuucuacacuuccuucuccucacccaacaccaauauuuaauuagucaccaauuucuaugaauuccaccugcuaaagcuuucuggcaucugccccucuucaaguuaucuccuaucuggacuauauauagccuucuaaguggucucuccauuccaaaauaucuuucauacuacucuugaaaccaucuucuuaaaauaaaauauuagccauguuaaucuccuggugagaauccuucaagagcucccaaucaaaacccuuugauacagcuuacagguagguacuuugugaucuggccuuucccugcaaacuguccccacauaucauuuauuccaaccaugccaaaaaacaggacuuauacucauggugguuaugaauacauaguuuucucucugccuagaaaguguugucucuuguuaugaauacuaaguacguuuuuguccauuaauuuaacaguuuuagaacacuuaguagggccaggcgcggugguucaugccuguaaucccagcacuuugggaggccgaugguggaggaucacgaggucaggagaucaaggccauccuggcuaacacggugaaacccugucucuacuaaaaauacaaaaaauuagccgggugugguggugggcaccuguagucccagcuacucgggaggcugaggcaggagaauggcgugaaccugggaggcggagcuugcagugagccaagauagcgccacugcacuccagccugggcgacagagcgagacuccaucucaauaaaaaaaaaaaaaaccacuuaacucuguggcaaaucuggcaggcaagugaaaauaaauaagaaacacuaccugccucuucucuggaagcacacuaccuagaaagaaagaaaauaaguacaacacagggauuuauaacggaaaguagcaugguguaguggauugauuucuugcaggagguggagagauacgauugacagacaguaagcaaaacaauggaauaaauacaauaugaucuccuggaucagcaaguuuccuugauauaaguaauuuaaaacauuuuaauacuauuauacauacuuauuauaaguaaaauacaaauuuacaugaaagaugcaauaaaagacuuaaaaauucaugggccauuuugggcaagaaugacuguucagauuagaauuuaaaguaaacacuuagcagaagaggagcgacuuuaagucagagagacccuuuuauaauugcgcaagucacaacacauuuuggccccgccuacucaaaaagccaucccuaguucaguucaaguucaaauucagagaagcaauacugaaaaaucaacaagauucuguaggacccuuugcugcagccagcucacaccucuauauggcccucuaugaagggcuacagaccuggcauggaagaaggcuuacucaugaccaaggagucuugaacucauccauuuugggggguccagauuaaaguugccuguaauuacguaaaucaggucuaagaaggcugagaaaaaguuuaccucgauuccaauuccuguagaaucggaauuauaauagaaaaacugcugacccccucccagaauaucagcccuggaaaaguuacagcccuggaaaaauggagagaacucagaaaaaccccuggguugacuaggaccccuguguguggaaugguggcuuaggccugagacaagaggcaguccagcaaagcugugggauaacaaacgagaaaaagaacuacuaaaguucuauuuugcuucucuuguauuccagugcccaugugcacacgaccuggccccaaacgugcauuacucagugauaaaaauucagaacagugguucccucuggugagggauaagaaugucaaggaagaagucugaaggaacuuaagggguaauaaaauguuuugaauuuuuacagcagaguagcuacaugaguauaugcauucaucaaaucucacucaacuauauauuuaagagcugaguauuuuaucauaaaauugaaauuuauaccucaacuuuuaaaaguuuuucuuaaaagaucacaauagauacuacuuuagaucauucaacuggcaaaauuuaaaagucugaaaaaaaacaaguauuagagaggcuguaaaacaacaggauuucucauacaucaaugguaggagaauaaaauugcauaagcccuuuggaaauacacuucguauuauaacuuuaaguuuaacauucauuacccuaugacccagcaauuacauucauagguguauacucaauagaauaucuugcauacgcauaagagauugacaagagucauggauaguaauguuuccugcagcaauauuaaaaauugcaaacaccugaaaauaagauucuuauucuuaaucccaggaauaaauugagcaugaucacuuucaaauauuuaaguugucuuuacguuucaacaauaacccaguuuuuauacauauuauaguuugcucaaggugugcauauauagaaauccaaaauuaaggcacagaauuaaggcauuauaaugauuuuguauuuuuuaaaagauggaauuuauuuauucaacaugacuuuuacaagaguaaagauagaauucaucuaaaugcugguuacauaaauuauacuauaaccacacacaaaauauccuguggcuauaaacacgaaugaaguagaucuacauauauggaaaaaucuccaagauacagaaguaaguuuaagaagcaaaaaguaggcuagguccaguggcucacgccuauaaucccagcacuuugggaggcugagguggaaggauuaccugagcccaggaguucaagaucagccuugacaacguaagaggacccacucucuaaaaaagaaaaaaacauacaucagcagcgcaugguggcacaugccuguagucccaguuacuugggaggugaagugggaggaucaugugagacgaggaguacgaagcugcagugagcugugaucaugccauugcucuucagccugagugacagaguaagacacuguuuuuguuuuguuuucuuuuuuuaaaugagacagucuuacucuguuacccagucuggaaugcaguggugcaaucuuggcucacugcaaccuccgccuccggggugcaagcgacucucgugccucagccucccaaguagcugagacuacaggcaugugccauuacaacuggcuaauuuuuguauuuuuaauagagaugggguuucaccauguuggccaaagcuggucucaaaagccugacaucaagugaucugcccaccucagccucccaaagugcuggaauuacaggcaugagccaagacccugucuuaaaaaaaguaagaagcaaaaaguagaacaguaaauucucacagaucaaaauaaacuccauauauauugaugcauauguauguuugcaaaaauaauuuaaaaguaaauaaagugcuaauguuaguuucuuuugaaaauagagacagaggaucuaaggugaaagauuuaauuuuguacauuugcacuaucuaugaaucauuuuauacuaucuaaauuucugaccacauaccuuuucuauuuuuuuaauuacagagaagagacagaggcccucgaaaacuuuuucuauuucuaauaagcaaacucuuccaugacccacaguaguuauuccaaaccuuuaccacuccccucaaaucccguaucucaguccuguugccuuuucccacauagccaagccaaggaccuuguccucugcuucagaggaaaugaaaacucccuauauuuccuaauucacauccacaaauuugucacuaguugcauccaugagcacuuccuucccucagaagaaagaagccauucccggcaaaucuuauguucuaucauguguucuacaugcaaucugccauuucugcaaggagccuguucuauuauucuccucucucucucuacuuccacaauuuugcucuuaccuguuuccuuuuuccccuaccucuguauauaugcauguucaagccucuccuauauuaaaaaguacccuauguuccccucuaucaagcacccuaaacucauuccuucuguucacaguuaaacuucucaugagaguagucuauacucuuugauagucucuucuucaucucccauucacugcuaaacacacuagaaucuguccucugucuccacugcuacuaaaaacaaaaaaccaaucuuacuaaggucacuaaaagaccaaaccaaaagucaugcuguaaacuuuauuuuauuugaacuuucucuguagcaucugacacuaaugaacacugccacccuuuucgaaacacucuaaucucuuugcuucugugauauuucucucucccggcucuccacugagcauugggggauuuaaaaaugaaaaugacaaagucccugacuucaagaagcauaguuucuaaaaugagagaaacauacacaaacaaucacaacauagugaaaaaguacaaagugcagugauagcuuagcaaucaacuuuauauggggaagcgagagagcacuuuaggaggaggaaacuagcauguacaaaguaacauauaaaucaguaugguuuguacagaaauuuuaauggauaaugacugaacacacaaguugugaaauaaacaaucugacuguaucuauucuaucugaggauaaaauaacagucuuuaccucacaggacuacugugaagauuacaugaaaugcuaaauauaaaccacuuagcauagggucuggcauauacagaaagaucucaauaagcguuaucucauauacuuucugacaaaaacauucaacaaacuaugacuaaaagagaacuuccuaaaccugauaaugggcaguuaugaaauacccauaguuaacaucuuacuugauccugaaagacugaauguuuucacccuaagaucagaaacgagacaagggcugagcacaguggcucacauguauaaucccagcacuuugggaggcuaaggcgggaggaucacuugagcccaggaguuugugaccagccugagcaacauggcgaaaccccaucucuucaaaaaauauauaaaaauaagcuggguaugguggcgccugccuguagucccagcuacuugaggggcagaggcaggaggaucaccugaacccaggaagucaaggcugcagugagccauguucacaccacuacacuccagccugggcaacagaguaagaccuugucucaaaaaaaaaaaaaacgguuucagccagagcaguuaagagacaugaaagggaucuagaucagaaaagagguaaaacuaucacuaugacacgaugacaugaucuuacauauuaaaaagcccuaaguaaucuauaaacaacuauuacaauuaacaaauaaguucagcaagguugugugauacaaaaaucauuauauuucuauauacuagcaaugaauaauccaaaaaugaaauuagaaaaaaaauuucacuuagaauacuauuaacaaaauaaaguacuuaggaauaaauuuaacaaaagaauuauaagacauacacugaaaacuauaaaacacugaaagaaauuaaagaccuaaauaaauggaaaaacauucaguguuuacagauuggaugacugacuguaaaguccccaaacugauuuaaagauuccugccucagauucaacacaaucaaaaucuagcuggauuuuuuuguaaaaauugacaagcuaauccaaaaauucauaugguaauauaagcaauccagaagagccaaaacaaucuugaauaaaguuggaagaacuuacacugcccaauuucaaaacuuuauuauacaacuacagcaaucaggacaaugugguacugacauaaggauagacaaaucaauggaacagaauugaaaguccagaaauaaaccccuacauuuauaggcaauuuguuuucuuuaagggugccaagauaauccgauagucagagacaacuggauaucuacauacaaaugaaugaaguugaaccccuacauuacaccauuuauaaaaauuaagugagaaugcaucacagacauaaaaauaagaggugaaacaauaaaacuccuagaagaaaacaugaguauuccccaggaccuugaauuagacaauuguuucuuagauacaacaccaaaagcaaccaaaaaaauaaauaaguaaauaaauacuuuugugcuucaaaggacaauaucaagaagugaaaagacccacagaauaggagaaaauauuuguaaaucauuucucauaagagauuuguauccagccaauauauauacacauauaaguugauccuuggacaacauagguuugaacuguguagguccacuuauaugcauuuuuuucaaccaaacauggauaaaaaaagacagcauucaugggaugugacacucaccuauacagaggacugacucuucuuuauagguggguuaguaggaccaaaugcaggacuugacuaugugugaauuuugguauacacaaggguccugaaaccaauucccugaauauaccaaggcacaacuguauuucuauuuaauguaaauauacauuuauauuauauguaauauaaauaaacauauauauacaaauaaccuaauuuuaaaauggcaaaggaugaaaauaaaaaugucuuuaaagccccuaccucucacccuauacaaaaaucaacucacaaagggaucaaagaccugaaacaauaaaaccacuagaagaagacauaggggaaaaugcuccaggacacuggucugggaaaagauuuuaugauaagaccugaaaagcgcaggcaacuaaagcaaaagaaacaaacgggauuacaucaaauuaacuucuguacagccaaugacacaaucaacagagugaaaagauagccuguagaaugggagaaaauauuugcaaacuacucaccccacaggagauuaauauccagaauauacaaggacaaacauauucaaaagcaaacaaacaaaaaaaaucugauuuaaaaauuggcaaaugauauaaaugaacauuuuucaaaagaagacauauaccagccugggcaacauaacuagacuccaucuccgcaaaaaauuuaaaaaaauuagccaucgugguacauaccuguaguccugucuacuuaggaggcugaggcaggaggauugcuugagcccaggaguuugaggcugcagugaacuauaaucaugccacugcacuacagcguagguacagagccagacccugucucagaaaaaccaaaaacaaucaaaaaaagaaugaaaaaaugcucaacauuguuaaucaaggagaugcaaauaaaaaccacauugagguaucaucucaccccaauuaggauggcagcuguuaucaaaagacaaaaaauaacaaauacuggugaaaaugcagagaaaaaggaacucuuauauacugcugaugguaauguaaacuaguacaaccacuauggagaacagcaaggagguuccucaaaaaacuacaaauagaauaucauaugauccagcaauuucacuacagugaaucuauccaaagacaagacuaucauuauaucaaagagacauuugcaccuccguguuuacuguagcacuacugacaauagccaagauaugaaaucaaccuagauggccaacaaaggaugaauggaugaagaaaaucuggaauauauauauaccagagaaugcuaucuagucaugaagaaaaaaaaaaagaaauccugucauuugcagcaacauggaugagacugggacguuaugcuaaguaaaauaagccagaaacaaaaaguuaaauaaacacugcauguucucacucauugguaguagggagggagggacagggagagauuuguuaaagaauaaaaaauuaccaauagauaugaggaauacauucuaguguucuauaccacaguaagaugaccauaguuaacaguaauauguaguuucaaauagcuaggaagaaaaucuaaaguuaacaguaauacauaguuucaaauaacuaggaagaggauauugaacauucccaacacaaagaaaugauaaaugucugagaugauggauauguuaauaacccuaucugaucacuaacauauauguacuaaaacaucacuauguaccuaugaauauguacaauuauuauugucaauuaaaaacuaaaaaaaaaagaaaaagaaaauguucaaauggccaauaagcauauuuaaaaaguucauaauaagucacuagggaaauacaaaucaaaaccaccauauaccacuucacauccacugaguggcuauauuaaacaaaacaaaacaaacccagacaauguuaaguauuggcaaggauauggagaaaucaaaacccucauucauugcuaguaggaauguaaaaagguaccgucuuuuuagaaaacaguuuggcaguuccacaaaauguuaaacacggaguuauuaaaugaccuagccauucuacuguuagguauauauccaagagacaugaaacccuauguccacacaaaaacuuauacacaaauaaguguucacagcagaauuuucauaauagccaaaaaaguggaaacaacccaaauguccaacaacugauaaauggauaaaugaaauauggcauauagauauuguggaugaaaaaaaagaaaaaaaagugugacuuuuuauuuuauuuauuuauuuauuuuuuuagacggagucuuacucuguaacccaggcuggagugcaauagugugaucuuggcucacugcaaccuccgccuccuggguucaagcgauucuccugccucagccucccaaguagcugggauuacagaugcucaccaccacacccagcuaaauuuuguaguuuuagugaagacaggguuucaccauguuggccgggcuggucucgaacuccuuaccucaggugauccaccugccucagccucccaaagugcugggauuacaggcaugaaccaccaugccagaccacuuuuuuuagcuugaucauaaacaauuacagucuuuaccuggcaggcuucacaggagaaaacugcccuccccacaccagauuuggugcauaccuggugcacugacaucucuaaagcaagcugcagucaagacucagguauuccuaaauggccaugcucuuuaccguaucuacauuaguagcccagguaccuucauucagaagucucuguggccuuuaacugaggccuuuccuuaggcaacuauggagaggccuccucaacagagggaaaacacuaaaaacacuuuccuccacucugacucaguaccuuccuccacuccuagccuuugcaccuuuuccuccaacccaccccagaucuauaaaacagcaggaaccuuuugcugggggcucccucagcauugagaaaauccccaccucuguguugauccacuugacaggagggagccugcacuuucucagcuuuaacuucuugcuuauccuaauucgguaagugauuaaaguaacucagcucuguguccccagcuaagcuccugacacuauggaauauuauucagucauaaaaaggaaucaagguucauccaugcuucaacauggaugaagcuuaaaaacuuuauguuaaaugaaagaaauuagucacagaagacaacauauugugcaacucuauuuacauaaaauguccacaauaggcagaaaauaaauuaauagcugaggggagggaggaaugaguagagacuacuaaugaguacuuuuaagagugaugaaaggccaggcagguggcucacaccuguaaucccagcacuuugggaggccgaggugggaggaucacuugagguuaggaggucaagaccagccuggacaacauggugaaacccugucucuauuaaaaauacaaaaauuagccaggcaugguggcacacaccuguaaucccagcuacuggggaggcugagguaggagaacugcuugaacucgggaggcagagguugcggugaaccaagauguugccaccgcacuccagcuugggcgaaagagacuccaucucaaagaaaaaaaugagugaugaaaauauuccaaaauuagacuguggugaugguugcacaucucuguaaauauaauaaaaacuauugaauuuuacacuuuaaauggguggaauuuauggcauggaaauuauuucucaguaaagauauaauaugaauacaugauguuaguguucauaucauaucuagaccacuauugcucuguaaaugaguuuguaaaauaauccuuaaggaauguagauacugaaggacucagaguaguagacggacaggcugacauuuuuuuaaagaaaaaaauaaucuguugacaaugauaaaaauggcugacagagcagucagacucaagguggagagacuuacaacgauguauuuggaaaaauuuuaacaagaagaggacuugagccaagacagguaagaaacgggaaaaggcuaugauccuaccuuuagaguggaaugcuaucuauagaagcuuucuguaaaagggaagcuuucuauagaaggcaacuauuaaccuauauccuuauuacagaggcucccaaacagggaacuacagaaagucaucaaguccaagagaguagagugguagaaagcucuuaauaauggcccauuaaaauagcaguuguuuuaaucuaugauuuaacuaauggaagacuugucuucaaaaauauuagauuauaaugccaauauauucucaaguauaucagagaacaguaguaugaauuucgucuuugaguauuaaagauauagaaaaaauucacucaaaaguauuuuaucacuagaacaaguuucauuuauuucaaaugucuuauaaacaugcuuaaaaguaagcauacucuauauguaguuuuauaacuuuccuauuaaaacacucagaggaaaagauauuugauauugccuuaaauuuuuucaaaaacaauucuuucucauuauaaaauauauauuaaaaggcaaaugaauucauaaauuaucucaccuuugguuuuuagauaaaccacaaagaaaugucuacagcauaaguuccaguuugggcagauaccugaauuguaaaaaacaaacagaaaaagacauggucaauaugguugaaucugaguauggaaauuuaauuauuucaauagaacccuaacuugaucauuuaccuccuaaauuuuuacguccaagcuguucuuuagauaucuauagaaugucaagaauuaagaaauucuccuggacuuucuauugccuuugauuaauguugguauuucuugaaauuaaaaguauaucaaaacaggccgggcacggcggcucacgccuguaaucccagcacuuugggaggcugaggugggcgggucaccugaggucagguguuugagagcaaccuggccaauguggcgaaaccgugucucuacuaaaaauacaaaaaaauuagcuggacaugguggugugugccuguagucccaccuacucgggaggcugaggcaggagaaacgcuugaacccgggaggcggagguugcagugagccaaggucaugccacugcacugcagcaugggcgauagagcaagacuccaucucauaaaaaaaaaaaaaaaaaaaaaagauaccaaaacauguacuacauaaacaggagaaaaaaaucaaucuccuucaucaacucaauucuucaaaagaaaguauuuucuacaguuuacacucccuauauuaugauugcccauccucauagaaaauacagaauuuaaaaaucuggaaauguaaaaguaaaucaauagcacauguuuauaaaaccuaagcaaauaaguaaauuaaauaaaaccaaugucuacuaaguaugaaaaauggaaaaaauguucucuacauuagcaaagaaaaugaaauuaaaaugagauaucaucuuugaucaaugaaauuauaauuguuuuaaaaauaagauuauagucauuggcacccuuccaguucuucuccuuaccagacucaugguaagauugcaccucacugcccucuuucaacuuagguguagaaacaugacuugcuuuagccacugaaauguacacagacgugauguuacacauuucuaaguauaagcuuuaagaccaacuacacaacuuacagaccucccagcuacugcagucauuauggaguucacuaaaugucucugaagagaaaaaaacaacccugcugacauguauuagacauguaacaugagcaagaaauaaacuuuguuguauuaugcaacugagauuuuuaggacuguuuguuacuacagcacaaucuaggcuauacugacagcuacaagugauaacguaauauaauaauauauaauauuauaauaauguaauauaacaggcauuuuuguacacuguucauaggaauuuaaauugguaaauuuguuuuuguuuuucggguuuuucugagacaggaucucacucugucaccuaggcuggaguacaguggcgugaucacagcucacugcagccuagaccucccaggcucgagugauccuucuaccucagcauccugaguagcugggacuacacaggugcccaccaccaagcccugcuaauuuuuguauuuuuuguagagaugggguuuugccauguuguccacgaagacuggucuugaacuacugggcucaagcaauccacaugccucagccucccaaagugcugggauuacaggcaugauccauacgcccagcaauugguaaaaucuuucuggaaucccagcacuuugggaggccgaggcagguggaucaugaggucaggagauggagaccauccuggccaacauggugaaaccccgucucuacuaaaauacaaaaaauuagcugggugugguggugugcaccuguaaucccaucuacucaggaggcugaggcagggaaaucgcuucaacccgggaggcagagauugcagugagccgagaucaugccacuguacuccagccuggcgaccgggcgagacuccaucucaaaaaagagcuagaagcaaacuaaaaguacaaaugauuugcuaaauaagcuagaauauuaagcaaucauuaaaacugcuuaucaaagaugcuuaaugacuaacagaagaaacuguguaaagggcauacauaggaacucucuguacugucuacucaauuuuuucauguauacgauucaagaacagguaaaacuaacuaaucuccacugacagaaaguagguaaguuauugcaggaaccaaagguuguaugaaagaauugacugcaaaggggcuuaagagaagcuuuuaagagugauuaaaauguucuauaucuugauuauggcgguugucaacaggauauacacauuagucaaaaccccucaaacuguacugcacauaaauaauuuuacuaaaguggauuuuaaaaguaaaauaaaaaugcuuaaugauaggaaaaugcucaucuguuggguaauuugaaauguguaauacauaaauuugcauagaagaggcuacaaauacauacaauguuaauagugcuuugcuuugcauaaauauuacauagguaguuuucauuuuuccuuaaguuauguacuuucaaaaugcucuaaguaaguacguauuuuuauguuuauuuggugguauuuuauugagaaccagagcuuaagccuagaauaagcuugagguuuuaauaauuuauucauucaguauucauuacaugccuccauguacaaacagcauucuaagugguagagggauaccuccaagcuuggguauguuucuccaagguucagcuagauggggcuuucaagugaucaccauugccagugaauguggaagcaucaacuaucaucuguaaaccacaucuguuuauaaucuuuacgcuggcaaaugacagguaaguugugacuauaaaaacuguuuggauucaugauuaucuguuuaccuaaucuuccugaaaauaagcuuaaauuuucuacaguguuuaauauguaauauauaacauauauuuagaauguauuauaaugugugaauguguuuauaagaauauguauugauaacuaaucauuuaaaaauguuaugaguuuugagcauuuauuuacuuaaaaaauuaaaaguuuugggccaggcaugguggcucaugccuguaaucccagcaauuuacgaggccaaggcgggcggaucaccugaggucaggaguuccagaccagccuggccaacauuaugaaaccccgucucuacaaaaauacaaaaacaauuagcagggcgugauggcaggugccuguaauccuagcuacuagggaggcugaggcgggggaauugcuugaacccaggaggcggagguuauagugagcugagaucacgccacuguacuccagccugggcgacagagcaagaugccaucucaaaaaaaaaaaagaguuaaaaguuuuaccacuauaaaaacugcuugaggguuuaaaacucuaagaaauuguagaaaaauauaaaugaaacauagaaagcaauaaguaagacaauggagacaaagcauuaagcaaagagcaagaaguguuugauuaaucaaauagaaacacuggauacauaucauuaacaaauuguaaucaacaaguaaaaauauagugagaaaauacuuguuucauguucagcagugaguguagcaauucaagauacuggggacaagggauuacgacuauaugcaggggacuauaugcacuaacuucucaugacagaaaaaucugagauaacuacuccauuauagggaauacacaugaagcaaaagagaaagaacauauauagaagaaucuaauccagaacugauuuuaaaccagugaucacugaaauuaaaucacuauguuuaauuauaacuauacaauauguugccuucucaaguuugacauuugcacuuacauguuguauucaaaaaguauaaaacuucauaauuuacaauaaaauacaaauaaaaugcacuauuuauacugauaaccauuaagaagcacuaaaauaaugugugcuaaucagguuacagcuaguaaagaugaguaaaauagucucagacauuaaggauacaacacagaaaauauuuguaugugaaucacgguacagauaguaaagauggauagacucagacaccaggaaguuuucauagcacuuagaaagacagcacaaacccaaaacacaaaauugccaacacuacaggaaugcaaauggagaguucuuguuaaguauuagcuucucgacccuuagaaaauacaaccuaugagucgucacugaaaauacagacagaugggaaaacaccaucaccaaguuggucuugguuuucuaaauucuagaaaccauaugugcaggaacaaguacccuaaucaacuaaaucagugaucaaacuauagccuaagagccaaauccagcccagggccuguuuuugucugauuuaugagcuaagaaugguuuuuacguauuuaaagggccauaaacaaacaagaauaugcaacagagguaguauauugccacaaaguuuaaaaguuuaaaggggaucuuuacagaggucugcugacuucugaacuaaauaauucauaaauggaugaaacaggucuuagugguggcucugauccaaagauuugaacugugccauggcaucauaguauauuagaacuggaaggaggcaugaagaccaucuuuccuucccaugauauugcaaaggcgcugacuauggcucauagguuuccaucuucuggaucuacuguauccugggucaaaagugcuuuacaucucaccacaacacuggcucccuuuuccuuuagugaaguaaucugggaauuaaaaaaagagguacaacacaguaaguacacucuccuccaacucuccacugagccuuuccuacacacaacuaaucaacuaaaagugaagugcugaugaccuucauauuuuacuaauucagcaucaaagaucauuuccuauucuccccacuucaucuccccacuucaucucccucuacucuacuaagauauucucuaaaccaagcaaauuaagcuacuagcauuccugaaaaagcaucuguuuuguccuauggaccuuggucuaugugguuucucuccuauggacaugacuuccuuucuccaccuauccaaauuccuuccauccuucauggcccaauuugacauccaugauaccuuuggaaagcuuauaauccaauaggaaacagagcucagguacacacaaaaaaguuuuaaaaaucuugaaaguuguaauaaauaaaauguuauaaaauuccaagaagcaaaaugucaccucaggggaaaauguuuagguaccaccuugggaaagucuuugaguaagauaugagaaagagcagagaagaaaaagggacguuccaggcaguggaaaugagcaaagguauaaaagggauaauuucuuauaguagugauucucaucuuuuuguuucccuagauuugccucuaaccaagugaugacacagagaaugcccucaauuucuaaagucccuugccuacccauaauuuugaauguuaccaaaacccacagauuuaaugugcugaucaguuaaucaaaauucaauggagacagucuauuucugcauaugucuucagauaacuuuugugaacauaaaaauccaacacaucgagccaggcacggugacucaugccuguaaucucaacacuuugggaggcugaagcaggcggauaaugaggucaggaguucgagaccauccuggccaaaauggugaaaucccaacucuacuaaaauacaaaaaauuaaucacgugugguggcccacgccuguagucccagcuacucaggaggcugagguaggagaaucgcuugaacccaggaggcggagguugcagugagcugagauugcgccacugcacuccagccuggcaacagagcaagacuccgucucaaaaaaaaaaaaaaaaagaaagaaagaaagaaaaauccaacacaucuacaaaaucaaauauaaauucugugacuuuaaggcugaauuauguuauuuucauaucauuaaucaaaccaaaagggcugaaaguaaaaacuucauuauuuugguuaccuuuuuacuaaguaauuuuauucuauggauagcaaccuuucacauucugguucacuccaaaccuagggccuaguagaugcuaccuaaauaccuguugaauuaauaauauuggaacauaauauauauuucacugaaaauauuccuuccuuuaauuaugcaguauaauagaaaguagagagaagauaaggaacauuaauugaaaguguuguaaaagugaagccaucaaaaaacuuaaaacaauuauuucaaaaccaucuuugaagcaaauaaucuauucacauguaacucagaucuuuauuguagccuuuguuguaacacuacacacauaccaccaccaccaccaccaccaccaccaccaucaucaucaugacauuuuuuucuaaauacagcuugaggaaggaaaccauauaauuugauuaacagaagcugggcgcaguggcucacgccugcaauccuagcacuuugggaggccaaggcgggaggaucacucgagguccagaguucaagaccagucuggccaacauggugaaaugccgucucuacuaaaaauacaaaaauuagcuaggugcaguggcacacaccuguaauugcagcuacucgggaggcugagacaggagaauugcuugaaggagguggagguugcagugaccugagaucgcgccacugcgcuccaacccgggagacagaggaagacucugucccaaaaaaauaaauaaaacuaaaaacaaaacagaaaacagucacuuauucaucuuuguauuucacguaauuccuagcacauaauggguacuuuaaaaucacucauugaguugaacagucauagagaaaauguuuucucugcucuccaugacuucacuauauuucaaagguauaaggcaacaacucuggcaauaaaagcagaacuuagaaagccugacuuauuucaagaguucucugauacgagaagagauauccaauagauguguucccuaauuacacaaguauaagaagaugcauugcuccacuguugucgauuugcuauauuuaguaggcucugaauugaauuauucaagcauguacaaauauaaccuuaaagggguccacauacuugcuccugacaaucuggauacaaaagcugccauucagauaaaagaugacaggcaacaagaaucugacaggccagcaauuuacugcauuuucugcacauuugaauuuguagcccuccauagccauuaagcaaaauuaguuucaugaugucagccaaaaagccucaugggcagcaguuuuaugucauuaaaaaaacuaccauccucaaucuguuugaaucuguguuugcucauuagaagccucucaaugaaucagaagcgaggguuuaaucacacucuuacucuaugaaugcuuaguauagcccugaacuauaacaaauuccuauucuaccuuucccuguaucuaaaauaguuuagauauggcugaagaaccuaaguaucagacaggcuagcaguucucaacugauaugguucggauauguguccccgcucaaaucucaugucagacuguaauccccaauguuggagguggggccuggugggaggugauuggaucaugggggcaguuucuaaugguuuagcaccaucccccuaguacuguucucaugauaagaguucucacaagaucugguuguuuaaaaguguguagcaccuuccuccucucucucucucucucuuuaugccugcuucccuuggccuuccgccaugauuauaaguuuccugaagccucaccagaacccuagcagauggccagcuuccuauacaacccgaggaaccaugaaccaauuaaaccucuuuucuuuauaaauuacccaguccagguauuucuuuauagcagugcaagaaugaacuaauacaucuaucaaaaauggagcaauuucaaaacuauaaaugugaucuuaauauguauuuauccaauuuaaaaagcaagugucagagaaaaacuucauccucuccugcuccuaacuguugaucucugaauccacuaugcucucuuaugccccuaugccuuugaaauuguuauuuuccccuuugcuuguuuagaaucuccuccuuaaaccugucuggcaaguuucuacucauuauggaagucuucccugguuuucccaaaaaagaugcaugcaaucuuccccuaugcacguuuauauacuuacauaaguaccucucaaacuauaucauaacugucucuuaugguuagagaacaguaagcucucuacaggcaaugacugaacaccucuuggcagaacuaauauugaacugguacacaccaacagagccugaagggucauacuuaaguacggaaauacuuccguaacauagucugguaacgugucacugccucaaacuccaccaguccuaaggugccuacugauggcccagucuccccaccaccacuacaacccagcagguaaaacaagaaagccugacacagcauaaaggaugaagggguucuucaagaucgugauccagugcuacagccaucuuaacugguuggucccuauuuuguacuuacugguaaauacuuuaaauaucacuccugccucuucauagccaaagcacaggacacugccuagcuuaucaggcuucuaauucuuuggcaaaauaauaaaugaagacauaccaggucuaucaauggcccagggucaaugggcaugcugucaaaacuaugcagacaaugaucagugaucagacugucaagaaaaauccagauacuaaaguacuagaaaagaaaauggucaagucugucuauucucuguguuugccuucagcauuugauaaaauaaaugcuuaucuugauaaugugcaaaaaaaucuucaaugugauacuuuauagagaauauaauucaaguauuuuuaauguuuuuaaauaaaguuuaaaagcaaaguuucuauaaaguaagucuccauaacauaucacaaacagugaucauuaaacucuaaucagugucuuggauaggaacacaaguaucacuaaaggaggagcacagugauuaauucaaauggagaggaaaaggcaagaaugagaagagucaguuaauuauaaauggcaugucuaauuacagauuuugcuaggggcuucagauacuucuaauuaguuuuacuagguauauuaauuauaaacagaauaccaugagagaauuuucuaaucacagaaauguaccuagaacguaaaaucagaguuuaucuuuauaauuuaauaauuaaauguucaauaauguauaauuauuuugaaagucaucaauaaaauauauaucacacuaaaaucaaguuacucagaauauugcuaagguggugacagagucuuuaaaacauccauaggggagcaaguguguagcugaaggaaggaugaacauguagcuucaauaauaagaauuuugaacuuauaaauggugauauaacaaucuuuuuaggcuccuuccuuucugguaaauacuuuaaauaucacuuuuuaauacuuuaaaauuuucugguagaaaaauugucuuuuauucaugcuguaggcaguuucagagagccauaugauuaaaauguuaaaaauaaagauggaagggauaaauagcagcaagagaagcuuaucuaauuucaacacuaucucauuaagaucaaucuuuaauuuaaaacaaaaacaaaacccugcugugcuauauacuguauuaaugaaaaauucuacaaggugacaaaaucucaaacaggaagcauaauguguuuacuaaggacaaauuaagaaaaaccauucugauuuuuugguauuuguauuaaaguaaaaacuuagaaaagaggagaaaaauuaaagaccaugauguauuucaacuuuaagaaaagcuuuuaaagucccacuaaucuuaaauuaaaacaaucagguaaauuauuuugguuauuagcacuaacaugaauuuaagcagaaaauauauacaaagaaaauguaaguaauaguuacaguaucuaucauuuauugaacaccuauauacuaucccaggcagaaugcaaggugcuuuaccuaaauuguuaauuuucacaaccaucuaacuuggcagauacuaucaucccuaccuuacugaugaugaguuaguauuaaaaauaaucucgccacagucagcuaguaaguggcaaagauucaaacucauaguugacuacccaacagccucugugcuggccacuacaccccacuaacugaccagauggccucaauguaguuaaaguaagccaagguagcacugaaguuccaugguguauaagcuguacuagauggaugaaguuaaggcuucuaucuacuauuccaaugaaugugacuaucugaauaucuaaggaaaacaauauaauuuaguaauuacacuucugacccugauuugggaaaucaaggauguagccaguuggcuuaagagcuaucacaaaauucuauuuucauuaaacucacuuugauccaaaugaucaaaaauuaagcacuuagauccacaaguaaaaggauucaaucaggaccgauauaagucaaaaauaaauguaauaauaggccaggcgcgguggcucacgccuguaaucccagcacuuugggaggccgaggcggguggaucacgaagucaggagaucgagaccauccuggcuaacacggugaaacccugucucuacuaaaaaaaacaaaaacaaauuagccggacgcgguggcgggugccuguagucccagcuacucgggaggcugaggcaggagaauggcgggaacccgggaggcggagccugcagugagccgagaucgcgccacugcacuccagccugggagacagagcgagacuccgucucaaaaauaaauaaauaaauaaauaaauaaauaaauaaauaaauaaauguaauaauaaaaauaaaugaguuugauuaucacaauuuauuuuaaaaaaccuuucuccaacuuuuuugaacacacauaacaaaaaagaaaauguacaguucacuuaaaaaaaucaggcaacuugaaacucuucugaauaaaugagcaugaauaaaaaaaauuaccauauaccuaacaaaggcacacaacaaacauuuaacaaacaaguuaaugacuuggcuaaaugaagauuaauaagugaaaauggggaaaacaaggaaaauuaagggaagaguuuaucuuucuccaaguuccuucucacauaaauacuaccugcucuauauuucccaggaaguugguuaagggggugggggggaaguaccugcucuugagguucuuuacuaaaaacaguccuucagaauauaccuacccuagcagaacucuccuccucauauuguggcuaaggaaauaucaccucucuccuaagagaaggucuaacauccaaaauaauauccuuccuuguccugaacagccucuuucuggaaacauuuucaaucccucuacaucccacagcauauuucgaagauacacuuuucugguuuucuaaauugaauauuauuuauuauuuaaucaucauaaugaaaaauuuaaagaguaguuuaugauauacagaaacucugacacaauaaggauauuuuauagugcaaauauaauucucauuuuaaaaacacaagcauccuucacaaagauuguuccauuugaaaagaauuuuuuaaggcuuuuuuauguaagcuauuuucuacuuuuuuauuugaaagaaaucaugccuuuaacaaaagcuguauuacaguuacacaucucuuaccaacagggauacauucugagaaauucaucaguaggugaucauugugcaaacaucguagacuguauuuacacaaaccuauauaguauagccuacuauacccagaggcuauuuaagagagccuauggcuccuagacuacaaaccuguacagcauguuacuauauugaauacuguaggcaauaacaaugguauugguguaucuaaacacagauaaggggcugggggcaguggcucaugccuguaaucccaacacuuugggagaccaaggugagaggaucacuugagcccuguuugagaccaaccuaggcaacauaaggagaccccaucucuacaaaaauguuuuaaaaauuagcugggcaugguagcacaugccuguggucccagcugcucaggaggcugaggugggaggauugcuuaagccagaaagguggagucugcagugggcagugauugagccacugcauuccagccuggggaacagagugagacucugucucaaaaaauaaaguaaaacacaauuacagauaaacauagacaagguaugggaaaaauacaauguuauauauacucuuuuuuuuuuuuuugagauggagucucacucuguugcccaggcuggaguacaauggcacgaucucagcucacugcaaccuccagcucacugcaaccuccaccucccagguucaagcgauucuccugccucagccuuccaaguagcugggacuacaggugugcaccaucacauccggcuaauuuuuguauuuuuaguagagaugggguuuuaccauguuggccaggcuagucucaagcucuugaccucaggugauccgcccacuuuggccucccaaagugcugggauuacaggcgugagccaccaugccaggccaacaauguuauacucuuaugugguccucguugaccaaaacuuugucauuccaugcauaacuguauuuacaacucuuaccugguuagugccuggaauaacuuccugaaucucaucuacuguaucaccugcugauucaaaaaucaccuuagagcccaacuccuuuacuucaccuaauaaaacuuacugagcuuggacauguaaaaaccacaugugguauauuuucuuccagugcaacaacgccuaugagacugggcaaguugagaccaagagugaucucuccucuucauacaaaacaacuagccuaucauuugaauaugcuauuauuuuacacaugaguuuaaaaagaaaacuaugccugacuaucacauuuccuaaaacuguaaguuucuaaggacugcacugacucuguauaacaauauuauauauauauauauauauacauaaucccauaaaaauaaagcaagcaagcauuuuguaauucuuauuucaccuguaaaaaggccaaccacaugacaauuuuacgaagcaucucauuucuuuaguaaacuauugaaagaucaucucucucucuuugacauacaugggcaguggaagucauaagcaaaagcaaaaugaaaugaucgucaaaaauucgugcuucuuacagaguacggaauucaauagucuaacugccaggaaucuugcuacuucacgguauuauuuacauauuacaaauuauauuuaauuagaguuuguuauuuguuccauuuuaaagguauuggaaaauaaaauauuucccuuugcugacauacuaacacacucuuuacuauauacuaaaacuuuauaacauuuuaugucuuagugguuuuuggaaggucaauaccauugcauacuuauaugcugaaauaaauccuuuuaaaaaucacauugucaauucucuuuggcuucagaaaauagacaugucaaaaacucaacuggaaagcaaauaaaucacaauaccuuugaaguguuauuaaauaauccugaagacgaaaucugagucaaacuacaaaaaggcccucaaucucugcuaccaagaauuguguuggauucauucauauaucauuuauagaaaagaaguaaucaccaugucuuuagccaagcacaaacauguuuguugagauggacuguguaaguccgaggauuuugcucgccaccccuauauuuccuuggucuacaagaaacaacuguaguucagcugagacugucuuuaacugguuuguuuuuaaagagcuauaucugcugaaaugagauugccuaaaagcacugcaauccucuccagugggauuacaaguuauauugguaauaaauguguucacuuagguaacaagaaagaagaaaaaggcaaccuacaaauagugcugaaaaucugaaguuauacauuuucuccaaugaaauaaaaguaguugaauaccauauauuucaaauagaaacucaaaaaucuggggauguccacagcaagaccuucccauaaggagcaaaauuaucuagcaguccuucuaagaggaaccugaauuagcauucucuauugaacuaaaaagucguaagagaaugugagucacuuuugaagagcucauugaagaauaaaaugagacuuuaagucuuuaaagaaacuaucuagaaauauauacaaauccuaaguugaauacaauguaacaaaaauaacacuuaucaaacacccucauacuuacaauucuauacccucugggaagaacgguauacauggagggaagccauuuucuagcuggacauacuaggcuaggguucccgaaauccaauauauagagauucagggguuugcugcaaauauucuagaaguguauaucuagaguaagaacuguucacugccaacccaagggcccauccaacauagaauacaccaauagggacccuuaagaggauugguuagguccaggaccuucauaagagaucuaauuagcuuuagaaaacgggccagaaacucuuguaacaggaaacuuuuccguuuacagcaggacuugccuacaagauaccaagacuaaaugcuguuucacuagaaugggacuuauuucaaccaaucauauacagaucuaugaauucaugccauccuauccaaaaugcugguuuucaauacuuaauuuggauaacuacuccaaaccuacccuaaccacugcucuuuucuaguacuaaaauccagacuuuucuuccucaacaauuacucacugaauuucuuuacuauauuucuuuaccuggcaaauguaaaauccuuacuauauuuccuuaccuggcaaauaaauaaacucagcuuuguuuuaucuuguuuuuuuagcuccauuggucuuuguuauauucuuugacauauugauuuucaagaauauuuucauuccuuuucuuccaccaaaagcaaaucaauacuggccugggagcuagaaucggucaauagcaugaccugcccugguaaucaauaauacacgcugguuauguaauaauacaggccgaugguuaggucaugccacuggcguaccugaaaaucugccagauaauuagaaucacccuuucagcaaaaacagcaacucucugaguacucuggugguacugaucagugcaguuuuggaaggcuggacauaacugaucuuuaaaggcaagaucccuuuuuauuccucuuucugcuuauuauguacgugguccacugucaaagagauaugagaaaaucaguuuuuugaauuuuuugagacagguucuuacucugcuacccagccuagaaugcaauggcacgaucacagcucacugcagccucgaccucccaggcucaagugauccucccaccucagccucccaaguagcugggaccacaggcaugcaacacuaugcccaguuaauuuuuguacuuaguguagagaugggguuucacuguguugcccaggcugguuucaaacuccugggcucaagugauccauccaccucagccucccaaauugcagggacuacagaagugagccaccaugacuggccaaaaaucaguuauuaugcaacaacuauuugcuugacaagcaucccccucucucccaaauggcagaguaaguguugcuggaaacccugguaugccacuuucaucaacccaaaacuaucuacauuuaauacacaaucuuuuaggagggacuuauuugucagguaauuucagagugaagcauaacugccagguaaaauaaguuuuauuuagacaauaugagcuaauaauaugauuugccuuauuaggucagccuuggcuccccagcacuucccaaacccugcucucccucuucacagagaauaucccagaggcucuguggaacccaaacagcaaaaugcuacuauggaguuuuaaauaauggaguaacaugcuaaaaaucauguuuuaagauuaauaaccuaaaaagcuaaucuaggacuacaguugggagacaauggaagcaaggaaaccaacucaacaugacauaauugauccuuaaagaauacagcaauggccagaugcagugauguguacuuguaguucaaguuacgugggagacugaggcgaaagcacugcuugaggccaggaguuaauggcuguagugcacuaugauggugccugugaauagccacugcacuucaguuugggcaacauagugagacccugucucuuaaaaaaaauaauuuuuucuuuaaaagaauaaggcaauggcucuaagaacaguaaagaagaacugaaucugacauuaccaacaaacuuuaucuuuuccauuacagauucaauucauugaguaaacagaaagguucacuuguaaggcauagagucauuuuuauccauccagguuacagagugcugaaauucaaccaccagaaaaucauccuuuucaauuacaacacucuacucucccaacauuuucuccaaaaacauucuagaaggagcaauuucagaaguacucauuuagccauuauugcugcuuugauggcaauuagcuugccugcuugccuucuccaggcacuuucaccucuaccccaaccccaaagcacaccauaguaucccccaaagccaccuugauaaaaagggauagggcaaaaacaagaaucuaagaaccuaauuguaucugaacuggaagugggacuaaaagaaaugagaugcuuugccaaaauuuggaauaaaaccagaguuaaguuuuuaaaauucuaaugucaggguucuaagauaaccuucauauuuucucugccuuuggauacaauauaucaaaaaccaaaaauccuuguaaaauuaaaauucacagaaaaguuucaagcuagacuccauccaugucucucucuuucucucucacucucacucauacccucccucccuccucucuaucuaucucuaucucuaucuuuaacuuuaguggggcaagagugguuaauagaaacagcuaacaaaucaaagagcuuccuucagggauucccugccaccaucagggcaaaguucugacuugacagccugguaacacaaggccccuaauauuugacacccaacaguccuuuccaaucucauccuucaccaugcuacuuuccauuuccucauucaccaaucauuucuacugaaugucuauagauccccagucuuuaacguugucuaauacuuccauaccuuggcucauucuuucaccuugucugauacucuuucgccuugucuguguggcuaugugaggcucgaguucuucucuuagaaauauuuccugacauccuuccucuugggcccuucaauacaccccucucuaacccacaccaaaucugcauuaggcucccuccuucaugcacaccucuaucaaacuucuuagaggguacugucaauuccaaaacuagggaaugcuugccacauuauagguacuaaaauggucauuaguuuccaguucuguguuccuccuagagcagagucauuuuucuuucucuucuuuuucuucuauuuugucuaagaauccucgguauucuuccuauuaacuugacaguuuuaugcacauuuggaauauggcuauuagcuucuuaaaggggaauccaaaugaaauuaaauacacaaggaaguuuuuccauaccgggcucaaugaaucaaucugaccccaaaaaugaacuuuuaugaauauucagacuacuacuaaaacaaaggaaaaaauaacuuuucuuaaaauguuuauugaucuacuuugaaaauguauuaauacaucagcuucugaaucaucaaaauguugaaauaugaaaucaguuuguaucuccuuuuuuuuuuuuuuuuuuuuugacacgaagucuugcucuauugcccaggcuggagcguaagugguaugagcucaacucacugcaaccuccguugcccggguucaagcaagucuccuuucucagccucccgaguagcugggauuacaggcucccgccaccacguccagguuuaauuuuuguauuuuuaguagagaugggguuucaccauauugguuaggcuggucucaaacuccugaccucaggugauccacaccucucagccucccaaagugcugggauuacagacaugagcuaccaugcccagccaguuuauaucauuauuuuaaauagagaagaauauccacacugcaauaggaaaucugccuugagaagaaacaucagaguuaaaacuugcaacaucugacuccacguuccuuuuugaucuuuuuagguaggauaacuguuaaaggauacauaaaaaugugauaacccuacuugucagaacucuguucaaaaucuucccacuagggauucagacuggggacugcaugacauccuuaugcuaucggugugaaaaacaaaaagcaagcuuugagcaaaaacgcuacccaaggcuauacucaguuauagccucaaacuggcaucacccccauauacaacaucauuuuuauaauauuacuuacuagauuuaggaauucuaccaaauuaaugguucuaauaaaagcacagaaaugugaucuaauauaaaauacucaugugggucuugcuuugcuuuuuagaaugacuuuggucaaucuaaacuuuucuauuucuuaagcucuaagauguagcaauuauaaagucacuauuuuaaaauguuuucuaagcuaccuggugcacuuuaacucaguuacucucucuagcucuaaaaaucaaacuacccguucauggaaacauacuuaggauuaaacacuguaaaauauagauugcaaauaaaaacaccagucaacuugaaucaaaagauuaaacucuaacaaaaugauuuacaauuauaccucaauaauaaaaauguaagugaauucaauacuaauuguaauacagugggguuucccuuauuuaccugagggaggguauggaauguagaaaauaaauuagguauucugaagaucagaguaaaacaaaacauaaccuagcuagaucugaaauuuagugcaaaaaaaaaaaacaagcucacaaacuauuauauuuuuguccuuuaccuuuacuccuucccugcugccagccaccuguuuuagauauucucaugcagagaaaauagcaacaaugccauuuuccuuccaaaugcaaucagguuuuggcaaacuucagucaguaugucaguuaaaaacagaaacaacccaaaaugugauuuggcaaauaacuacuuaaguauugaguaguuccuccccugaaugguauugcacuuuccauuuaucauuuuuaaauguacaaagaaaacugaaaaucugcacauguagcuggacaaguaauaguuuccaaauuaauaauacauuaugcauuacucuauuaagcauacauuaagagcaaaauuaugccauuuuggaaacagaacuccuugugagagugguccuuacuguugugguauuucaaaccacugcuuucauuuuuauauaaaccuuauugacaccuuuuuaaguuaguauucaaauuugccagaaguuuaaacaacuguuuucaucaacaugugugccaacugccuucccuuggcccuccaccagauccauuuaggauucucagacuaagccugccuaaauaaaguuuuauuuuaauagucacacccauuugguuacaaguugcuuauggcugcuuuugcuguaugucaacaguugaguaguugugacagaucaucuggcucuaaggaaaaagucugccagcccaggccuuuuuacaaauaaacuugauaaaauccccucaccacugucuucacuguucaucuaugaaauaaaggugaaagagugcuuacagaauuucucagagcauaugcaauuaacuuuuuaauauuuauacuacuuggaacccauguauaagauacuuuccugaaauacugaguugauucagcaacucaggugaaccuaaaaucuucucagauucaaaauguaaaaugccuacacccaaaaccacacuaauuacuauuacucagcaauaaguauaacaccaucauaaggaaguugaguaaugacagaagccuauuugucugucauuauuucugcuauagaauuuucaaguaaaaauaaaaaacaaaacaaaaauguuuagaggugguuaaaacaaauguucuuuaaaguuuugcaaauagaagacaauuguuuuauuuucaaugaugcuguuucacucuaaagccauucuaaaauuuuccagcaaaaaauaaaaggaccaaacuucagauuaaaaugucagauagcuaaauauuaaacaaauaucugaggaauaaagggagcuauggggaugcucugguuguuaacuucauuguaauuauuuuguguauuacaauuuucacucuguaaagguaaggacauagauauggcaaaggagucuuuuuucuaacccagcccagauacuucgagaccccuauaaggaaggcuaucuggggacugggugccaaggcugccucaaucugcagagaagaugaacaaaaggaagucacacuguaugaaaauaauucauggaaaacccugaagucugaaaggcacauuucuaaagaagagucacaucauuuuaucauggugauuaagagaggcacuuauuuagaugccaccugagccuuuggucuucuaacaccaacugccuccugacuaguuaaaagcauugggaauuuccaaaggaccaugcuuagggcagaauauaugaagaaggaaggagccuuaguuuuagaaugagucagauaaaccugguuugaaucuagcacccauuuuauaugugaccuugggccaauuauuuagccucucugagucuucgucucuucaugaagauaaaaaugguacuauuuucauagaacugcuaugaggauuaauggagcuauuauaggaggcacugacuccuggaauguaaaaauaauuaauaacagcagcuaaacauauauagaacuaaaggccaggaauauauuccucagcauuuauuccucagaaaaucuauuuaguagguauuauaacuuguccaaagucacaaaacaagcaaguugcagaaccagauguggacccacgaaguacgccuccaaugucuuuguucuuaauuaccucuuauacugaaguuauuauuagaaugagcaucccaaguauuccuaagaauggcucuauguacaacaaaguaugugaagccuucuucaucaauauuugaauuuucauagauuucuaguuuggaaacaauccugcuuuguuguuaaaaugcuguugguagcacaaagcuauuaacauuauggucauaaauucaauaucuguuuaggucacuuaauuacaaucagagggaaaaaauuuuccaaaaccccaauccauuuaggcuggcuuuguucauacccaucagaacaaggacugcauuaaaaaaauagaaagggcuauggaacaaacaccucuucaugaggagcucagaagggauucugguggcaucauaaaaugagagacucagagauagaagggccuugauuuaacucccuuauuuuacagagugagaaaugaagccaagagagaaguguugcuuuccccaugucccacaguugguuauccaucacaucagaccaugugcaagaagaucuucccacgacaccacuaugucuagauuccuacugaacugcaaacucaugccucguuaauaccucaauugacagucaugcauagcuggcuacuacacaacagaaauauacuggaaaucagcagauggagagggauccucucaccaaagaucuuuaaagaauuucucuaauacaauuauuguguauccauaguaaaaaaaaaaucuauuuaaacaagacauaguaaacuuguuaacucaauaaagugcagacguauaaguuuguaaacauuccuaauacacuucugaacuauuucuguguucucaacauagaauaagucuccaacagaaauuaucucccuccuucuagaaucucucacaagaaaacucccauuaaggccugauuacaaucuugauaaucuuuucuacaaaaacacuugcucccuuaaauuaauaaguuauuaaauucucucuuccuggaaacaaauccaucaauagacuuuuaaaaugguaaguuaccugauacuuuacucucuucaaagacuggcuguucacugccuagguguaaauauaauuagccugcuccuaaaauaauuuuguaggguaagaauucccucauacuagguuacaaauauuugucuuuaugcacaucuuaccuuuuguuuaaggcaaaacagauggauuuguuguucaaauucaaaacaaucacauaaggaaagugauuugcucacagcugaugcuuucaacuccuuuuaugacaacccuaacuaauguguacgaucuccucucuuagcagaacugagaauuacaucuccaauagggaaguagcucuccagugacauaccuaagcagccaaacuaagguuacauaacuaaauuaagcaaaaaugaaaaagcauuacccaggaaaauguguuauaaaguuacuugaggaagcuaugagaauucccaaaaaaacaagcaauaauuaucuuucccucuauagcaaaacaauuaaaaauuaaaaauaaauaaaauagugacagugaugggaaaggaacaagcuauauauuccaaaggaagaacuaccagacuugguuagauauaaagaugaagcacucaaugaauaaaaagugacuucagcauuuugguaucuggccaacuauguggauggcagccuucuugacaaacccagaagucagaggagaguugguuaguaaggaggggagguagggccaguuuuacccuguugaagugaauguuagcaaguggguauacuuagcauguucuaaguauauauagcugaaauuagcugggcgugguggugugcaccuguggucccagcuacuuguggggcuugaggcaggaggaucgcuugagcccaagagguaaaagcugcaguaagucaugauagcaucacuacacuccagccugggcaacagagcaagauccugucucaaaaaaauaaaaacaacuugaaaaguauaugcaacuggaucacgcguaaacugaagguacaaaacuugagccucuuguagaaguuuaaacaugaaaauguuuaauuaccaaugugggcuucauagguaaaagguaaagccucagagugauagauaugacaugcuaacgugcagcuaaugaaaucuguaucagaacuuuuaguguauuacaacacuugcucagauaguugcaguugcuauucagugucugccuccuuuuccccugcuuaaacacuccaaauaaaagacgacucauauuggcaucucguuuacagaaaaauauaauuuaauacuaugucaacuaacucaggaaauauuaacuccagaaugcuuaccugaaucuucucuccguguaucaaacaauacaugcaauuugccuucucugaaccauaucuacauauagcuaucacuuagaacauauaucuucaacauuucauguugaucauuguuuucuguuaaauauacauaauguuucuauuucuacauuuuccuuucaacugcuaauauucucuucauccucucuucuacaguuucaaguuugaauucugggucuccaaguuaaaacuucacacuacaaaaaaaaaaaaauacuccaucaaacaggccuuauaugaauuguuuaccagagauacuugaauaaauuuguuuccauccuaucuuuuauguuccacauuuauuaacuuaacuuucuucauaccuucuuucugccugucuaccuucuuuugcuuauuuuuuuuuuuuuuuuuuuggagauagggucuugcucugucgcccaggcuggagugcaauggugcuaucuuggcucacugcaaccuaugcuuccugggcuuaaacgauccucccaccucagccucagcuaggacuacagacaugcaccaacuuuggcuaauuuuuaaauuuuuuguagacacaagguuucacuauauugccuaggcugaucucgaacuccugggcucaaagugauucuccugucuuggucucccaaaguguugggauuacaggcaugagccacugcauccauucucuuuuuuuaguuguaucauuuacaaguuuuuauaggaaaaauuuugacccuaauuuugggauucagcuuucuaauucugagcaaaaaaggaaaaagcuguagagugaaucaacccugugugucacuagacaggugugcaaccuuaggcaaauuauuugaccuuucugagccuugcuuuccuaauuugcaaaugggagauaauaccaucucucauggagggauguuuugcaagucaaagaaaaagaaacguaacaaagcugggaugauaacuugugguuauacaugaaauuuuauagguuauuaugaaaguaauuaucuuagaggccauuucagaacuuagcuaccaaacacacuggaugcacuuucuaauucugucuucaacucaaggacagaguacaaauuagauuacugaaguuuuauuggaggaggcaucaaggugugcauguaauagaaaucuaggguuacuaccuuuuuguagaaaggcuagaauacaaacacgggaaagccaaaucucaagguuuacuauguuccaccaucccuguauacccuagaagguaguaaaaucuugacugcaauuggaagguuuacaguguauuucaagcagggaacugcuacauggcauuuagacucacaauuccaagcagaaaugggauuaguguagucuguauuucauugcugauuugaaacagaaugaugauaaugaauacauuaacuuuacaacuaauauuacaugccacguacuauguuaaguguuuuguauucaucauuaacccucauaacaacccuaugaaguggauacuuuuaucucauuugacaaaugaaagaaaacugaagcuugggagagcugggauucaaacccagauaacaguaaaaauuucaaaacagugaaaaugucaauaacacagcaacaaguuaugugcugacaguaagauaccaauauuucagcagucagagcuauuugaguaucugugggggaaguggagcaucauauucaccuaacuguauaaguaagagcaggaaagagggagaagaaaaagaaaggauuacauccagagcagcaauucuggaauuuucaaauauuaaaaaucaugacacugucaaauuaagcauagccugcuuugaggauaauuagggcuuuccagagcuaaaguucuccaccugcuuucuaccugacacauggugauggaugacagcauuagaagcugauguuaugugcuaucauaugcucaacacacuuccaugggcacagguaggccucuguaaaacucccagaacaucagcugcaccucuguggcuucucaucuuccucaggaaagcauauuagaaugaaaaugaguaaaagaaguaugaauuuuaucuguaucaaauauguacauguuaauauuuacugaacauugguacuaugugccaggcauguucuaagcccuuugccucuauuaauccacaaaugagacuauaaauuagacacuauuuucauuuuaaagaugagauaacuaagaaacaaaauaaguaauuugcugaagaucacaaauaagggagaucacagugccaggauuucaacaagguggucugguugcagauccccagcucuuaaacaggacaauaaacugucaacuuuuccuggggcacaauccaguagacagaugcccugggaauuccaggaacuccuugcaagaugacacaaccaaaaagaagaacuuuugccucugcagaauaaguucaaagggcucccuaggacugugagggugcacuguccccaucaggauuuuaguuuaaagucacagagaccuugaaucccagccccacagacuuagaagacucuauuuaugacucuccuuauuccuggguaagcugggcaguaagaaucuucuuaguuaccccagcaaaugauacugguugaggcagcccagacccauggugcuacugcugagcuacacaguauccacauaguuucacauaaagaauaggaauacaacuccuugcucugaaacaagaacugugcauuaaagauucauucagucuucuggguagcacuguucacauaccauucauucaacaguauuuacugcaagcugcuauauaccagacacuauucuaagugcuagaauaccucugugaacaagaagaacccugcucacaaaguuuauauucuaaacuuuauauauaaaggucagauuuaaauacaagaggaaaggguacuggcaccaaccuaacucauggcaaaaaaaaaaaaaaaaaaaaaaaaaaaaagagauaccagggaaacaccaggccagacuacugcacugcuauuaaagaugcugccaacuugaaaugaaaagcaauaugauuugaugguacuauuucuggcucaggcuaagauaacaguacccaccagcaaguauccaaaagaaaaaguguaaagcacaaagauacagaagucugaaucacuguuuuuuaguaucccuucccaaaaaagggaagagaaaucacuaucaaaggauccuaaauucugccaacucgugacauuguauacuaccagugugcaaacuaauacaaggaaauaagauagcaaacaagcuaaagaguucucucuuuaaccaacaaauuaaacaggggagaagagaugaucacauacauacuaauauccgauuauucaccuguaaguucuuaaaaagugauaauaccagaaugugaagcgugaugaaccauuagaaauacuuuaaacucuuagccuauaaacuaucucuauaucagaauggucaaauuaacaccaaagugcaaaacuaugauccuguauauaccccuauaauuguacuugacacguagcauugaaauuaacuuccugggcagugagauacaggaaggccagacuguaguucauucauuuuugcacccgcagcauuuagcaccaggcuugucacaaagaaggcaugcagaaaauguucgcaaaacugaacuaaaaaucagaaucuucaauauggaaauaauagaaccacuggugggauacacacuaaacaauauucaucacaguuguucacucugaaugguguggccaaaguuaccuguguagcuuagaucauaacuuagauaaugauaaucuaugugaaaaaagaguaauaccucuaauagaauaaaguaaaauauagcaagagaacaaaauaacucaaauuuugauaauauaucaaacagcuuaacugcucagaauuacagagguauuaagaccaaugcaauucaaggcaaucucugcagccuuaacugccagguuauuuucaacucauggcccaaagauuaauaugcaucauauauauggcauuuauacauucaucuauuccuacaucuucaugucuaugccauaugagauauaaagagagguacaggggaucuaacuuugaauaggaaaacacagguuuucuacccucauggacggucuucuuuacugcucucauucaucaaaaaagauccaggucuuguugaggaggcggcggaguaagauggucaaauagacgcauccacaccaaucguccucccugcaggaacaccaaauugaacaacuauccacacaaaagagcaccuucauaacaagcaaaaaucaucugauuuuuuaacuucauaucacugaaagaggcacugaagaggguaggaaagacaguguucaauugccgacaccauccccuccucccucccccauccuguguggcauggagagggaagcugugcacuugcggggaaagagagcacaccgcuugugggacuuuccauuggaccucagugcugcccugucacagcggaaagcaagaccaggcagaacucagcuggugcccacagagggagcaauuagagcagcccuagccagaggagaauugcccaucccagcagcuggaaccugaguuccagagagccuugccaccaugggcugaagugcucugggguucuaaauaaacuugaaaggcaaucuaggccacaaggacugcaauuccugggcaaguccugguguggugcuggguuuggagccaguggacuuuggggaguacacaaccuagugagacacgagccagggcgaccaaggcagugcuugaacuccacuccccacacugucccccacaaccccaggcggugcagcuugcaguuuggggagaggcuccuucccuccuuuugagaagaaagggaagaguaaagaggacuuugucuugcaacuuggauaccagcucaaccacaguaggacaggccaccaagcaggcuccuauuccaggcccuaguuccuggaccacauuucuagauacacucugagccagaagagaacccacugccuugaagggaaggacccaguccuggcaggaugcaucaucugcugacuaaaggacuccuuggcccugaauaaucagcaguguuagcuaggcaguacuugccaagggccuugggugagacuuggcuucaggcaugaccuaacaccucauacauucccagcugugguagcuacaaggagagacuccuucugcuuaagaaaaggagagggaagaguaaaggagacuuugucuuacagcuuaccagugcagccacaguggaauacagcaccaagggggaucuugcaggguucccaauuucaggcauuggcacuuagauggcauuuucagaucugcccugggccagaggggagcccacugcucugaagggagaguccugggccugaaagcauucaucacaagcugacugaaggguccuugggccugagugaacaucagcaguagccaggcaguacucaccacgggccugggacaaugauggccauggggacagaauucucugcuuguggaaagggaagggaagaguaggaaggacuuugucuuguggcuugaaugccagcucagccgcauuagaauagagcaucagcuagauuccuaagguuuccaacuccaggcccuggcuccuggauggcaucucuggaccuacccagggcuagggagaccuugccacccugaagggaaagacacaaaccuggcuggcuuugcuaucugcugauuguagaguucuaguaucuugagcaaacauaggcaauaggcaggcagugguuaccaugggccuugagugagagccggugccaugcugaccgcaggucugacccagcacagucccaguaaugguggccacagaagugcuugugucacccuccuccacuuccaggcagcucagcacagaaagagauuccauuuguuugggagaagguaagggaagugaacaagagucuuggccuaguaacccagagacuucuucuggaucuuauccaagaccaccaaggcagcaccucuaugggucugcaaaagccgguguuacugggcucaaggugcccucuaaugcagacauggcugcaguaacuaaaaaccuggauuacaacacccaagucccuucaaauaccuagaaagucuucccaaaaagaagggguacaaauaagcccagauugcaaagaugacaauaaauaccuaacacuucaaugaccaaacacccacggacauccagaagcaucaagaccauccaggaaaacaugaccuaauuaaaacaaacugaauaaggcacaaggaaucaauccuggagagacagagauaaugugauauuucaaacauauaauucaaaauagcuguuucaaaggauaaauguuugaggggauggauaccccauucuccaugaugugacuauuacucauucuaugccuguaucaaaacauuuacuguaccccauuaauguauauaacuccuauguacccauaaaaauuaaguuaaaaauuuaaacaaacuaaaauugcuauuuuugaggaaaugcaauaaaaaucaagauaaaauagaggaugaauucagaauccuaucagauaaauuuaacuaacagacuaaaauaauuuaaaagaaucagacagaaauacugaaguugaaaaauguaacugacauacugaagaaugcaucagaguuucuuaacagaagaaagagucaguaagcuugaagacaagcucuuugaaaauacacaaucagaggagagcaaagaaaaaaagaaugaaagacaaugaggcacacuuaaaagaucuagaaaauagccucaaaagaccaaauccaagaguuauugcgcuuaaagaggaggcagagagagagaggggcagggauagaaaguuuauucaaagggauaacagaagacuucccaaaccuagagaaagguaucaauauucaaguacaagaauguuauauaacaccaagaagauuuaacccauguaagacuaccucaagacauuuaaucaucaaacuuucaaaggucaaggauaaaaaaaggauccuaaagcagcaagagaaaggaaacaaauaacauacaguguagcuccaauaagacuggcgggagacuuuucaguggaaacuuuacaggccacgagacaagaggcacaacauauuuaaagugcuuaaggaaaaaaaaaccuuuauccuagaguaguauauaucuagugaaaguauccuucaaacauuaaggagaaauaagggcuuucccagacaaacaaaagucaaacaaaagggauuuuaucaacaacagaccccuucuaugauaaaugcuaauaggaauucuucaaucugaaagaaaaggacuuuaaugagcaaaaagaaauaaucuaaagguacaaaacucacugcuaauaguauauagaaaagcacauaauauuacaacacuguaauugugguguuuaaaguacucauaucuugaguagaaagacuaagagauaaaccgaucaaaaauaauaacuauaacuuuuaaaaacacaguacaauaaaauauaaacagaaacaacagaaaguuaaaaagcaggugggaugacgauaaaguguagaguuuuuauuaguuguuuucuuugcuuguuuaugcgaucaguguuaucaccaauuuaaaauaauggguuauuuaaaacccauuaucaaauaucuaucuauagauagguagguagauagcuagauagauauuauaugcaagccucauaguagccucaaacuagaaaacauacaacaaauacacaaaaaauuaaaagcaaguaauuaaaacauaacaccagagaaaaaucaccuucacuaaaaggaagacagaaaggaaggaaagaaggaagagacgaccacaaaacaaccaggaaacaaauaaaaauaugguagaaguaaguuacuuacuuaucaguaauaauauugaaaguaaaugaacgaaacucuccuaucaaaagacacagaguggcagaaaggauuuaaaaaaaaccaacaaaaaagucccaacuaucuguugccuauaagaaacacacuucaucuauaaagacacacauacugaaaauaaagaaauggaaaaagauauuccaugccaauggaaaccaaacaagagcagggguagcuauacuuauuugagacaaaauagauuucaagacaaaaacuacagacaaauaaggugauuaaauaaugaugaaggggucaacucagcaauuagauauaacaauugcaaauauauauguacccaacacuggaggacccagauauauaaagcaauacuagagcuaaagagcaagcgagcaagcaagcaagagagagagagaaaaguagaguuaaagagagaucuagaucccaagaugauaauaguuggaaacuucagcaucccauuuucagcacuggacagaucauccagacagaaaagaaacaucaaacuuaaucucacuucuguaacaaauggaccuaauagaucuuuacagaacauuuuauccaauggcugcugcauacacauucuucuccucagcacauggaucauucucaaggauaggucauauguuaggccacaaaaccauucuuuaaaacucaaaaaaaaugaaauuauaucaaguaucuuaucugaccacaaugggauaaaaccagaaaucaauaacaagaggaauuuuguaaacuauauaaacacaaagaaaguaaacaauaugcuccugaaugaccagugggucaaugaggaaaucaagaaaaaauuuaaaacuucuugaaacaaaugauaauagaaacacaacauaccaaaaaucuauaggauauagugaaagcaguaccaaaaggaagauuuacagguauaaucaccuauauaaaaacaacagaaaaauuucaaaucagcaagcuaacaaugcaacuuaaagaacuagaaaagcaagagcaaaccaaacccaaaauuaguagaagaaauaauaaagaucagagaagaaauaaauaaaauagaaacaaaaaaaaucaaugaaaugaaauguugguuuuuucaaaacauaaaauugacaaaccuuuaggagacuaagaaaaaaagaaagaagacucaaauaaauaaaauaaaagaugaaaaagaagaaauuaaaaccaauacugcagaaauucaaaggaucauuagaggcuacuaugaguaaccacaugucaauaaauuggaaaaccuagaaaggacaaauuccaacacacauacaaccuacaaagauugaaucaugaagaaacccaaaaccugaacagaccaauaacaaauaaugagaucaaggccaggugcaguggcucaugccuguaaucccagcaccuugggaggccaaggugggcggaucaccugaggucgggaguuugagaccagccugaccaacauggacaaaccccgucucuacuaaaaauacaaaaaaaaaauuagccaggcaugguggcgcaugccuguaaucccagcuacucgggaggcugacgcaggagaaucgcuugaacccaggaggcggagguugcggugagccaagaucgugccacugcacuccagccugggcaacaagagcaaaacuccaucucaaaaaaauaaauaaaauaaaauaaauaaugagaucaaugcuauaauaaaaagucauccagcaaagaaaagcucaggacucaauagcuucacugcugaauucuacauaauauuuaaagaagaacuaacacaaaugcuacucaaacuauucugaaagauagaggaggaggaaugcuuccaaacucauucuaugaggccaguauuaccuugauaccaaaaccacacaaagacacauuuaaaaaaaagaaaaagcaaagauacaggccaacaucucugaugaacauuuaugcaaaaauucucaacaaaauacuagcaaacugaauccaauaacacauuaaaaagaccauucaucaugaucaagugggauuuaaccugaagaugcaaggauggcuugacauaugcaaaucaaucaaugugauacaccauauuaacagaaugaaggacaaaacccauaugaucauuucaauggaugcugaaaaagcauuugcuaaaauucaacauuccuucaugauaaaaaaaaauucaaaaaacuagguacagaaggaacauaccucaacacaauaaaagccauauaugacggaaccgcagcuaguaucauacugaauggagaacaacugaaaaccucuccucuaaggucuggaacacacagauguccacuuucaccacuguuauucaaaauaauacuggaaguccuagcuagagcaaucagacaagagaaagaaauaaagaauauccaaauuggaaagaaagaagucaaauuaucauuguuuguagaugacaugaucuuauauuuggauaaaccuaaagauuccaccaaaaaacuauuauaacuaauaaauucaguaaaguuguaggauacaaaaccaacauacaaaaaaaaguagcauuucuacaugccaacagcaaaaaaucugaaaaaaaagucaagaaagcaaucccauuuacaauagcuacaaauaaauaaaauaccuaggaauuaacuuaaccaaagaagcgaaagauccuuacaaugaaaacuauaaaacauugaugaaauaaguggaagaagacacuaaaaaaugggaagauauaccauguucauggauuggaagaaucaauauuguuaaaauguccacacaaccuaaagcaaucuauagauucuucauggacuggaagaaucaauauuguuaaaauguccauacaacccaaagcaauagacaauuuaaugucuaucaauauaccaaugacauucuucauagaaauagaaaaaaacaauucuaaaauuuauauggaaccacaaagacccaaaauagccagagcuaugcugagaaaaaaagaacauaacuggaggaaucacauuaccuuacuucaaauuauacuacaaugcuauaguaacuaaaacagcaugguauuagcauuaaaaauaaacucacagaccaauggaacaaaauggagaacccaaaaacaaaugcauacaucuacagugaacucauuuuuaacaaaggugcaagaacauacauuaggacagucucuucaguaaauggugcuggggagacuggcuauccauaggcagaagaaugaaacuagaccccuaucucucaccauacacaaaaagucaaaucaaaaugaauuagagauuuaaaucuaagaccucaaacuauaaaacuacuacaaggaaacacugggaaaacucuccagggcauuggacugggcaaacauuucucgaauaauacuccauaagcacaggcaaccaaagcaaaaguggacaaaugggaucacaucaaguuuaacagcuucugcacagcaaagaaaacaaucaauaaagugaagagauaacccacagaaugggagaaaauauuugcaaacuacccauuugacaagugauuaacaaccagaauauagaaggagcucaaacaacucuauaggaaaaaaucuaauaaucugauuuuaaaaugggcaaaagaucucuauagauauuucucaaaagacaugcaaauggcaaauagaucuaugaaaagguguucaauaucacugaucaucagagaaaugcaaaaucaaucagauauccucucacuccaguuaaaauggcuuuuauccaaaagacaggcaauaauaacugccggcaagaauguggagaaaagggaacccaugcacauuguuuggggaaauguaaauuaauuaguacgaucacuauggagaagguuuuuggacauuccucaaaaaaaacaaaaauagagcuaccauaugauccagcaaucccauucucagguauauacccauaacaaaggaaaucaguauaucaaagacauaucuccacucccauguuuacugcagcauuauucacaauagcuaagauuuggaagcaaccuauguccaucaacagaaacggauaaagaaaaugugguacauauacacaauggaguacuauacagccauaaaaaagaaugagaucuugacauaugcaacaacauggauggaaauggaggucauuauguuaugugaaauaagccaagcagagaaggacaaacuuugcaugcucucacuuauuugugggaucuaaaaauuaaaacaauugaacucauggggaugaauuuaucaggacauaaucccauuauaaguugaggaacaucuauauuuaauauugagauaggagguagaauguaaaacaacauaugcaauauauuaaaaauacagacacaaaauaaaacuacauauauacacuacagugcuuggaaagauaucauagcugacugcaaugauuaccucuggaagguaaauagaaaaauauugaaggaagauuugucuuguuuuucaauauauuguuugaauuuuucugagauauuauucgucuaucacuugcucaauuuaaaacauuuuucuaaucucuaaaaugagauaaauaaucaagauuuugcauuugauccuuacuauuucaaacacuacauaacaaucuuguguauuguuuaugucagaauaacugacaaaacauuuagagccaacaaaacccaauauauacaauaaauggcauaaauuuagaaaucuuaaauuuuaaaagggguacaucagaagaaaaaacucuuacacuuuaaaaacucacauucuacccacuagaaguaggcuggauacuacaaaaacugcuuucacacauacccuguaacucauuuauaauaaaugugucuuacagauuaaugguucacaauaauaucaucaaacugcaaacuacuaccuccaaaauaaucaccauauaaaugagcaacuuuucuucuccuuugcuuuugcuguacauacuauuuccuuuccugauagaugucuaauuugcuggcaauuuaagcagugguuuaauuuuagcacuaauuaagaauacuuuuucuuguucuuucaacauuuuccuagaaaugauacccaaggaccagacaccaugacagucaaucugcacuagucauaauacaauuuuuaagaguauaagaagaacaauacucaccuaaaaucacauuucuuuuguuucuuaaaaaacucaacacaaaaauuguagcuuauagaucaauuaaacucccaaaucagcuacaaacauaucuuuguauuuuccacagaauguuauucauuagaacuucaauggacauugccacgaaagaacucaaaauuaacacagagcauaaugucaaaugcaugaaaugcaauuugguauacauuaaaggugccaguuuuacuuucuuagagagcuuuugcugaucuguauuggaauuuuaaaguuccaauaaaaauuauuuacaacaugauuacaaguagccauuagguacaucuugcuuuauuauauuuucuaugcuaagaaugggcagaagcaagauacagaaguagcaagacuaaagaaaaggagggccaggcgcaguggcucacaccuguaaucccagcacuuugggaggccaacgugggcagaucaccugagguaaggaguucaagaccaaccuggccaacauggugaaaccccagcucuacuaaaaauacaaagauuaacugggcguagaggcaugcaccuauaaucccagcuacuaugguggcugagacgggauaauuguuucaacccgggaggcagagguuguagugagccaagagggacacuccaccucggaaaaaaaaaaaaaagggaccagauuucaauccucuucccuugugccuaaguacaacaacaaacaguaaaauucagaauggaacagaaacaagcagaagguuuucaguaauagaauugcuuuaaaaugcauaucuagacaucggggagaaaaggagaucaagggaauaaaucaagggaaaagaggcaaguuccuucuucuccucuuuaaaugagaccaauuauuucauucaaucaacauaucacccauuuauuuagccaaauggucuucaaugucacugcauaucuuuuaguaaugugccauauuuucucaauauuuaaaauauuacauguuaaaauuauuaguauauaauuaucaugugaagaaaaagaaaaaaucaaguuuaaucugauuaucuuucugucaucaaauaaugaaagauaugcuccaguuuugaaugaagguacaaagugggggcauauaaugaaaacagaaaacugugccaacuacucccauaguguaucguuuaguuaaugguuccuaguacacugauaauauucaacugcuuucuaaaguucucauuuauucccaggaaacaauaaagcagacuuucauacugcacaugccauuuuauaugaaucuugcuuacuucauucaggauagauaaaagccauguuguaugaaaaaaaaaaugcccuaacgaaugggaaauaucuaaacuuucaauugcuacagaugacucagugagugggcaguugcagaaacucauagcugaggccagaaaaagcuuauguuuucaugaagaucacuuugaaaugcaguucuggguagacauuauuugcucuugcauuaugauuuuguuauacuuccacucuaagcaaugaugaaauguugcaucccauugcagaagaaaaagauggaguuucucucaucauuauagaaauaagaaacccuuucuaaauuggagccuuuucugguuacuagaaccauauuacaggauuuaaaauacugcuacuuugccuguaucaucuuggccuccaaugagauuguauuugucucucaaacugcugauuggguauggugaaagcagucaagucuaucucccaauaccaacaacaagauuucaaauuguuuacucugaagaaaagcagagacauuuaagugcuaaacauguuuuaaaauaagauaguaacauauuuuuagaaauauauuuauuuacagccaagauauaaugaauaaaauauuacggguaaguaaaaauacaaccaugauaggcaaucuuacauauugauuguaaggguaaauaauuauuaaagaguucucauauuccaguaaagaacuuaaauaagaaauaguacaaaucaagcacaguaauaauagcuuccacugguagcauauuuauuuagaaaguucuuucacauauauucagccucugagucuaauauuuauuggauguucauauaucauacccuauacuaaguucuggggacaugaagaugaauaaaacacaucccccuuuaguuuccauucaucucauuugacaaucaaaaccauauuaagaaaaaagggcaggauuaucuccaucuuacaggaacaaaauaaagcguaagauguuaaggaauauuuuucacaugaccacaaacucaauuuaaaaaaaagcuuauucaauucuauucuaauauaucccuaaccuuuaugcccaugccacauauuuauuacaaugccacaaauucauuuuagaaacagaaugacuuuuuuuaauuuccaacuuuuagguucaggggauacauuuacaaguuuguugcauggguaaacugcgugucacaaggguuugguacagauuauuuuaucacucagguaaugagcauaguaccugguaguuaaaaacagaacuuuagaauauagaaucaauuuuacugaccauucugagaguuacugcaaauaauauauccaguaggccuuuagacaacuacaaauuuaacacuugugugacaugaagguccauaaauauagaaauaccuaauuuuauugaggcaaagguuuaacaucuugugagacaccaaagugaguguucaggauccaugguguaacuuggcuuugcuguuuucuucucauacaccucuccagaauaccugcaaagugauauuuuauugcaucuucuggggggaaauuccauguucuaggacugugcuaauacuagccaccuguggcuacgaagcaucugaaaugcagccagucugaagugaaaugugcuuuaaguggaaaauauacauuggauuuggaagacagaaaaaauagaauguaaaauaucucaauaauugauuauauugauggcauguugcaauauacaauuuauacuagaauaaaauauaucauuaaaauuaauuucaccugcuuuuuuguacuuuuuuaaauguggcuacuagaaaauuugaaacuacauaugugguuugcacuauuucuauuggacagcacugcuuuaagauauacccaagagauuugagacauauucuucgagacuauaaagagucugcuguacuaauauauuuggagaaugaucauaggagaaguaggagguaggauuuauuaaugauaaagucuaugauacauuaucagaaaaaaagagcagguuaucagauuauuaaagguacugcugcuucaauauguauucaacuuaucgaauguaacuuagcaauaugaaaaaaagaaaaaugccaauuccugcagugaacauaaaucugcucucuccucaaucagucucagcuccuguaugccuuucacagugugaccacuuuacugcauucauuauaacugauacauaaacuacaucccuauuauauguaguauaaggucaauuaguuuuuuguuuuuuuuuuuuugagacagagucuugcucugucagcaggcuggagugcaguggugcaaucuuggcucacugcaaccuccgccucccggguucaagcgauuccccugccucagccuccuagguagcugggacuacaggugcacgccaccacacccggcuaaguuuuuguguuuuaguagggaugggguuucaucauguuggccaggauggucucgaucuucugaccucgugaucugcccgccucagccucccaaagugcugggauuacaggcgugagccaccacgcccggcugaggucaacuagauauuauaagauguauauauacacaaaaaggcugaggagaagggcguuacauuauuagcacuaguuaucucuggaugguagcaugacagauuuucuccuuuuuacuuauucuacauuuuccaacuuuucuacaacaaaaaugaacuauauuccuaucauaaaagcuauuaauuuuuaaaagaugugugguauaauauguaauaucaaacuccacuugagaucuuuagccaaaaaggacagaaaaaauuagagggaaaucguugcauauagcaggagucagucuccuaguaagacagcaagcccauaaaaauccagacgcugaaggcccauagaagauaagagaagaucagcauucgcaucuuaauaaagcccugccacugccuuuuacaaaagaauacaaaacauauccauuccuagggacaagauuuuuugcuacacaacugacaacuacaaguugcauuuaugagauucaaauuuuauuuauauauauuuaauuuuaaaauaugugaauaagaucuaagucaauaauuaaggaauucagaggucuaacucccuaaaaaucuaagucaauaauuaaggaauucagaggucuaacucccuaaauuagaaaccauuguaucuacaaauuauuucuaugcugcuuauggugugauuuacauacucacugauaauauuucacaagcugcguuuguaugggaagagauauauaagacaccauuuaaauuugcuguuaugcugcauagaagaaaauagauuuuuauagguuuuuugucuuucucaucacucuuagauuauaauacauuccucacugaaucuggaaacgaacgagcucuuuuaacuucaggaacaauagcugaauuaagacccagcaguuuaccugaagucuuuaguuuugagguuuagcaguauggauguagccagauuccaaaaggcaaauaaaugaaaaacagccuagccuagccagagcaaccagauaagagaaagaaauaaagggcauccaaauugguaaagaggaagugaaacugucacugcucacugaugauauaaucauauaccuggaaaacccuaaagacucauccaaaaagcuccuaggucugauaaaugaauucaguaauguuucaggauacaaaaucaauguacacaaaucaguagcacugcuauauaccaacagcggccaagcugagaaucaaaucaauaacucaaccccuuuuauaauagcugcaaaaaacaaaauaaaauacuuaggaauacaccuaaccaaggaggugaaaguccucuacaaggaaaacuauaaaacacugcugaaagaaaccacagaugacacaaauggaaacacaucccaugcuuguggaugggcagaauaaauauugugaaaaugaccagagugccaaaagcaaucaacaaauucaaugcaauuuccaucaaaauaccaccaucauucuucauagaaaaaaugauccuaaaguucauauggaaccaaaaaagagcucacauagccaaagcaagacuaagcaaaaagaacaaaucuggaggugucacauuacccaacuucaaacuauacuguaaggcuacagucaccaaaacagccugguacugguguaaaaauaggcacguagaccaauuugaacagaacagagaaccaagaaauaaagccaaauacuacagccaacugaucuucaacaaagcaaacaaaaaacaaaguggaaagaggauacccuauucaacaaauggugcgggguaauuagcuagccacauguagaagaaugaaacuggauccucaucucaccuuacacaaaaaucaacuccagaugaaucaaagauguacaucuaggaccugaaacgauaaaaauucuaaaagauaacaucggaaaaacccuucuagauauuggcuuaggcaaagacuucauguccaagaacccaaaagcaagugcaacaaaaacaaagauaaauaggcggaacuuaaauaaacuaaaaagcuucugcacagcaaacgaaauaaccagcagaguaaauagacaacccaaagggugggagaaaaucuucacaaacuaugcauccgacaaaagacuacuauccagaaucuacauggaacucaaacaaaucagcaagaaaaaaaacaauccaucaaaagugggcuaaggacaugaaaagacaauucucaaaagaagguauacaaauggccaacaaacauaugaaaaaaugcucaacaucacuaaucagggaaaugcaaaucaaaaccacaaugcaauaccaccuuacuccugcaagaauggccauaaucaaaaaauauuagauauuggcacggauguggugaaagggaacacuuuuuacacugcuggugggaauguaaauuaguacaaccacuauggaaaacaguauggagauuccuuaaagaacuaaaaguagauuuaccauuugacccagcaaaucccacuccugaguaucuacccagaggaaaagaagucaucauaugaacaagacauuugcacaggcauguuuauagcaguacaauucgcaauugcaaaaaaauauggagccagcucaaaugcccgaguagauaaagcaugauauauauauauauauauacacauauauauacacauauauacauauauacacacauauauacacauauacacacauauauacacauauauacacacauauacauauauacacauacacacacguacacauauacacauauauacacacauauauacauauauacacauacaugcauagauacacauauauacauauauacacauauauacacacacauauauacauauauacacauauauacauauagacacauguauacacauauauacauacacacacacacacacacacacacacacacacacccuggaauacuacucagccauaaaaaagaacaaaauaauggcaguggcagcaaccuggauggaauuggagaccauuauucuaagugaaguaacucaggaauggaaaaccugagaacuuacaaguuuucacuucuaagugggagcuaagcuaugaggaugcauaggcauaagaaugauaaaauggacuuuggggacacagggggaagggugggaggggggugagggguacacaugggguacagcguacacugcuuggcgaugggugcaccaaaaaucucagaaaucaccacuaaagaacuuaucuguguaaccaaccaccaccuguucccugaaaaccuaugaaauaaaaauuuaaaaaaaaaaacagucuaggaauacugcugcagaaacaguuuuucaaaugaaguagagaacuggcauuagaagauauuuucuacuguuucuccaaugccuuaacucuucuuucacacaaaccuccacaauuaaaaaacuacuucauacucaaauaaaaucuacaaauauuguagcacgccuagaaagaaggcaguuuuucagcauuugaaauauucaacuaauuauuccaaaauauuuaagaauugaagcaggaugugauggcucaugccugcaaucacagcacuuugggaggcugaggcgggaggaucaccugagcccaggaguuugcaaucauccugggcaacacagggaaacugucuccaaaaaauaauuuuaaaaauuagccggaugugguggcaugccccuguggucccaguuacucaggaggcuuaggugggaggaucguuugagcccgggaggucaagucugcagugagccaugaucaugccacugcacuccagccuaaguaacggagugagaccccaucucaaaaacaaacaaacacaaaaauauuuaagagugguaccauggcaucuucccuugcgauaacaaaacugaaucuacuuugaaaauuaagaggggacccuaacuuuaaacaauaaaagugcuccugucaaugugggugaaaguauaaauguacugggaaaauuaaaaucuuuauuuuuaaauggaauauuucuaucaucuuuuauauuauuuagcacacacaugauacuaugcuucaggcauuauuuuaaguacuuuucaaauaugagcucauuaaaaacccucugagguugaugcuaucacuucccccauuuuacacauaagaaaacuaaggcaccaggaaagaaagugauuuucccaagugguaaagaugagauucagcuccaggcagucugggucccaaauccauguucuuaaccacaauguugcuuacucucagaaaguaacaugcucaugaaagcccaguguuugacgcauaguuaagcauuuaauaaaaaucuguucaacaaauaaaagaaaaaauggagauggcaaaaagcagaaaacccauuacucacugucucaacauaucauuaugaguauagugguauacuuucugucaguguuuuuucuuguucacagagggauuuguuuuccuuuaacacucagcauaugcaauuuugagaaaauaaaaaaccuuaagauacuagccucuuagcauuuuuagaauaacaguuaaaaacugaacacuuguauauaugcaugacauauauucuaauuucaccucacaaccccauaaaguaaguacaaguauuauccuuauuuuacaaaugaggaaacugaagcacaguuaagaaacuaacauaaagucacauggccaggaaguggcugagcugguaaauucaaauccaggcagugugacuucugaacuagaauucuugacuauucuuggagggcagguuaugagcuacuugaaagacaguaaucgugguuuuuuuguuuuguuuuguuuuuugguguguguguguguuuuuuuuuuuuuuagacagaguuucgcucuuuuugcccaggcuggagugcaauggcacgaucuuggcucaccaugaucucggcucacuggaaccucugccucccagguucaaguuauucuccugccucagccuccugaguagcuccucagccucccaagugauucuccuaccucagccucccgggauuacaggcaugcgccaccacgcccagcuaauuuuguauuuuuaguacagaugggcuuucuccaugugggucaggcuggucucgaacucucgaccucaggugaucugccugccuuggccucccaaaaugcugggauuacaggugugagccaucgcacccgucugugaucauguuuuuacaaagugguaugauuuguuuggcuuggccuaaaaugaggauguuaccuuacagauuuauuuuguuuuacacuaacucugacuuaaacaaugaaaauuuuuaauaucuucagcuuucuugaacaagcuaaauaaaucuucaugucuuaaauuuuauaaggguaaaguaccuuauugaaaucuuucauucaacaaauauuugaauauccacuacuuguuaggaacugugcuaauaagauacagucuuugcacucaaugcauuggcucuuuccacucagcauauaaauaugcucagauuucucacaacuaauaaauacaacacacugguccauaaaccuggauaauagcuuugucgacuauucggagguagaaauaagaauggaauccugcaauuaccugcccccuauccuacaaaguagauacaccuguuauuuuucuuguaguuccugaagagugacugacacuuaaauaauuacuagauaggugcuauuugccugccucaugccauacuaccaccucuuaucagcuggcaaugaaagccuaccuauuuuuaaugcaaagggguugaaauuaaaauguuuuacuaaaacuuugguuuaccaggcuacauguuguaauuauuuuuaaaauucuaaaauuguuauuuuggguuugacuuuaauaaccagaugauaaaugugaaugucuaagaccacaugugaaagaaauaguuaaaaaaaaaaaaagguggggcaaauucacggcagaugguaaggccaacccugcuugauuuacaacccugcuuguaaauggaaacauuugauuguaugcagucugaaguuaaauccuauugauugugaaaagguagcagagagccaaaaauuaaaaagucgagggcagcagaaacacuccucaucaguucacugaguggcuuaauugauagccaaugacuacaggcacaauuaacaacccaagaccuaauaauggaaaggaaguaagaacagaaacaaccuccgaaacuaauguuaacauauggagaaacuucuacugguugauaauuacuaguguguacauaaagccuugacaaguuucuugacgcacacaugcuuacaucgguguuuaaauauagcugacacauauuugaguucauaguuucucauguccacauucucuaauaagcuucauuaguacuucauaccuuuuuuuuuaaauacagucuugcgaugucaccuaggcuagagagcaguggugcgaucauagcucacugcagccuugaacuucuggacucaaguaauccuccugccucagccacuuaaguagcuaaaacaggcaugggccagcacacccagcuaauacuuuuuuacuuuuuguaaagauggggguugggggugggucucacuacccaggcuggucucaaauuccuggccucaagugauccucccgccucauccuccaaaagagcugagauuacaggcaugagccaccacacccagccccuaguacuuuauaucuuuaucagguauguggccuucuacugcuauucucuuuuuaagucuguaauuugucuuauaaauuuauggagggagugauguuaaccccaaacauaacuugguaucuugcaaauaauagguauuaaguguuuauuaaugauaugaaauccacccuauaaccacaccucagcccuuaucauuauguggaacugcuccuccuuaucucucugacuggaaugccccaugggccaguccuuaaauuucuucucuucucuagcuacccucacuccucaggugaucuaaucuauacugacaagucccaaauguaaccuggaccauucuucucugaacucuagauucccauguucaacugcugacuuaauaucucuauuacuuagcaugucuauuagacaucucaaaaacuuaaccagucuagaacagaacuccuaaacucuccccaaaaaccugcucugcaccguccucaagucuuccucauuucuauuaaugacaacucuauccuuccaguugcucaagucaaaaaccuuggagugauccauuacucuuuucuuuucacauucuacaaccaauccaucaguaaaucuaucuguaucaaaacauauccaguuagagucacagacaaucaguauauuuauauuuuuauauacagaaauacagauuuuuacauaauuguacauggauacguggauuaguauacauacaugcauuuccuaguucuuuccacugagaaagucuaggagcaaugauacuccacagcaaugagcacacuuagcauccagaucuuggcuucaaaauaucauccuccaaugaaaggaaccaagguuccuuagagaaauaauugauucuagggcugagguaggaaaaaaaaacaagaugaaccugaagcaugugguagugucagagaauaaagaagugugcauguacauacgcauaaaaaaaggauagaaauaugccaaaaagacacagaaguagaccuaaaagagaucccaagggccaaaacuggaauaauuugagcaacaaaauaaugauagcauuuaauucuaacacuaagaauaaaauaaauaucuaugaauuugaacugagauaaaugauuagauagaagggaaaaccuuccuuauagaagaauucuaauuaauaaauguagaaagaaugaggaaaauuuaaaaaaguaccuucagaagccacagcaauaauugcugcaggcaagauccacuaaugaaugcuaaaauuagugggcagaaacaggauacuggcaaagccucaaaguagcucucucaaaauauuuaccaauuacuguggugguuuuaauauauguccacaaauucuuuuauacuucucccuccaggaaguggaguuuaauuuccaucccuuuaagugugggcuacacuuagcaaccuguuucuagugcacggacuaugggaaaggaaaaauaguaacuuuacaguggacaaaccuagcagaaaccaccguaacagagugcucacaagugauaaauuauuugauaucaugcaccuccuguaugaaauaauaggggcacuucaccuuugcaguacucucccccaaaauccauaaccccaaucuaaucaugagaaaacaucagacaaaccuaaacugaagaacauucuacaaaauacuugugucaagguuauaaaagauaagaaaagaccaagaaacugccacacauugggagagacaaagaagacaacuaaagcaaugcaauaucaagguuuggauaacagaauggaaaaagaauacuagaaaaacugguaaaauauuaaagcaguuugaagcuugguugaagcaucguaccaauacuaauuucuuagcuugauaaaugcaccaugguuauguaggauguuaacauuagaggaacccaggugaagaguauauagcagcaguuuuucuguuuguuucuuugagacagggucuuacucuguugcccagacuggggugcaguggugcaaucauggcucacuacagccucuaccauccaggcucaagugauccucugaccucagccuccuaaguagcuaggcccacaggcacaugccaccacacccggcuaauuuauuauaguuuuuagagaugaggccucccuaugucgccuaggcuggucuuaaacuccugggcucagacgaucuucccacuucagccucccauaguacugggauuacaggaauaagccaccacacccagccugcauuuucuuucuuuucuuucuuuccuuccuuccuucuuucucuuuccuuccuuuccuucugucuuuccuuccuucuuuccuucuuuuuuuuuuuuuuuuuuuugagacagggucuugcucugucacccaggcuggagugcaguggcacaaucacaguucacugcagauugaaccucccaggcucaagugauccucccaccucagccuccugaguaggugggacuacaggugugcaccaccaugccuagcuaauuuuuuguauuuuuuuuuuuuuuuuguaagcgacgggguuucaccauuuugcccaggcugaucuuaauguccugaccucaacccaccuuggccucccaaagugcugggacuacagguaugacccacuaugccaggcccaauuacuguauuuucuaucuuauccucugacuugaaacgaacaugguuuggacaagaaagaaugggcuuugaauccugguuccaucacuugacagggugugucugaauauguuauuuaaccuuucuaauccucaguuucuucaucugaaggagaacaaaggaaauaauauaagguaaauaacaaaauuguugaguuaguguuaggaucagaauuagguauuaaagugucuagcacauaggagguacuccacaaauagaagcuaguauuauuugcucuucauuugcucuacagcuucacacugacuucuagcauuucaugcuccucauuuucucccaacuggaucaccuccuuacaggcuuccagcucauaauccaggaggacuccauaguucuucaguagagcuacaauacucaauaucauuaauucccucaaccaacuguccuucagauaucucuaccaaacagauaucuacaaagcagcagauaacagccugggcagaauuuaaacccaagcuguucaucuuacaaacaaggagaguaacaguaacaauacauaacucauaagguucuugagaguauuaaauaguuucuucagauagucugaucacucacugcuggagaaaaaucaaccacgaaaauugguacugcuacaaaugugaggucuacaaucugaaauaaacagguccucaaugcuaacuaacaauccuucuucaguuuccuagucauguaacuaacaauccuucuucaguuuccuagucaugugucuguuuaccucucucucccuuaccuccaccccauccacuguuagccauucccuuggaagccguuuacaaagaguauguauaaacuacagacuaucuuuuuuuccauuccuuucacagggguggauuaauuuuaccuggcuuuuuuguuuguguguguguuuuuuaagagauagggucucauuauguugcccaggcuggccuucaacuucuggguucaagcgauccuccugccccagccuacugaguagaugggacuacaggcacaugccacagcacuuggccucacauacauuguuuaaaaacuccuauucuaccacguucccuucacucuuagcagaugaucaaaaauuacacaagacaugucaucaacucuuccuuccugcccugucaguuacaaacuuauuuacauugccauccaucuccuuccuuucugcucacuggaaaagugagacuaccuucuacuuaagaccaacuucucugccuacgcccuggaucccauuccuuauuaccuucaaauccuugucuccauccaccagccagucucccacgcccaccaaacacacacauauacacucuucuucaguuucuccucuccaguggcucuuuccaggcucacauuaagaauguccaagauucucuaaaucccaaguaucucccccugcuuaaagacuccuucagaguccuuuguugaaaacauuguaccccucucaauuagcuacacuuacaguugucauucacuuuucaacacccacccccaugcauuacaauguagcuaagugcucuagcugaaguuauaaaagacauccuaaucaccaagucucagagacuucauuaggucuuuaucuuacuuuuccuuuuggaggcaggauacaguguugaccacuccuagcccuugaaauaauauucucccucagcuuccaugacaaaucucuauuuccuuuuuucaucuuuggucugucuggcacagaugguuggcuucucuucagcugcuugcccaaucuacucagcggaucacaacagaaauguaggaaucauccaaaaucuucaaucuugcucaauucuauaaucuaaauagauuuauccugucccguuaauaauacuuccuaaaucucucauagagccacucccucuucuacacucuucaucauuucucaccaggaauagcuuccuaacugguccuugcuuccaguuuugucccucucuaauucaauauucacuucacugucaaaaugacaggucuaaaauacaaaucugauucuaccacagcauaauuuuuuuuccccacuaaauccccgcaacuuuuggaauuaaguuaaaguuauuaacuugguucacaagacaaucauugauuuggcuuauuacuucauccaccccuguucuaaagcugugcugcugcuguccacucaccugcagcuauugaguaugugaauguaguuguccaaauugagaugugcuauaaguguaaauuacacaccagauucugaaaacaguagaaaauuaugcaccagauucugaagacaguaugaaaauggaaaugucauauuucaauauuacuuuuuauacugaaugcauguugaaaugauauuuuggauauacugaguuuauauuauuaaaauuaauuucacuuuuuacuuuuuaaaauuugguuacuagaaaauuuuaaauuguauauguaacauauuuguggcuuguauuaaauuuuauaggacagcacugguauaagauguacuuucccucuuucuggaccuaguuaacucuuaccuauuauugaagauuagcucagguaacacucuaagaugcauucuagacacccuccacccaucccccgaagucugagucagcuaccccuccucugugcuuccauccauaggaaugugugcaugccccugucauacuauaauuauugguuaucaccuaucuucuccuccucaacuguaaacuccuugcaaaaaggaaucucauauucuauaauacucagguccuaccuaccaccaugccuggcacuuaaaagguacucaaacauuugucaaacaaauguaaacuaucuauuccuggccugaagguuacuaggauuucuacuucacuaaggaaaacaaaccagccuugagggaaccuagaaaguaccaggagcuuuaguaaugaaaggacuaggaaggagagugggguggggggaugcggggcggggggggaggggggcaagagguaggaaucacaguaaagagaucagcaaaugacagaauaacgcucaucacacacaucugccucuuacacugaaaacagggauuugcaacacugauauggagccuuguacucacacuuggcaugccaggggccacaguuugguuacuaaauuacuuaaacaacccauccaacaaaaggguaugauuuggcagguaucaacacaaauggcuagggcccagcacccguuccacuuaaacagcacaucaguacaguuaaaaagaacaacaaaucucucucaugaagcaaaugcuaaucucaugaugcuucaccacggaacaauuuagaagaguuauuauaugaaaugugccaaagcaugaauuuauagcugaugcuuauuuggcaaauaugguuggcacugcuagauguugaaaaacauguaugcaaauaagcaaauaaaaguuuuuaagcucucagacuuaaauauuuacauuaccauaaauguacaaagauaaauguuuauaugaguacacguauaaugcauuccaggaacauauuuuuuaaugugauugucggcaaacaguuaugaaguggcauuauuucuucaugggccuucaggguagacucuuaaaaaugaauuuugaauguuaauaggcuacaaacauuauugugaaaguuucuguauacuaucaacuggauaaaacgaauaguugagguaucauaauaguucaaagugaucuuaucuuuuucuuucaccaaaacacuucucuuccaacccuagaacacagccacacauaaauuuuagccucuaaguugggacaggagaugggggguagugagggaaaagaaggaacauacauuaaaaagccuuaaagaaaauaauuugacauuuuuucccacauaauguagucauguuagagaauccaaaauaaagacaugauaaaauauuucccuuucccccccgacagcaaugaaaaggggauguuuguuuuuucacauaguuugugaguuggucauauccaaaauucacuagcaaugcuaugacuucuacuuccauuguucaucucugggcugaggcuauaacccucaacuuugaagccaagaaaauguaccauaucugccauuacaguuuacuaaauaagucaccaaagagaagucccaggcaagucagaaaguaauuagggucgucagugaauugagcuaucuagaaaugcucugagauuacgagagaagccaucaugaagugaguauccaagauugcucauggaaaguuuuaccccgguggauaauucacguuuuucacuuccacacugcagagagcaauauggguucucugacuauacacaucacuacaucacuucauuuaucgggggaaaaaaaaagacgcuguggcugaacaaaaaucaguaaguaggccccaaaacagaauccucaaggcaaucccaauucaggugaaaagcuguucacguacaucauccaaugaccuaaaaauagucuuuuauguaagucucuaaguauuuaauucaacguaugaucuuaccacauucaacagaggcagaaaaaaaaucaauuagguuuucuauagcaaggccaauaaagaugaaaucauaguuuuccucuaacucaucacuacccccucaacgucagccuuccaauaacuccauuccacagcucucaaauuccugaacuuggaucuuuaaaaaacaacgaaucgcaaaaaguaacauuuaacaggccagaggcaggcgggggaggagggucucucccggugcucucagcaaucuuuaacguagccaaaggaggaaaaaacgaaaucaagcucccagacggauggugcaugcgacgagaggggagggggcagacgcgguucagacggcaaguccccaucgaaggaggaaagaaaaguugcaagaacggaugggucaaagggcagaaaagaaaaaaacugagcagccgaaccacucacaacccccaaacgaccccgccagcccacacguucgcgggcuccccagccgcggcgcgaagggagcaggcagggagccacccggcuccgucccgacgcugccggcgaggcugcgccgaugcucccgggugcgggagcgggcugaccguguggacccggcaggagccagagaagccccuccugccccggccuccccgcguccagcuccuccaggcuucacuuucccccgcaaccucccagccgcgcccgggggcgucccucgcggcaggucccaacuuuccuuccucuggggggcgucgcgcucccggggccgccgccgagggagggggcaggggcggcagggggcgcgcggcaccggcggggcgcggggguggccggggagcuagagcccgcgccgggcgggacgcaccggccgccagagccccggcggcggcgccacccagaacccgcgccgccacccagaacccgcgccgccccgcccggauucccccgggucagcgcccucaacccgcggcaacccuggucccacagacggcgcgugaguagaagacaaccgagcggacgcggacagccgggccgcuguuaccugaggggcgcacacgccgccgcggcgaccaccaucaccguccgucccguccccuuccuggugaccacggccgccgccgccgagcaacugacacugacu

SEQ ID NO: 192056 - RNA, 28023 nt, Homo sapiens
gggacuccaggugaagcccuaaggcccgggaagaucugcgggaggcggcagggcccagggcguugaaugcccggccacaagaucagccuccucccauuggcgaaaggagccccgaagagcuuguguucaggagggaggccucggccuggucaagucaucuagcaggaagagucccggacagugcaaagcaaaugcaagaagacccccucccuagccgaugggaaaugccccagccguugaaggcggaaauaacggccuguaggcaacggaacucccagcguucgcaaaggagggaggagccggaaacucagggcgcgaggccugugggcccagcggugaggcagcagcugggggcggggggagggcggaccuagcuucccagggcaggugauucgucggccccgguggcggcggcgcgugcgacggucaccucgguuugggugagucccuggguucgagcccgggccccgccagcugccgaguugccucucggugccggacugugacucccucuggccggcccugcacucuggccuccugggacgucaucuggagggauagagccaggccugggacuccuuuugggagaguuuccguucuucuauuccgugcuguccggccaggaccccucagggacuucuguggggcaggggcgaaucaugcauggccuagaugaccccaugccuagaaaaaggcagugcggggcgguggcggcgcgcacggccgagugaagcagauagcguccccggggcuggagcccgguagcagggguagggaaacgcggaggcugccaggaugcggacccaggggacgcgaggcgggggcgccggauggggagacgcgaaggagggggaaggggaugggggagggggcuagacagggagggaggguggagcgugggcggggccuggggcgggucggacuuuagggaguuggagcggggguuacuggugcuaagaccaccuggggcuaagguccgaacacuuggaggcagcaccauccaaggaauggguugaaacagcaggagcccggcggggcgcaguggcucacgccuguaaucccagcacuuugggaggccgaggugggcggaucaccugaggucaggaguuugagaccagccugaccaacauggugaaaccccaucuguacuaaaaauacaaaaaaaauuagccgggcguuguggcgcgugccuguaaucccagcuacucgggaggcugaggcaggagaaucgcuugaauccgggagauggagguugcagugagccgagaucaugccacugcacuccagccugggcaacaagagcgaaacucugucucaaaaaaaaaacaacaacaacaaagaaaaaacaaaacgaaacagcaggaacccgccaagaacagccuugaaggaagguaaaggaaccgccccaguauccaggacaucaguuuuucuuuuuuuuuucuuuuugagacgaaguccaggcuggagugcaguggcacgaucucgacucacugcaagcuccgccuuacggguucaagccauucuccugccucagccucccgagcaucugggacuacaggcgcccgucaccaugccuggcuaauuuuuuuguauuuuuuuuuuuuuuuuuaguagagacgggguuucacuguguuagccaggauggucucgaucuccuaaccucaggugaucugcccgcuucaaccucccaaagugcugggauuacaggcgugagccaccgcgccaggcccaggacaucaguuucaaagguugugugguucuuggcagagcgggagcccacaccaagauagugcaugauaggccuaauaaaggugcuuuggauuuggucauuacuuuggugaugaacugaaaacauaaugacuuuuuaaaaauuuuuaucggccgggcgcgguggcucacgccuguaaucccagcacuuugggaggccgaggcgggcggaucacgaggucaggagaucgagaccaucccggcuaaaacggugaaaccccgucucuacugaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaauuuuaucaugaaagcuuucaaacuuacacaaaaguacagaaaaguagagacaauagcauacauaccauuauggaugauuugaauaacauaccauauggaucccaagcacucaucaugaggccucagucacucaggaauggcaacccuugguugcauugcaaagauauuaaggcacaccucaagccgggugcaguggcucaugcuuguaauuccagcacuuugggaggcugaggcaggcagaucacuucaggucaggaguuucagaccagccacgccaacauaaugaaaccucuucucuacuaaaaauacaaaaauuagccgagcaugguggugcaugucuauaaucccagcuacucaggaggcugaggcaggagaguuacuugaacccaggagguggaggcugcagugagccgagaucacaccacuguaguccagccugggagacaaagugagacccugucucaaaaaaaaaaaaaaggccgggcgugguggcucacaccuguaaucccagcacuuugggaggccaaggugggcagaucaggaggucgggagaucgagaccauccuggcuaacacggugaaaccccgucucuacuaaaaaauacaaaaacaaaauuagccgggcgugguggcgggcgccuguaaucccagcuacgcgggaggcugaggcaggagaaucacuugaaccugggaggcggagguuguggugagccaagaucgugccauugugcuccagccugggcaacaagagugaaacucugucucaaaaaaaaaaaaguuucuuuuauguuuaaagguuacagagguucaguuauucaagauaaaaggaguucuggagaguucugcacagcaguguugaacauacuuaacuuuacagaacuguacaccuacaaaugguuaagaugaugaauuucaugauauguguauuuagccacaauuuuuuuuucuuuuuacagacaaggucuugcuauauugcccaggcuggcuucgaacuccugggcucaagcauaccuccugccucagccuccagaguagcugggacuaaaggcaagcacaacugcaccuggcaaaccacgauuuuuaaguuccuuuuaaauuaaacaaaaucuaauguuucaaaucaagaaaaauaucugacuucacuugugcaauggaaaguaacucacuggccaaguagaggccuauggaguuguauuuuucacuguagaggcucuggaaugaaccuguugauuuugaugcucagagcacuggaccuggccugggauggagguuaagcacuggaggugcccucugguuuacacuagaaccaaagggcugggccagcccagcagugcaagucagauuucucccaaauguuccuguuuucuuauaaucuaaggcucacaggcgcuugaaugaagugugaauucaccuuucuccccacucccauucuuuaggguccaccuaaagugggaagucuguuuucaaaaugacaucuacuccaugccugucuuguuucccuaauguacuuuauggaaguucuucacacuacuggagcauugacguuacuuguuaagcagccuuccacauccuagcucuuuuccaagugagucccacauaaguagcccugaaaccuucuuucugcccacccaaaaacaaaacacaacuagaauaugaggaaguaacaaucagauuuuuuaaaaaauaaauuauaauuuaaaauaauuuuuuacuuuuuuauuuaaaaaguagagacauagucucacuacauuguccagguuggucuugaacuacuggccucaagugauccuccugccuuggccucccaaagugcugggauuacaggcaugagccaccuguaaucccaggucgcuagaguuuguuuuuuuguuuguuuguuuguuuguuuuuugagaugaagucuugcugugucgcccaggcuggagugcaguggcacgaucucggcucacugcaaccuccgccucccagguucaagcgauucuucugccucagccucccgaguagcugggauuacaggcgccugccaccacauccagcuaguuuuuguauuuuuaguagagacgggguuucaccauguuggucaggcugguuucgaacuccugaccuugugauccacccaccucggccucccaaagugcugggauuacaggcaugagccaucgugccuggcgaguuugggguuuuugauugcuuuugucuuccuccagggacccuagaaccaguguuuccucuggaauuaaauuuucauaauaugaguuggcacuuaguugagaauuaaauaaccaauugaauaaacugcauggagaguuauauugguuaaugagugauggcuauucaggaaacuguagaggaacugcucagaaaaggccgggcgcaguggcucacaccuauaaugccagcacuuugagaggcugaggagggaagauugcuugagcccaagaguucaagacuagccuaggcaacauagggagaucccgucuguaccaauaaauuuuaaaauuggcuggguguggugguguauaccuguagucucaguuacuggggaagcugaggugggaggauugcuuggguccaguagauugaggcaacagugagcugugauugcaccacuacacuccgaccugggugauagagagagacccugucucaaaaaaaaaaaaaaaaggaaauaucuguaggaaaauaauguuauugcuaauauaugacucauuuacccuuuaacuuccuuuugucucauggaaacacuugugauuuugcauuaaguuaauuuuuuuucaggaauguggccaucauaucauaacugcauaacugucuguauacaggagaugauaugaaaugaaugaaccauuuucuuacguuuuccuuuguagggaagauggaagaguugagucaggcccuggcuaguagcuuuucugugucucaagaucugaacagcacagcugccccacacccccgccuaucccaguacaaguccaaguacaguuccuuggagcagagugagcgccgccggagguuacuggaacugcagaaaucguaaggaagcuuuaacuccuugucuucuuucucugggcuaggagcuaugaaccauuccgaaggcucuaggcuugucucuacagacucucccuucaaaguagacucuuuguaggcugaucuucuugcccacagguugggagggguaaauccuggcagagguagguuucuuuuauacccagagcuuaggagaagaugaggaauuagggagacaccgaaguuugaaaccaaaagcucaauuauuugguuaaguuuuucuuuuuuuccuggcagcuguacugagcucugugguuuaggaacuugcgaaagccacgcccagacuuucacuccccacauuuccugggaugcuuguguuuggcuucugcacucugaaugcugguauugguguggucuucccaucugccuucagcccaaauguuucuguggcacucuugggaguucaagacaaauaauuccuaagggaaucugaggaaaugucuuccauauacuuaauucuaagugccaagaugugcaaacagggaaagagggcaggauaagaguguuugaggcugagcuacucugaaggcagggccgauccuuguauucucaaugcagcaugggccucuucugggucauaaauuaaggaauuagggaucagaagaaacuacuaacagcugcauaguuuccauacagucugcauuuugcccaguguugcaucacugguuguguuuggcagagaugguucccuguggcucuggguggcuugcagaauacauucccagaucauuccucuccccauuuuuaaaaauguaguuaucuuugaauagguaauacauuuguaugguugaaaauuuaaaauauacauaagaggccgggcaugguggcugacgccuguaaucccagcacuuuggguggccgagguggguggaucaccugaggucaggaguucgagacuggccugaccaacauggcgaaaacuugucucuacuaaaaauacaaaaauuagcccgacaugguggugcgugccuguagucccagcuacucgggaggcugagacaggagaaucacuugaacccgggagguggagguugcagugagccgaaaucgcgccauugcacuccagccugggcaacacagcuagacucucuccaauaaauaaauaaauaaauaaaauaaauagaagaguauauggugaggucuucccauuucuguccccuagcuauccaguuccucuccuauauuauuaguuucugguguauccuuccaaauauauauauauuuuagacagggugucacuguguuguucgggcuggagugugcagaucccggcucacugcagccucaaccucucaggcucaggugauccucccaccucagccucugaaguaggugggacuacaggcacacuccauagcaccuggcuaauuuuuuuauauuuuguaggaacagggucucccuauauugcucaggcugaucuugaacuccuaggcucaacugauccucccaccuugaccucccaaagugcugggauuucagacgucagccacuacgccuggcccuuccgaagauauucuauacauauaugagcaagugugugugguaguauguguacaaaagcuuuuuuuuuuuuugacucuaucucccaggcugaguacuguggcaugaucuuggcucacugcaaccucagccccucaaguagcugggaccacuggugcaggccaccacacccagcuaauuuuuuuauuuuugguagaaacacaauuucaccauguugcccaagcuggucuugaacuccugagcucaagugaucuggccaauucacccucccagagggcugggauuacaggcaggagccacugcaccuggcuuuuuuuuuuuuuuuuuuuuuuuuuuuuaacacaaguagcaguauacuauauacuguucugcacauuuauuuagugguguuuugggggagaaauucuauaucaguucauaaaguaccacaucauuccuuuuucguggugcuagguauuccguggaauggauacuucauaaugccaucaagccagucccuccugaugggcaucugggcaguuuucuucucuugugauuacaaacaauguucaggaaauaaccacagacagacuuucuuucacacauguacaaauauaccagcucuuuuauucucgagauaaaagaccauugugcuuucauauguucucucuggugugugccuuuuuauaaugagcaugaacauguauguguuuaagagaaaccagcuguguugguuucacugccucagugguugaauuccugccuuagcauugaagaaaucaaaugugggagguuaugugguauuuccaaaucacuuugaaacaauuagguuccaaaagauucuuuuuuuuucuuuucaguuucccaaacuuucuagcauguguuguuuuaaaacaagauaacgauaaagggaaacaaauaaauaaaauauauuaaauuguaaacuaagugaccuuuuuugaaaguuagacaggaacuggagaaaggccuggcuucugagaaagcuguauaagcugggcacaguggcauacaccuacgguccguaaaaaaaaaaguucucuuuaaaaacaaaaaagguguauaaggcagaaaucuccagaagcuguccuugcuuuagacuucucacugcaucucaguggcucuucucuuccaccccuggggucuuuggaugagaugucugcuaggcaggaaggugucagcucucaucuggggugggaugggguaggggugaagcuagccuuuccaucuagugaaccuuggaaauuucuuuagauauuuuauuuugcauucuuaggaaacucugaggaaggcugaguguauucagaggggguuucgcuauuuaggauuuugagggggcggucacuguuuuagccuugcaaaggagauuccaucauuucuuacuuccaccagaauccccaaguugcucccaaauuuggagcuuuugaauuaaaugugucgcauuauagggcaucuuccuaaaagacauaaagaccugcccuggccagaugcggugguucaugccuaauaaucccagcacuuugggaggcugaggcaggcagaucacuugaggccaggaguuugagaccagccugggcaacauggugaaaccccaucucuacaaaaaauacaaaaauuagccaggggugguggugugugccuguagucccaccuacuguggaagcugaggugggaagaucacuugagcccaggagguugaggcugcagugagcugagauugcaccauuccagccugggcaacagagcgagacccugucuaaaaaaaaaaaaagaagaaaagauauguccuuaugccuuuuuuuuccuuccagcaagcggcuggauuaugugaaccaugccagaagacuggcugaagaugacuggacagggauggagagugaggaagaaaauaagaaagaugaugaagaaauggacauugacacugucaagaaguuaccaaaacacuaugcuaaucaaguaagugguccagagaagaugagacccagcuaaucucacucccuuuacuaugcagucaaagcccacugaaauaaaugcugucauaaagagaggagaaugaggcaggaaaaaggaauaggaacugcaaagaacaugccaguguacguagaucauaugggaugauaaguagagauggcuuacugugcuauggacugacuaggaaucacugauggaaucuguggguagugggguuugggaacuauuagccugugcuguuaccaaaggcugccagcccacugcagaaagccccugagcuauugauauaguaacacacuccauauccuugucauuuuuuuuaguugucacugcacagcuguucuggauugggccugcccagccuaccacugacuccuuccacuucccugggugguagagucuuucccaggcaguguacuaugaggccagucuugaaauuucacacucaggugguggcaagugggaaguacagcugcccuugaauaaagugagccugcccagccaccccagaccagccagcuggccaaggugagguucaggccaugaagcagcagaucacuauaauaaaccugacucagugcccuuuuagauccagagaggaaaccaacauggcugugguaccauagggaaagagguauggagagagacuguucuuguguuccaggcagcucagguauuucagaaagcaggguauggguccaaguugggauggaggucuacccugcuaucauauacuugugucuagaacccaaguaucuugucaucucagaauucuccccugccuuuagaauaugguuccugggccugagugugguggcucauaccuguaaucccagcaauuugggaggccaaggugggaggauuacuugaagccaggaguucaagaccaaccuggcuaacauagugagaccccaucucuuuuuuuuucuuuuuugagacagaguuuugcucuuguugcccaggcuggagugcagugguacgaucguggcucacugcaaccucugccucccggguucaagcaguucuccuguuucagccucccgaguagcugggauuacagaugccugccaccacacccggcuaaguuuuuguauuuuuaguagagacaggguuucaccaugguggacagguuggucucgaacucccgaccucaggugauccaccccccucggccucccaaagugcugggauuacaagagugagccacugcacccggagagaccccaucucuaaagaaaaaaaaaaacacaauagaauaugguuauuggaugcacucccacagccccuuucuuuaccccaaauacaguacagauaacauccucugugacaaaguacaauucaauuuuguucaguaagcauuauugaaagaccugcucuguguuaaacuaggcuaugacaugggaagauagauguggagcagaaauagccccugugcuccuagaauagguguagaagauguuuugugcuauaaaaaagugagaugcuggccaggugcaguggcucacgccuguaaucccagcacuuugggaggccaaggcggguggaucacgaggucaggagaucgagaccauccuggcuaacauggugaaaccccgucucuacuaaaaauacaaaaaaaaaauuagccaggcguggugguggcaggcgccuguagucccagcuacuugggaggcugaggcaggagaauggugugaaccugggaggcggagcuugcagugagccgagaucacaccacugcacuccagccugggcgacagagcgagacuccgucucaaaaaaaaaaaaaaaaaaaaaaaaaugagauuccuuccaaccaaggaggaaggagggggugugaaaucagagaaggguuaaugaaggaagaggcagccuugaaggguaaguaggacauuaauagauagaagugcagugcauuuuagggcauuccaggcagugggaacaaacaggcugagcacgaggcccagaagccagaaaggaguauauggugugcccgggagcaguuugcaggccaguuaggguagaguggcauagaguugggagaaggaguauggcagaagagauguaaagggccucaaaaauaugugcagaggcugggcacaguggcucaugccuguaaucccagcacuuugggaggcuaaggccaggaguucaagaccagccuggccaacauggugaaaccccaucuauuaaaaauacaaaaauuagccaggugugaugggugucuguaaucccagcuggacagcauaggaagaucccauuucuauaaaaaauaaaaaauaaauaaaacaaauaaaaaagaaauguugccagauagaauggaagaacuuagcaguggacuggauaugagaggcaguauaagaagugggaaaggauguaagcuuugaggucacacagaucugaucucaaagcuaggcucuguguugaccuuaagcaagguauuuuagccacucuaagucuuugguuucuuaucuguaaaauggggauaguaauaguacuuaucucauaggauugguagaaggauuaaaugaaauaauaugccuuaaauaccuagcccagagucuggaagugccccacaaguauuagcugcuacuacuauuuuuuagacaguuauauugagauauaauucacauaccauacaauuugccuauuuuuauuguauaguuuaaugguuucuuuuuuuuuaguguagucacaagacugugcaaccaucacgacuauuuaauucuagaacauuuuccuuauccccaaaagaaaccccauacuaauuagugucacucuccauucuucccuguagccccuaaucauuaaucuacuuucuguuccuauuuugcacauuucauagaaagggaaucauauaauauguggacuuuugugacuggcuucuuuuacuuagcaugagguuuccaacguucaucauauuguaccauguaucaguacuucacuccuuuuuauugccaaauaauauuccacuguauggauagacuacauuuuguuuauuuauucuucaguuuauggcuauuugaguugcuccuacuuuuuggcuauuaugaauaaugccauuuuuauuuguuuuuuaauuaauuuuauuuauuuacuuuuuucgagaugaagucucacucucucacccaggcuggaguacaguggcauguucuuggcuuacugcaaccuccaucuccugaguuuaagugaucuuccugccucagccucccuaguagcugggacuacaggugugugccaucacacccagcuaauuuuuauauuuuuaguagagacgggaguuucaccauguuggccaggcuggucucgaacuugugaccugagcugauccaccugccuuggccucccaaugugcugggauuacaggugugagccacugcacccagccaaauaaugccauuauuaauauucuuguacuacaaguuuuugugugagcauauguuuucauuucucuuguguauauaccuagaaguggaauugcugggucuauauaugauaacucuguuuaaccuuuugaggaagugcuagacuguucuccaaagugacuccacuacuuuacauucccaccagcaacauauaaguguuccaauuucuccacagcuuugccaacacuuguuauuguccauccuuuuaaauauagccauccuagugggugugaagugguuucuugugguuuugauuuguauuucccuauuucccuagugacuaaugauguuaaacaucuuuucuuuucuuuucuuuuuuuuuuuuuuugaguuggagucucccucucuugcccaggcuggagugcaauagcacgaucuuagcucacuacaaccucugccucccagguucaagcgauucuccugccuuagccucccgaguagcugggacuacaggcacccgccaccacuuccggcuaauuuuuguauuuuuaguagagacgggguuucagcguauugaccaggcuggucucgaacuccugauuuugugauccgcccaccucggccucccaaagugcugggauuacaggugugagccacugcaccuggccugauguuaaacaucuuuucuugugcguauuggucauuuguauaucuucuuuggagaaaugucuauucaaauccuuugcucuuuuuuuuuuuuuuuuuuuuuuuugagauggagucuugcucugucgcccaggcuggagugcagugacgcgaucuuggcucacuacaagcuccgccucccggguucacgccauucuccugccucagccucccgaacagcugggacuacaggugcccgccaccgcgcccggcuaauuuuuuuuguauuuucaguagagacgagguuucacuguguuagccaggauggucucgaucuccugaccucaugaucugcccuccuuguuuuuuaauugaguuauuuaucuuuuuauuauugaauuauaagaguuuuuaauauauucuagauacaaguuucuuaucagauacaugauuugcacauauuuucuuucauucuguggguugucuuuuugucuucuuggugauauuguuggcagcacagaauuuuuaaauuuugauguagucuaauuugccuagauuaugcuuaaacucuaagauucaguaacggaguggugaugccauuaacaagguuaugagacgcagaagggaaggguagguguuucaggggugggaaguacuuaggcaacagaaggcaguuaauuccacucuggauauacugaguuuucggugcagaggagacaaacagaaagagauaccaagcagacaucucgcaauauagaugaguguggaggaaagaagucuggagaugaaggagcauuaggaggcacaagugaagcuauagaaauagaugagauccaccccuaaugggaacagcaucuaagagaaaagggggaccuaaaacagcccccugaagauuacauauuuugggggaguguguggaggaauguuuagagggaaaaacagaguagugcuaugucauggugccaagggaacggaugucaggaagggagauguggcugguagcauuacguaaggcgaggaguagaguggggaggauaagaaagagguaugggaggccaggcacaguggcucauaccuguaaucccagcacuuugggaggccgagguggguggaucaccugaggucaggaguucgagaccagccuggccaaaauggugaaacccugucucuacuaaaaauacaaaaaugagccgggcguaguggcgugugccuguagucccggcuacuagggaggcuaaaaugggaggaucgcuugaacccgggagguggagguugcagugaaccgagauugugccacugcacuucagcuugggugacagaguaagacuccaguucaaaaaaaaaaaaaggaaaaaaaggaagaguuaugagaagaggucagagggccuucaguaggacugugggguaggaaaucuggacuguggcugucagauugagcaagaaggcagcaucaagaaguauuaaguaguuuuuaaacuaggagaaaguggaguagcucaacagaaaugcugagugacaaaaaguuuuuuuuugagacggggucucgcucugucgccaggcuggagugcaguggugcuaucucggcucacugcaaccuccaucucccagcuucaagugauucucccgccucaaccucccgaguagcugggacuacgggugcaugccaccacgccuggcuaauuuuuguauuuuuaguagagacggcuugucaccauguuggccaggauggucucgauuucuuggccucaugaucugcccgccacagccucucaaagugcugggauuauaggcgugagccaccguuccuggccacaaaaaguuuuuuuuuaaagugagccgggcgugguggcucaugccuguaaucccagcacuuuggggggccgaggcgggcggaucacgaggucaggagaucgagaccauccuggcuaacacggugaaaccccgucucuacuaaaaauacaaaaaauuagcugggcacaguggcgggugacuguagucccagcuacucgggaggcugaggcaggagaauggcgugaacccgggaggcgcagcuugcagugagcugagauagcgccacugcacuccagccugggcgacagagcgagacuccaucucaaaaaaaaaaagauugggagugagugccuaaagggaaggagaaaugaaagauucaaugagagagauuaauugaugggacaaagucuuuuuuuuuuuuucuuuuugagacgaagucucacucugucaccaggcuggagugcaguggcgugaucuuggcuuauugcaaccugcgccuccuggguucaaacgauuuuccugccucagccuccugaguagcugggauuauaggugcccgccaacacgcccagcuaauuuuuguauuuuugguagagacgggguuucaccauguuggccaggauggucucaaucucuugaccucgugauccgcccgccuuggucucccaaagugcugggacuacaggcgugagccaccucgcccagcccaugggacaaagucuuuacagauggaagagacugaguggaagaguuugucuucccaaauuaauuucaccacaucacuguuuuuguugguuugguuuggcguuguuucguuuuuuaagacagauuuccuaacauccuguaguauaguauuuggggcaucgguuugagaaaugcuggucuagucuaagagcaucucaaggucagggaucuuauucaucucugaguuguggcaaacauaauaguaaugaugauaggagcagauggacaaaguaaggaaaggaagaggguucaucacccugacccgggaggugaggcaguaagcauggugugguugcagguggagauggaggagagaagccaaaguucauagucaguggcccccaucauccugucagcugugcaggagacacagccaacucccuagagcacaugggguggaggugccacugucagccuuuucugcccucauucuuuuuuuuuuuuuuuuuugagacagaguuucgcucuuggugcccaggcuggagugcaauggcaccaucucggcucacugcaaccucugccucccagguucaagcaauucucguggcucagccuuccuaguagcugggauuacaggugccugccaccacacccagcuaauuuuuuauauuuuuuaguagagacgagauuucacuauguuggccaggcuggucuugaacuccugaccucaggugauccaccugccacagccucccaaagugcugggauuacaagcaugagcccccgugcccggcucucugcccucauucuuucacucagguuuuuaauauacacacaggauauuaaugccuugucauugcagacuuucgaguagcacaccccugcugaucuuuaacacuauuuuuugcauuuccaguugaugcuuucugagugguuaauugacguuccuucagauuuggggcaggaauggauuguggucgugugcccuguuggaaaaagagcccuuaucguggccuccagggugaguagcugccugcccccuaugccaguaggccuggucuguagugggagggauucuuugugcuccauuuuccucauacgccacaacagcugugccuggaguggagcuugaaacacuuuccugcaggaagguuuguugagagccaucuuuggucgaguaacauuccugcagaaugaggaggcaagagggcgaggagaccuugaggucuaauaagaaugguaacuuucucuccaugcaggguucuaccagugccuacaccaagaguggcuacugugucaacagguuuucuucacuucugccaggaggcaacaggcgaaacucaacagcaaaagguaccuacauagagugucuacuuauugaucaguaaaagacaguguaauuugcuuuaaagacccacuuugggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggugcgguggugggcaccuguagucccagcuacucgggaggcugaggcaggagaauggcgugaacccaggaagcggagcuugcagugagccgagauugcaccacugcaguccgcaguccggccugggcgacagagcgagacuccgucucaaaaaaaaaaaaaaaaaaaaaaaaaagacccacuuugauagcuuaucuuuguuuuuuuuuuuuguuuuuugagacagagucucacuuugucacccaagcuggagugcaguggcaccauauuggcucacugcaacuuccgccuccuggguucaagugauucuccugccucagccuccugaguagcugggauuauaggcugcacccggcuaauuuuuguacuuuuaguagagacuggauuucaccauuuuggccaggcuggucuugaacuccuggccucaaagugauccacccaccuuggccucccaaauugcugggauuacaggcauaagccacugcacccggccugaaagcuuaucuuugaaacugcauguagacaccauccuggccccuggaccaaggaccuccccuucaaggucaagcguccccaguugcagaauaaaugcagccccaugaggccugaugguccguaaauuccugaauuaaggucaacauaucuuuggacuucuauuacgggacaacagauacagauuuggggggaaacgucucugagagaauacuaagcauaaugguacagccagcugaugcuggggcuucccugccaaacucccuuuucuccuuucucauuguuguaaccuuagguucuuccuccccacugggccuagcugaguagacuaaggucgugggggagaaauaacuuacccacaguuauucaguaaggaauuggcagagcugggcuugcuuucuucucuaccugcucaggcuccuuuggugguuccucauguccucuguacugagcccagacuucucuuuuuuauuuuuugacacggucucacucuguggcccaggcucggguucaagggcaugaucacagcucacugcagccuuuauuucucaggcucaagugauccucccaccucaauuuccugaguaacugagacuacaggagugugccaccaugcccagcuaauuuuuuguauuuuugguagagaugggguuuugccauguugcccaggcuggucugaaacuccugggcucaaagccaucugccugccuuggccucccaaagugcugggaguauaggugugagccacugcaccuggccuugcucugacuucucuguuggcguuuaguaccuuucacaugcaggcuuugucccacccaucccaugucuuuccccuacuccuuauacccaccuucuguucagcugacuuaucuccccacaugugcccaguucauucugccucuggggcuuugcucaugccacaucaguacuugggucugaaaugcccucucuucuccccucugcccuguuguuuaaacccggcuggucccagaagacuauuuguauggcaucucucccuugaagcauuuccugcugcuccagccuucucuuucgggaacuccuguugcucuuaguaugagcucuguaauuuagcucuuaguucuucugugaucaucuuauccccuuaaccaaaugguaacuuccuuaaaggcagggaauauuuauaguuaauauuccccacauaacacagugccuaugauaggaacucaaaaagcaguuguaaacuaaaauggaagaugacuugcuuuuaaaccucguugaggugaguaaaugugccaguuuaucuaaaacuucagaauucucacuuugcuuaagguuugccuugaugcgucuugugcugucuuacccugagucaccaugaagcuguagcugguagccaggcaggguucucuccccagugaauccuuaguccuuagugccagugacugcugcaagcacugaggauuguuggacucaagccucugggauggggcucccuagguugugguggagggaaccugguuggaagaagaacucugugcugacuuucugcuuuguguccucagacuacaccauucuagauugcauuuacaaugagguaaaccagaccuacuacguucuggaugugaugugcuggcggggacacccuuuuuaugauugccagguagggauggauccuccucucguggcucuuccugucuucuccucuccuccugggaaagcggcucagcauguggguuugguaugugaccaacuucuuggugugcacaggaugugguauaucaagaacauuaucuaaugcucccugcaucuuugaguguguuuaaauuagcuuaguuuuaaaagagaaauaggaggaacuaagagaaacaugcaguucuugagaggaagaaagaaagaaauggcagggguguaggcugggacuugauagcagcugcacccacccccuuaucucucuccagaguaugggaggauuucuggcagugaagauuguggggcaaggggguggggaugccaccuugugcagcagccccaggaagagaagguggaauugaauguaagucaccaucuacuagacuccugcaaccuccacuccuucaccaaccacauccugacccugaaaauggcagggccuccuugguaugacccagaaccucaaaucucaaagguuagcucuaggaggagacuuuucaaaggaggagaggccccaauauucuccccuucuguuucaccauacccccaacauuuuacuauuggugauucuuaacagguaacagcagcagucaucaggugaggcugagugagccccaccggccuccaucccuguuaagaacacucuccccgucauugucccaguuguauaaugguggguuuggggguuuugguacuuccuuuugcucccugucaauuaguuuaucauagugguucucgguguguagucuccagaccaggcauaucagaacguuguagaaaugggccugaggcugaugugugaacaggccuccagugaucuucaugcaggcugucaccauaggcugcuucuuucuaagccauucccgcauacuagguuuccaaaacacacuagguauugguacucagaauucuaaggugcaucucauucaaacaauaacaaucaagaugugcauugcuaagcacuuucugcauuagcucauuaaaucccuuacaacacguccuuauuguaagguaaguacuauuaucauccuuuuuuuucuuugagacggagucucgcucuguugcccagguuggagugcagugcugcgaucugggcucacugcaaccuccgcauccuggguucaagcacuucuccugccuccgccuucugaguagcugggauuacaggcgcuugccaccacacccagcuaauuuuuguauuuuuaguagagacggcguuucaccauguuggccaggcugucuugaacuccugaccucaagugauccacccacuuuggccuaccgaagugcugggcaugaacgacugcaccuggccuguccuugacauauagauauggaagcugagaugcuaagaagcacaggucuuaaguaccuugcccacguguagaaccaagccuacaacucagaacauaaauucaaucuagaacauauuuuccuuuaauucugcugaaggauauuuuauuacauguauucacaaccuacaaauuugguaacuaaaaccaaauauauuuuuauaacguaaacaaaagacuguauguaucuuuuuaaauuuccaaaagcaaaauaauuuaaaagaaugaagaggcccggugggcgcaguggcucacaccuguaaucccagcacuuugggaggcucgagguggagagaucaagaggucaggagauggagaccacucuggccaacauggugaaacccugucucuaccaaaaauacaaaaauuagccugguguggcagugggcgccuguagucccagcuacuugggaggcaggagaaucgcuugaacuugggaggcggagguuacagugagccgagacuguaccauugcacuccagccugggugacagagcaacacuccaucucaaaaaaaaaaaaaaaaaaauagcaugggguguuuuuguuuauauuagaguuugaaauggaaaguauuucaucuuucuguuucccuucucuguggcagacugauuuccgauucuacuggaugcauucaaaguuaccagaagaagaaggacugggagagaaaaccaagcuuaauccuguaaggccugguguuaggaucacugaguuccuuauggggaguaguguggauuggucuguuaucuaaauauaaucauuauguaugaaaugaucuuuuuugaggcagcaugguauaaagggaagaguaucaaucauguagaucugaauuccauuuuuggcuuuuauuauuacuaauuuaacauccuauguucucacucauaauugggagcuaagcuaugaggauauaaaggcauaagaaugacacaauggacuuugggaacucuggggaaggguaagggggaugagggauaauugggugcaguguacgcugcuuggguggugggugcaccaaaucucagaaaucaccacaaaagaacuuauucauguaaccaaacacuaccucuuccccaaaaaccuauugaaguaauaauaacuaaaaaaagacuaaaaaaaauuuauuacuaaguuaaguuaauaaucucacuuacccuuagauuuuccaucugaaaaauaggguaauaacaucuaauuuacaggguuguuauaagaaccaaauuauauaaauaugcaaguccuccuaacauaauacucaugguaggcacucaauaauaaucagugauuuaaauaugugacagcuauuuucagggcauuuuauuagcccugcagauuggcauuugcuuggauugcucacaaaaaauguuaaagccaagggccaggcgccguggcucacgccuguaaucccagcacuuugggaggccgaggcagguggaucauuugaggucaggaauucgagaccagccugaccaacauggcaaaacccugucucuacuaaauacaaaaacaauuagccaaguguaguggugcacgccuguaaucccagcuacuugggaggcugaggcaggagaaccacuugaaccugggaggcggagguugcagugagccaagauugugccacuguacuccagccugggcaacagagcgagacucugucacaaaaaaaaaaaaaaaaaaaaaguuaaagggaauuggacaaccaguuauaggagaauaaauaugaucaguacuuucagugauguuauuaucauguagguccuggaggaacaugcauugaggaaggggaagacugcucucucuaagacacugguuuaagugcucuauguauauuaucucacugaauccacacaguaacccuacgaaguagauaugugcuguuguuaucccauuuuacagaugggaagaugaaaguauauggagguuaaaugauuggcagaaugggauucaaacccaagcaaucugacuuuagaguuuguaguucuaaucacuuaguuaugcugcuucagucuaaaaauccuugcaggugugaaaaggauuucacuagcccuuuauuagugguagcugucauggggccaagagaauaacacacaaccacucaaccuaguacaauacagugguucccacuccugacuguauguuaaaaucagcuggagagcuuuuuuuuuuuuuuuuuuuuugagacagagucucgcuccgucacccaggcuggagugcaguggcgugaucucggcucacugcaagcuccgccucccagguucacagcauucuccugccucagccuccugaguagcugggacuauaggcgcccaccaccacgaccggcuaauuuuuuguauuuuuaguagagacgggguuucacuguguuagcaaggauggugucgaucuccugaccuugugaucugccugccucagccucccaaagugcugggauuacaggcgugauccacugcacccggcccagugaagagcuuuaaaaaaaauaccugggccaggccgagugcgguagcucacgccuguaaucccagcacuuugggaggccgagacaggcgaaucacgaggucaggagaucgagaccauccuggcuaacacagugaaaccccgucucuacuaaaaauacaaaaaauuagccggucgugguggugggcgccuauagucccagcuacuugagaggcugagcaggagaaugcugugaacccaggaggccgagcuugcaguuagccgagaucgugccacugcacuccagccugggugagggagcgagacuuugucucaaaaaaaaaaaauaccugggccaggcacagugacucacaucuguaaucccagcacuuuggguggccaaggcagguggacugccugagcucaguaguucggagcagccugggcaacauggcaaaaccccaucucuacaaaagaaauacaaacaaaaaaauuagccagguauggugaugugugccuauaaucccaucacuuugggaggcugagguagguggauuguuugagcccaggaguuugagaccagccugggcaacacagcagaaccccaucucuacaaaaaaauacaaaaacagauuaggcaugguggcgugcaccuauaguuccagcuacuugagaggcugaggugggaggaucacuugagcccaagagguugaggcugcagugagcugugauugugccacugcacuccagccugggugaaagagcgcaacucugucucaaaaaaaacaacaaaaaaccuggaucccaccccagaccaguucagucagaaucucagaguagggccugugcaucaguaauauuuuuuuuuuuuuuuuugagaccgagucuugcucuguugcucaggcuagagugcaguggcacaaucucagcucacugcaaccuccgccucccagguucaagcgauucuucugccucagccucccaaguagcugggacuacuggcauguaccaccaugccuggcuaauuuuuguauuuuuaguagagacgggguuucgccauauuggucagacuggucucgaacuccugaccucgugauccgcccuucucggccucccaaagugcugggauuacaggcgugagccaccacaccuggccagcaucaguaauuuauuuuuauuuauuuuuuauuuuuagagacggagucucgcucugucacccagguuggagugcaguggcacaaucucggcccacugcaagcuccgccucccggguucaugucauuuuccugcuucagccuccugaguaucaguaauuuuuaaaagcucccuagaugauucuuguggauaaaagaagguuggggcuggguacaguggcucaugccuauaaucccagcauacugggaaacugaggugggagaaucccuugagcccaggaauuugaggaugcagugagcugugauugugccacugcucucuagcaugggugacagaaugagaucucaucucuuaaaaaaaagggggaggaaagauugggaaccacgaccuaguaguuaagagaguaaguagaggggaauuaguagagaaggaugagacugaaaacuuuucuucuuuguuuuuuuguuuuggcuugguuuaguuugguuugguuugguuuuugagacagggucuggcucugucacucaggcuggggugcaguggcacaaucugagcuuacugcagccuugaccucaggcucaagcgauccuucuaccucagcagccucccaaguagcugggacuacaaguuuuucuucuuugacagagauuuucuuuucuuuuugcuuuuuuugagagggagucuugcucugucacccagucuggagugcaguggcaugaucauggcucacugcaaccuccccuuccuggguucaagcuauuuuccucccucaaccucccaaguagcuuggacuacaggcacaugccacuaugccuggcuaauuuuuguauuuuuaguacagacgggguuucaccauguuggccaggcuugucuugauuucuugaccucaggugauccuccugacuuugccucccaaagugcugggauuacaggugugagccacuaugccuggccugacagagauuuucaauugcuugggccaguaucauuuauaacguacuaauuccuuguucuaauuucuauuucaguuuaaauuuguggggcuaaagaacuucccuugcacucccgaaagccugugugaugugcuaucuauggauuucccuuuugagguaacgaaaccauugucuuuauugccuugacaugaugauaggcugcagagagacuuaguuacacaaagucuuaaaauauuccuugauugugcugugucaaagcaucagaaugggacaaagcugauucuggagaaaggauguacuugcugcccuucagagccugagcuccacccaugcuggauaagucagaaugcuggcacuggaagggcccuuaauggacagcucguccaacucccucaucuuacagauggagaaacugagguccggagaaacugaggcccagauaggagcaagacuugcaugccuagauccuucuugugugccucuuccuacugcaagcugagacccaggucccugguuuggcugucguggcugcuuguaaagugaaggugcuucugugacugaaugacuccaacaaauguccaaaucccuaauccuuuccucaccaaagaagauggcccuuggggacagcagcacuugcugagcaggagcaugagucaggugaccaccucauuccaguuugcucaggacucgcccuguuuuagcacugaaagucucacagcggcugggcaugguggcucacgccuauaaucccagcacuugggaaggccgaggccgguggaucacuugaggucaggaguucaagaccagccuggccaacauggcaaaaccucguuucuacuaaaaauacaaaaauuagcugggcguauuggcagaugccuguaaucccagcuacucgggaggcugaggcaggagaaucacuugaacuugggaggcagagguugcagugagccgagauugagccacugcacuccagccugggcaacagcacaagacucugucucaaaaaaaaaaaacaaaaaacaaaccucacagccccagaggcuccccaguccucaacagucuugucagccucagaaccugcagcuaccuucucuaggcucaacaagcacauuuuccuuugcccaucauucccuuaaaaauucugccuuggccgggcacaguggcucacaccuguaaucccagcacuuugggaggucgaggcaguuggaucaccugaggucaggaguucaagaccagccucgccaacauggugaaaccccggcucuacuaacaauacaaaaauuagccaggcaugguggcacacgccuguagucccagcuacuugggaaguugaggcaggagaaucucuugaacccgggaggcggagguugcacugagcugagaucgcaccaccgcacuccacugcagccugggcaacgagcgaaacuccaucucagaaagaaaaaaaaaaaaaaaaaucugcccagucacugcaagcauuugcuugaacuggauguaauuuuauauaaggaucacagcuucccaaauaaggaaauggcaaaggcugaguugccagcauuucugggagucaauuaagaaggugguaagaauaccaucuuuauuuauaacccuuaugccccagugacaauaaaugcuuuuuagagaugagucacugaaucauagaaaauaaaaugugggacuguaggaggucuucccguugagaaaaacuguuucccagaacauggcucacaaacaauuuagggggagguuuaggcaaccaacaguagccagggaagcagggcaucuggacagccuguuuccacugugugcagcaaucugcugccccggaggggccuguccaguuccucugcuuuucauuccaugcacagagcucauccaccacaacacagaccccuaagugguggaaaguccguggaaucuggggacagaagaccagaguucaaguugaaguccugcuuccuacucacuguguguuuuaaggagguccucagaacucccugaguaugagcagccccaucucucagacaccgucauggguaagauaguaaaauagugggcaggaaagcacucuguaaacaggaaagugcuauuuauguuuauccuuuccuuuuuuuuuuucuuuuuuugagacagagucucacucugucgccaggcuggagugcaguggugcagucucagcucacugcauccucugccuacuggguucaagcgguugucgugucucagacacccgaguagcugggauuacaggcaugugccacacaugccuggcuauuuuuuugaauuuuuaguagaaauggagucuuaccauguugcccaggcuggucucaaacuccugagcucaagcaaucugccugccucagccuccaaagugcuggaauuauaagcaugagccaccacgcccagccaauguuuuuauuuucucaaauuuaguuuucuaggccauuucuuuauuuagagaaacggcaugugugagaagcugggacucuuuccucugucagugacccagaaaaaggagucggaccacaagagcugcccuuguguguauaggcucuccuggaaacauguggccccagaagucauuugauccucaauuuccccuugucuuauagguagauggacuucucuucuaccacaaacagacccacuacagccccggaagcacucccuuggugggcuggcugcgccccuacauggugucagauguccuugguguagcugugccggcuggcccgcugaccaccaagccagacuaugcugggcaccagcuccagcagauuauggagcacaagaagagccagaaggaaggcaugaaggagaaacucacacacaaggccucugagaaugggcacuaugaauuggagcaccugucuacucccaaguugaaggguucuucccauagcccagaccacccuggaugccucauggagaauuaaagagagaagccuccuuaaggagccacaggaugguaccuggccccaaaaggaauccuggagaggaggacagugacaacaggugacuucauucuuuagagugaacuuuccaaacccaguccagcuggaaacagcuuaucuauaaucugaaaugcuggcucaaacaguuauggggagguucccagauugcguagcauucagauugauuugagcagcuccuacugugauaaguguaucccagauccacaauguaaauauaugugauuuguaagaaagaa

SEQ ID NO: 192057 - RNA, 86405 nt, Homo sapiens
uuagcccugauauuuuaauggaaauacugaccaaguuuacaacauuucaaaugcagaucacacggaaaggugacuaaguacagaauaacaaaugugauuuaaaacaaagauaaccugcugcugcauauaauacagguuggguuuagagcuuggagcucagaugucagacagcaggaggaauaaaaaugcuacuugugaaaacccaggcuguagguaaaacuuacucuuuuguugguugcacugguggguugggacuuucuccugaacuggccuugaaauccuauccugaccugcaggcaagugcucuggacaaaacacugcaggggcagcaacagcuggggcugacccugaucacaccccaccaauuuccccuaugguuccaggucaacaugaccuuucuugagggaacacggggauaggugaauuauuugagaaaaccucaagaucuuuccccuaaaucaguacacaugaccaccgccaagucagacacugccccagcuuugcccuaaaaucucaucccacaaagcucuuuuuggcacccuacacuuuggcucacagucucuucuccccaguacaaaaaaagccuaaaaucaggccaggguggcucacaccuguaaucucagcacuuugcgaggccgaggugggaggacagcuugaggccaggaguuugagaccaaccugggcagcauagcaagacccugucucuacaaaaaguuaaaaaauuagcugggcgugguggcaugcagcuacucaggaggccgaggugggaggacugcuugagccugggaggucaagccugcagugagcuaugaucguggcacugcacuccagugugggucauaaagcgagacacugucuuuaaacaauaaaagccuaaaaucagagaggucuaccauguguuuugaaaauccaggagccaaaaaauuuuguuuuucuuuuugguggugguggugauuuuuaacuaaaaagcaaacauaaaacacacagaacauugcugguuacaacuaagacuugcguaaugguugcugaagaaaaauccaccagaguacugggaggggcucaguuggucuuuguucagaaaguccagguuaaccacauagaaaaauccuaaucauucauguuuaaaugucugcuaguuuaaauuuauguaauuaaaaaaauagguaucccauuucaaauucucucccucccaacuccauuuauaagguauaccacaugccuuaugcacacuuuuuuuucaaacacugguuugguauuuaaguugcucacccccauccaucaccaaugugaauaagaaaaaauauauagaaauacaaacuacauagcuugacaacuuacccaaauauaaaauauuuucagauuauuugaacaagggaaaaaaacacguacuaaaagacuuaaguauucuaagauuuuggaauauuuugauuugggacaaguaacaaguauuuuaagcaaaauccuguuucuacccuggauaaggaacugaagucaaaaucccugcuucacaguauuuucuggugaggacaagggacguggguugagaguuuauuccuuaaguaagaaccaagcuuuauuuauuuacaaaaaaaaaaaaaaaaaaguugggggcaaaggggaagacaaguuuuacacaaaaguacuacaaugguaacucccuuugguaaaaaguguaauaaaugucuuguacaucuguucauagguacuaaaucugaagccacaguacuaugguacacaagaagcuagagcaguuaugcuagcacaucaaagcauauuucuuuuaauaaaaaauugacaguauguacauuauguacaaaaaaacaaguuaaaauugugugugugugugcgugugugugucagagaguaaagcugguggauggcacuaagguagacuaguaaagaggcagauacaaaacaguuccacgggagcuaaaaaggacaacugauuugaacucguugagguugagaaccagaggagagaaaaggguaggcagcaagggaaucgucaggaauaaaauccacaagaugaucaaucccaaagccaaacugcaggucccagauaaaaccuaaugggugaucuuagaugugcucgagugaccagaaaaaaaaaaucaaauccagcuuuuuuuuccuuuuguggggaggggagaggagcagugaccaugauaguuccaauccaucugaguauuaaguccuucuccagucuguuuuguaaaugcaucuccauccagucaaagugugaacagcauccgguucccucauugaaaguuaggccacaggagacuccagucuuagcucugcuggugugugcaagcaaacugcaugucuuugcuugcauggacuuccuuccccuccagggcaggcuauacccaaaacccuuugggaaaaguuccagcuucagcuuuguaagguauucauguuccuaacagguagcccacuuggugccaggcugcaccagccacacacaggucagguggccaugucccagagaggcccagugaggcuugaaaggcaucuuccuuguuucuucagugugugagugcauaggcccacacacacauccccacacacaccccaaguuaucugcucuggcuuugcaguuaaggggcuuugaauacugugccguauuugacacgauacuuguuaaugcucacaaaaugcagggucucuguaucacagguggugguacagggcaccaggcccuccagccccucacccaugagccacuugcuggucucugcugccauuucacggggcacaugcuccuugguccauuuaucuacccaggccuggaaucucugauguagacgcuugcuuacacgcucaugggacugcaaaacagaaaaaaaaaauuuuauuaaaugaagcagaaccaaaaaagagcccuucaaauacaaagccuaauuuucuucuaaaggagcaaaggaaagaugugggcucaagucuuagauaccacuguuuuuuucuuaaaagaaaaaaaaaaggauucucuguuuaaagagaaguuaaagagguaagaacauagaacaugugagggcaugaaaauccauaaagccuccaaagaaaugcgaacacaggcucugggcugaaaaagcucgcuguucucaauuuuagcaugcguuaguauaaccgagggaauguguuaaaaaauacacauuucugaccaggugcagugacucaugccuguaauccuaguacucugggaggcugaggcaggcaguucgcuugagcucaggaguuugagaccagccugggcaacauggcaaaaccccaucucuacaaaaauacaaauaauaacugggcgugguggcacacaccuguagucccagcuacuugguaggcugaagugggaggaucgcuugagccaggagguggaggcugcagugagccaagaucgcaccaccgcaccccagccuagaugacagagccaaacccugucuccaaaaaaaaaaaaaaaaaaaacccaaaacccccaaaacccacauuuccuugguuuaccaaugugcauuuuaaaccagcaauccagcugauucuaauguauccuggguaggacccagugagccauugaucacuucuaucagcauggagauccaccucuaagccagacagugcaaagcaaagggcuuaaaaccacucucccuccacuguguuaccccacccugggaagcagaguccaggcuuggcagauguucugcaggggguucuguucccaccaacacauucaauaaaaauuuauugguguccacaugcaaggauacuagaagagauacaaagacaaaacugguguugcccagugucccaaauaaugugaaucagagacaggcagacacacaacacauagcaaaaaaaaugagccaggugugguggugcacgcccguaaucccagcuacucgagaggcugagacaagagaaucucuugaacccgggaaguggaggaugcagugagcugaaaucaugccacugcgcuucccucagugccaugagagaaguagagcagacucuugaacaacacagcuuugaacagcgcagggccacugauaggcaaguuuucuuccaccucugccaacccugagacagcaaaaacaaccccucccuuccuccucccucuucagccuacucaacaagaugagaauaaggacccuuuaugaugagccacaaccacuuaaugaagaguaaauguaucuucucuugcuuaugacuuaacauuuucuuuucucuaacuuacuuuauuguaagaauauacaguauaggcugggcacaguggcucacgccuguaaucccagcacuuuaggaggcugaaauggguggguuguuugaacccuugaguuugagaccagcccugggcaacguaaggagaccccgugucuauuuucauuaaaaaaaaaaaaaagaaagaaaaaaagaaugcaguauauauaauacauacaacauacaaaauauguuguuuaucaguaagccuuccagucaguaguagacuaucaguaguuccauuuugggggagucaaaaauuauacacagauuugacugugcaggggccagugccccaaaccccuugucguuaaaggguuaauuauacauuaaacugucugcucaacaucucccauuugaaaguuuuguaguccuuucaaacuuaaaacagcacuucaucugucucccaaaccucauaacccuuuccuauuaacaggugagccccuaaaaucuccacuuaagcaaaacaaaacaaaccaaaaaaccccaaaacuaaucaggcaccauccuugauguccuucuuuugcuuacccccacauuugauccaacaccaucucuugucaauuaaauaucuaaauaauaucuacaucugggcgugguggcucacgccuguaaucccaguacuuugggaggcugaggaggguggaucacuugaggucagguucgagaccagccuggccaacauggugaaaucccaucucuacuaaaaauacaaaaaaucagccaggcaugguuugagacacagcgaaacucugucucaaaaauaaaugcauaaagucuacaauguaauucuugcaauuccacugccacccuaguaguacggguggcccccacaucucauuuggacaagggcacccuuuugaguggucucugcucuuccaacuuuauauauacccaucuccacuguccucacagaacuccaagcuaucuuugucaaaugucccagugcaucucaaacaaauuacaaaccauggccuaucauuagacaaagugauguggccucugccuacccuucuaacuucaugcaaccuugagccacaaugguguuuguaauuucuugaauaugccaaguccuuuccucccagccuuguacuagcucuuuugucuagaaaacacccauccucuacucuucaccaggcuaauuccuugucauuauucaggccucaagcaucaccuccuuugagaagccuccuccagugaaagcaaggccuguaugcuaguuacccuugaucacuucaccugauuuguuucccugguagugcauaucaucgcauuacuucaucugcucuacuucauggcuguagucccagggccuggcauaacacccuauacgcagcugcaccaggaagguuucacaauugagacagaauguaaagacagguaggauucauacaagcaaaagaucagauacuacuugagauguaaauacugggaguaaauucaccaaaaaggugccaccggguauuuacgugcucuuacaggcugaacuguauucuccuuaaaauucuuauguuggccgggcaugguggcucacgccuguaaugcuagcacuuugagaggcugugucaggugagacucugucucaaacaaacaaacaaaaaaucauacauugaaguccuagcccccaguacuuccgaaugugaccucaucuggaggcagacacacacacacagguaggaacaccauaugaagaugaaggcagggaucuacaagcccaggaaugccaaagauugccagcaaagaaccagaagcuaggagaggccuagaagagauugucccucacaguccucaaaaggaaccaacacugcugacacuugacuuuggacuucuagucuccacaacuuuugucauuuaagccacagucugugguacuuugucacagcauccuuagcaaccaacauacguacuuccucaguuaagucucagcuccaagaacagguuugcauaaacaaagaaaaacaaucagaagacucugggccuccccugguccuagcuagggugggagauguguacagaaauuucaguuacugguucucaccugaugagcccggagcagggcgguccuccgauacauauaguccucugauuugaucacauacaccaucuuguaggaauucagcuugaaucuacacuccagcuuauccagacuauccacauucuccauggucuucuugcuguuuccuuccuucccuuccuuuuccugcugcucucgaccacguugacacuuccggauccgccguagauuccuauugcagaaaagccccggaggaugagagcucguccagaugcagauucccgugacuuccccaaagugaguuuucuuuauuauaugcuugcauaguacucaucccaauuuguuaaauacauacacaaauguucaguuguuucacugcaaaaaaaauuucaacugcaaagguacacagaauaaaaagcagaaaucuucacccauccccuacuugacuuagcagauguagccaguuaagaguuuuaaugagaaacuucuaggccucugucuguaaauuuacacauguaauuaccagcuacaguucugcuuugggauuuguuuuuaagacaaaauaggaucauacuauauauuuuguccucaacuuuucacuuacugucaugaauauuuuuucauuucaugauagauuugucuuauucucuuuaacugcugcagaaaaauguaccccaauuuaccauuccuuaacaguuucuuucaacugagguuccucaucugaaccacauaacaaaaauuuauuugaaugacuauuuuuaaaaauucccccagaugauauaaacuagugccauucuacauacacaagaaagaagauaauucacaugaauggaugcccugaggggugguaggcuugcuaaaucucaacauccagugaaaaaaguuaucagcuagacaauuauauuguuucucauaacuugcuauuaaaaacacugcuucagguuggccacuguggcucaugccuauaaucccagcacuuugggaggcagguggauugcuugagcucaggaguuugagacuagccugggcaacauggcaaaaaccccuucucuacaaaaaaaaaaaaaaaauuaggcagguguggugacgugugccuagagucucagcuacuugggaggcugaggugggaagaucguuugagcccagaaggcggagguugcagaaagccaagaucccaccacuguacuauagccugggacacagagccagacacugucuuaaaaaaaaaaaaaaaaaaaaaaaaccaaccagcccaaaauauugcuucagugagaaucuuuguauacaaguauuucuguagacagcaguucuuuguccaaagggucccaggacccuuucaggagaucugugagaucaaaacuauucucauaauaauacuaaaacauuauuucccuuuuuugcuguguugacaucugcacuggcaccauuaaaguaauggugaacaaaaaugcuggugguggcgccaaacuguauuugcaauaucgaacaaauuguuaccaaauuccaauaucaauuuguacaucacugagcuuuucauacaguugucaaacucuguugguuuaucuuguaccaucaaugaauccauuuuacuuccaugauuuugcaccuucaugcgacugcaauucaagucuuugaacuucacacugaccauacaaugacauuaagugaaaaaagccaguuucacuuaagaauguuucugaugggccagucacaguggcucaugcuuguaaucccagcacucugggaggcugaggcaggcagaucacuugaggucaggaguuugagacuagccuggccaacauggggagaccucaucucuaauaaaaguacaaaaauuagccgggagugguggcgcgcaccuguaaucccagcuauucgggagggugagacaggagaaucacuugaaccuggcugguggaggcugcaguaagccaagaucgcgccacugcacuccagcuugggcaacagagugagacucugccucaaaaaaaaaaaaagaaaaaaaaaguuucugaugaagcaguaacauuuucuauuaaaucccaaccccucaauuuacaucuuuuuaacaugcugugugauaaaaugggaacuacacauaaagcaccuuugugugcuaaaguacaaugguauucuuauagaaaagcacuugagcaauugcuugaguuguaaguggaucaucauuuuuacccgaaagaacaacugacuaaauauagucaaucucagccaaguauuuggcagauguuuucucaaaaaugaacaagggagccuaucacuucaaggaaaacaauguugccaaugguaagacuggaauuuucaagcaaaacuaugaauuuuggugaacugguaucagccacccugagcuugacagcuucccaauacuuaaagauguguuugaugaccuagcgauagcgauauuaaaucaaugugauuucuuuuggagacacuguaaaauauaucaacauuuaguagguguguauaacuuauuuuccaaauagccaauugcguaaaguuacaaaaucauagaggaaaaaaagauucauucaugauacaaaauaaaucaauggauuuuuacaacugcaugaaaagcccacugauguauaaauugauauuccaacuaaccuuuaagaaacuaucacuggggccgggugcaguggcucacacccguaaucacagcacuuugggaggccgaggugggaggaucaccugaggucaggaguucaagaccagccagaccaacauggagaaaucccaucucuacuaaaaauacagaaucagccgggcgugguggcacaugccuguaaucccagcuacucgggaggcugaggcaggagaaucacuuaaaccugggaggcagggguugcagugagcugagaucacaccauugcacuccagccugggcaacaagagcgaaauuccgucucaaaaaagaaaaacaaaaacaaaaacuaucacugguaguuuuguugucauaucaaagaauauccaguuaucugaaggaucugaaaauauuccuuuuuccagcuacacauuugcgugaggccagauuuucuucacauauuucaaucaaacaacauacauaaugcaacagauugaauauagaagcagacaugagaauccagcuguucuucugguaagccagacacuaaacaaauuuauaaaauauaagcaaugccacucuauucacuaauuuuuguuuugaauuagcuuuucauuaaaaaauauuauuuaagaaaauauaauagggauauauauauauauauauauauuuuauuuuugaggcagagucucacucggucacccaggcuggagugccguggugcgaucuccacucacugcaaccuccgccuuccgguucaagcaauucuccugccucagccucccgaguagcuuggacuacaggcgccugccaccaugcccagcuaauuuucuguauuuuuaguagagacaggguuucacuguguuagccaggauggucucgaucuccugaucucgugauccacagccucggccucccaaagugcuggaguuacaggcgugagccacugcgcccagcccaauauuguuauuuuucaaaugaauuaaagauugaaaacauuucuuuguuuuuauuucuaacuugguaaauauuacuaguauaauccauauaaacaaaagcuuuuuggaguacucaugcucuaagaguguaaggggucucaaggccaauaagaugagccccuuagcugucagacaaaucauuagaaacugaaauucuggagggaagauuccauacacuucaacuacccugccaccagaacgauuauaucaauuuccuuuuccucacaguacauaaaugugccuccuuccucauaucauggugagagacacaugaugacagguuuauuguaguauguuauuagcauggagccuguuuuguugagaggaaccugacacagagcaacugcucaaauguguuaaaugauucaaugaauggagaacccggcagggcccuuuuugcugguaucucuuuucccauguucucauuaggacucaauaagucuaauaacacugggaugauacuuucuuggaaaccuaagacauaagauuucaauucaaaacuuuuaggaaggaagaaagccauucuacccauuuuauacuucuuaaacuguuuucauauacuuggaggaucaguaucacaaucugccuauacacagagggaacauuuuuaaaauucugugcagaaaagaguuaauguagcaggccuaagauugcuauucuuugaaaagccugcuuauaaaaguuggcccuuggcugggggcugggaucuuggauuuugggcaauguucuaccauuccuuaacucauauaagugucucacuguaccuaaacuauuuguacaaacucuauagcuuaugcugaaaaugugcuuucuuucugagaguuugggauuuugguacaugcuaggcauacagugccuagaugacuacaucucaauaaaaauccuggcacagagucucuaaugagcugcccugguagacagcauuuugcauguguugucacauucauuguuggaagaauuaagaguguccugugugacuccacugggagaggauucuaggaagcuugagccuggcuuccuccagcuuugccacaggcaccuuuucgcuuugcugauucugcuuugcaucuucucgcuguacuaaaucagucugacuauaugcagaguccugugaguccucuuccaucgaaccauggagacucugacacacauucccauccaaaguacggagguuauuguugauucucuacaacucucaccucccagaugcuuugacacaugcuccagguaagcucauguugugacagccauauaaaaccuugaauuagcauccccagcagauagaacaaaugaauaaaauaugugaaggccaagaacgugaaagucauuuaacucuccauuccucaaucaugcacaguauggacugcugacagaugacauggcucacucaccuggggagaaauacugguuucugugcuagauguucacgaagcucaggcgagguaguaucugaauucauguaucgcuccacguagucugaccagcgcuaagauggcaaacacaaaauacagguggaaggaaaucacaaaaacagcuccuaaugcauugggcacucuaguaaauucuaugauuacaaugccccgaauucauaaauuucaagaucaaaaaagucccuuucuauaaagacaugauuguuaguagguauuggaacacggauuaaaaauucuguuagccagcaauacugcuaaguuucugaggugcuaagguuaugagaagucauaaacagguagaagcuggcucacugacaaguuucauuuccccacagagcauuuuguuaaagaacaaaauuuauaguggcaaaugugugaaaguuuccuucacauuacaaucuagauuucugacaucgcuuaaaaaaaaaaaaaaaaaaaaagaucugccaacaagccaacauucccaccaaaacaagucaucccacacgaccccccccaacaucauacauauggccugcaucuccuguguacauuaucugccauaaccaacuaugauaaucacaccugucuauucagggguugaaaacucuggacuuuaucaguccaauaaaaaguaaacaugacacaaagaaucaagaugacaugagaaagaccucauuuguuguuuuuuauacuuuaggaaaaaacaggaaagcugccaaccauaagacuuccuuagaggagauagcuuuacuaagugcaagaugagguuaacaucuauaaccaggcagcccgucucuucagcugaagacauggcuggauugacuuguacuuuaagcauccagguccugacccuuaaacaggccugaggugccuuggccuuuuggcagacagggucacuggacagacucucaaggcacgccagcucugcuuggcaccuggggucugugauguacuugcucauaccucugcuuccacagggucauccgaauucuccucuucuguguccagaagcucaauagucagcuggaccuggccuuggcucugaauaaacauaagcugcaaauaagaaaccuaagcguaaacaaaagaccgucucuguagcuguaaucuaucuucucaaggaaugagaggugcagaggcaauaaacuuaguaaacuuugcuccaacugaagagaugaggaagauacuagaucuuggguggccagugauaaaggcaaaagucuacacuuacuacaaguaaaaugaaauauauuaaagcaaaagguacuauuucauguuucaaacuucuagaauucgcuaaaauaauaaucaaugucaguaagaauguuuuacaaaacaaauauuuugucagaaagaaauauggcacauguagccagaaccacaaaaugucaaugcucuguccauugguaaucccacuucuaggacguaauagaggagguaacuaucagaaucacauggagaaggucagagccuggaaggaaaccugagaauuuuuuauuucaaccuucuucauuuuacacagagacaaaacugaaauucagaagaguucugguuucucaaggcacaccacuaaucaauauacaugcagagccagaagcuagaucuagcucaguguucuuuuaaagcuuuaaaaauugcucucugcuaguaaagcuuacaaccugacaauaacauaauauauacacacacaaauacaguuauuuccaaaauagauuucggggugggggcagacccugcauuuucacaauuuauaauuuaagaauugcaaaaucugucuccaguauucauaacaggaugucauuaaccaguccccauaguggguuggacgucuaggauguuuccaacuauuugcuuuuauaauuauccauuauaauggugaaaaauuggaaacaaccuaaauguccaccaauacaggcauuaauucucuaaaaagugaauaucaaauagccauaaaaaagacaauaaagacccagaaguguuguuaauugagcaaaaauacauuaaagaccauuuccggucagaugcaguggcucacaccuguaaucccagcacuuugggaggcuaaggcgggcagaucacuugaggccaggaguuugagacaagccugcccaacauggugaaaccacaucucuacuaaaaauacaaaaauuagaccgggugcaguggcucaugccuguaaucccagcacuuugggaggccaaggagggcagaucaccugagcucaggaguucaagaccagccugaccaacauggugaaacccugucucuacuaaacacacacacccacacaagcuggccaugguggcacgugucuguaaucccagcuacucaggaggccgaggcaggagaacugcuugaacccaggaggcggagguugcagugagcugaaauagcaccacugcacuccaagccuggacaaccuggacaaccuggacaacaagagugagccuccaucucgggaaaaaaaaaaaaauuagcuggacauagugguacaugacuguaaucccagcuacuaggguggcugacgugugagaaucacuugaacucaggaggcagagguugcagugaaccaagauugcgccacugcacuccagccugggcaacagugugugucccugucuuaaaaaaaaaaaaaaaaaaguuaaagaccauuuuguccaguauaaacucuuucaaaauauauacucaagcauagagaaguuuagaaucauagagaugucaucaaugauaauuucaggaaagaauucuaaggugacuuuuuuugguuaucugcauuuuauuuucauuuuuuugggacagagucuugcucugucacccaggcuggggugcagugacgcgaucaggccucacugcagccucgaccucccaggcucaagcaauccuuuuuuuuuuuuuuugagacggagucucgcucugucucccaggcuggagugcaguggcgcgaucucagcuuacugcaagcuccgccucccggguucacgccauucuccugacucagccuccagaguagcugggacuacagacgcccaccacuacgcccggcuaauuuuuuguauuuuuaguagagacgggggcaauccuucuaccucauucuccugaguagcugagacuacaggugcacgcuaccaugccgggcuaauuuuuguauucuuguauuucuugcagagaugggguuuugccauguugcccaagcuggucucaagugauccgcccaccucggccucccagugugcugagauuacaagugugagccaugugugcugggccuauguuuucuuuucuauaaugaucaugaccauggauuucauguaccaacauuuuucuaacaauaauauuuacaaagcauacuaugaaaaauguucagagaaaaagaauacaaaauuguaaaaaucauauauaacuaguuuuuuuuuuuucuuuaaaggcaggaaagaaacaaaguagauuguccaggaagacaauuacuuccacuuuguaguucucuggugaacucauuaaaagguccaggaguagaaucacaggucaaaguaccccggcuuuaacuucugguucagagaauccuaacaacugacauugucaccagcaaggucuucgacuaccugaccaacucucaccuuaaagcaauucucaucugacauuagcugcucagcuuuccgcugauacguugacuccaggaggcuccuugaguucuguguguucagcuggccuccgguggccccauuauuauuuucugccagguaaaggucagucaccugcacacagaucucaucacucacgauaugcugcagcuggaagcaaacaaaggcaagcuuuuagugaacacagaaaacauuucuccauuauacagucaacguuccuuugauguagucauucaacuccaaaaagguuuuucuuuuuuugggggggugggggggugcuggcaauuuuagaaaauuaaucacacaaaccacuguaucauuuucuuggagaauaaucaagccaggauuuucaaccauaucagugguccaugguaaaacuuuccuaucuauuuaaaauaagaaccauagagaacucaggauaaucguacuauuuaaaauucuaagcaucuuuaaauaauuuucuauaggucauaucuuuauugcauuuuaaaaucauuuacaauuggcucucauacauauucuuucucauuugaucuucacaacugcccugggaaggcaagcuagacagagaguuggggccaguuaggagacaaauuuacacaaugcaucagaaagguggcucacgccuguaaucccagcacuuugggaggccgaggugggccaaucaccugaggucagguguucaaaaccagccuggcuaacauggcgaaaccccaucucuacuaaaaauacacaaauagccgggcgugguggcaggagccuguaaucccagcuacuugggaggcuggggcaggagaaucgcuugaaccugggagauggagguugcagugagccgagacugcaccacugcaaagcucaccgugagcuggggugaggaagggagccuuggagaaucaugaaugcaguaucuaugucuauauucccaggccaacuacaaagccugaaacucauuaaguauuuaagaaauagcugcugaauuauugcccaggggugcucagcugaagaaggaggguugggacuaaaagucaagguuccugacuccuagcccaauacuuuuccaaacacaucaccuauuuuucuguaucugauagaaaguauagggcuuaaguuguacauaaaguuaacucacuuuccauacaggccaaucaugauugacuaucaguagcuuuugugacaaucuuaggaaacuaaugacuagaaaguugaacguuucagaguucccauucucaugucaugcuauuucuauuuugaaauaaaaauccuuccaaaugaaacuuuaucaucaaaaugacagaagugaaaaauagauacaagaagaaagcaaaacguuaauuucaauauugauuugucuguuuaaaaaacuuuaagaugaucauaaccaccaagccauucuauuuuuaggaagacacauucuuuuuaaguguuaggaaccaugauaacuauuuauucuuaaguccuaaaugaccaguauguguauuaguagauaacuggacacagugaaaggucagaacggugacugaguguggcagaaagggcaguaucuccagcaacuacagauggauaaauaaaucacaaugaguccagauaaaggauucugauacaaccauuaaaauaaugcuuaugaguaccugauaucaugaggaagauuaagauacaguguuuuaggagaaaaaagaaaagguggaaaaaaacagauggaaagcaugacuucaaucauacauacagaugcuuccacuuucuacuuucuuuuugagacagagucucgcucugucgcccaggcuggagugcaguggcaucgugaucuuggcucagugcagccucaacuuccugggcucaagcaacccucccauaccucagccucuuaaguagcugggucuacaggcaugugccaccacgcccagcuaacuuuuuuguauuuucagaagagacgggguuuugccauguugcccagucugaucucaaacuucugagcucaagugauccacccgccuuggccucccaaacugcugggauuacaggcgugagccaccgccucuacuuuauacuuucuuguugaaguagacuguauuacugauuccccacccauacucucuuuuuggauaucuggccccuccucgagucuucagaaaagacagcacuacaaauccagagacagcuacggaacucccacccccacugcuaagcagaucagauucucuaucuugcuaauuggagaugacagagaggguguucaauagauuuuuugaggaggagcaucuguauggaaaggucuaguaacacugggaccagggguacugggagggcaagccaaagccucagaggcuggaggagccuggagcacaugccguauguucaucugcagagcaaagcacaagcauggagcagaaguccagagugaaggcaugcaggagagaaaaaucaccucccagcccaauccuuccauggugugguccuauuuugaguucuguacuuggaugucugugagguugccuauuguauucuuaauacaaaucccucuuaagccagccuacaauagguaagauaaauguaauggcuucacuuggcuggaaugcaguggugcaaucacggcucacugcagccucaacuuccuggguucagaugauccucccaccuuagccuccugaguagcugggacuacaggcaugugccaccaugcccagcuaauuuuuuguauuuuuaauacaaauaguguuuccccauguugcccaggcuggucuccaacuccuggacucaauauaucugcccgccuuggacucccaaagugcugguauuagaggcaugagccaccaugaccagccuugacuuugaaauauauguuguacauucagucagcaguggaaucugagggaacaccaaauaugaggagaaugagagaagagauaccuccaguuaaaggaguugagaagcuugaaaauguuuuaaaaagucacuguaggcugggcacaguggcucaugcccguaaucgcagcgcuuugggaggcugaaguaggugaauugcuugagcccauaaguuugaggccagccuggacaacauggcaaaacuccaucucuacaaaaaauacaauaaauuagccggugugguggccccuuuggucccagcuacuugggaggcugagguaggaggucaaggcuacagugagcugaucacaccacugcacuccagccugggcaauagagugagacccuggguuggaaaaaaaaaaaaaaaaaaagucacuguuuugggguuuucuggaugaaaccuguuuccauuaaaaaaaaaaaaaaaaagcgggggguggguggagauaguauuuauuacugauucaaaaucauaaccagauacaguaaauaauuguaacuauuguuucgaaaaccaaccucagaauuauuaaaaguuaguuuuauuggauuuuuuuuuuaagcugugcuggugguaugaaagacuucguuccuagcugaagcagcagcaagccuguaaucagcaacauaagcacaggguaacuggagucuguauuuuauauaaauuucagggaaguuaaggaagauuagucugaaaaaguaugacuaugggugacuauguauccaucuaaugauuucugccaguuaccauccagaccucuuaugggaaggccuaacaacuucuucaacuuauuggaaacaacuaucugacaacuuucccccagauguuaagguucauuuauaugaagggcucuuccucaauccuguguagauacugugggaggaguacagaggcaugcacccuuccaaaaccaaggcaaaagcauggguacuuugcaaagaauucaauauuuuagcccaagagaacauuaagcaacaagcucuuuccuucuacaguggcaguguggauucuagaauuagaaauugcuuuuuacaaguuuucacuuaaguacuucaccgccuuucugcugagcuauucuauggaagagggcuguagguagccacgguacccagguggaacagcaugauccuaaagcccuacuuccacaaggaaucgcaguggcccauggccacgugguucaaccagccagcccagaagaucugcagaugcaagcaaaaguauaccacauugaccugcacccugcaucuggacccaucugacccaugguaagcugccccacagugagguaccacaccaaaguacaagcuggcaggggcuucagcuuagaagaguuaagggugaccagcauccacaagaggguggcauuaguacaccaugucccugugggccaauguucagcaccugaaggaguuaagacuccaagcucaaccucuucuccaggaagcucuuagcccccaagaagggagacaguucugaaaaacucaaaucagccacccagcugacaggaccaauaaugcccauauaguacgucuauaagaaggagaaagcuggaaucaucacuaagaacuuuaagguauuugccagucuucacacagcccacaucaauuuucagcucuuuggcauaugggcaaaaagggccaagggagccacagaacaggaugcugaaaaggaaaaaugaagcccugcuggggacuugcagucaaucagcaguagagcugggucuccagaaaaagaaaaaagcaguuaaccaacaaucucucugggaguucagaacucaaguccaagaaguagaaaugugacuaucuguuacaagcuauuuuuuauaucauuguuguaaagaacaacauguuuacaaguucccagggugccacaggaagaacacacaaaaccaaccagaaaccuaacuuagagggaaccgcagaugagugaggugggcagaguauuauaaaagauguuaugugaacccuuucuuauaaaaagaauuucaaauauuaaacaaugcaaguacauaagaguuaccaacaccuugaccaggcgcaguggcucgugucuauaaucccagcgcuuuaagaggccaagacaggaggaucacuugagaccagaaguucaagaccagccugggcaaaacagugacacccugucucuauuuaaggaaaaaaaaaaaaaacuuaccaacaccuauggaagacgcaauguuccacacugugugcuuacccauggcagacaagguaagagauagacaaguugugcaggaagcuggggucaggaccacugcacucuacagguggccagcaagaaaggauaugggguaggcaggcucauacacugcaacuuuguuaacaugagaaaucaggcaucacauuaaccuccccuccucucuucagaacccuacguucauaaacacuguuauaugaaaaaguugccuuuccuuuuccuugcguggcccaucucuagguaaggauuucuucccuuacucacccuagccuccuccaugcccucaccugucugacaaugcucuggaucaguuuguccaugguaaaggcaauguaggcaugaauggugaacaucucucucagugaaucuucauacugugaugagucuauguugccauccagcaggcuccgcaccauguccaggaaagcuggguaauaaucuucuacaucaacauccacugugggagagaugggauuggugaggccuuaccuugcuaagaaaagacuagggauagaguacagggcaaaucccacagcuggccuaaauggcauuugaaaguaugaacacuagguauucaaaauauacucacucauuccaauguaaacagagaugaauuccgacaggugacuacaaucaccagcacuaucagagugacucugcaacuuuaacaguggcuucuaauauucugacuaccaugcuagaaagauacuucuuuaugguacugcugggccacuuucagagaggaaaauauccuagggaagccaguccuucaaagagcuguuggcuccccugcugagagaggaaccuacucucccagccugcacaagagcauuccucacaugggucacuugcucauaaagcuauuucaaugaagcauaaaguacagaugaggaaaggcagacacagccauacuccagcacugggaaaccucuugggaacacaaaaauaggagugcaaauuaaauccuuuaugaauaaugaaguaaucugcauuugucaaaguccuuuuguuuaaaaauggauucgcuacguuguauuucacaaauugcauuaaaucaucuguaguugcugcacaugaaucauuucaaucacuagcuagaauaaaucucaucaguuguuaaagacauuuggcaacuagcagagggcacaaggaguauuaaagagugcugccuuuagcuuacuaaagacccauuuauauaaaguucaaaaauagacaaaucuaaucucuaguguuagaaaucaacaaaguggaaaaaggacugguuaucagaguacugguuauguuucguuucuugaacauagguacgucuagucuguaaaaauucacugagcugcacaauucugauuuguauacuuuucuauauauacaugccguaccuuauauguauuuuuuuguagagauggggucucacuuauuaaccaggcuggucucaaacuccuggccucaagugauccucccacaucggccucccaaagugcugggauuacagguguaagccacugcacccggccuauacauugcacuucaacaaaaaguugacuaaaaugaaaaaaguuacaaaacgaacuauuugucacugacuaauugguuacuugcuaguuguguuugugcuggagaaaaaaggcuaggagcaaaaccaaguugucuccauuuaucugaagucugacgaauucauuaaaaaacaggcaaaacaggacaaauacuguuuaaaagaggcaacuggcuugaguuucaucacagacuaucacauucuuuagcuccauagaauagguauaggcuauagacuccaaaauauaccacugcuaugaaaacugcuuuuaugccagaauaaaguuuugaguccaaaccacagauuuguccaaacaagcugugguaagugugaggguuggcauuaucagacaagacaacauuauguaagccucaaaccagguuaagucaguggccaagccaggaauaggccauuuaauuucuaauuucuacccaaguagauggaaucaccacaaugagaucuaaaauuuaucucuuucgagcuaggacuagucuagauaaaagcuuucagaauuauuuuucagugucauuagcuccucaacagauagaaagcuagggccauaucugggcuuccuacaucagcaacacauaaaaaaaaaaaaaaagaagaagaagauacacuccucagguuggcuauuuccuuaagagcccagaagaaaugcuucaugaaaaagcuuuuggcucacagcucaaguaccuaauuuaugacgugaacuggaagcaggcagcacaaaauuacauaaagcacaugacagcguccugaacccucacuuacuuuccuuuuccugaguucuacaucuuuaucccuguccugccuguucuccaugucucauaucaccuuuugaguuccagucuccuuuccauaaacuauuucuacauauuaagaaugagccauaaaccccacugguuaaacagaaguccugcucaaaaauaugagaaaauucuguuuuaagcacuaggaauuuauguucugucauggauugaaauuggcugugacaguuuagucucuaucuguacuuugaaacagauggcaguaacccagaaaucugccauuugagaaauuaacugugauacccccuucccaggugcguccacaguaccaaccacugaccaaguguccaugaucuaagcccugcauaggauacuuugcacaaagcaacaccacaagcaacuagagccuccauuuuucagauaaacagguucagagaguuuaacuacacagacucuaaugccugugcucuauuaauaaaagaagcagucccaagucuagguggcucuaagguccucaaccucacacauccucuguaaaucagaggucucggcacucacuagguucuuugagacguagcugaauggcagggcugucacucuugucucgcuuuaugcccagcacuucccguucccauucucucucucgguuuucuucuucaauuugccguucggcuugggaacaaauccguagcagccucaggcagagaaucuggugcagucgcauaaaaauauaccaguuguuguugacauagaagagguuguauacuucauccauuccucuuaauuuuugagcugcuguguuacuaaacaguaacuuggacuuagggggacugcccccaacaccauugugcuucuuaacugccccuguggcuucaucuacauccaucucuucuucuuccucuuccuccacaucugagagaucaccucuuugggcaaagagcaaaucuggaauaaaaugaugcaugauuuguuuuaucuuauauuuguccuccuucugaaugccugucugccucuucacaugguggauaaucagagcagcagcaucuuccaguauuuguuugucuucauacgcaagugagaggugugggccaacagguacaccagcauucuccuccguagccugcucuugccucugaugggacagagacacaaaaguauucugugagaugucuacagcgacaacaugucuacaagaccacaucagccauacaucccauuaucaaccacagugucuauauuuuucuaaucaaaaacuuaggaccugggacugggagcgguggcucacgucuauaaucccagcacuuugguaggccgaggagggugaucacuugaggucaggaguuugagaucagccuggccaauauggugaaaccccgccucuacuaaaaauaacaaaauuagcugaacauggugguaggugccuguaaucccagcccuugggaugcuaaggcaagagaaucacuugaacccgugaggcaaagguugcagugagccgagaucguacuacugcacuccagccugggcaacagagugagacucugucucaaaacaaaacuuaggaccugacuauaacaauaauuuuugucccucuuccagaaacaaauagguaaugacagagacgugguuugaugucaaaauacagguaccuucuacacacugaugacuuacagggagaguaggacagaauuggaaccaucuuucuuucuuuuuuuuggcagggucuugcucugucacccaggcuggagugcaguggagcaaucuuggcucauuguaaccuccgucucccggguucaagccauucuuaugcuucagccuccugaguagcugggauuaagaagugcaccaccaugccaggcuaauuuuguauuuuuaguagagaugagguuucaccaugucggccaggcugguuucgaacuucuggccucaaguuaucuguccaccucagccucccaaagugaugggauuacaggcgugagccacugugcccagugggacuaucuuucaaaauucuggauuaguaucuauauaaaggauaugauaugagaucugugauuuacuuuacuucugggguggggguauggagggugacaaaguaacaucagcaaaauauggaggauuaaguuuauuuauuuuauugauuuugagacggaaucuugcucugucacccagacuggagugcaguggcauguucucagcucacugcauccuccaccucccagguucaagccauucucccaccucauucugccgaguagcugggacuacaggugcacaccaccacgccuggcuaauuuuuguauuuuuaguaaagacgggguuucgucauguuggcugggcuggucucuaacuccugaccucaggugaucugcccgccucagccucccaaagugcugggauuacaggcaugagccacugugcccggccugauuaaguucacauaagagcucauuuuacuauuuuuaaaguucaggaucaccccacuccaggaauucccaauugcacugcauuuauguuucuauccaucuccuaaaacugagcccacggaaaccaggauuuauugcuuauucaucucugauccuagcuccuaguacuauuuauaguccugguaggcaugcugaauaagcaaggauuacaaagaguuugguggucaaugacaaauuuugaagcuguaaguaaggagagaugggacuauauggauacaagguauuauuguuugaaggaaacagguagucggagaaguggaaaauggaggcaggagguauaaguugaaaccaggacaguaaacuaggaaacuagucaaacagcuuagguauaaagguauaguuuagauuuaaaaugguagaaugaggaauagaaaaggcuaugacagcuaucaagcaagaaucaacaggucuuagagagucucaccugcauuuaacaaagguaauuuccagaaaucaaagcugugcuaaauauagacuagaguccucucacagaugcagaaaccccccgcucaccucaucauagauacucucaaucucauugaguaagcucuuagaccucaggaccuuggugucauucuguuuaaaguugauccccuggugguccagagacuucaaguaguauuucucauuuuguucucgccauacuuuguuaaagccucucugagcuucucgccauucuuccucuuucaucuucaaccuagugaagcgggaagggauggaaacaacacaugggaauucagaggguuuagaagaaagaaauuugccaggcuuacuuuaguuaaagaaaggugcaaagcuauauuaggucucucaaaauuacuggcaacuugggaugcuaucaaaccagucuugaacucuguuucaugagggaauuacucauccaagacuuacuuugaggaaaugauuuaucucaaagucaaauaauuuaccuagaaugguuacuuaaaaacagcauuccagggaauaucuuucagguauaaguauuccuugaaaaaaagaguucuuguuucuuugcuauaggacuuugcaaaacguucacaaugcuaauagaaacacagaaguccaagacaagagaacuugcacaguuauguuccucuggauacagucaggaaaguucugaucagaacugauucuaauaacccagaagagaacagacuaagacaaaaaaaagcacuaaaacugaagaauaaccuguaucucaaaagccagaaguuaaaugcuacaggcaagaagaagaaaccaucaaucugugccagcucuugaggggaagaugagggagaagaaaccaucaaucugugccagcucuugaggggaagaugagggaggacaaaucaaaucuggguauuugugaacugugcagcaaauaagaauuaauuuuuaccagaugauacugagagagaaccaagcuccuaacaaaggauucacaguguggucaauaaugacauggggcugggugugguguggcuugugccuguaaugccagcacuuuggggaggccaaggcaggaggauugcuugagcccaggaguuagaggccagccugggaaauauagcaagaccucaucucuauuaaaaaaaauaaaauaaaaauuagcugggugugguggcacauuccuguagucccagcuauucgggaggcugaggugggaggaucaccugagccugggaaguugaggcugcagugagcuguguucacacuacugcacuccagccugggugaaagagugagaucuugucucaaaacaaaacaaaacaaaaacaaacaaaccacaaagauguuaacaacaguuaguccugaguguggcaggaacaugggugguaauuaucuucuuuucuuuucuguauuuuaaaauacucccccaaacauacacacagagccuuccaccaugaacuuacaagauuuguucucuaauguugguuacacaggacccccaaaagaaguuccauucugcaccugaauuccaacaaccaggguuggggagaaagagaggucucaugggacaaccagguugaaaaugagagccuuauuuaaugagacacugaaccgguagugaaguacacuaaagcacuaagggcacauuugcucauguaccuuuuaaggacaauuggaacagcaauggagggauucuuucucagaccaucaaugaugucagcugcuuuaucagcauauauccucuggagugcuuuucuauggaugacuucugaugugcccccaaggguguuguccaagcgaaauuuggcuuguucuucagcagacaagcgggaaagcuucuucuguauugcuuccagaacccggauuguugccagauuggucucuaaaacuacaucaagcugaagaggaagacaaagaaggguaugcucaggacccaaaucaaaauagaauagaguaguguuuagaagaauaagguagggagucaaacuccuuggauuugaauccugguucugcccuacuagcuacauaagacuguuucuuuaucagcaaaauagggauaacagcaccuauuacucucacaacccugugucuggauuaaaugauacaauccacauaaaguauuuagcacaauaccuggcacauaagaaccacaggaugaaguuggauaaaugguaguuauuaccaccaccgucgcugcugccgccaccaccaccgugugcuuugcuuaggacuacugauuuuagaccagaggaaccaaacaggagaugacuuuacugaaacguuucccugaacuuuccugaauugcuaagauccauuaugaacaaacaauaacaaucaaaacaaucccaaaagaccgcuuugucuugagaguuuuuugguuuaacuugaaauauuuaaauauauucaaauacuuaaauauucaauagccuuguuccacauccaguaauaauaagagcagugacuaucauaacuuaaggaguucacuguuguagcugcggguaaccauuuaaauucuuauuggacuccuggcaaccuuugagucuacuuuuucccuagcuuaaaauaagguucucuaaaugagaaacagaaaaugaaguaaaugagcagucucaacggucuacaaccaacuguuugcagaaguguucccuaaguuuucuuguuuugggaaugugguagucauuuggucaauauuucuggccccucuugcucuccaauuaugaacaaaaaauggacuaaacuuccuggcucccuuaugauuggauagggccauguaacuaguuuugaccaaugaguuguuaugagaugaguagaaguaauguuuauuacuucuaggcugcagcauuuaaaggugugagaucauuccaagcucucuuuuccuccuagugacuagcaacauucauaauggcagcaaucccuuggccugaauccccaaguaauucugauaugccaaauccccugcuaaacaucaauguacauguagaaugauuagaaauuaaacccauugguuuuacaagucacucagaugugggaguugucuguacugaggcauuacuaaccuaucuugauugguaacgcacauuccuucaaacuagcucaucccaccaaaucuuaaacacaugcacaccccacuucuuucauguuugcccuuguagucacaaaugggaaaugaaguugccucucauuuggaggcauaccagcugagagaggauaggaacacucugucaaaaacaaaugccaagcucugcuaaacucaucaguuaaccuuacuaaacguaaguaacaaagaaaugccuucuuuagcuugauaacacucccuauggaaguuaacaucugucuugauuuagcuuucugcaaauaggugcaacuccuuauaaaugcuggggcaaagauggccaaccaccugccaguggccaggcagcaugugguucucaauuaaaaacacaccagaaacugcugaaccaagugugaggcgggaaaacuggcaaagagcuaaaagaguaccaaaacaaacaaacaaacaaacaaaaaccagcaagauaccuauccacacaaguaagcacagccagucaauuuaauguaacagauacacuaaauaggauacguaucauuuuacaucuuuagacaaaccagacuucccuuuuuaaaaaugauaauguaaaccagacauauaaacacacugaggauugagcccacuuucaguagucccucuccugauauaggugguauggggccuucuaccaccucauuuauucacuccacucuucccuuccuaauuacuucaaaauaaagcuccugggacaggcgcaguggcucacacuuguaaucccagcacuuuggaaggccaagacgggugggucacuugaggucaggaguucaagaccagccuggucaacauggugaaacccaucuccacuaaaaauacaaaaaaaauuagccggguguagcggcauacaccuguagucccagauacuugggaggcugaggcaggauaauggcuuaaacucgugaggcagagguugcagugagccgagaucacaccacugcacuccagccugguugacagagcaauacucugucuuuaaaaagaaaggggucccuaauuuagccuucuuucaaaaggagccaaucaggccagguaugguggcucauguguguaaucccagcacuuugggaggccagggugggaugaucgcuuggacccaagaguuugagaccagccuggguaauguaguaaaacacuguuucuauaaaaaacaaaaaauuagccacaggggguaggaggcaaggggagggagagcauuaggacaaauaccuaaugcauguggggcuuaaaaccuagaugaugaguugauaggugcagcaaaccaccaaagcacauguauaucuauguaacaaaccugcacguucugcacauguaucccagaauuuaaaguuuaaaaaaaaaaaaaaaaaauuuacccaggcaugguagcacaugccuguagucccagccacucgguggcggguaggggugggggucugaggugggaggaucacacuugagucuggaagguugaggcugcaaugaacugugauugugccacugcacugcagccugggcaauagaaugagacccugucucaaaaaaacaaaacaaaacaaagcaaucagcugggcgcaguggcucacaccuguaauccuagcacuuugggaggccgagacggguggaucacgaggucaggagaucgagaccauccuggcuaacacggugaaacuccgucucuaauaaaaauacaaaaaauuagccggacguguuggcgggcgccuguagucccagcuacucgggaggcugaggcaggagaauggcaugaaccugggaggcagagcuugcagugagccgagauugcgccacugcacuccagccugggagacagagcgagacuccgucucaaaaaaacaaaacaaaacaaacaaacaaacaaacaaaaaacaacaaagcaaucaauaccagaaacaugaaagaaaaaugccaguucucagagcugguuugcuaaccauggcaagauacuugcuaaggguaacaauacacacagaucuuaaauaauuuaaaaacagcuucaagaaaguacuauaaaccuuaggauacugauuuucuucaccaugcaaaacauaauaaucuuaaaaugccaugcaaaaucaaaagaacuauuauuuagucaucaauggacaauuucaguuaaaagggcuaaaguggccuagauaagucacauuugccauaaagcauguacuaauauauacauuugaccaaugcauaaagcauggaaaguaccacaacaagcacuuaccauagaagaaugugagccuuuggcucuuccaucuuaauaacccucagagacagguacugauagucucacugagcaucucccauuucccccaacuucaaaugccaaacaagcuuguaccucaaagcguucaucuucacaacgauaaauauguucuucauauugagucuucuuggaacucacaaagguagaguccucagaccacgaagggaaggaaacccagguaucauuuaaaaccuuuggguagaagaagagagacugaaacaaaagccuaaaaaagcuuucuggugauuaagcauucugaaugaaaagacaaaacucuagcagagaaauaggcaacuaauauuacuucacaaauuucaccuuuagcaaguuuacaaaaagcuauuaguaagaaaagggugcugaauauaagcggaaauauaauuccagugcuuugggaggacgaagcaggaagaucaccugagcccaggaggagugacccaaucuuuacaaaacuaaaaacuuuuauuuuuauauuuuuagcugggugugaaggcauguguaagucccagguacuugggaggaucauuugagcccaggagguugaggcacuaugagccgugaucacaucacugcacuacagccugggugacaaaacgaaacccugucucaaaaacaaacaaaaaaguagaaaacauuuucuuuuuaaaaaggauuaaaaggguucuuaauuucaucauucauauaaauucucaauccuugguaccaccacucccuucuggaaaaagcugaggacccagggcugaucuuugcuagggaaggccuuaccucuuuacagagaggaguccguccuguacacuugggcugcugguaacucuuugguaaggcucgauagcuggagcccaaucguuuacaagaagcauaaucuaucuccauagcaaugcccucuguggcucgcuccuuuggauaaguuuccagauguacagacuccuuauagcccagaaaguuuuuaaaccaauuaaacaacucagggaauuuccugaagaaucaaaccaaaaagugacaagcaauuaggggcaggaugcaguuauccugagguaugacuacuaccaucugguuuuggaucagaaaucugcuaccagggaugaauuauuuccugccuaagaagaacugcuucugagcauuugguuuccccuuuuucuaauaaaauacucucagaucaguuaaaguggugaucaaagaguuguaccgaaaccaggcaaaauaacaagccauucuuuugaucaagaauauugcuuuaauguucacauaauucuuagguugucaaauauaguaaagauuccagacucgguguaguggcucaugccuguaaucccagcacuuugggaggccgaggcagguggauuaccugaggucaggaguucuggaccagccuggccaacaugguaaaacaccgucucuacuaaaaaacauaacaaaaauuagccgggcguguggugacaggcaccuguaaucccagcuacuuggggggccgaggcaggagaaucaccugaacccaggaggcggagguugcagugagccaagaucaugccaucacacuccagccuggggaacaagagugagacuucaucucaaaaaaaaaauaauaauaauaauuuuuaaaaaaauuccagaacucugggagagauuuuucuugauaaacauccagcacugguuagaagaucaggagaccacuagucuuggccauuagucgauaaauacuuaaugcccucucuauuuucucaucucuagagcuggacuagaagacuucucaggacucuucuggcacuaacauuugagucaacugauguaucucaaguaaauuaacuuugccuaucauauacucucacaaaucaaacauuaccuggucuccauaucaugcaucagggcuaagccccucacuucacuuaccccaggaaaggagagacuaguugcacaagcucagcacgagagaucaccuccugguuaaaaauaacaagacagcguaggaaauuuucguaggcuucugcacuccgaagagccuuucggaccuuauggagacaacgggaagaaaaacaguuuuuguuuuucuuaaaguggggaacugaaaagggccucgcucugucgcccaggaggaggcgcaguuguguaaucucagcucacugcagccucccauccucagccucccaaguagcugggacuacaggugugagccaccaugccuggcuaauuucuaaauuuuuugcagagacgaggucauauauugcccagcugcccugccauuaguuuuuaaaaacuggggaaauuuguggcugggcgugguggcucaugccuauaaucccagcacuuugggaggccaagguggguggaucacuggaggccaggacuucgagcccagacuggccaacaugcugaaaccccgucucuacuaaaaauacaaaaauuagccaggcaugguggcacacgccuguaauuccagcuacuuggguggcugagugaaacauaagauuaucacuugaacccuggaggcagacguugcagugagcugggauaaugccacuguacuccagccugggugacagagcaagacucugucucauaaguaaaaaaauaaaauaaaaacggggaaauuuaaacugauauuugaugacacuaaggaaucaacguuaguguuuuuagaugugauaaugauuauguuugcaauaaggaguuuuuuuguuuuguuuuguuuuuuaaacgcaguccagcacuguugcccaggcugaagugcaguggugcgaucucagcucacugcaaccucugccuccuggguucaagcaauucuccugccucagccucccaaguaggugggauuacaggcaugugcuacuacacccggauaauuuuucuauuuuuaguagagacgagguuucaccguauuggcuaggcuagucucaaacuccugaccacaagugauccacccgccuuggccucccaaagugcugggauuacaggcguuugagccacuguacccagccacaaaaaggagucauuuuuaaaagaaacuuacuaaaauauguauggaugaaauaagguaucugcgauuugucuccaaauaaacugggaugggugggaauauauaugaaacaaguaacuggcuagaauugggaaccgcuaaagcuggaugguagguacgugaggaaucauuuuacuauucuguuuauguauguucaaaauuuuccagcugggcgcaguggcucacgccuguagucccagcacuuugggaggccgagguggguggaucaccugagaucgggaguuugagaccagccuggccaacauagugaaaccccauucuacuaaagaaaaaaauacaaaaaaauuagcuaggcgugguggugggcaccuguagucccagugacucaggaggcugaggcaggagaaucgcuugaacccaggaggcagagguugcagugagccaagaucacgccacuguacuccagcuugggcaauaagagcgaaacuccgucucaaaaaaaaaauaccauaauaacaauuuaaaaacugagaucucggaguauaccuucucauaugcuugauucuccacaccauaucagaguuacucagguuuuuguugccucuuuuucuuuuuuuuuuuugagaccgaguuucacuauuguuguccuggcuggagugcaauggcgcgaucucagcucacugcaaccucugccucccggguucaagcgauucuccugccucggccucccgaguagcugggauuauaggcaccugccacaacgcccagcuaauguuuuuuuuguauuuuuaguagagacgggguuucaccauguuggccaggcuggucuugaacuccugacuucaggugauccacccaccucggccucucaaagugcugggauuacaggcgugagccacugcguccggccuguugccucucuuaacauguuuacagcaagaaucuuugccaaggcuguuuuaaacucugguaaucuggaauaacgcucucuuaagauaguucuguccucugaucuggucuuuuuucuuccucuauuuacaauauugagcaucuuaauaccaaaaacccaaaaaugaucaauggcauagacaaaguaaaacuagucuagcuagauuaccaaucuggaguuucaguuccaaaauaaguauuuagcacugugauccuuuggugaagaccacagacugccaccaaaccaaguggcuuaucagcaaccccugcuccagacuuccguaugcuuuucuuaacuauucaucaguagacacuauauagaaucuagacuuuuaaagcuaaagauaaaagaacacuguaccuuuuauacuguauacccuauuuaccuuuacuuuuuauuagcuuuuaaacauacacaaaaguagacagaaguauaacgaaccuauguacucaccccaaccucaaugaucuauaguaaauuuuguuucaucuauacuuacuucuccuaccacugcauuuuaaagcaaauuccagacauuucaucuagauauaguauauauguuuaagaaaaaguacuaagaaaaugccauuacaggacugggugcaguggcucacgcuuguaaucccaacacuuugggaggccaaggcaggcggaucaccugaggucaggaguucgagacagccuggccaacauagugaaacccugucucuacuaaacauacaaaaauuagcugggugugguggugggcgccuguaaucccagcuacucgggaggcugaggcaggaggauugcgugaacccgggagguggagguuacagugagcccagaucacaccauuguaccccagccucagcaauggagugagacugucccagaaaaaaaauaaaaaaaaaacaaaaaaacaaaaacaaaaacaaaaaacccauuacucuuagaaauuaacuuauuuucagaagacuccuuaaggcaaggcaugguggcucacaccuguaaucucaacacuuuggaaggcaaaugcugaggccgaaggaggaggauugccugagcccaggagucugagaccagccagggcaaaacauugagacccccucucuccaaaaaaauuuuaaaaauuagcugagugugguggucuguaccugcaagucccagcuacucaggaggguaagaaggaucacuugagcccaucucuuaaauaaaaaaggccaggugugguggcucacaccuguaaucccagcacuuugggaggcgaaggagggcugaucacccgaggucaggaguucaagaccagccuggccaacacagugaaaccucaucucuacuaaaaauauaaacauuagccaggcguuguggcggggccuguaauccuagcuacucaggaggcugaggcaggagaaucgcuugaacccaggagauggagguugcacugagccaagaucacaccacuucacuccagccugggcaacaagagcgagacucugucuaaaaaaaaaaaaaaacccaaaaauguaaaaaagauuccuuaauagcaucuaauauugaguccgugucaaguucaauugucuaauuaaugucuuaaaaauuggcuauuggccaggugugguggcucacaccuguaaucccagcauuuugggaggcugagguggaucaccugaagccaggaguucaagaccagccuggccaacauggugaaacccugucucuacuaaaaaugaaaaaauuagcugggcacgguaguaggcgccuguagucccagcuguuugggaggcuaaggcuggagaaucgcuugagccagggaggcggagguugcagugagccaagauugcgccauugcacuccaagcugggcaacagagugaggcucugucucaaaaauaaaaauaaaaauaaaaauaaaucagcuuuuaaauucagaauccaaagucugcaugucacauuuggcuuauauauuucuuaauucuuaauuuauaauagcuucccuuccauacccuuuucuugacauuuauugguugugaucuagacuuccacacuugucuaagagcaccaaccgcccaagcagacuuugguaaugauucacaucagagcuaaggacucaacacucuugcaggacucuccugcaaaaagcucacauaggcacagcagacagaaagggaucaggagauacuaaucacggagauguuaaaucaucugcccuucugcaaaacccaagaggcagaaaauagagucaaucaccacagaucaauccagguugauuccuaccagugagaagcccaacaggugccagcuacccugaugaaaguuuccugcuaaucaucaaguugacuccgaggagcaaaucacacuuaaguuuauguggccaaacuaaggcaccacacaacaucauuuaugccaauaaucucaacucucguugcucauuagaaucagcuggguagcuuugaaaacaugcaaguaaauuagaauuccccugaaugcuauguauguguguacuacaaauaacuaucacagcaauaagauuacaagucaucggccaggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggugggcgccuguaguccuagcuacucgggaggcugaggcaggagaauggcgugaaccccaggaggcggagccugcagugagccgagauugcgccacugcacuccagccugggcgacagcgagacuccgucucaaaaaaaaaaagauuacaagucaucuuaaauccucaaaaauugguacaggcacugguacugccugccacacagaccuggauaucuacaaugggagcuccaaacaucuuucaagagaaacauaauacauuuucuaaaaaucugucuucugccccaaacugcuucauaaaaccaaagcaaacaaugcuaccauuuuucuagcuaugcuaauaguacuagcagacucaaaggacucacaacugggaaacuauguuaaaaaacagaaaguccuaauuagccugacaccuuuaaaacgaaaccuuccagggggauaagaugauuuucuuuuggcauuaacaggcacuaucaaaucuaacucauccauuacucaccuuaucaaaaaauaacgauucuguuccaccaccauguuugcuggcaucugccauagaagaauccuucagauugagcaguuuggguuucuucugcaaaagaaagauacaaacaugugagauucaacgagugguuuucucugaauuuuauuuuugucuguauucaaugguuucaucacugaaaccacugcugauuaauaauuugaaacaaaugagagaacucuaaccaacucacuccauacccucuaagauuucaacucauauuuucuauuucaguuugccuauuaaguuucuuucuacaacagagguucaaagaucauucuacccccaaaauauuuucuccagaaaugaucaugacauuacugugacaaacuuuuagaauauccuuacuuuuucuaggggcccaaaguaacuucauguagaaucuaaugccacuguuuuguucuccuaccagcugagggagaaaaggcuguuuguaaaaagagcucacaaauugacagaaaucaaucuuuaacccugaauaauauuucaauuaaaaauuuacuuaaaaagcauaauuugcugggcauggugacucaugccuguaaucccagcacuuugggaggccaaggugggcagaucaugaggucaagagauugagaccauccuggccaacauggugaaaccccgucucuacuaaaaauacaaaaaaauuagcugggcgugguagugugcgccuauggucccagcuacucaggaggcugagacagaagaaucgcuugaacccaggagguggaggcugcagugagccgagaucacgccacugcacuccagccugggcaacagagugagacuccaucucaaaaaaaaaaaaaaaaaaaaaaaaaaaaaggcacgccagcaauauccacucagacuaauuuaauauuguucuucuaaagggaaccaacaggccaugauauaauccugucaggcaagaaguuacuuuuaaaauccaccacuuacucucuaugaagaaaugcacaaacuuugugagaaguagcacauuuaccuuggcuaucucagaguauacuuucuuaagagccgcagccucugcuuacacugccuauggagaaaguaggcggagaauuuuaagcccccacuauauucuugccaccuguagguaaucaagagugggcggacguaaauccaagcauggaguguaucuacugagcugauucuugcuacccauauaacuaauucucuuuauugaaaugaagaaauagaaaccauuauuauguucaacuugauuucaaaagauuucaaaagaagaaaccaugacaaacacuaaugaaaaggauacuucaaaagugucaguaacaccuaguacgucagaccuuguagucagucaaucacuauucaucagccaccucuuacuauuagaaauucccaaacuuuugucauuauuuaauucugcagacauaucugucucuucuauauuacauacugcuuugaaauucacugaagaauuaaacauucaauacauacaacuagcccucucccuaucauagcuguguuacaucaaagaagggagcaagcuaaguuuucugcaggcagaccaucaguguuaacuauaacaaaaaacaucauguaauggauuacuaagaggaguuuaagacuucccucugcuacagcccaaagguccugccuuggagauuaagaugauacacauaagaucugguaacccaacaaagaacuuugagcaggacaggguucuagaccagagaucucaaaaaacacaugcacucuacucacaagaggaccucagagaccacuuauuucugaaauaauucucaagcucaagaauguucuuucuuaacacaaggcagauuuaaagcaucaaagaagaaggggccaggcgcgguggcucacgccuguaauuccagcacuuugggaggccgagguggguggaucaccugaggucaggaguucaagaccagccuggccaacauggcgaaaccccaucucuacuaaaaaugcaaaaauuagcugggcgugguggcacacgccuguagucccaguuacucaggaggcugcggcaggauaauugcuugaacccgggaggcagagguuguagugagcugagaucacaccacugcacuccagccugggcgacagagcaagacuccaucucaaaaaaaaaagaagggaaaaaaauuucaaguauuggaaauucuuaguagcaaccaaaacauuaaagaaaugacagcucauugcaaaggagagauaauaaagaacucagaaaaguacaguaauccaagcaaucaauguuauucuaauacucuuuugcaaagccagauaaacucugcacugaguuucugugacacaauacuaacuuccuccaaauaucuaggacccaaccguuaacacacuuaagaacacaugacugccgggcacagguaaucccagcacuuugggaggccgaggcgggcagaucaugaggucaggagaucgagaccauccuggcuaacacggugaaaccccgucuccacuaaaaaaaaaaaaaaaucagcccgguaugguggcaugcgccuguagucccagcuacucgggagggcgagacaggagaaucgcuugaacccgggaggcagagguugcagugagccgagaucgugccacugcacuccagcuugggcgacagagcgagacucggucucaaaaaaacaaaaaaaaacaacaacaacaaaacacaugaccaccucuagaguaccucuccauuagaaauacuugugagugucaaaaugagcagcugcugcccauucucaccuuaacuggaggggugguuccuguaggaugucugcggaucuggcagccauucuggcugggccucugcggcuuguuguucaguuggggcuucuugacagugccuccaugaucauuucucacagaaucaaccuucucagcaguuguuuugcuuaaaagcugauuaagacacaugaaugagauuaaugcucuuaucaaagcaaacaaauaucaucuaggaaaaguccccuucugagcacaguuuuccaacucaucuaagauaauaauaguaaauaguguaauucuuauuaaaaaaacauaccacggagcuguuggcaucugguaggaauuguccaaacucugacaacaaaucuuccugguuuuuaaagagacgagcaaccugggcauacaccuccugcucugucaaugcuggaguguaguuuccuccagcuuccuuggcauuucucugcucuuucugaggaauugcaaaugaaaagagaucauuugggcuacuguuuugagucacucaucuuugcacgcuuucuggaaucacuguuaucuauuuaggcugcauguaagaagaaagucuauguucuuagcacccguucugaccacagacuuucaaguugagaaaaaaaaaaaguugaagaugguggaugacaauuccuuucaaaacuaggguaguaaauauuuuugagacggaguuucacucuuguugcucaggcuggagugcacuugucucggccucccaaaguacugggauuacaggcgugagacaccaugcccggccuagggcaauaaauauuaaugcccaggggaccacuaccaacugacaaaaccuuagaaauuucuccuccuccuacuguacauuaacuagacuauauaaaucaccaucuaacugucccagauaaaacugaguuucauuucaugggacagugacuaacaauccugacugaggccgggcacgguggcucaugccugcaaucccagcacuuugggaggccauggcggguggaucaccugagaccagccuggccaacauguugaaaccccgucucuacuaaaaauacaagaaaucacuugaacccgggagguagaggcugcagugagccgacacugcacuauugcacuccagccuaggcaaaaagagcaaaacucugucucaaaaaaaaaaaaaaaaauccugacugaauguugcagggcaaucaagucaggcaaauaaaacuggcuuuauagcaugggggcgguggcucacgccugcaaucccagcacuuugggaggccaaggugggcagaucacaaggucaggaguucgagaccagccuagccaacauagugaaaucccauuucuacuaacaauacaaaaaauuagcugggcguggugggcggagccuguaaucccagcuacuagggaggcuaaggcaggaguaucacuugagcccgggaggcggagacugcagugagcugagaucgugccacuacacuccagccugggugacagugcaagacuccgucucgaaaaacaaacaaacaaacaaacuggcuuuaaaaacaugcaugauaguuucuaacugguuaauuuccaguaugaauuaauggacacaauaaugguuacuuguuauuggacuagaugcccuaagagggugaccugguuaagacaggcugaaugggcacuccuuaccugauaugugugcaaaaucuccaggaaugcuuuguagaugucugguuggcccugaaaucuguucuugaucuuauuaacauaguugauggcaugauuaaacuccacagguugauuguucugcaaggauggggccguucccaacgagauugucacuggugugugaggcuggaccggcggagaacguggggaugcauacgguggaagugggggagucugcugacuggccggaguaugugcuugcaguugggagggcuagaaagaaaagaaaucuuuauucucuucagaugcauagaugaguugauacaaggaaaguucaaacuaaagagaaacaaggugucaacguauauccuuuauuuacucacucaggccaggucauuuuaguccaacacaaaucauacugggcagcagugggaguuguaggcgguucaaacaugcugauacaaauauuucagucucacauuuucuaaauaaaaccuuaaaacuggagccaucuccaauuacagggaagaauuuuucauaugcaauguuuuagcuuaguagcucaacaaguacacauagaaaaaaucucauucuacauagccuuuugaugucaacaacaagacaacuguugcaguagcuccacauaaaaaagucuucuacgccaacucuguccuguagaacugagaugauggaaauguccuuuauuugcacugucuuauacauagccaccagccacaugagguuacugagcacuugaaagcuagugcaaaugaaaaacugaauuuaauuuaaauaguccuauguggcuaguggcuacugugucagacagugugguucuagaccaagaacaccccaucuucaucaccaucacuaucacuauucauuagaucuucuacuuagcuugauauaaucuaguuagugaaauaacuuucauaaaauaaccaugugggcagcagcacaauuugaccaggauaagacgaugguuucuaucugugcugucaacuacuacuacacaaagucaccaccuguugggauguucaugguuuuauaagcagaaacuguaaaaagaaagaccuugaaaguuguugcuguguugauuuaaauagauaccuaaguaagugauguguaaaugugaaccaugucauagugaaguuuucauacagcauuuuucuaugacgaaaucuuuguaacuuuguuucucaguaucuaagucuuauauaaaggggaaacaucaaaggaaggugcucucuagggaugcauucauauugaugcaauauuuuccaagugcucaccuugcugacuuuggcaggugggggcugaggagcuggcugggcaggagcuggggcugacugggcugaaggcugggaaggauguugggguggugguugaggcuguggcuggaugccaugggugggaaucugaugaaccuggccaggaguugucacauucaccaugucauugguuugcaccucaauuuuguagccagggggcaagaagguguugaaucccauuaucagaucgggguggccuuugaauagcugggacacacgacuaaucacuccuggggugucgaugcugauaaaaaacaaaaagaaaagugauaaacuguaagcuuaacaaacacccuguuaagaaaaaauuucauguuuuuuuuucuuuugagacggagucucacucuguugcccaggcuggacugcaauggugcaaucuuggggucuuggcucacugcaaccuccaccucccgaguucaagugauucuccugccucagccucccaaguagcugggauuacaggcaugcgccaccauacccggcuaauuuuuguauuuuuaggacaggugggguuucaccauguuggccaggcuggucucgaacuccugaccucaggugauccgcccaccuuggccucccaaagugcugggauuacaggcaugagccaccucacucaaaauuucacuuucuacuagguuuucucuaaacaggaaaacagaucaucuacgcauuuuaaaauuaacacacgaacucugaaauuccaaagccauuuaguuuuagacucaaagauacuuggccacaauuuguuuuuuuuuuuuuugagacagagucucauucuguugcccaggcuggagugcaguagcacaaucucggcacacugcagccuccgccuccuggguucaagcaauucuccugccucagccucccaaguagcugggauuacaggcacccgccaccaugcccggcuaauuuuuggaauggucaaaauuuuuaacagaauauauguucauuguaauaauucuaccaagcagauacucagaugauauauauaaagcuacauaucccaaacaagauucacucuuugauauaccaguauacaucauuucagcacacaucuacauuguucagaugaguuacacucuuacaacagugaaccaugccagaauauaaggguaucuaaaccaauucagaaaccaaguagccuaaaucacuaccagugcuacuucccugauugagacaaaacacuggaaaaaauuuaguuaaggaaaauuuaccaauagggauaaaaaagucuaguggccauaauuuccaucaauaaagguaugcauaaaauaaaggcaugauuuugaaaauucagcugcaaaaaggagcauccuuuaucuuccaguaaauaaacuauauccucuuccuuccaaaaucaauaugccagauacaaagcuugaguacaaucacacaucuuuuaccucugagauuuaaauuccuucaugaugucaaggaaaucauuguagaccugaggcugacuaccaaacugcagcuucaccuggucaagauaagauagcgcauccuccaccugaggcagggauaaauaucaagguuauaaaaagaaaguaagcucauaauuacaaaaaaaaaacaaaaacaaauuauuuaugccuaaguaugcuuaaugcaguaaaugaaguaaaaauauauuaaauauauacuuaaaaguuaguauggauaccaauaauaaacucaagcuuaaaauaauaaucaacucauaaaaucuguagccuugccuuggaaaauuuugaacagaaugaucagugaagaauaauuacaaugauauaucauuuauuaauucauuucacaaguaucuacuaaacugcaacauaccaggcccaaugugaguaccaaggauucaaugacaaauaauuuguagccccucgucuauagacauuuguuuguauguagucaggaaucauaacacaguggguaacccgguaaucacuccaugccuggagaugacaugggaaggacacgucuucuccaccaaaaaaagugaggcuuccccaggagguaauguauaaacugagaccuaaagaugacuauaagcuagcaaaagugaagaccagugaagaaaaucaaaagcggcagcacggguaaaauccuagacaggauacgauaugggauauuuagaaaucugaaaacaguuuaguuuggcuggaggaucuguagugaagaggaaggaaaaguaacaaaaugagacagaaaaaaaagcaggaucuagauucugaaaggauuuguaaaucuugugaaaaagcaauuuagauuuuuaucaucugcauuuucguguacgcaauuugacugcaguguugagaaaaaauuggcacaagagcagaaaagauugaaaggagguaggaagaccagguaugcuacaggaauaacuggacaacucaugugaaaacaguggcuugaauuauaguacuggcccagaacaacagagagaacugcauagauaaaaaagcuuuuuggguaguagaagugacaggauuggggaacugacugaauagaggagcuaagggagagccagcauucaaaagugauccgccacggagcacugaggaagaacagucaagagugacucucggaccgaucaaagcccacaugccacugcaucccgcacucagcgcuuacauccuuccacaucaccaccacacccaagagaaagccugaaggggaugcuaaaggagauagagccaaggugaagaacaacccagagaagauccgcaagguuguaugcuaaaccugcuccuccaaagccagagcccaacccuaaaaaggaugcaggcugggcgcaguggcugacaccugcaaucccagcacuuucagaggcagaggugggaggaucaucugaggucaggaguucgagaccagccugaccaacacggagaaacccaucucuacuaaaaauacaaaaauuagccaggcaugguggcgcaugucuguaaugccagcuacucgggaggcugaggcaggggaaucacuugaacccaggaggcggagguugcggugagucgagaucaugccauugcacaccagccugggcaacaagagugaaacucggucucaggaaaaaaaaaaaaaaaaaaaaaguccccugcaaaggagagagaggagguacccaaagggaaaaaggaaaaugcugacacuggcagggaggggaauaaccuugcaggaaauggagaugccaaaacagaccaggcacagaaagcugaaggugcuagagaugccaagugaaacaugugcauuuuugguaacuguguacuucuggugacuguaaaguuugaacuauaaaguuaugaaguuuguaaauuuugaaauaccauuguuuaaaucaagcuuuauaaaaaugcagaauuuuguuuugcuuuuucuaaagcaguguuguuaucgcacacagaacacuucauuguuguuuuggugggaaggaucacaggucacuaauagaaugucuuugaagcuggacugacguggggaaaacaccuuucccuucuaguuuugagagacuuccucuuggcuuauagaagaaauucccugacuuuauuuacuuauuuauuuagagacagaguuuugcuauuguugcccaggcuggagugcaguggugcgaucuuggcucacuguaaccucugccuccgggguucaagcgauucucuugccucagccuccugaguagcugggguuacaggcacccgccagcaugccuggcuaauuuuuguauuuuuaguacagacaggauuucaccacauuggccaggcuggucucaaacuccugaccacaagugaucugccagccucagccucccaaaguccugggauuacaggcgugagccaccacacccagccuagauucccugacuuuuaacacacauggccaccuuggcacaaacaccuugugggauggaaaaacaaauucauuuuuacauccuguucucccuccccaccuucacagaccuaacucccuuuuacccagacaccuguugggaccuaacccccaauaacugguuaccaauaugucaggcagucaaacuuuccagugaugccacugaaauggcagcccucaaaagagcagugguugcuuuuucuagacuguggaucuucagauaaguccugccauuuucauuucacuuccugaaagucaggguuggcuugugaaaaguuguuaaacaacaugcuaaaugugaagugucaaccuucacucuaaacuuucccuguucagagcaucaaaugagacuucacuggguuuuauaguggcuuuuuuuuuuuugguagcucauuguuaaggauuguccauguucugccugaaauaccaugacuguuuuuggaaaguaucuuuaaagcuggauacaguuuggcugggggagaaaaaaaacugaccuaucacaaagaagaacagguuggaaaggcuaagcuaugagucugauuuaggacagagacacccaaaagaaauccccacuagguguuuccuauuuacucugagauacguuaaguuuuauuuugguaguuuaacugaagccuaaauauuuaaaauuauacaaaauaucagguuuaagaaauuucagaaauaaacauuugaugugauuuaagccagucuuuuucuuuuuuuuuuuuuugagaugggagucucauuuugucucccaggcuagagugcaauggcgcaaucucgggucacugcaacuucugccuccuggguucaagugauaucuccugccucagccuccugaguagcugggauuccaggcgcaugucaccacauccaacuaauuuuuuuguauuuuuaguagagaugggauuucaccauguuggccaggcuggucuugaacuccugaccucaacugauccgccugccucagccucccaaugugcugggauuacagaugugagccaccacaccuggccaggcauagauagucuuuugauuuguugcaaaauggaacauuuacauucaagucaaucauuaacuggugcuguggucugaaaugugucccacaaaauucuuacaucgaaacuuaaucaccgauaugaugauauuaagaagugaggccuucagaaagugauuguggagcccucaugaaugggauuagggaccuuauaaaagggcuggagugaaccaguguuagucccuucggcccuucucccuuccaguguaaggacacacauucagggaccaucucgaaaaacagaguucaggcccucaccagacaccaaaccaacuggcaccuggauuuuauuuuauuauuuauuuuauuuauuauuauuauuauuuuuuuagaugaagucuugcucuugucucccaggcuggagugcaaaggcacgaucucagcucaauacaaccuccgccucccggguucaagcgauucuccugccucagccucuugaguaacugggauuauaggcgccugccaccacgcccagcuaauuuuuguauuuuuaguagagauggggugucaccauguuggccaggcuggucucaaucuccugaccucgugauccgcccgccucggccucccaacgugcugggauuacaggcguaagccacugcgucuggccuauuuauuuauuuugagacauggucucacucugucacccaggcuggagugcaguggcacaaauucggcucacugcaacuuccaccuccugaguucaagcgauucucgugccucagccuccagaguaacugggauuacaggugcaugccaucaugccuggcucauuuuuuuguaucuucgguaguuuuaccauguuggccaggcuggucuugaacuccugacuucaaaugaucugcccuccucagccucccaaagugcugggauuauaggcgugagccaccgcacccggccagcaccuugauuuuagauuucccagcccccagaacuucuccagaacugugagaaauaaacugcuauuauuuagauuauacagucucagguauuuuguuauagcagcacuaauggauugagacaaauggccgcuuuuuuguuuuuguuuuuuuugagacagagucucgcucuaucgcccaggcuggagugcaguggcgcuuucccggcucaccgcaagcucugccucccggguucacgccauucuccugccucagccucccaaguagcugggacuacaggcgcccgccaccacggccggcuaauuuuuuuuucuauuuuuaguagagacgggauuucacuguguuagccaggauggucucgaucuccugaccucgugaucugcccgccucggccucuuaaagugcuaggauuacaggcgugagccaccgcacccggccccgagacaaauggcuguuuaagaguucuucagacuuccauuacggccaugguuaaucaguguuucgguguugcuagaaaucagauuguauaguuggucaauacccacuuguuugaugguuaguuuuucuauacaaauaucaugacaauuucuguugaaauucaauggacuauuuuaauucauauucugaacuuuccauacuaaaauguuucauuaaugaccaacuuaagugaacacaaaauauauuaaguuugcaaaaggaaccaagacuuuggaagauauuuaagaauagcaugcaucauuacacaacaaaagaacaguuaucaauaagacaugguaugguauaagguaacuacugcagagacggaaaaaguacagaaacccaaaagaaagcaauuaugugugauauguauaugucugaaacaaaaagguacugaaagucacagcaaaccaagcaaaccacuguuuaaaaauuaguuauaggccaggugugguggcucaugccuguaauccuaguacucugggaggccaaggaggguggaucccuugaggccaggaguuugagagcagccuggcuaacauggaaaaaccccguccuaguaaaaaaaaaaaaaaauacaaaaauuaggcuugguggugcaugccuguaaucccagcuauuugggagacugaggcauaagaaucacuugaacccaggcaggggagggugcagugaguugagauggcgccacugcacuacagccugggcagcagagugagacucugucucaaaaaaacaaaaaaguaaaauaaaaguuauagaauaauccuaugcuuuaaaaacucugcaugacacucacauaauaaauaagacaccuacauguaaaaauagugaggaaauucucucaucaccuaaagcauaguccaacucuuauauaaacucucuauaaaugcauguauacaguucuagguagcacaacuuaaaaaaaaaacuuggauguaguuauuuagaagcuacagauuuaaggaagcacuuggggagacccuuagacucugcugauaaaguuucuuagcucacuucaacagggauuuacuauuaaggccccgaaucuccugaagucuacaaucuuguugggagagaaaaacacaagcaacuguaaagauaaccugcuaaauauguaccaaauaucacugcugcugacauucaauaacuaaauaacaccaaacaugccucaaaucguucaaaucccuucuugucaccaccaaucuaccaaagacaaaaaacaaaaaaaaaagacaauguugaggcuugaaauaauguguaagcauucucacugaacauuucuuuuuuuuuguuuguuuuuucugagacggaguuucacucuugucgcccagacucgagugcagugguaugaucuuggcuuacugcaaucucugccuccuggguuccaacgauucuccugccucagccuccugaguagcugggauuauuacaggcaugcgccaccaugccuggcucauuuuguauuuuuaguagaggcaugguuucaucacauuugucaggcuggucuugaacuccugaccucaggugauccacccaccucggccucccaaagugcugggauuacagguguaagccaccaugcccggccuacauuauuauagaauauaaaugauuuauugaaguugauucaaaugcuuguaaugcauuuuaagacugauccaaaaaugacaggcaaugugggaauacugaguuaaauuacauggagguacaagaagcauuuuaccucuccucaucagaaaggaaauucaacaaguuauuuuaugcaggaauauagucaagagcuugugacuaaaagaacacaacaagaaauccuaacucuaucuaugacucacucuauaaccccaaauccaaaaccuuuccuuguuuccuugccaguuuccauaaagcaaacaaaacauaauccauauacuuauaccaaagaguccugugaggaagguggguaaaaacugguguugugcuuugauaggguugauugaaaaaggcuauagaaauacauauguuuuuguuaguuuaauaagcaaguuuauaagcuauuuugcaacauuaaaguauaacuacugaauauacaguguuaauacagaauuaaaucacgcacaaccaaguuuuaaaaaaaauauuuucaggacuuaguaaagugcuaagcccgcagcaauaauacauuuugguacacagccaucacucuacaacagacugaaaauguuuuaaaggaaacaucaauauuccuuauacacauuuucccaaagacagaauccagagugaagcuucaggccuaaaaaaccuguacucucuuuaaaaggcuaugcauuagucaauacuauguaagccaauauagagaguaaauuuuacaaaauuacucuaaaucacauagcuuugcuguacuuuauaauauuuauguagcauuuaauacucuuaggccaauauuaaacaaguucccaagaauccacaccaacgagggcagggaucaagaagaacuaaaguaaguaucagggaaaacagaagaaacaacuauuugcugcauauggauauguccuuagaggguuuauuucucauucgugccugcaagcaacauaaguagguugcaauaaccaaaugaagauuuaacaucucuucagaguuccuccauuuauuauuuccugaacuuaauuuuauauaaacguaaaauuagaaaaauugaaaccugaacacuugcugcaacaaucacauauuuugaaaaguaacauucaaguggucagagauacaagguuagcugggaacacaagcuucacuucuccagggaugccucaugaauuucaaagcacugaaaacguaccacacauacucagcagaaaauaugaaaacacugauaauucauucacaguuacaguuuucccugaacuuuauaaagauuccccccaaaaaggagcauguguuuuacuaagaauggacuugaugaugugagucaauucagcuauucauaaacaggaauaaaaagauaaagguaauaagaacauuacaggcaugagcugggcauaguggcucgcaccuguaaucccaacacuuucgaaggccaagaugggagaaucacuugaggccagcaguuugagaccagccuggggaacacagugagacucccaucucugaaacuaaaaacuaaaaaaaaaaauuuuuaagaauuuaaaaagauugaacuguaagauauauuacugggccaauuuacuguacuaaccuguagccaaucauauaugugcucaauagagaguucaaaaggaagcagccaaaaaaugaauuuuaagguuuauuuuguauuaaaauggccccacaauccugauaacauuugaccgacaugcauucauacaguccacaaacauuugaguauauucuucucuggaucaggcacugaugccaagauaggaaacauaagcaaauuucacaaaacaaaaacgguaaaacuugugauucgacagcuaguaucucagguuagaaguuguaccaccacaaccaacaagcugcaaccaguauuuccugcuaaagauaaauuuuuugacccaagaaaaagagcugaauaccaccuucagccucugaaauugcugcugucccugcacuggugcaacugguggggcuggaugagcaugacucuggaccaccuggccuccguggggcugcaccgcuguugggugaugauggcugcuaugaacugcugcuauagcgggcccaugacugccggagcucuguggcauggcugaaaccuggggugaacaaaauacagacaggaaacuucaaggcuuguacauucuuccccaaaugagucuaaauaacuaacacaaaugcacaaagauaauuaauuggaaacccaaauuucugcugggcgugauggcucacaccuaucucaccuacauaggaagaucgccugaacucaggaguucaaggcugcagugagcuaugaucaugccacugcauuccagcuugggccacagagugagaccacgucucuaaaaagagaaaagaaagccugggcaacauagugacacccaucuccacaaaaaauaaaaacuuggccaggcauggcaacaugcaccuguggucccaccuacuccagaggcuaaaggaggaggauugcuugaguccaggaguucaaggcugcagugagcugugaucacaccacugcucucuagcccaggugacagaaugagaccgucucuaaaaaaaaagaaagaaaagaaaaagaaagaaacccaaauuuuccacaaaaggaacugguuaaauaaauuacagcccaccaaaguuauaacaaaauuauuuguagcuauuaaaaauuauauagccgggcacgguggcucaugccuguaaucccagcacuuugagaggccaaugcaggcggaucacgaggucaggagaucgagaccauccuggcuagcauggugaaaccccgucucuacuaaaaauacaaaaaauuaaccaggcguguuggcgggcaccuacagucccagcuacucgggaggcugaggcaggagaauagcgugaacccaggaggcggagcuugcagugagccaagaucgugccacugcaauccagccugcacgacaaagcaagacuccaucucaaaaacaaacaaacaaaaaaauauauauauaguuuagcugggaacagugucucacaccuguaaccagcacuuugggaggcccaggcagacagaucacuugaguucaggagcuugagaccagccuggccaacaugguaagacccugucucuacugaaaauaccaaaaaaaauagcuggacgugguaacacgcaucuguaaucccagcuacugagaggcugaggcacgguaaucacuugaaccugggagguggagguugcagugagcugagaucaugccacugcauuccagccuagaaaacagagcaagacucugucuccaaaaagaagaaaaaaaauuauauaguuuaucucaaacugucugugguaaaggaugaguuuuuuucuuaaaauuucaauccaucagggaccacaacuuuuauaaaaauccaauaaaaauaaauuacuaugaaagugaaauaaaaaauacauaaacccgccgggcgugguggcucaugccuguaaucccagcacuuugggaggccgaggugggcggaucaccugagguugggaguucucgagaccagccugaccaacauggagaaaccccaucucuacugaaaauacaaaauuagacaggcaugguggcgcaugccuguaaucccagcuauucgggaggcugaggcaggagaauugcuugaaccagggagguggaaguugcggggagcugagaucacgccacugcacuccagccuaggcaacaagagugaaacuccaucucaaaaaacaaaacaacaaaaauacauaaacccguaauuuuuuuucuuaccuuuuuauugagacagggucccgcucucucacccaggcuggagugcagugguacaaucauggcucacugcagccuugaccuccccaggcucagaugauccucccaccccagcuucccgaguagcugggacuacaggcauguaccaccaugccugguuaauugucguacuuuuuguagaaacaggguuucaacauguugcccaggcuggucuugaacucuuggguauggaguccaccugccuuggccucccaaagugcugggguuauagacguaagccacugugcccagccuguaacuuucauuacuggauuuuacaaauaaaaaaugaucauguccaauugcucuaauaguuucuaaacaauuucuauacuuaugccauuacaaacuaguaacaaaggauacagauuagccauuuuuaagccacacuucaacaaugauauauauggauauauuugaaucugaaaaaaaaguucauaauccacaaguugaacauauucauguacuguauauaaacuuuuaaauaguuuuuuaaagcacauuacacuggcugacaaagacccugucucaaaaaaauaauaaaagcacauuacaaagcaguaugauaaaaagauuucaaaccuuagacaacuaauauauagcaaaauguuggcauuuaaucuugugguuacagaauuaaagaugacucuuacuuuguuucuuuuuguuuuugaaacacucucgcucuaucgcccaggcuggagugcaguagcacaauuucggcucacugcaaccugugccucccagguucaagcgauucuccugccuuagccuccugaguagcugggauuacaggugccugccaccaugcccagcuaauuuuuguauuuuuaguagagacaggguuucacccugguuagacuggugucgaacuccugaccucaaaugauccacccgucuugggcucccaaagugcugggauuacaggugugagccaccgcgccuggccuacuuggcuuauuuugcuuaucuugauuugcuacgagcacuguaucuaauguaaaauaaauuuuuucccccuaauucuugaugguuuggccucaaacaaaugucuuuucuauucuuuuaucucagucuuucuccuguccucuuacaaguuugaggaaauaaaagccaaaacuacuuuccuucuauaucuauuucaagaaaugcuacaaaauuuuuuucagaacuuuuuuccuuuuucagaauuguugaucaccacagaagacaacaaucuguccaaaugcccaaaugccccauccccaaaauaaggagacuaaauaacaugaaacuuucuuucucuaaacaauguuaaguuuuauaccacaauuuaagagagaauaaaacuuuuuuucaaauccucacuuuuauaaaaauuauccuggagggagaugaagaaaugagggagagggagaaaccaagcaacuaugcauaaauccacagaaacaaaacaagguguauuaagaguaaaaagaaacuauuuagacaauucuaaaagcucuaauguaccucaaagaugggcuaguauucugagcuucuguauuccaacaugcauguuuuuuacaggguuuacaggcuuucacuagacugacuuauacaaacacauuauaguuuccauucggaagaaauuuaacuaucccaaauguagaaaacagucauuaaccuguuuagauaaugaaaguaaucacccaagguaaacaagcaacuuuuuuuucuuccaaguccuaaaagaugccaucuguuggcagucuucugacugcugccccagccccacaggaagggauuagacagccucaaggggacuccugaggaagagugacaccuaaggaaucaccauuuccuacuucagcugcauuuccucuucuuuauauuuuuauacuaaauuccuagaaauggaauugccaggucaaaaacuaacaaaaccaucugacacaaacugccaaauugcucucaaaaaagauuacgucaguuuauauucccauuaccagccguacauuuuuaaggucacuaacaaaugagguugaaggccuccccagaccaguuauaugcugaaguagaaagauauccacuauauauuaaaugaaaagagcaaacagcacaauaguauguaauguaugauccacauuguacaaaaagaaaagcagaaagggcggacgagguggcucaugccuguaauccuagcaguuugggaggccgagucgggcagaucacuugaguccaagaguucaagaccagccugggaaacauggugaaacucugucucuauagaaaaaauacaaaaauuagccaggugugguggcaugcaccuguagucccaacuacuugggagacugaggugcuaggauugcuugagcccaggaggugaagggugcagugagcugagaucaugccacagccuuccagccugggcgagagugugacucugucucaaaaaaaaaaguaaauuuagauagcuagacagguugauauagaugagcuuguauaugcauauaaaacuggauacccaagaaauucaccagugggagaaaaucugaggugugacagaaaaaaagucauuuuauauccuuuuuuuaaaaaaaaaucaaaguguggcagggugcaguggcucacaccuguaaucccagcacuuugggaggucaaggcaggcagaucacuuaaaaccaggaguuuaagaccagccugcccaacauggcaaaacccugucucuacuaaaaauacaaaaauuagccgggcaugguggcuugcgccuguaaucccagcgacucaagaggcuggggcaugagaaucacuugaaccuggaagccagagguugcagugagccaagaucacgccacugcacuccagcuggggcgacagagcgagacaccaucucaaaaaaauaaaauaaggccgggugcaguggcucacgccuguaaucccagcacuuuggaaggcagacaggcggaucaccugaggucaagaccagccuggccagcacagcgaaaccccaucuccacuaaaaauacaaaaauuagcugggcgugguggugcacgccuguaaucccagcuacucgggaggcugaggcaagagaaucgcuucaaccuagaaggcagaggcugcacugagccaagacugaaccauugcacuccagccugggcaacagacagagagucugucucaaaaauaaauaaauaaauaaauaaaauaggcuaggcgugguggcucacaccuguaaucccgguacuuuggaaggccaagaggggcagaucaccugaggucaggaguucgagaccagucuggcccacauggcgaaaccccaucucuacuaaaaacacaaaaaauuagccaggcauggcagcaggugcacguaaucccagcuacucgggaggcugaggcaggagaaucacuugagcccgggaggcagagguugcagugggccgagaucgcaccacugcacuccagccugggugauaagagcgaaacuccaucucaaaauaaauaaauaaauaaauaaauaaaugaauaaaauaaaaaauaaaaaaaccaaagugauacauuacuuucauaauaaaaaagggcaaaaaccaaauuucuucacuucuacaaaacagaguaacagaugaaugaucaguguuggucaggacauagaacaggaauauacaaugcuugggggaacuugcuaaagaugcauauacccugugacacagcaaucccuuucauagguacuugacaaacucuuguauguccucaaaccugcugacugguuuccaacagguuaaggaguuugcaccacaauguaaaccaacgaugguagacccuugaauaacacggguuuuuguuuuguuuuuaaggagacagggucuugcacuguuguccagucugaaguacaguugcuugaucacagcucacugcagccuugacuuccugggcuugagcaauccucucaccucagucucccggguagcuaggacuacagaugcacaccacuaugccuggcuaauuuuuuauuuauuuuuucaaauuaauuaauuaauucuuucuuuuugagacaaguucacacucugucacccacgcugggugcggaagcauauucacuggagccucaaccucccaggcucaaaugauccucucaccucagccucccaaguagcuaggaacacaagugugcaccauuacgcccugcuaaucuuuauuuuuaggagagacggggcuugcuauguugcccaggcugaucucaaacuccugggcucaggcaauccucaugcuuccaacuucgccaacuguugggauuaugggugcgagccacugcacucagcaacaacacaaguccacuuauacauggauuuucucccaccucugccaacccugagauggccagacuaacccuucaucuucuuucucccuccuccucagccuccucaaugugaagacaaggaugaagaccuuuaugaugauccacuuccacuuaauaaaugguagauauauuuucucuuccuuaugauuuucuuaguauuuuguuucuucuagauuauuuuaagaauauaguauaugacaaauauacaaaauacaugcuaaucaaccauuuauguuaucgguaaagcuucuggacaauaggcuauuuguauuuaaguuuuaggggagucaaaaauuauacauuggccagacgcaguggcucagacuuguaaucccagcucuuugggaggcuggcugggggaggauagcuuugggccaagaguuuaggaccagccugagcaacacagcaacaccucaucucuacaaaaaucauaaaaauuagccaggcaugguggugugcaccuguaguccuagcuacuagggaggcuagggcacgggaggacugcuugagcccaagaguuugaggcugcagugagucaugaucgcaccacuacaccccaacaggggccacagagcaagacacuaucuccuaaaaaaagaaaaaggaaaaaaguuauacauguauuuuugacugcauggggggaagucagugccucaacccccacacuguccaagagucagccauauuucacuacaaugauguuuaauucagcugucuuuuuuaaaaauaaauagcaaaacugucuuaauaagugcguugauuuaaauucuggcacaagcuucuuauuuugucaugaauugccacugagugcacuaagacaauaucacaauguucacagcagcaccuuuguaaaagcaaaaaccuggaaacagcccaauaguccaacaguagaauugacaaauaaauugaguauaugcauguaauuuacacuacagugaaaaugguggaauuacagcgaucuauaaaaauaugggguuuuuaaaacaaagugagucaaagaagaaaauguuuccauuuauauaaaaguucaaaaauaccgaaacuaaacaauuauguuaguuuuuuuaaguaaauaaagucaagggaaugauaaauacaaaguuuagaucaguggcuaccucugaagggagggaaaagaagggagcagagugggauacgcagggaacuucaaaggucaugacaacauucuuuuuuuaaaaacuuguauggugaguacacaguuauuuuuuuuuuuaccuuacacauacucaacaauuuuuaauaucuaacacaguauuaaaaaaaguuuuauaauugccuaaaaccacuauuucucuucccucauucuagucccuugguuggcuccagcuuaccugguagcuggguguuacagaguacugaauucccguagcugacugcauggucucagacacugcuucauacacaggaggggcaggggcaagcacccggugcuggugaggaaaagccucugugcugccagggauccgacgcugcugggcugcauacaccggugacuccuggucauccaaacgccgcuucauucugugcucaugcucagggaugcacuacaaaaccugcagaaaccaaaagcaauagcaugcaagucaauucucacuccaguaugauguacgccacuuaggaccagucacccaaguuuaguaaaagcuugacucccagaacugaucaucuauuucaucuuagugaugaaguuuaagugcaugugggcauaccaccccccaacacagugaacaaguuauaacugaaaaagacaaauauuuaaauaacauaauuuuaauuaauuugguauuaugaaguugaaaaauacgcuccaauuuaaaaauauaaacacaaccuuguuucccuuuauucucuaguuuucuccucaaaugcuaucacuccuaauauuaauuacauaucuacaugcugcaaaaauauucaagugcuucuucuuuuuuuuuuugagacggagucucacucuguugcccaggcugagugcaguggugccaucucggcucacugcaagauccaccucccggguucacgccauucuccugccucagccucccgaguagcugggacuacaggcacccgccaccacacccggcuacuuuuuuugcauucuuaguagagacgggguuucaccgaguuacccaggauggucucgaucuccugaccuugugauccauccgccucagccucccaaagugcugggauuacaggcgugagccaccgcgcccggccucaagugcuucuucuuaaauccucucaaaaccuacuacuauaauuguggucuaauuuaaaauuuguuucaacaauuauaaugguaucauggaaagaauaccgugccaggaaugggaagacaaagauucuagacuugccaauuuaagaugcuacguaacuucaacaaguuccucauucuaugugaauuucaguuucuccaacuauaaaauaagaaaaguuggaacagaucacuccuaaauuuucuucugguuuuaacaguuauaagaagagauucucuuagcuuaauaauaccuccgugggagacaauuucauuccugcaggacacaguaaucuacuuggcccaguaaucuacuugggucuucagagcuuuuccauaucaguaucacuaacacaagcauaacacaccaucagugagaaagaaugaaucagccauccaaagaaaaaaggccccaccacuuuuccagucccaaaaaaaucucuuaaauaagauaccacugcuauggaaagaagauaaaauuuacaguaauagugggagauuuggcaagccacccccucaucugaaauacgguuaaguuaaaaaaaaaaaaaaucuuuaccuaauucauaagucuacccaagaucuuuucuuuauccucugggagcacacaagcccugaagggaaaguagucuuuacaaggacucuccauggcuguuucaccuuuucuuuguccucacuauaguccucaaucugccugccacucuaauccuuagcucugaaauccugucucagguuuuucucacauuucacauaccuaagugggacccugacacagcagcacaacccauuaauuugcaagcuggcuacuuuuaucuauuuguaaacucaagccacaaauaugcucucuguggccuauauaacuucagacuaagucucucagcuuugugugugauaauauguggaacucaguuaaauggaguugagaacguuucugacagcugcugaggacaaauaauuuaaaaugucuuagcuaguuaugcuuuccuauguuuuucuagcaugaaauagcauguuuagcuuaguauucaaaaaccuuuuagacauauuaagagguugaguauauagauuuaugcauguuauuugccacuaaucaacuacgaacacuaaaccucagcguguuuugggaugaggaacugagucuaaucacagguagaguaaaaugucuuuuuagcuauuucuuauauacguucaugacuuucagugguuuggucuuggguucuguugguuuaaaacugaugcuuaacucaucggagauuaaccucuguaaccaaaaaugaagucaauacuuuauuggccggaugcaguggcucacaccuguaaucccagcacuuugggaggcugaggcaggcagaucaccuaaggucgggaguuugggaccagccuggccaacauggugaaacccugucuccaguaaaaauacaaaaauuagccaggugugauggcgcacaccuguaaaaccugcuacuugggaggcugaggcaugagaaucgcuagaauccaggaggcagagguugcaugaggggaggucccaccacugcacuccagccugggcaacagacugagacucugucucaaaaaaaaaaaaaaaaaaaaauuauagaaauguuaugauagggcagcacuggguuuaaaaaacaaaaacuucauaggcuggucacaguggcucacacccguaaucccagcacuuuggaaggccgagguggguggaucaccugaagucaggaguucgagaccagccaggccaacauggugaaacccagucucuacuaaaaauacaaaauuagcugggcaugauggcacgcaucuguaaucccagcuacuugggacgcugagacgggagaaucgcuugaaccugggaggcggagguugcagugagcaaauucgcaccacugcaccccaggcugggggacagcgcgacugucucaaaaaauaacaacaacaaaaaaaaacuuuauaaauaauaagccaaaaucagaugugaagagcacggcacgacuauagaaaaaacacuagaguaccuuuuaagaacuggauucuguuggaugggagaauguuugagggcaaaaaauaaaaacaaacaaaaaagaacuggauucuacuccaaacucuaucuaccaugaagcuuucuaauuuuggcccuguuuucaaacaggggcaaaaggaggggaucagccuacauuagugauuuccaaaugcugguuuaugaaccagucuauaaggaaaaagaagauuguagugagcuuuucauacauuaaguauuacaguacuaugguuuauucugauaucauacucuaucuuuuggcuguuaaaauaucguuucuuuuauuaagugauugggauuucauaugguacuuaacuucauccaccuccagaguuugcuuuccauaccaccucuacaacacuacagaggcugaacuuucucugaaccauacuuuauuccuuuaacaauuaccacucauaggccgggcgugguggcucacgagaucaggagaucgagaccauccuggcuaacauggugaaaccccgucucuacuaaaaauacaaaaaauuagccaggcguaguggcgggcaccuguaguccuagcuacucgggaggcugaggcaggagaauggcguggaccgggaggcagagcuugcagugagccgagaucaugccacugcacuccagccugggcgacagagcaagacuccaucucaaaaacaacaacaacaaacaaacaaacaaacaauuaccacucaaaguucuauuccuaacucucucucaaauaaauugcuuccgcucuaaucauaccuccugguuucaggcccugaucauccuucacaacaaccuuauaagcaagguguucucuaauuuaugaaugaggaaacugaaaaacaaagauuaaguaaacugcccaagguugcacagcuaguaagaggcaaagcugugauauaaauccaggaaaucugucuccagagccuggcucuuaacuacuucacuaccuuaccucucacagaagagaagaagugaaggaagaaucccuuuacuuauuuaaggcacacaugcagggagcaaguucagcuuuuuuuaaccuuucacacacuuagcuaacucauccuucuucagccuaaaccuaauaaagcagaaaugcuuuaguagcauucauucauuaaaagcaaauguucagugaguagauaugaaguugguagaugauuucagcccuugcccucuaaaaccauauauagccucacuaguaauaaaaaacguguaaaguaggccgggcgcgguggcucaugccuguaaucccagcgcuuugggaggccgaggcaggcggaucacuugaggucaggaguucaagaccagaccggccaacauggugaaacccucccucuacuaaaaauacaaaaauuagccgggugugguugugggcgccuguaaucccagcuacucaggaggcugaggcacgagaaucacuugaaccugggagguggagguugcagugagccgaaaucgcgccacugcacuccagccugggcaauagaguggaacugucucaaaaaaaaaaaaaauaaaaggucaggcgccguggcucacacuugcaauccuaacacuuugguucgccgaggcgaguggaucaccugacgucgggaguuugagaccagccugaucaacauggagaaacucugucucuacuaaaaacacaaaauuagccgggcaugguggugcaugccuguaaucccagcuacucgagaggcugaggcaggaaaaucgcuugaaccugggaggcagaggcugcagugagccgagaucgcgccacugcacuccagccugggcaacaagagcaaaacuccgccucaagaaaaaaaaaaguaauuuacuccaaagcaauuuaaaaaaaaaaaagaugacaguguggguaaggauacagggaaacacugauggaggaggcuuuaauugguacagccuauuuagcuggcaacuuguagguauuuauuaaaauuuuaaaugugcauacccaucccaugcauauuauggaaaacuauguaagaaucagaucaaaguuuauccacgaguauaagaaaugaacucuaaaacauacuagauuuuggaauacugaaacuaucaauuccacuuucaggccuguauccuacacaucugcugaguauauuuauugcagcaaaauaugaaaaucuaaauaucuaucagcuaaauaaaugugaucaugcauauuauggaaaacuauguaggaaucagaaagaucaggguuuauccacaaguacaaagaaugaacucuaagacauauuaagugaaaacagcaggcuaggccggaugcaguggcuuacgcuuauaaucccagcacuuugggaggccgaggcggguggaucaccugaguuugggaguucgagaccaaccugaccaacauggagaaacccugucucuacuaaaaacacaaauauuagcugggcgugguggcgcaugccuguaaucccaguuacucaggaggcugaggcaggagaaucacucgaacccaggagguagagguugaggugagccaagauggcgccacugcacuccagccugggcaacaagagugaaacuacgucucaaaaaaaaaaaaaaaaagaagaagaaaacaguaagcuauagaauacauacagcaugaucucauguauguauauauacacauacaaaauguacuaaagauuuguacauuucauuguauguaaaauuugcauugaaagaaaaaugugccugggcacagugauucaugccuguaaucccaacacuuugggaagcugaggcucaaggauggcuugagcccaggagcuggagaccagccugggcaacaaugggaugacccugucucuacaaaauaaagaaacaauuagcuggaagugguggcgcacaacuaugguacuagcuacuccagugacugaaguggaaggaucucuugaccucagaaguugaggcugcaagguuguagugagcagugauaacgucacugcacuccggccugggcaacagagugagacucugucucaaaaaaaaaacaaaaaaaacaaaaaagaaaaagacaaagaaaaaacaugcuagccacgcacaauggcucacaaagugccuguaaucccagcacuuugggaggccgaggcaggcggaccucuugagcacaggaguucaagaccagccugggcaacauggcgagacuccaucucuacaaaaaauacaaaauuagccaugcaugguggcauguaccuguaaucccagcuauuuaggaggcugacgugggaggaucaugugaguccaggagacagaggcugaggugagcugagaucucgcuacugcacucgagccuggacaaaaaagaaaaaugcuauaaacaauauuaaacucuagauaaugauaaacaugcucaagugcuuagaugaaguauacuaaugucugcaauuuauuuugaaauacaucaaaaaaucagauucauugauggagcgauggauagauggacaggcauauguuaaaccuaguaguagaaaaaugauaaugguaaaaucuagguaguguguauauggguguucauuauauuuacuaaaauucuaucaacuuuguuguguauuuggaaauuuucuugauaaagucuuggaaaaaaacauccacagguucugaggauuaggaaaaaaaaaaacaggaagaaaagccaacaauacaaaccagcucuugaguggaaaaaauaaguacuauaaauugggaaagggauacagacagguacacuugggaagacucuauaaagguaaauauucagcuacaucuugaaaauuagagaugaauuagaacacagggguauagagcaugaaauuaaaauaguaaguuuagacuugcaggcaauaguuauuuacaaucuuugccaagucauucaucccacaaauaauuagcaagugcuuaagacaugccuggcccugugcggaggguuagaaguccagcacugagccagagauuuccuccccgacaacagccaagucuuccauguaugacugcuaucagcugauguccuccucgcaacaauccugucagauaggcagucccagaacccuuuuuuuuuuuuugcaauagcauaccauuauguccaccaggcuggagugcagcagggcuaucacggcucaccgcauccccaaccuccugggcucaaguaauccucccaccucagccucccaaguagcugggacauaggcagcgccaccauaucuaacuuuuguauuuuuuguagagacagggucucgauaugcugcccaggcuggucuccaacuccuggccucaaacaauccuccugucuuggccucccaaagugcugagauuauaggcaugagccacugcgcccagccagaccccucuuuuuuugagggaaacugauacucaaauuaaaugacuuauucaaggucacauaccugacuaaaagagcaagagguuaaauucuuccuccuuggaauaugaacaaucuaaaguagaaacauuggacaagacuguaaaaccacgcuugcagagggguacaguguaauucuagaauauaaagaaagccaaacgauggaaccacaaagucagccacaaaaguacugucaagucccgcuucagccaacaugguugaucuccaucuguuucaaauuuggaguuuauaguacuaucagaacucuagucuaggaagacauuauaaaaagaaaaaaaaagcacuuugacguauagaaacuauggagagaagacuaaauaauggcagcagaacauuuaaaggucaccuggugggcacaguggcuugcaccuguaauuccagcacucugggugacugaggaggaaggaucauuugaggccaggagguggagguuagauuaagcaagauugcaccacugcacuccagccugagcgacagaggaagaucccaaauacacacacacaaaaaaaacaccuacagguccuaaaagucaccuggccauguguuauaauaaaacugggcgcggugguucacaccuguaauccuagcacugugggaggcugaggcaggcggaucacuugaggucaggaguucaaaaccagccuggccaacauggcgaaacucugucuuuacuaaagcacgaaaaacaaauuagccgggugugguugugggugccuguaaucccagcuacucaggaagcugagacacaagaaucgcuugaacccagggugcggagggugcagugagcugagaucgcgccaccgcauuccagccugguugacagaacaaggcucuccgucucaaaaaacaaaacaaacaaaaaaaaaacgggugggaugcuggguguagcagcucacauuuguaauccuagcacuuugggaggccguggugggaggauugcuugaggccaggaguuugagaugagccugggcaacaaagugagacaccgucucuacaaaaaaauuuuauuaaaaauuagcugggcaugguagugagcaccuguaguccuugcugcuuaggaggcugaggugggaggaucauuugagccugggagguugaggcuacagugagcugugauuaugccacugcacuccagcaugggugauggaauaagacccugucucaaaaaaacaaaagucuauccuggucaguuuguuuaaaugcauacucuuagaacaaaaaauaaaauaaauaaaugcauacucuuuuuugcuuauuuuuaaaugcauauucuugaaacaauggaaaguuucucuucaaaagcaaacuuccaucgcaguauuaagucaauguaaacuucaacccagugcaauuuugaguagucuaauucaaaauuuguccaaaaguccaccucugguuuuaaaucugcuaagaaagaaucuauuacagaaugaaaggcacucuauuuagauuucauauauugauuagaauuauugcuuggaaaaauuaacaaccagcucuucucaaaagacaccauuagaucuaauauccaagccuccuuugaacucaguuuuuauauucuucuaaugcagugguccucaacuaggggagauucugccucccaagggcacauguaguaaugauggaagacauuuuugguugucacaacucgggaagauggaaugcuacugauaucucacagauagaguaaaaggauguugucaaacauccuacaaugcacacgacagucuccucacaacaaauuauuuggcccaaaaugucaacagugugugaagacugagaaaccuaaguuuaaucauaaccccaacugucacauaucuuuuuuuuuuuuuugagacagagucuugcucugucacccaggcuggagcgcaguggcgugaucuuggcucacugcaagcuccgccucccagguucaugccauucuucggccucagccucccaaguaacugggacuacaggcgccugccaccacgccuggcuaauuuuuuuuuuguauuuuuuaguagagaugggguuucacuguguuagccaggauggucucgaucuccugaccucgugauccgcccaccucagccucccaaagugcugggauuacaggcgugagccaccgcacccggccaucaaugcuucuuuuacggcauaugauacaccuuuaacccgcauuauaccauuacgcauuggccagacacucugaccuaaaguuuuuuagaacucuuaucuuuuuuuacgccuggucuccuuucgucccucucuuaggcuugaucuguaaaacucuucugacucaaaauuuuagagcuuuucugauaccauaaugcucauuaaaucuguaaaaauuaaaaauaacgccaagugugguggcucacgccuguaaucucagcacuuugggaggcugaggcgggcggaucaccugaggucaggaguucaagaccagccuggucaacauggugaaaccccgucucuacuaaaaacacaaaaauuagcugggcgugguagcgggcgccuguaaucccagcaacuuuggaggcugaggcaggagaauugcuugaaccugggaggcggagguugcagugagccaagaucacgccaaugcacuccagccugggcaacagagcgagacucccucucaaaaauaaauaaauaaauaaauaacuuuaaaaaaaccccauaucguuauuacuuacuauuuuaacaagaauguaaguagcaaauuuguuuuuuuuuuugagacacagucuuacuuugucacccaggcuggagugcaguggugcaaucucaacucacugcaaccucugccucccagguucaagcaauuccugugccucagccucccaaagcagcuggaauuacaggugugugccacuacaccuggcuaauuuuuguauuuuuaguagaaaagggguuuugccauguuggccaggcuguucucaaacuccugaccucaagugaucugcccgcuucagccacccaaagugcugggauuacaggugugagccaccaugcccagccuuaaguagcaaaucuaaauuuuuauuccguacuuuccuggacacugggagauauaaauauccaaaaugugcaacauccuuuaaaaugcaaccaaguacucaucaaaugucaugcaugaacuuggaacacagccauucuauaaauuuuuuguuucuuuuaagaaacaaggggucgggcgcgguggcucaugccuguaaucccagcacuuuggaaggccaaggcaggcggauuacgaggucaggagaucgagaccauccuggcuaacaaggugaagccccgucuuuaccaaaaauacaaaaaauuagccaggcgugguggcaggcgccuguagucccagcugcucgggaggcugaggcaggagaauggcgugaaccuggaaggcagagcuugcagugagcugagaucgcgccacugcacuccagccugggugacagagcgaagacucugucucaaaaaaaaaaaaaaaaaaaagaacaagaaaaagaaacaggguuggccaggugcaguggcucacgccuguaaucucaguacuuugggaggccaagucggguagaucacgugaggugaggagcucaagaccagccuagccaacauggugaaaccccaucucuacuaaaaauacaaaaaaauuagccgggcaugguggcgugugccuauaaucccagcuacucaggaagcugagucaguagaauugcuugaacuugggagguggagguugaccgagaucucgccacuacacuccagcgugggcaacagagccagacuccgucucaaaaaaacaaaaaacaaaauaaaaaaaaaacagggucuugcucuauugcccaggcuagaguacaguggcaugaucauagcucauuacagacugcugggcucaaacaauccucccaccucagcuuccuaaguagcugggacuacagaguggcuaauaagaaaaaaauuuuuuuuagagacagggucucccuacauugcacaggccggucuugaacuccuggccacaagcgauccuccugccucagccucccgaguagcugguguauaccacuacacuuggcuuccacucuguaaacagguacacaccaccacgcuuggcuuccauuuuguaaauuuugauuccagguuucagguacagcucuaguaagguucuagcuuaucaccucugggucuuuuuuucccuuucugcccaucaaaugaaauacuuugaaaacucacuucauaauuuuguuggagagaacagucaucuucuuugcuccauaaucauaagcauucucauuuuuagacuaauaaaugucaaucagaaugaacaauccaggcugagcguguggcucuugccucuaaucccagcacucucagaggccgaggcggguggaucacgaggucaggagauugagaccauccuggcuaaaacggugaaaccccaucuguaccaaaacuacaaaaaauuagcugggugcaguggcacgcacccguagucccagcuacucgggaggcugaggcaggagaaucgcuugaacccaggaggcagagguugcagugagcaaagaccaugccacugcacuccagccuggguaacaagagugagacucugucucaaaaaaaaaaaaaaaaaaaaaaaaaaaaaaaaacugauuuuuuuuuucauuuuuacauaauuuuuccuucuaaccaucuuuauacauauacguaacuuuggcaccuguccacuuacaaacugcaucaacuaaguuuugguguacaaauaucuugaaagaugaaagaauacuaucauacaucuuuuuggcaaagugcagugguuuugauuguuuuuuuuuuucauuucuuaaaaauagaaauggggucucacuauguugcccaggcuggucucgaacgucugggcucaagcgauccucccaccucagccucccaagaaggugggauugcaggcauaugccacugcacccagcccaguucugauucuuauaaaaagaaaaucacauucuagcuggaugccuauagugccaguuacuugggggaacugaagcaggagaacagcuugagcucaggaauuuaaauccagccugggcaacauagugagauagaucccaucuuuaaaaaaaaaaaaaaaaaaaaaaaaauucaccgcugggcaugguggcucacgacuguaaucccagcacuuugggaggccaaggcagguggaucaccugagguugggaguucaagaccagccugaccaacauggagaaaccccaucuuuuacuaaaaauacaaaaaauuagccaggcauggugguacaugccuguaaucccagcuacuugggaggcuaaggcaggagaaucccuugaacccaggaggcggagguugcggugagccgagauugugccauggcacucuagccugggcaauaagagcaaaacucugucucaaaaaaaaaaaaaaaaaaaaaaucacauucuaaacucaucuaggguacagucacauauguauauggguggagacagaaucuugcuauguugcccagccugguuuugaaguacugggcucaagugauccucccaucucagccucccgagaugcuaggauuacaggugcacgccaccaugccuggcugaagacucuuauuuuacaacuugguuuauauaacuuuaccgucauccuaacagucuagaguacuacugucacacagcauucaucuacuaguuccucugaaaugucuucuguagucaguuuucuucucuuugccauuauaggaggaagaugaaaaacuauggauuuuuaaauauguccaaugaaagcuuaaaaguugaaaaauaguauaaaaauuaccauguacuccuucaccuagauucuccaaauguuaacaucuuacauaauguuuaagaugguaucucccaacuucuuuuauacuuucuugaaagaugcuguaggcugggcaugcuggcucaugccuggaaucccagcacuuugggaggcuaagguggguggauuguuugagcccaggaguucgagacuagccuagacaacauggcgaaacguucucucuacaaaaaaaauacaaaaauuagccaggugugguggcacaugccuguagucccagcuacuuggagggcugaggugagauugcuugagucugggaggcgaagguugcagugaacugagauugcgccacugcacuccagccugggugacagagugagacccuguauccaaaaagaaaaaaaaaguugcuguaaguuuugggaaaagcaauaagaaaacugaagggcugcggugcacaccuauagucccagcuaccgaggaugcuuaggagggaugaucacuugagcccagaaguuugaggcugcagagagcuaugaucauaccacugcccuucggccugggcaacaaagcgaggccccaucucuaaaaacugaaguguaaaacuaaugauuuauuucacuacugcauauccuuuuaagcaauucuauaauucucccuuugucauauuauuuuaguccucuuuagcauauuugagaauugaugaguaaugaugaaauaauuccuaggaugaugaaauaccaaaacauuucaauauacaggaaaaauaagaucaguaaaacuccacaacauuguuucgauguacaagugguaauagcuaaaaugaguuuauuccuuuggaaaaaaaauaaauuuucaggcugggcauggugacucaugccuguaaucgcagcacuucgagagauaagaaguuugaggccagccuggccaauauggugaaaccccauuucuacuaaaaauacaaaaauuagcuggguauggugguacacaccuguaaucccagcuacucgggagguugaggcaggagaaccaguugaacccaggaggcggagguugcagugagccaagaucgcgcuacugcacuccagccuggggauggaacaagaccgcaucucaaaaauaaaauuaaaaauaaaaauaaauuuucucuuugcuguuuugaagaccuccaauaaauaaaagucaugaaauauacaucuuuacaaguaguuaguacugcuuuaaaaaaaaaaagcaaaacucaaaaacuaaaauugaguccagaccaggugcaguggcucaggccuguaaucccagcacuuugggaggccgaggugggcagacugcuugagcccaggaguuugagaccaaucugggcaauacagacuucggugacacugauguuacccagacauuucuuacuacuguagguagaaaaugaacagaaauuuaguuaaauucaaaauguauuaauaauuguuaucaauguugauuuucugauuugaucacuguauugugguuuuaaaagaugcacuuggggaaucuaggugaagauuauagggcuauuauuuguauuauuuuugcaacucucuuugaagucuaaaauuauuuccaaagaaaaaguuuuuuaaaaauuaaguauuaggccaggcaugguggcuaacaccuguaaucucagcacuuugggugucugaggcagguggauugcuugaguccaggaagaccagccugagcaacaugguaagacccuaucucuauuuaauauaagaaauauaaucuuucaaaauaucuauaaggccaggugcaguggcucaugccuguaaucccagcacuucgggaggccaaggcagguggauugccugaggccaggaguucaagacaaggcuggucaacgugguaaaacccugucucuacuaaaaauacaaaaaauuagccaggcauggugguggcgccugugaucccagcuacucaggaggcugagacaggagaacugcuugaaccugggaaggggagauugcagugagcugagaucgcgcuacuguacuccagccugggcgacagagcgagacacugucucaaaaaaaaaaaaaaaaaaaaaaaaauuagccaggcaugguggugggugccuguaaucccagcuacucgggaggcuaaggcagaagaaucacuugaacccaggagguggagguugcagugagcugagauugugccaagccgagauugcaccacugcacuccagccugggagacagagcaaaacuccgucucaaaauaaauaaauaaauaaauaaauagcuggguguaguggcgcaugccuguaaucccagcugcucgggaggcugaggcaggagaaucacuugaagcuggguguguguaugugugugugugcaaugagccgagauaguaccacugcacucuagccugggcaacacagugagaccuugucucaaaaaaaagaaaaaaaaaaaaaaaaaagaaagaaagaaaagaaaauagagcauuacaaagaauagaacuugagauaguucuugaaaggacagguggaagugucacucacaucucacacugcuuuuaucacauuagcucuucugcucccacacaaacaugggcacauaacaucuuuaaccaucuauguauccucuaccaugcucagcauacugcuuugucuugucugugguggaaaccaaaucauucauucauguauacauucucuaauaucuacugagcacauacuaugcaccagguguuuuaggagcuggagauacaacgguaaacaaaaaucucuucccucaagaagcuuauauuuuagugaaagaugacacaauagacaaaguauaauauuuagaauaguaggcagugacagguaucaagaacaaaaggcaaggaagaguuuuugaaauuguagauaagaauggucagauaauaccuacugauaagguaacuucugaguaaaggaagugagggagcuagucaugcagaaauuaguggaggaagccuucuaggcagaggggacagcaaccgcaaagacccucaugucuuugugagggcucacaugugcuugacauguuccaaaacagcaugaaggcuggguagcugaagaaaaacgaaagaaggacuagucagaaauguagucagagagguacuaggauaaggguggcaggcagaggguacaucagauuuguucuuacagguguuuuuuuauuuuuugacacagggucucauuuugucgucaaggcuggggugcaguggcacagucauggcucacugcagccucaagcuccugagcucaagcaauccuccugccucagccucucaaguaacugggacuacaggcacgcgccagcaugcuuggcuaauuuuuaauuuuuuuauagagacagggucuuguuaugaugcccaagcuggucucaaacuccuggacucaaacgauccucccacuugagcucccaaaauggugaaauuacagacauauccuuuuuuuuuucuuuugagacagucucgcucugucgcccaggcuagagugcaguggcacgaucuuggcucacugcaagcuccaccucccggguucacaccauucuccugccucaaccucccgaguagcugggacuacaggugcgugugccaccaugcccggcuaacucuuuuguauuuuuuuuaguggagaccauguuagccaggauggucucaaucuccugaccucgugauccgccugccucagccucccaaagugcugguauuacaggcaugggccaccgcgcccagcucauuacagacauaucuaaauaaggacucagguuuaauacucagacugaaauggaaagccacuggaugguuuuaagcagagaagugacacgguaugacuuagguuucaaaagaaucacuuggguugcuauguugagaacacauuuaagagccgcaguaacaaaacaaggagaauagaauccaagcuagagaugcacaggcacugacuagggcaguggagaugcagauccuaaguggucuaauucuggauaguauuuugaauauaaagcaguaaaauuuacugauggaccacauaugaaaaagacacagaagagucaacaaugucucuuaguuauccaagaggagacaucgaguggagaccuugagugggccacuaaacauauuagucuaugguagagggagagauccccguuagagucaucagcauuguuuggauuuuagaaagguaauaugguacauauacuguaucaucucucucucccagcuagggcugaguagcuccccauaaucaagcagucacauuucugcaucaugcaggauagcccaggucaggcuguaccccaaaacuaguuguggaacuagacuuaccaaaaaacaaaaacucuugcauuucagaacugcaaauaaaggauguggaccugcauauccuccaauagcccauaugucagcaagccuagcccuggaggacaccaagaagacucaugaaggguccacugucaugcugagaaauauggguaacauacaagcauacaagacaaaaaguggguagggaaaacaaaagcaaaaggggcaaauaagaaauacaucagguagaaauugccacccaugaccgggcacggugacucacgucuuaauccuagcacuuuugagaggcugaggcagaaggaccucuugagcccaggaguucgagaccagccugggcaacacagcaggacuucaccucuauaaaaauauaaaaaaaauuagccaggugcgugguggcacacaccuguagucccagcuacaugggaggcuaagguaggagggucgcuuaaguccagaagaucaacacugcagugagcugugaucaugccacugcacuccagccuggugacagagcgagacuucgucuaaaaaaaaaaaaaaaaagacaugagaaaaaaagacauuaugcggccgggugcaguggaucaugccuguaaucccaguacuuugggaggcugaggcgggcggaucacgaggucaggagucugcgaccaaccugaucaacauggugaaacccugccucuaccaaaaguacaaaacuuagccaggcgugugguggcgccccagcuucuucuucguggaggcugaggcaggacaaucgcuagaacccgggaggcggaaguugcagugagcugagauugcaccacugcacuccagccugggagacagagcaggacuccaucucaaaaaaaaaaaaaagucuagugccuaacacaguaucugugacacaguaagugcucaauaaauaucagcuuuuauuuuucaaggggcgaggaagguguauuuugaaaaagcauauacuauuuauuuuuuuaaaggccuacagaaaguaaagcuuaacaaacucuuggcugguggauugcccagaaaagagagaaagccaugaaaagcacuaugcuaaacuacugaaugccagggauauaaccucuuaauuccaguuaaaauucccagguacuaacaucugccaugcacagcucuccagugucuugucugcucccacugaagauguaaaaagaauuauacuucaccaggaaucuugucaaauuacuacacaccuccuuccuuaaaaaagaaaaaaagucuuucucuguauguaaauuauuaaaacccucuuaauuacgaagugccaaucuuucuaagcuauuuaucucugaacaaaauuauaguauauaaaauaauuaucuggagauuaugaagcauuuaugaaaauguuccuaauacagcaaaaccagguucuuacuugaauccuuauagacucuucuguguuccccaguauacagcacugcaaaucaugggaacuauauauguagcccaaauuuuccucaauggucaaucguucuccacuaucucucucaguuuauggcaucagaaaaaaccaccuggauuuuuugucuccccaccaauucuauuacagccaucauuugcuaaacuaaaaugcuauugcuuuugcaacuuccuuagcagagaagguaggacccaccuacccuuuucacauaaauauagcacaggguaccacucaggcccuacuaaccaaagcacaaaucuagaauuucacuucagauaauuaaccagaggcucauuuagacauuacugcauaaauaaacauugguuccauguuuauuuuucucaugaaaaaugugaaaaacauugaaauaauuucucucaauaggaaaagauaauguaucaagugaaagcaaaaaccucaucuaaugugguucugcuaucuaaaucugaaaugcccuaaggcaacucuccaauacaggcuggagggcaacgcuacagaagucacauacagaaggcuacccugauccacaauuccacccuccucugaaauaaaaagggcaacaacacuguacuauguagaguauaaauagaaaguggucuagauggucuaacauaaguacauaaaauaaaaaagaaaagacuuuucaccuauaguuaccuaaauagcaaauucuuuaggaaaccaaguuuuuuugguuguuuuuugaggcggaguuuugcuccugucgcccaggcuacagugcaauggcaccaucucggcucacugcacccucgccucccggguucaagugauucuccugccucagccuccccaguagcugggauuacaggcgcuugccaccacgcccagcuuuuuuuuguauuuuuaguagaaacaggguuucgccauguaagccuggcuggucucgaacuccugaccucaagugauccaccugccucggccucccaaagugcuaggauuacaggcaugagccaccgcgcccguccaggaaacuaaguuuauauagcagaaccaugugcacaaugaaagcauucaaaaauacaacugucagagauaucggaguauuuuauucaaagucugaguucuuaaaaaaaaaaaacaaacccuacuuuauaaacagaccaguuuugagauuaaaauguaaauccaaacuuuccuguuauaaaucucagccuuguaaagaggaggagcuuccacugccuuuucaaggcuaacuucguuuaaaguccuaacgcaccgaaacagacgccaagucuacuacccaccacccauuggcucaaaggaagccccgccccguacagccacgguaacugaacaucaagggaaccccagggaagguuuucccuccgccacauuucuagucucugaugacucccugccccuccccuaccaucaccaccgcggaucuaggguuccagcaccagccacgcacgcuccuacaagaggaccuugggcacuucgccccaauaguuacaaccaagaggggagugggggugaccaugcucccacucuccuggcugcacggugccagacacgcugcauggagcaaagcggagaaagcagcuccggcacagggcccuugugcccccaggcagaaggcaugacccagccacaagaguaaguccugacaccuccacagcucccagucggcgggugccccucccuccccacggagacauagggcggggcagaucuaggcgccgagacucccagccagacccgacagcgggcuuucccuagcaccuccucauugccaaggaggcggaaacccggggccugggcggggugcagggggggacggccaaggggaguggcaucacggaucaguacggccccuccggccaaccggaucccaagaaggcggaggaacucagacuucacgcccccucccugccgcgcccugaaucuacacgcgggagaccccccccuaccccuccccgaccccagcaggccagagcgcggccgccagcccgaggccccgcccaccccaggaggaggggaggggguggucggccgcaaacugcacucagcgcgaagccggccccgccccuuucuccacaaucgcacgcgcgcgccggccccgccucugagcggcggcgcgagagcccgccccccuccgcgcgcaccgggacuacgcucuccucccccucccgcgcggagagcuaccccgcuccgccccccaccccccucacacaaccacacaccucccgcccgucugcucuacgggaagccgaggaggucagccccccccccccaaaauacacacccucgaguccggcguuacccgccaccaggcucccgcccggcccccggcccagcgugcucucaccgcaaagcugcuucggccgcucgucacugcgugucccucucagcgugagccgcgagcucagcagggaggccccgagaacggcgcggggcacaggcccgccgaagcggacugccagcuaccucuccacuaacgaagcggucacaggcuccggugcccagacugggaaggagggagggagggagggagggaaacuccgaggggggaaggggaggggggaagauggagaaaccgucuccgccgccucuaccgccgcggccgcuucucuguuacccgggaaaucccgcccacucccccgaccccgccccgcagagggaagacucagcuucguuccaauacaggacgcaauacccgcccgucaaagacucagccaaccaccgaggccugucuuaugauuuucccgccccuucccccucgacugguaggggagggggagccgcucuccuucuccacgccccuauuggcggggagcuucccuaacucaaccccgccuauuggagacggacugcugaagcccacccccgagccccaacacuauuggaggaagcagggaagcucuuccugucucauuggaggacaccacauaacccgcccugcagcgucucagccacaggccuaacaaguuggcucccgccuccgcuggucaucgcauuggaaggcuaccccuggcucucccaccgccccaguaagguaaguaaccgaugugggguaaaaugucuguaagugaaacaggcuccgccuaccgcacugccgggccaggccccgccccaagagucggauuggauaucuuggcgcugguaggacccuccauuggccagggcgcccgucuaggaaggagcuaauuccacccugcgcgaggaggcugaaccuuagcaguccuuuuguggaauguuuacacuagagacugaagcucggaguuccagggcccgagauaggagggggagcggagcucaucagcggagacuccacauccuaggauuugaaggaaaggcagcccaccauggaggacucccucacaaaaaaaaugagagaaugagaacucauccuuccguccaguuaucuuuacaguuuacauucuacacacugcguccuuguaaacacaaauauccggagcagcuggcaacuccuuucagccaaguagaguacagaacuaaggucuggagaccuaggcggagaaguaaacucccuagagcugaauaugcaguccuaagagggcggagauaaccaaaagagaggcgggcucuaacagccaccgcccuggcaagccuccggaaggcggagcgugaggcacaagguacucacgaucucccggguggaucuggaggcauccucagaacugagaaaggagaggaaaacaccaaaacaggccacggcauaaauuaacauuggggacaugccacacucagagaauggauaaaauuuccguaguuggggacauaagauaacggcuguucaccuucuccuuggccgggaguguuaauagcaguuccugugcccucucuguguagguaacagugccucgaacacacagugagacaaagugcuuucaauuccuaguuugcuuuuauuuauucaccaaauagggcgugggccugacgcugaucuuacuuuggggggcgcucucucagcgccaggagaggugacgggauuacguuguuaccgcucucccgaauaaguagaacccuccucccagagagcuaagaccccaagggacacgcccagggaacccacgccuagguccaacacuguccucccucugcaauccagcggaaacggccaggaacgagcucuggcagcaggugggccugacuccagcgauggcuucgagccgcgaaaccacagcagcgaauugugaacuccaaggguagccgacaggugggagcagccucgccaguagccaagcccugccccaggacagagcucuaaaaauaagucagaccaacgaagcgaccccagggccaaacugcucggagguuaggaggaagcggcacuccagcagaacugacccacggcuacuuuuaacuuugcgccgccuuccaccacuagacugaguaccacagggcauucccaccaugguaucaagaacuacucagaacccaagccagcauuaggccgcccacgacuucccgugaacacaggguaccaccugcgcuaagaucucgccuaagggccccaggccagggcacuagguugucagagucucagauacagccaacuaaggacagccgcugccaugccuaggaaagaacagacacuugcagcgucugcagaguucucgagcuuaagcucagggaagucaaggggcacggaaauagccaagcgacaggguuagaacuuuaguacuuggccccggccccgaaaggcagaucucaaacccagcagaaccuccggaguuucgcucccgaaauccacuccgcacuguaauccccuggcuucaccccgaaggcuacuaggucucgagccucgguggaaccuuuguguggcuucucggcucuccccgccccccucgccaagggcgccgagccuaggacuuccgggcgggagggcaguucgaaggagcuaggcgggccucacacaugugcggagcgcgcucaagagcggagggaggcggggagcaaggguggacuuccccucccagcucucuccgccggaggaggccgggcuacccgccccaccaaucagaggcgggggcgggaccuugcgccucacgucauccgcaagaaccgucccuccucccuccgcgaaaaaaaaauccuagcaacuuaaacuccagcccggccucccgauaggcggagcucgggagaaugucauccaauccacauccaagaaggagaaaaaaagggagucucgccuagccaguggaagacaagagaaggcggggccuccgggagagccggaggugggugggagagaggaaagggguccgccccucagcuccccugcaggcggguugcacaagccgccggcggaguagauaguaaacagucugggccgaggagugcaggcaagggccgcccggcgcucgguggacugggccccugcgccgccucucccggcgucgccccgcccggccgggacgguucccgccggcgccccgccuacccgcccgcggccgccaucccggcugacaggcgcgccccccgcgccccuccccgcccgcugaugcauuuccuuuucccgauuccgagcguggagacuguuuucccaguuuccgaccuucacugccccuuucaggccacccccucgugggcgcgcacacgcccgcgcccccgcccccgccccauccgcgccgagcgguccgcagcagcaccucgcgggaagggggagcccggcggcggcacggucgggggaggggaagagagcagcagucgccgccgccgccuuggggugggcggggaagcaggcagcuccauguuugcaaggggaucagccggggccgcggacgaagccgccgaguuucuggggguuuuccgcaccaccgaugcgagcuccuugcugggucgcggccugacggguuccggcaccgaaugcugacucgaccgccacggccagggaguuuggagacccggcagcucgcagggcuagcggcgaggcgcaggggcucuuuccgguggccucucccgcccccggccgccccucccgcaaguccgguguugcccccgcccccagaguccauaacaaccgcgggcccacagugcccgcgccucuccggagcgcgcccaccgcccccuccaaguuugcgggcaaaaacaaaacccucggggcggcugccgcccuuguccagcguggguagccagggaagccgcgggccccggcucgcucgcuaacuccagcucucgagcaacuccgagcgccgcgagcucagugggccccgccgaccaugcucgagccgccgcccccugccgagcccgcacgccgcagcuccggcccgguucuagucggugugcggaaucccccuuuucuuuccaguauuuuucuuuuuaaaaaaacggcacaacaggagucgggggucuccugcccgccccuucuccaguccgccgccaaaaccuaccgaaaccgacugcucggugagauaaacuaggcuacacggccggcgcagggacgaccccaggccaggcccaccccucucccacggcuccggccaggcugggaaacacacacacuggcgagcgggcggcgccaagagcucuccuuccuggccugucccucgccuaccucggccgcggaacuccgagccuccccucagcucggucccagggcccgcagggcccacaccacgucgggccggccagaccgagcggccggcggacuagccccccaaacgccugagauuggggggaccaaauuaaaagcagcuguuuaac

SEQ ID NO: 192058 - RNA, 25961 nt, Homo sapiens
cacagggccaaauguuccccuuuauuaugguucacucaguuaccaaagacagacacauuggcucaggcagcucaacugccagcuggggaacauccagcuccagaaacagggagcagcagcggcaccaggagaauggcaaagcaggucacugggaccccagaacugaccugggcccuccuucacccgaccccaggccagaccuuccuacaaagaugaaugugugcccugcccccacuucucauacugguucucuccccgggaaagugcauaguugccuggagaugcagcaucccagggccugaacaagcugggccacacaccgggaucaggcuucccaaggguagagccagagcauggccauauagguccaagccaaagaggcagguaggacaggaaacugauuggagguaacauccaacaggucauggaugcuaggcagggagcuggaucacaggccuccuggagcuaccagagagagaagggaaagggagccaaaguucugggguaggggagaggaagggaaagggaagaagggccuagaccuagguaccuuuucagguaccagggacugugaccauugcucccaagagagaaaaugggagaggggagaggcaauuauauuuugugcccaaaccuaaaggaccaucaggaagagaauuuccagaggccccuggcucaggauggccuguaagccuagguauuggguuccaagcugaagccaggccagaguagccaagugggguuuggauuuuuguccaaacagcucaggcaagcuucuggugggagaagggaaggugggaaaugggcagaugcucuuugggcgagaacccacuccccuucaggccccgcacacagcuagagccucuaccagccauguucucacacugcuuggaacagaacagccccacgggccuaaaaccacucuccugaaagugguagggaguuccgacugggugaggacaagccaagaccaaggccuguaggcagaagggagcaaguuaccuugauuuggaaaacaaaacaaaacuaaagccagagagccuccccucccacccugccuaaccugaaaucccauucaggcuauugugcuugcagccaggacugggccugugcuucugcuugggcccugaguucaagugcccagaaccgcccugugaccaagagcaagccagggugggggaaggcaugcuccccucucacugggcccugccugccuucuccucugaccuucccuccgugccuagcccucugagcccuguccuaccagauccaaacagaacagcuacugcuuccaggaauccaacggucaccgagagauaccuaaaugccucacugugcuggagccagccagaccuuccccagggaccaaucauuacugacaugcccucugcuccagcugugccuuuacaucugacaacugcccagcaugucccagcuccucagggaaggcaguaaggcagaugccaccuggcacaugguggggucaggguagcagaaucaagccacagcaacugggggcauggggaggaggcagagggacauaggcagaggggcucaagggggcucuggggagagaaggaggagaaggcaggggagagaaaagaugagccugccccugcagaucaaacucucaggcccaagcagacucauccuugcauuuucauccccugggggucagguacccaggugggcucugcacccccagcugugugccccuccuacaucagggguaaggcccagcuccccaucagcuuccuugaacuguaaaucagauuagauuuggggaucugggcucagucucaggagcagauaaaacugggacacucagccuuggggaagacaaagaaaagccacauaggaaagagauagacagaccaugggcaagggaagauugcacagggaaugugacaucagggaacagaugagggaggaggaggcugaaggaggcgaggccuggagggaucaaaagagcaagggaauaucccuggccuguacccacccucccacccaccaccaagagugcuaaguacuguuacuucccaggaagacugaaaguagaaacaguuccagcucauaacccuaggaaggggccagucuuucugcuaugccuccccuggccccgugaggggucccugggccagggucagaggggccagaggcaagaggggcagguggagggugggggugggggcugguuuagcucuaaacacacaucuagcaccacaagagaccuccacugcacacuauuucacgaggggacacagacacagcuacuaccgcacgggacagcuccacgugcagcccacagcugagugccaagagcagaaucugaaaggugggggcugggguacagacauauacauauauauauauauauaacucugguccuuuguacaaaguagggaaggagaaaagggaagggggaacccugcuugguaaccacaaaugacgauguggcuugagcccccugucccaauggccccagcucugccaccugguaggcguggcugguucacaucucauuggaguacguguaauuggggguggcggaauacugagucugaggcugauucauggcacccugggcugcccccauggcugcguucugggcugccugcugcacauguggauucuuccaggccccugugguccacuccuccugagcuuugcugaaacuccccccacuuccccgguaaaauuuaugaaccuguaggaaaaagagcguaaagaaggguuaaucaaagagaaaaggcagcccauccaggaaauagaugggacccaucuguaaaaaaaaaacagugcucccuccccaugaaugccucuguaggagaguccugcaggccauuccagagugagucccuuggaagaccucgggauccucuugcaacuuggaggagggcuuguuucagaacauggccccuucccaaagccaccuucucacccuugaggggaccacguaccaugcugagggcgaugaaggaaaagacggccaucacugugaacaugacagugggaauuagcaucaccaccgccgagccaauguucguuccgaagaaggagaugguagcaauccagccgcugcaggaagaggccaguguggggcugcgggcaggauaagaggugcccaggagccccccgcuagaggaagggaccgucucauugccacagggaggaaacauaucacuggaugcagagggaccaucuuacugauacccaaagaaccugugccaguggcucaagaagaccccaucccuguggcucagaggugcucuucagauacaacacuuucuucccccagguuuuccuauaaucccugacaccccucagcccccaagaaaccacugccagguucuccuucccucugaugcuaugguuguacuacuacacuaucccgaauccucucacucucccaacaacccaucacucaggccccauaggcuagacagcuuagcacacaaagguaagcaaaagauacacccacaacgccaccccugccagccccaggccacaccccugccucuuaccagacgccccagccugggaugcccacggccuggaugaugcugaugaccaacugagccaugaagguaaagaagaaugccaugaaacugaaggagcugucaguccugcggcagaggagguggcucccgucaccugggcagagggccagggcuucccugccuucaaggcccccaagcccuuccaaguuuaagugcauaauggacagaagacauuuaaaggccuuaauugagaggucagaagggguuaguucuacccauacaucuuugcaaguuuccacgugguagaccuguguguugcaacauuacacagggagggauuucccaugaacagaccacccacugguacauggauggacggccucauuggcauagaaauagauggcuccacugaggcaggaauaaauagucucauugucaaggggauggacaaugacaccaagacagcuagcuccacugguacauggauggauggucucauaggcucagagauagaaagucucauuggaacuagaauggacacccuauuggcaccaaaacaguagcuaauuggcacuuagauggauggccugauuggcacaaagagauuuaaggccccauuagcauugagauggauauucuacuggcaccaagacagauagccuugguacauugaugaauagucacauuggcacaaagauugaaaaugccauuuggcacuagguagacacccacuggcaccaagacagcaagccccacugauauguggauggguguucccuuuggcacacaguuggaugaccucauugcacaugaacagugucaaugguacauggcuggcuggucccauuggcacauggauagaugguguccuuggcaccaagucggcuagccccacagguacuaggaugggcagcuccaccaagacaggcagccccacaggcaaaauuuaacaugcagcugccugaggaaggggaugacagaagaaaaaauaggccuggucugucuauauuucccccacccaaggguagagugaggaggaaagaaacuaacucucagcccucucaccucaacuuggcacccccagaaagcccaggcccuaccuagcaaucugagccaaaggugagcaagggaaagugaguuugggggaggguaaaaaaaaaaaaaaagaagugagaaaagauauggagaagagacaggggagaugggcagagacggcuaggcacugcggauagcaccaaccacuuacuugaaggccuuguaaaugggccgaaaccagcagacguaggagcagggugugaagaggaugagccagagaaaggcgaggccaaaguugguggcucccccgccuccgaucagccacgcgagacagcccaccagguucacggccagcgugacgcuguucacugcaggcccaggagcacaugcacacauagagacagacacccaggcccauagagagacacaugagcacccggacaugggcacacacacaccaguaacgcaacagagacccacaaucaagccaggccaacagcgcagacaagcacagagagaugcagacacauucacagauucacacccacacaaaagacccacaacccguaccaacaaauacauacagagacacaggagacacacauacacacgcagaggaguaaagacuguaagaacgcaagcugggagcucgaaccaacccccaccccucaaccccagcacccacuccugagaaaucuggagagcacagccuccagaacccagagcuucugcccagcaagccccuuugaagggccccaaagccucagggugguagaaaugcucuuguccuugucaagaauggcuucagccccugacccucccagacucacagcaaucaccaagcccaagacaugggaaaccgaccuuacacuuucucuuucgagauaugggcauggaaagggaaaaauaaaaggccuuguggaaacaucucuucuagccauugugccaucuaccuugcacuuaaauggggcaggcauuggcggcuggaaucucagucuuuaucuaaucuauuucuuuuuuuuuuuuuuuuuuuuugagauggaauuucacucugucgcccaggcuggagugcaguggcgcgaucucagcucacugcaaccuccacuucucagguucaagcgauucuccugcuucagccuccugaguagcugggauuacaggugccugccaucacgcccagcuaauuuuuguauuuuuagcagagaugguuuuucgccaaguuggccaggcuggucucgaacuccugaccucaggugauccacccgccuuggccucccacagugccggauuauaggugugagucacagugcccagcuaucuaaucuauuucuuagauaacacucaugccagcuccuugaagaagucuuccuuugcuacugcaaccucaucaucucccaucccucugaccuucuacagaccugggcugcucucaagguuccccagauauaaaucccagcccaucaaccagacuaaaaguuccccaagaacaggacccaggccccccccccucuguccccaccucaucuagcugaacuaggaggcacagugucacugagucacggccagcagggaccucaaagauuuacagauaaaagugaugcugguacuaacacacaugcgggucugugcagcacaucauuaucuaacaucagggcacucccuuccuugaaaacaaagcuaaguccacaaagaccugcugaauaaacaaaggaaggagggcucaaccguggccucaaacagccaggcaucugugguccugucuucugaauagaacccuuaagcaccucaaggguuauauacauuuccuugggaguaaagcaccugcgggugccuagugaggacuuaaggagauauuuauagcccuuaaauccagcuucuggaugagauguucccagaaguugaguucccagagcccaggucagacacagugaccuacaagccuggccugaccaccgugucacccaucucagggccccucaugggugggcauuucuuccuguacauuucagcuguauuuccucuaucccuguucauugccccaaaaucuccuggaggcuugguguuaaaacugauuuuauuugcucuuuauauagaaaagacacuaaccuauuauauugguucacaucucuccccaguccaaccugccccagcucccuugcucaaacaccucugcugcaauuauucugcuuccucucuggaauggauacccaugagcucagccccucucucucucuagccaucagcuucuuucugucuucacucuucuccuuauccagcuuagauuccauaauucauuacucauuuucuuauucccuccccugcccugccuucuggccacacucacccuagaugaacauaauucucaucuguaccugagcugaauguugcuaagaaaaaaggggaccccaugaggaagacuguaaauucacaucagccaaugucaaaugaaccuuguguguggcccagaaaucuuaggggccggguuucuuuggagaguguccucacuauccgucgacaaacauggccucguugugagcccacucuccacacuacaucauauuugauggaaaaaauggaagccaucagagguaacuucuucauuugcuucccaacaucuacagacuuacccacaccugucccauccccccuucucucagguuacauggugggagaucccuucuucacucaaaggccaagccaggccuugaaacugagucugucugccccauccucuuccuaccaugccaugagggaccugcugcaaagacaguauauuuuaccaccuugucggcacaugcaagcaucugcccagguaggcagcuaagugcaggccucacucagggcagugucacauauagcagaacccaacugcaguuacauugcggguaucuugggauccuggggcucacacccagcacaggauagccagcuugccucccccucacaugccuaagagguaccuucuaacuagccucagcacagccaagucccauccccccaagaagacaccuuucccacccccugcuacagaucaccagaaaugaggccuuuacacucucagccuuaaaaccuuagaacauugaugcuaagguuuucuaaauaaagaauucuagauuauuuaauuauuuuuuuagaggcaggcucuuacucugucacccaggguggagugcaguagcaugaucauagcucacugcagccuugaacuccugggcucaagugauccucccaccuuaguccccugaguagcuaggacuacaggcaugugccacuauucccagcuaguuuuuuuaaagagaugggguauugcuauguugcccauacuggucucaaacuccuaggcucauuggauccuccugccuuggccuccugaauagcugggacuacaagugugagccaccacacaggccuaauuuuuuuauuuucuguagagacaggggucuugcuguguugccuaggcuggucuuaaacuccuuaccucaagugauccuccuggcucagccucccaaagugccgggaucacaggugugaaccacugugccugacauuagacucuuacagguauagaccacccaacacagagcugcauggaaccacagcaaucgccaagccaauacuuucuuccuacaaaugaggaaccugcugcuuggcaagcacagugaccaggcaaacuugaucccacagcucccaacucccagcugaauccuccucucuuugagcaaucuuccagagaaagcaagacaaauaaggcuuugagggaaggauuccucuccaaauccagaauccugagguccugacaguccccagagguucccuggaaaguuacuccaguggaagggaaaggggaagcaagaagacagggauuacacugcagagagggaccccuguccagaugcucugugaaaggaggguggaggggaaggaagggaagagaggccuagaugggggagguugagggaaacugaggcccagucggggagguggcccauggaagaagccucugggagccuggcaggggaagacuuaugguccaugcauaugccacaagugggacugaaggacagucaggccugugggcaccccaccccgcugcccagcacgcccagucuuccugccuccuccagccacccuggcccacccccaucccauggcacucacacauccagagguaguagaggcgcuuggucaugcugacaugcuggggaggaauaucugccucgaagucuugguagaaacauggcuucagcgggaugaauuugggcaauggugggaaguuguucacuuucucuguggaugagacacauugcacaacaucaccuccagucuuccacccgacaauccaagacgcccauccuuccccuggcugugcugccccauuggccccuguggccaccggccacucugcuuuccccacccagccgucccuaccuccccgggucagcugugaugaucccaaaguagccaaaggcccugagacagugucacucagaauaaaaaacaaugucaccuugacagacagcauuuauuauuuuuuaauucugagugacacugucucagggccucaagguaccacccucucagugggggcagcuccaggcagaagaagcggaugugugagaaucuacagacguggguuccagccuccacucagcauuugugcucuggggcaaaucaucgccccucucuagaccucaguuuauuugcuggagugggggcugggcuacacggucccuaaaguucccuccagcucuggcauucuacaccucugagccuucugaaccagauaaaaaaggccucagaguauuagaaagcaauagagacagaggggaggagggcugagccacucaugcagcuaaucaggcagauggacaguaagacaaggacaucaaggugcucaauuccugguccauaggaccaaagaucugacagagggcuagacaaugucauguugaaguucucagacaggccucaguggagagaguggggaaagcuuggggacaguaagauggaaagaaccuggccuccaaagacuaggggagauaagggaaccaggaagagggccauccacgcuaugcucacugucauguccuacccacacagccugccccucuccuuaccugccaugauguuaccagcuggcccaguggccugcccacaccucuuuguccugaacugcaaggaaagaaaagccagagaaggaugagaucagggccacacccaacccagucccucucuacuccucaucugggcugcaagcuccccaggacaggacccagcacauacucccacagugccgugaaugcaauggaggcagcuccccuccucccagagccacccuuccaccagcugcaucuuaccagcugcucccgcccucugcuucaaggcacaaaaucuacucucugaaaaccccauccaaggguaggaaaggaaccugggaggggaucccauacagggaaagccaagugacauucuauuccuugaccuugaauuacagacugagccucggccuuggucacaggcuagccucccuuugcuccuuuugccuuuguucauuuauuaggacacuuauauggugcuggaagaaugagugagacagauguggucccugcucuccccaugaaacagucaaucaccucugcaguaaaucauacaaaaggcaagcacagccaccgugaaaacauacacaucauguccuggugaucuaaucuggucuggagaggcagggaaauuaaauuuuuuuaauuaaaaaacuuuuuuugagacagggucucucucuguugcccaggcuggagugcagugguauaaucccagcucacggcagccucagccuccccaggcucaggugauccuccaagcgcagccuccugaguagcuggaacuacaggcaugcaccaccaggcccagcuaauuuuuauauuuuuuuguagagauuaaguuucgccauaucgcccaggcuaauuugaauuccuaggcucaagcaauccaccugcuucagccucccaaagugguaggauuacaggcaugagccacugcacccagccucagggaaauuaaauacaagugguaguaaaaaccugaagcaugaagaggaguuccccgggcaaaacagccuucuaggcagaugggaaagcaucguacagggacaguuccuuacuaggaaggagcuucacauuuuuuuuuuucuuagacagggucucacucugucacccaggcuggaguaaaguggcacuccugggcucaagccauccuccugccucagccucuugaguagcuagacuacagggacagacuaccaugcuaauuuuuuaauauuuuguagagaggaggucuugcuguguugcacagcuggucucaaauuccuggccucaagcaaucuucccgcuuuggacucccaaagcacugggauuauaggcaugagccacccaucauaagggaaagaaagccacuauggccaaagcagagugcaaaugagggggcagcagaugaggcuggaaaggcaaggugggcaggaugugcuuccugagacccuuaggagacaaguuugaaggggucuugguuuuaaggaguaggggaaagggagcaauuggaagacucccugcccacuuaaccccgaguggaugguggagacccaucaugacaagccugugugagaugaggcggagguuccaggggaggacgagcagcugugcuagggacauacaggguagagacgcugggggacaccuggacagggcgucuuauaggaaucuggaggguacaaacaugcucugcuccugggaguucagcaggaggccuggcugacccaugcuaaguaaucacuggcaaguuaaggccaaggaaaccaagcagcaaucaccuuguuagaacagugacuuugguggacauuuauauagucaacagcagaaaaugguccacaaccaagugcuaaggcaaugcaacauuuaaaagcugggcagaaauuugcuuaaaguuuuggaacaggaaaaacuaaaucuaugguguuagaagucaagauaguauuacccuugauggggcagcgacugggggcccggcaucuguucuuggucgggguucuggauacacaaagguauggauuuugugaacauucuccaagcauacaguuacaacuugugcaaucuccuguguguuagacuuccaugagaaguuugcuuuaaaauaaaaacuucaggcugggcauaguggcucacaccuguaaucccagcauuuugggaguccgaggcaggaggaucacuugagcccaguaguucaagaccagucuggccaacacagugagacuccaucucuacaaaaaauaaaaaauuaggcaggcacgauggugcgugccuguagucccaguuccucaggaggcugaagugggaggauugcuugaguccaggagguagaggcugcagugagccaugauugcaccacugcacuccagccugggcaacagagcaagacugucucaaaggaaaaaaagcacacacacacacacacacacacacacacacacacacacacaaacuucuagcauuccagucaaauucuucuggaccugauuaaaagaucgggcaauuacaaucuucggacucuuuugugauaugggaucaaauacagauacaaaaacccaguaacaucuaccacaaaaagagaagagaaggguaugauagagacaaucaggaaaugauacccauacacaggugcauuaauugcggcacuguuuugaauaacaaaggauuagaaaccaucaauaggggacugauuaaaccaaugguagucauacaauggacuguuccgcagcuauuuuuaaaaaugcuuugcagcuguuaaaaauuuuaaaaagaggaagcaguucucuggguacugauaugcaaaagucuccaaaaagaugaguaguuaaaaaaagcaagauguacaacagucuguauguuauacuuuucauauuaaaaaaaaggaagagaagauaauaagaauauauuuuccuuuuaaccuaauaauccugcuccuguuagucauuuacccagauauaagaaaugacaaacacacacguuauucgacaugacacuauuugcauuagcaaaaugcuuaaagcaaccuaaaugugacuauuugaauauacgaggugcaucauacaauagaguauuacacagauguaaaaaagaugccagccauggugacucacaccuguaaucccagcacuuucagaggcgaaggcaggaggaucacuugaggucaggaguuugagaccagccuggccaacauggugaaaccccaucucuaccaaaaaaauacaaaaauuagccaggcaugauggcauaagccuguaaucccaacuacucaggaggcugaggugggagaaucgcuugaacccaggaggcggagguugcagugagccaagauuucgcugcugcacuccagccugggugacagagugaaaccaugucucaaaaaaaaaaaaaaaagaauaaagaugagcucaguaaacugcuguggaaugcuuuccaggauauauuaaguaaaaaaaaaaaagcagagcacaaaaaguguaaaucauaugcuaccccuuauguaagaaaggggaaguaagaaugcacauaugaauuugcuuauuuuugcaaaagaaacacaggaagaaucaaccagaaaguaaugaaauagucaccuacauaacggaagggcuacgaugaguagagagacuuccauucuuuauauacuuauuaauaaguuuuuuuaauauacuuguacacauaaaaugacuuccauauuucaaaaacuuaaaccaaaaagaaaagcaaacucuaaaacugaaacaaaaacaaaucaagcuaacuauacuuuaaauugauaacaaucucacagacaagaaaaaaaaaagagcccaaguaacuuuugaucacaguaauucuggguucuccuauguucuccuagaaagauaaaccucaagggcaaaaauaacugcaaacaggccgggugcagugguucaugacuggaauuccagcacuuugagacaccaaggcagauggaucgcuugggcccaggaguucgagaccagccuggguaacacagcaagacccccgucucuacaaaaaauacaaacauggccaggcaugguagcucacgccuguaaucccagcacuuugggaagccgaggcggguagaucaccaggucaagagaucaagaccauccuggccaauauggugaaacccuguucucuacuaaaaauacaaaaauuaccugggcgugguggcaugugccuguaguuccagcuacucgggagguugaagcaggagaauugauugaaccugggaggcagagguugcagugagccgagaucgugccacugcccuccagcccggcgacagagcaagacuccgucucaaaaaaacaaaaacaaaacaaaaaaaaacauuagcgggacauggugaugugcgccuguagucccagcuucucaugaggcugaggugggaggaucacuugagcucaggaagucgaggcugcaaugaagugugauugcgccacugcacuccagcccgggcggcagagcaagacccugucucaaaaaaagaaaaagaaacugcaaacaagucaugaauuuuagcaaguuuacucuuacugcugguacugcugugacgacucuaaagcuuugcccguauacuacaggagagggcaaaugaaucagugugcugauuauuuggggaaggugguuucucacuguaggagauacaauucagaccgcggaaagguaagaaagagccuugugguguuggauucaaagcggagguaucaguaugaacacagaauuuuaaaaauauauauggcuggucccaagccaggaaaaggaaauacaagguuagccuggaacaucuugugguaucauaaagaagaaaguacucaauaacuaauggaggcaagucaaaaggacacaagaaccagucugaaagggcuaccaccaaccaaauuugggacaauuagacuaucaaaaguaauaaccacguggauuuuuuucucucuuuuuuuucuugagacagagucgcgcucuguugcccaggcuggagugcagcagcaugaucucagcucacugcaaccuccgccuccuggguucaagugauucuuuugcuucagccucccgaguagcugggauuacaggcacccgccaccacacccagcuaauuguuuuuuuuuuuuuuugagauggagucucgcucugucacccaggccagagugcagcggcgugaucucggcucacugcaagcucugccucucuccugccucagccuccccaguagcugggacuacaggugcccgccaccacaccuggcgaauuuuuuuguauuuuuuuaguagaaacgggguuucaccguguuagccaggauagucucgaucucuugaccucgugauccaccugccuuggccucccaaagugcugggauuacaggcaugagccacagugcccggccaauuguuguauuuuuaguagagacaggguuucaccauguuggccaggcuagucuugaacuccuggccucaagccauccacccaccucagccucccaaagugcugggauuacagguaugagccacagugcccggcccacauagauuuuuuuuauuauuaauccaugaguccaaagugacauuauuauuuuauuuuuuaaaagagagggagggccuggcucaguggcucacaucuguaauccuagcacuuugggaggccgaggcaggaggaucacaaggucaggaguucgagaccagccuggccaacacagugaaacccugucuauacuaaaaauacaaaaaauuaacugggugugguggcgggcgccuguaaucccagcuacuccagaggcuggggcaggagaauagcuugaacccgggaggcggagguuucagugagccgagagcacgccacucuacuccagcccgggugacagagcuagacuccaucucaaaaaaacaaagcaaaaaaaaaaaaaaaaaaaaagggaggccgaggcggaucacuugaggucaggaguuccagaccagccuggccaacauggugaaaccuugucuccaccaaaaaauacaaaaaauaaccaggcaugguagcacgugcuuguagucccaacuacucgggaggcugaggcaggagaauugcuugaacccgggaggcggagguugcaguaagacgagaucgcgccacugcacuccagccugggcgacagagugagacuccgucucaaaaaaagaaagaaagaaagaacaucaugugccuccugcuaugcugugcacagaaggacucaaggucauguaugaauacuguugccaaaaaaagguuuaaucugaaaauaauuaugaaaaaacaauccgacaaauucagauugugggaaauucuacgagacaaauguuaaugucaugaaagacagaaauuggcagggggaauuuaucuaaauuaauggagacaaaagaggcaugcaaccaaaugcaauggggaagccuggcagaauuuuuuuuuuuuuuuuugaaacggaguuucgcucuuauugccuaggauggagugcaauggugcaaucguggcucgccgcaaccuccgccucccaaguucaagcgauucuccugccucagccuggaguagcugggauuacaggcaugcaccaccacgcccagcuaauuuuguaguuuuaguagagauggcguuucuccauguuggucaggcuggucucaaacucccgaccucaggugaucugccugcauuggccucccaaagugcugggauuacaggcccggaucuuggauuuuuuuuuuuuugagacaagagccucacucugucacccaggcuggagugcaguggcacgaucucggcucacugcaagcucugccucccagauuuaagcgauucuccugccucagccucccaaguagcugggacuacaggcgcacgccaccacacccagcuaauuuuuguauuuuuaguagagacuggguuucaccauguugggcaggauggucuccaucucuugacuucgugauccgcccaacuccgccuuccaaaguacugggauuacaggcgugagccaccgcgcccaaccagguccuggauuuuaaaaucacagcuauaaaggacauuuuuaggacaacuagagaaacuugaauauaggcugcauaguagauacuacuauucacuauuaaauuucuuggguauuguaugugugcauguuuuuguuucuuucucucuuucuuuuuuuuuuuuugagacagggucucacucugucacccaggcuggaggagugcagcagcacaaucacagcucacugcagucucaaccucccaggcucaagagauccuccagucucagucuccugaguagcugggacuacaggugugugccaucaugcccagcuaauuuuuguauuuuuugcagagagaagguuucgccauguugccuaggcugaucuugaaguucugggcuuaagagauccacccgccuuggccucccaaagugcugggauuacaggcgugagccaccaugccggccuguagaacaccuuuguucuuagaagacacacgcuggucuuuagaagcagugucuggucuguaacguccuuucaaacgguucugcgaaaaaauuuuauacauauacauaaagcagaaacaagcaugguggugugugccuguagucucagcuacaugaggagcuaaggcaagaugaucacuugugcccagguguucgagccuucagugagcaauaacgcaagauccugucucuaaaaaguaaaaauaggccagacgugguggcucacgccuguaauaccagcacuuugggagaccgaggcgggcggaucaccugaggucgggaguucaagaccagccugaccaacauggagaaacccugucucuauuaaaaauacaaaauuagccgggcaugguggugcaugccuguaaucccagcuacucaggaggcugacgcaggagaaucgcuugaaccccggaagcggagguugcggugagcggagaucacgccauugcucugcagccugggcaacaagagcgaaacuccaucucaaaaaaaaaaaaaguaaaaauaaaagauaaagcaaauguugcaaaauguuaauaauugaugggagaaggguauacaguuguucacugcauuauuuuauuuauuuauuuauuuuagauagggucucacuuugucacccaggcuggagugcagcggugcaaucauagcucacugcagccucgaacuccugggcucaagcaauccucccaccucagcuucccaaguagcugggaauacaggugugcgccaccaugcccagcuaauuuuuuuauuuuuuguagagacgaggucucgcuacauugcccaagcuguucucaaaccccugggcucaagcgaucuacccgcccuggcuucccaacgugcugagauuacaggcaugaggucacugugcccagcccauugcccuauucuuuaaacuuuuuuguagcuuugaaauuuuucaaaauaaaaaguggggggaaauauacauaucuguauuugacaauauaugcacaaagaaucucuggaaggauaucaagaaaaaaauaugguaauuguggcucucuggggaacaaaggaacugaauggauauagaguaggugggaagcagaauauuuacuauauaacuuuauaccauuuccauauaauugaugacaucaucaguuuuaagacagaccauuauuuuauugaccaaaaguaagaaaaaacauugccaauuugcaggcugggcaccauggcucacgccuguaaucccagcacuuugagaggccgagauggacggaucacuugaggucaggaguucgagaccagccuggccaacacagugaaacucugucucuacuaaaaauaagccgggugugacggcgugcgccuguaaucccagcuacacaggaggcugaggcaggagaaucgcuugagcccaggaggcagagguugcagugagcugagaucgugccacacugcacucuagccugagugacagagccagacucaaucuccaaaaaauaaaaauaaaaaugccaauuuguaacuguaagaugccagaaauuuuaaaacacagacaugaaaauguuuucagaaauaucaaaauguucaucuuagaacugacaaaauuuggaacaucuuugugaacuguaaaucauauauaaaugcacuaccuauucaaaaaaauaaaaagucaagaaaguuaagcagaaaaaaaaaaggcaagcagaauaggauaguuggggaagaaugagaaggagcagcugaugagacacgaggaaagcccagagagcguggagucuccauagccaggggcagagauuggacaaaugugauaaugccacugagggcucccaugugaaaggauggcacuaccgggacuaacgcguucaugacacuaacagcaucgagucagcugugaauccagcaagaaucguuuugguggugacagcagugauaaagaagccuggcugacaauauacagagagaauagagauaggguaccaccuggguaggauauggggguagggagagggcccagggagggcugcagcugggggucauuuuagguggaaauaagccagagauguguaggauacauagaaagguugcaauuacaguagagacagauguuaccugauagacaaagcccgugaagagggagacacaggggcaccagugcaaggagguggacaagccuugauccuaacaggugggaagccgaacaggauccaagcagaugcaggcagguuugaggucuuagaugggcagugagagcaucuuggaugucugcuucaauuuucuguuuuauuauuuuauuuucacaggcauucaauuuuguuuuauuuuuuauuugagacagggucucacucuauugcccagccuggagugcgguggugcaaucacagcucacugcagccucaaccuccuacacucaauccauccuuccaccucagccacccaaguagcugggacuacagaugcgugccaccaugccuagcuaauuuuuuguuuuguuuauugguagagaugggguuucaccauguugcccagguuagucucuuuuuuuuuuuuuuuuuuuuuuuuuuuuugagaccgagucuugcccuguugcccaggcuggagugcaauggcaugaucucagcucacugcaaccuccgccuccuggguucaagcgauucuccugccucagcaucccgaguagcuggaauuacaggcacgugccaucgcaccuggcaaauuuuuuguaucuuuaauagagacgggguuucaccacguuggccaggcugguguccaacuccugaccucgugauccacccaccucaaccucccaaagugcugggauuacagccaugagccagggugccuggccgccuagguuugucuugaacuccuggacucaagagauccacccgccucagccucccaaagugcugggauuacagauaugagccacugcaccuagcccaauuuucucugugauagaggagacaagaugaaggugagagggaggagauaagcguacaggacccagcuaaaucaaggagcaauucugacacagccugagcacucugggagagcagacucagaaagcugugguaacacagaacaccucccuggucugucuuacaggagucaaggauggcuucauagauauuggaucugaaucuuuuuuuuuuuuuuuuuuuuuuggagucucgcugugucgcccaggcuggagugcagugacgcgaucucggcucacuugcaagcuccgccucccggguucacgccauucucccgccucagccucccgaguagcugggacuacagacacccgccaccacccccggcuaauuuuguuuuuguacuuuuaguagagacgggguuucaccguguuagccaggauggucucggcuaguaucgaucuccugaccucgugauccgcccgccucagccucccaaagugcugggauuacaggcgugagccaccgcgcccggccuggagcugaauuuuuaacaaggaauagggaguuggccagggaaagagaaucaggaaagcaggugugaaagucagaagagcaauagcacggcauacuuaaggaacgaaagaggcagaggaaggaugaaucucaaagugaagggagcaaaggaaaggcaaaauggaguugaaagguaaauggggcuaggucauccuggccuugaagaccaugggcaguauuuggacuuuguccucagugucacgggagccacugaaggauuuuauucuucuucucuucaaaaaaaaaaaaaaaaaaaggcugggugcgauggcucacgccuguaauccuagcacucugggaggccgaggugggcggaucacgaggucaggaaauugagaccauccuggcuaacacggugaaaccucgucucuacuuaaaaaauacaaaaaauuagccaggcuugguggcgggcccguagucccagcuacucgggaugcugaggcaggagaauggcaugaacccaggaggcagagcuugcagugagccgagauugugccacugcacuccagccugggggacagaacaagacucccucucaaaaaaaaaaauggccuuaaagguuuuuuaaauaugccuagcccgguggcaugugccuguagucccagcuacucaggaggcugaggugggaggauugugagcccaggaguuggaugcuacaaugagcuaugauugcaccugugaauagucacugcacuacagccuggacaacauagugagaccucaucucuaaacuaauuaguuaauuaauauguugcuuuuuagcuaucuguaaaaauauaugcaauuaaaaaaaaaaucuaagugcauaaaguagaaaagucuucccaaaauccacuuucucagaugccaccccuuuaacagucugaucuuuagguuugguggauuuuguuggcuuucauuuuuaacguauauagaaucauauaugacaaaaaugagaucauuccacacauccuguuuuauaaccuguuuuuuuccacucaacaauaucucgugaaaguuuuucauguuaaugaauacagaucuaucucaaucuuuuuaaugacuggucgacugggucaacaauauccauggccaugaagcagucaggugacaaguugauauggcaaucaggaaguguuuuauuuuauuuauuuauuuuugagacagcgucucucucugucagcaggcuggagugcaguggcgcgaucucggcccacugcaaccuccgucuccuggguucaagcaauuccccugccucagccucccgaguagcugggacuacaggugcgcaccaccaugccuggcuaacuuuuguguuuuuuuauuuuuguuuuuguuugguuuguuuuuguuuuuguuuuuguuuugagauggagucucgcucugucgcccaggcuggagggcaguggugcgaucucggcucacugcaagcuccgccucgggaaaacaugggggugguuccaccucccccacacacaccccaaccacccucuacaugagcaaagggccuggggagaguaguccaguuuggaauacuccucccauggaauagaaaggggaacugaugggaaugaggagagggguuucuauaagugaugaagggauggcugagacuggagacccuuccuggcagcucgggugacacacaggcaaaguggcaaagugguugagggcauggaguucagaaagaacacggaagaggcaauucaugagauggagaaaauggaggugucugagaacuagaggucuccuugaggucagagcacauaaagcauuaguuagacuguggucagagagaaauacuagaguuuaagauuucagagguggccacaugccaaugaggaccacauucagauguaguugguuaaaauggugacugaaagaggcacuaccuccccugagacaaugggacauggagugggagacugugguccagcacuaaagaccuccaggaaaacaaggaagcagagggagaggagaaaacaacuagaacauaggggccucaaaggaggagucuucucccuaaccgggcuccagccuaaccccugucccuggucccagacaaucucccaaaagucugcuuacaguuccagagaagucagugcagcaaaguaugaauaauucagagcagaaaccagagcagagggcaaagcugccuuguuuguauauaaagguuagggcagagagaaucuggggcuugagagggugguaaaagacuagggucacagaaauggaaggcuccaggcuucucugcccuuguuucugggaagccuuugaaauggggggugggggguuggaggggaagacagcaaucacuggccucugcaaaccaaaguucuuuuuuuuuuuuuuuuugagauggaguuucacucuguugcccaggcuggagugcaguggcacgaucucagcuaacuacaaccuccuccacccaaguucgaacuauucuccugccucagcuucccuaguaacugggauuacaggcgugcaccaccaugccuggcuaauuuuuguauuuuuacuagagacacgguuucaccauguuggccaggcuggucucgaacuccugaccucaggugauccacccgccucggccuccccaagugcugggauuacaggcaugagccaccgcgccggccaaaccaaaguucuuagacuacaaaacagaagaauuagcaaucugcucaacugauaaucuuuuauaauggggauaagggcuacauaucccuccaaagauguaggccuagggaaacaccuuaauuaucaauaagauagcaguuacuaccugaauuuuguucaugaaacccuaacuauaauguauuccauuccuuauugugaagcuaggacagaagcccccacaguggggagacugaggccucuggcagcagacgagggucaagccuggcuucagaucaggccagaguccuggggcuaacuccagggcucccugcucaccaguaugggccccucaucccuggcacagaaauggugauuccuuuuugcugcccagagccaaccugcuaagauggaaguuucccccuccugcucuaccuccaauccccucaucccacuccuagccccaucuucugcccugaaaucccagaacuaugaauaauccucagaaaacagcagucuccuggccaugcugucccuguccuacugaugacuauucaguagccuccuacagaucuuugccuggcauucaaggcuuugugccagucagcuacaaaccucccucccaccaccuuuggcugcucacagguugaccugccuccuacacucccagccucaugcaggagaucaucucuagccgcccccucugcuuccagugccccuaaauuggcagcacuaucagcuccucuaaguccugcuaccuucucacaucccaccccuucugggaagccuuuccaaaaaucgcugcucugcaucccgcugcauacauuuugagucagucauugggcacuaaguguucacgucuucucccauaaucuccucacucccuccuggauggaguuuccaggagggacccagcacagagcacagucaauccauauacuugcuuaagacuuggacacuuucccaaugggugggagggaggcaauuaacgcccucccccaaucagauuaagcccaaagcugcugucaaaccugcuguaucacacuuccuccaggaaaccuuccgaaacuccuggcuggcagcagggaaggaagugcagccuguaaaggaaaugcuguggggggcaagggguggggauagggacagggaggcagagggauaggggaggaaaggaaaaggaagagggagaagaaaggggggaugcucuaaacuagaacaaggagcauccucaagggaggucacuacuuaguccuauuauuucaucucuagagaaaggugcuagaaagagaugcccagagaggggaggugacuuggggaacuugcuuggagguggccacucaggaaacgguuaaagaaacagccacagagcccaaggucucucucuagaacuccccuccugggaccccacuaacucuccaagggguuugcuaaaccuaagacccucuuucaggggcccauucaccagagacagcccccucucagcucuagagacuuugcccuaaggcucaccaagcccagaacaaaccuaaguuagcaagaccuguguagccccaaacaaaaucucucugccaaucaugccccugcaagaaccaucucccucuuucagagcccugcuccgugaggcagaacauguaggggacagguugcaaauuucuccagacuccaccaccccaugggcagucacauggcugagcucccaggcucagcccccaacagcugugcucguuuucaucccugugccuuugcccauacauucuccuggaaugcccucucuugccucuccucccacccaaaucccaucaccucuggaagucuccuauucgcuagcugucgccucccuuucucucugugucccugggaaagucugccaggcccucacugaucuccccaucgggaagcugggacauuacuuguuuaagccgccugugacagugaaugcucaguccgagucucuacuugguucccccaacccacagaccaggagcuccccgaggcggaggacaaggaucgguucacaaacaccucaccuccauccucgugaccuccggccagcguugaaaugagccaaauccggcgcccccaacucaccacccaaagcccugauggagcccgccugguggccugggccagcgcgcccgucgccucgcaacccuggggcggcugagguccgccauccaaaggucggccgcccgagggaggugagggaagucaacccggguccaccugcaggcgcuaguuggaaggaaaggcccaaaggaagccacgggcacccccuuccagucgcccccauccccggcugcgcacgccaucuccagaaggccgguuuccagggaacgccagguggggcuggcgggggggauggagggcccaaagcucaggcuccagauccagggucugacgucacccaaaggcccaguucccucugcgggagccacagaugggaaugggggggcuuggggggcucggggggccugggugcgcccugagcgcucucccccagccccaaacaguaaaggucaccuccacucccaccucuccagcaguucggccuucuuccugcauccaaaggugaaguguaggaggaacaaagcugcagccagcgacccccacaccucucgccccgcgcccagcuucccuucaaagcucuccucccagccuucaugcccagacucaccugccgcggccguucggcugccgaaaggccgcagcgcugcgcugagcugcgcugcacccgagcgaugcggcgcggagccggccgcgagccgcuccggggcugggggcggggagcgcgcgcgcgcgcgcgcgcgcccgag

SEQ ID NO: 192059 - RNA, 44392 nt, Homo sapiens
uuguuucuuugaauuuuaucuuuauuucuccauaagggcaaucagagaaauaugcuuuccuuuuuaacaagcucaucuuuaaugugguagcaaagauggaaggugcgagaccaaaucuuaccaaacuagcuauuuuuacaggccaauaaagcaacaugcaaucccccucaacaaauuuaaauaaucaggcaauacuaagaauguauauuccauuaaacuaaaauaaacaagguugaaaugugguacagaauucacugaugagccugugaacuccacgugaggauguccagugccuuauuuaucucaguaaccagaguacccagcacacaagauaaaaguggguauuaccuaaguggccacuauuuuauuaauaaugcacauaacauaugcuuaucauuaacucuuaaaaagauuauuauuuaacuauacaagaacuaccauacaacauuucaacauacaaguuccuauacuucuuaagauacacaauaauauuuugaaagauuggaaauguuucccaaggacuuuccuaucacaaaucccccccaguaaaaauuauaggaacuguggaauauggcugcuaauauucugagaugaauuuagaaaguauaaguauugagagauggacuuuauuauagcaccuguagaagaaccaaauucaggcauuuaucccauauuuucugaaauauuuacaaagcucuuauaacauuuucaaauaacauuuaauuuacuaaguucuauuucauggcaaauaagaaucagaaaauuugaggaugcuauuuuuuaaguuuucccaauacaguuaaagcuuuugggauaaagcuguauuuacuaaaaugauccuguucucauuuguggugcucguucucuuugucauuucagagcccuugcuaagucacaugcaaaugguuacggagaucgugguacccacugucugcucccucuguguccucaucacugcuguucuacuaaugcuccuccugaggaggcagagcugagacaggauuaucaauuuuggagcuucauaagagaaucuucaggaucuuccucccuuuucugcuuugaggguuuccauacauugcuguuuucagguucuacaauaauuaccuuuuuuucucuuucucuuuuuggcuugugcugggauuuaagaauuagaaaauaaaaauaagcagaaauuaaaaaaaaaaacacuuguaaucucaccccuccuaaaguuaauguuaagauuuugcuguauauaaugaauguauauuaugaauuauuuacaaaaauggcaucauaguauacaaacuguugugacuugauuguuuaucacucuaaaaucuguccagaaauauuacuuuaauguucaaaugauugccaucucagcacugucccauaccugauagauaaaaucaaucuggcugggcacaguggcucacaccuguaaucccagcacuuugggaggcugaggcuggugaaucacuugaggccagaaguuugagaccagccuggccaacaugguuaaacccugucucuacuaaaaauauagaaacuagcugggcaugguggcgggcaccuguaaucccauuuacuugggaggcugaggcaggagaaucgcuugaaccugggaggugaagguugcagugagcugagaucacaccacugcacuccagccugugcaacagagaaagacuccguuucaaaagagaaaagaaaagaaaucuauagauaacaauccuuccagguuguaaauauuauuagccaaccacagaaaagcaugaaguggguaccaaguaaaugagcacguacacucuucugacacuuuagucugaauuuagucugacaacucugacuaaauucaacuuacuuuagucaaugaaauaccucaaagaaauauuacauguuuauuuuuuauuuaucuucuagguaacucaauaucgucuuuuuuauaauaaagauucauuuuacucuuaacuauguuaaaaugcuaaaauuaauuaauuuccauuuauuuggggauaaaacauggcuuaagaacaaucucaugcauuuuucucauuaucugauuuuacuuaauacuguuucugaaaccaaaaaagaauaagacaguagaaaaugucucuacuaaaaauacaaaaaauuagccaagcgugguggcaggcgccuguagucccagcuacuugggaggcugaggcaggagaauggcauugaaucugggaggcggagcuugcagugagccgagauagcgccacugcacuccagccugggugacagagcgggacugugucucaaaaaaaaaaaaaaaaaaaaaaaaagaaaaugucauuccauuaauucuuuugguuaauaugaucucaaaucaaaacauuuuaagaagaguauuuacaucuggggcuuguccuauaguugggcuggaauaaaauuauuuauaacaaaacuucgcuuucaacggcaaaucaguaugccuguucaggguuuuucucuugcaucaauguuuucaaaaucaaacucacuuucuacuacauauacagauuuuaaaugcaaagacauuaccacucaagaauuuuuuuuuauuucucugguuuuaggauuaaauugaccuauuaaaaguugaccacaaaagguagaaagaaaauuaaagaguugcacugcucaauaacaacugguaagccuuuuaugugauuacuaauaaucccuauuccuaauguagcaaaucgacauugauaauguagaaagaacuaaacguaagguacuuauuacaaaguauuugacaaagagacuaaaaugugaacauaaauaccuuauagaggacuucaucagcacacuucacuugaaaugcaccuggcugcagguaaccauguuaguaaagaauauccuuucuuccaggcuaccguuuaguguuaauuccgaaaaaucuguaaucaaaaagagagugagaucagaauugcuuaacacccugcuuuucuaccauguauaaugcugaauuuuacaccaauacaauaacuaagagguggucuaaauggcaaugugucuucuacuuuaagagaauucauugggaaaaauucaguaaggacacuugcuuuaaauaugaaacucuugaugcauuuaaaacaugauuaaauaaacuaaaaaugaagcagguuauuuuuuaauuauaucuuuuuaauuuggaaacuuacugcuuuauuuuuugugccauauuaacuaggguuacacaacugucuuuucuccaauccuaacauaaauuucagaaaagaauuucuauuuaagauuuguagucuuagggcuagacacauauccauuuuucucccaaagacuauuuuauuucaaaaauaaaugguccaaucaacauuuugaugggauaauguccacuuccuugugggucaacauuuugguuuccauauuuucaucauuaucaacaaucauuuacugagcacccacugggugagcagcacuccacuggucacguuuucuccuccauuaacuccaaaucauuacccucucucuuuccaugguggcuaaaaguacacauuucucucuuaagucucccugccuuugaugucaacuauuuuacucaaaagcaucauaccauuaaauuucuugaaaagcuaguauuggacuuaagugcucaguccaaagaaauaagaagucuaacuccuuaaaagcauacgaucuucgaaagaaaauuaaacauuuuaggccauauuuacaauuaagacuuuguuugaauagcccaugacuuuuacaaaugagauacccccuucgaaaaugggucuugcuuuggggauaaaagacacugaauaauuucuagacaaacauaucaagaauauaugauggcuacaagagguuauaaaguucaagccaaaauggaguuugaguguguuccuaagcacauaaauauaugauuuuauaagaauuccuuauuuucauaaaaggagucacuggaccaaugcacuagaaaauugcuuuaacuccaacauucaaaauaacuuucacucuuuuuuguugcaauccaugucaaaaagacauuaaaugauguguucaguauacuugcuuauucagcauuauuaggaaaagauguuucaucuuguaugaauuuccucaaaacagaacucuaaucucuacaaaauaaaauuuacuuuauuuuuuuggagacagaauuuugcuauugcugcccaggcuggagugcaauggcgugaucuugucucacugcaaccucugccuccaggguucaagcaauucuccugucucagccuccugaguagcugggauuacaggcacccgccaccaugccuggcuaauuuuuuguauuuuuaguagagacaggguuucaacauguuggccaggcuggucacgaacuccugaccucaggugauccacccaccucagccuuccaaagugcugggauuacaggugugagccaccacaacuggccaaaauuuacuuuaaaauggcauuuuuuucagcugggcacaguggcucacgccuguaaucccagcacuuugggaggccaaggcaggcggaucaugaggucaggaguuugagaccagccugaccaacauggugaaaccccaucucuacuaaaaauacaaaaauuagccaggcgugguggcacgcgccuguaaucccagcuaguugggaggcugaggcaggagaauagcuugaacccgggaggcggagguugcagugagccgagaucgcgccacugcacucuagccugggugacagagcaaggcuccaucucaaacacacacacacacacacacacacacacacacacaaaaaccaaaaaaacaacaaaaaaacaaggcauuuuuuucacaaauguuucacauauauuuaugucuuuaaaauuguccuuuuggccgggggcaguaguaguucgcaccuguaauccuagggcuuugggaggcugagccagggggaauauuucagcucaggaguuugagaacuccuggccaacauaacaagaccucgccucuaugaaaaauuuaaaaaggaaaaaauuaggcaggcaugauggcgcccacccauagucccaagcuacuugggacgcugaaguaggaggauugcuugagccuggaagauugagucugcagugaggcaagaucaugccacugcacuccagcuggggugacagagcaagacccugucucaaaaauaaauaaauaacauuuucuuuuuaaccauaaaauacguuucuucuuuaaaaaacaaaauauauguuuucuuuuuucuuuuuuuuuuugagauggaguuucgcucuuguugcccaggcuggagugcaauggcgugauaucggcucacugaaaccucugcuucccagguucaagcaauucuccugccucagccuccugaguagcugggauuacaggcaugcgccaccaugcccggcuaauuuuuuauauuuuuaguacaggugggguuucaccauguuggcugggucuggaacuccugaccucaggugauccacccgccuuggccucccaaagugcugggauuacaggcgugagccauauguuuucuucuuuaaaagacauguuucuucuuuaaaaucuuuaaagaauauauguuucuucuuuaaaaaacaauagauguagacagaauguuuacuuuagguuggugauucucagccacaguugcacaguggaaucaccugaagaacucuacaaauuacugaugucccagcuguacucccagagauucugauuuacuuggcaugagcaacagaacuuuuuuuuuuuuuucugagacagggucuugcucugcuacccaggcuggagugcaauggcacaaccucagcucacugcagccucaaucuccugggcucaacuaauccucccaccucagccucccaaguagcuagaacuacaggcauaugccaccacacgcagcuaauuuuuguauuuuuuguacagaucgggucccacuguguuacccaggcuggucuugaacucuuaggcucaaagugauccucccaggccuuagccucccgaagugcuaggauuacaaaaucgugagccaaugcaccuagcuuaggcaauagaaccuuaaaagcuuugcagaugauucuaauguucagcccaaacugguaaucaucucugcaaucaccauuccacaucucauggcuaaaguuggauuguauccuucuaggucuuuaucuaaguccccgucuccauguuuuugcuaccauaagcaauaccacaacuaauagucuuguucauaggucugauuuuauguguguaauaaauuccuacuuaugaaacugcuaggccaaagaauguauuuauuuauuuauuuauuuuuugagauggagucuugcuccgccacccaggcugaagugcaagagcacgaucuuggcucauugcagccccccacucccaaagucuagcaauucuccugacucagcaucccaaguagcugggauuauaggcacaugucaccaugcccagcuauucuuuuacaauuuugauggguacuaccucccacagaagcuguacaacuuuacauuccaaccagaaaugugugagaaugauugcccguucucccauacccacgccagcacagacaccaaacuuuuugaucuuugcuaauauggaaaagguaucuauauaauauaaauuugcauuucucuuauuauaggugagguugagcaugguuuauucuuuuacauuuuuuagagauggaaucucgcuauguugcccaggcuagccuugaacucuugagcucaagcaaucuuucccaccucagccucccaaguagcugggaguacaagcaagcauaucuuauuuuuaaaaccacauuugaauuuccuuuugguacacuguuuaccuuacuaucaauuuuucuauugagcuauuaauauuuuucuuacugaaauauauccccuuuucugaacauggguugcgaauuucuuuuuuugagacgaaaucuugcucugucacccaggcuggaaugcaguggcgcgaucuuggcucacagcaaccuccgccucccagguucaagugauucuccugccuccgccucccgaagagcugggacuacaggcacaugccaccacaccuggcuaaguuuuuguauuuucaguagagacggaguuucacuguguuagccaggauggucaugaucuccugaccucgugauccacuugccuggaccucccaaagugcugggauuacaggugugagcccccgcgcccggccuuuuuuuguauuuuuuuaguagagaugguguuucaccgugcuggccaggcuagucucaaauuccugaccuugugauccgcccaccucggccucccaaagugcugggauuacaggugugagccaccgugcccggccugggcuacaaauuucuuuuccuaguuuauaauuugucuguuuugccaugcagaaauuuuucuacuuuuacagcugauucucagucuuuuaucacuuccagguuuuguauaacacuuagaaaaaaacagcacaauuuuaacugauggcucucagaaaaauucaguuugguuaugacuuuuauaguucaacuauaugaacagagccucuaacugacagaaauuuccauuauaccuaaaucagaauauacuugggagggcaggagcacaaacauuuucuggaaaaauuuuuugcaaguuauuaaucaguaaaauaaaacuauuuguauucccagcaguauaggccuuugaaaucuaauuaauagauucagucugaaaacuaucagauuuguuuucaaauaaucuuuacauauuuaaaugaaggcauuuaagacccauaugaauaagagacaacagcaccguacaacccacgugcaugaagauaugaguuugaggguacuuccugaaggaggaagacuugguaggcuagcuaauuacacaaagggcuaaaagacauucuuugccuaauauggaccaucugugauagaauacuagcaaucucaacccuuauuucaaccauggagaagacacuaugacagaaauaucaucaucguuuuaaccagugcccaaaagugucaaguaugaaucagcauuuccaucuuacaaccuauuuuuacuccuaugucccuauugcuugaucucuuuuaguaaaaguuccucuauacaagauaaggagaaaaagcauucuuuucugauuauuauacacuaaauuuuucuggguauuacaguugcauaaaaauaaugauaguuuugugugugcgugugcgugugugugugugguguguuucugagacaggguuacacucuguugcccaagcuagacugcaguagugcgaccagcucacuguaaccuccacuuccuggguuaagugauucucccgccucagccuccugaguagcuggaacuacagcaacaagccaccaacacccggcuaauuuuuguauuuuuuuuuuuuuuguagagaugggguuucuccauguugcccaggcuggucucuaacuccugaguucaaagugauccaccugccucagccucccaaagugcugggauuacaggcucgaaccaccgggcccagcaguuuucuuuuuuaaagaauaaauauguuuuacacuuagaguucgggaaaauuacuuaaaacugggcacaggccaggagugguggcucacaccuguaauccuagcacuuugggaggcugaggcagguggaucaugaggucaggaguuugagaccagccuggccaacaugguaaaacccaucuuuacuaaagauacaaaaaauuagcugggugugguagcacguaccuguaaucccagcuacucaggaggcugaggcaggagaaucacuugaacccaggaggcggaggcugcagugagcugagauggugccacugcacuccagccugggcgacagggggagacuccaucucaaaaaaaaaaaagaaagaaaauacugggcacacaagagcuauaauaauaauccauuccaguaagauuuaguuuauuuucuuuuuucuuuuuuuggaggcagagucucacucuguugcccaggcuggagugcaguggcacgaucucagcucacugcaaccuccaccucaaggguucaagcaauucuugugccuuagccacgugaguaguugggacuacaggcacaugcaaccaugcccggcuaauuuuuuguauuuuuaguagagaugggguuucaccauguuggccaggcuggucucaaacuccugagcucacacaaucugcccaccccggccucccaaagugcugggauuacaggcgugagccgcugugcccagccagacuuaguuuauuuucuguuggaauuauuuaucugaacagauuauaaaccaucuuuaccagguuugugaaaauucagauggucuaugggugagcugucacucaguugccaaacugucuuaaucuucuuuugaccacuauauauuuccacucuccauuucuguggcuucucacuaaggaaagaauaaaacgacaaaagaaaaauuuucaaaaacagccauuuacuuccuucccucuacagccauuuagugaagucuucaugugauaagcacugaggacaaagagguaaacgggucacaauucccgcccuugagguguauagucaagagagcaagaaaaauaagaauaaaaauaacaauuuggaaaaaaaaaugcuacaacagagaaauacuagauguguuaggggaaaacugaagagaggaauguaacucggauuggggauagcagaguuggaaagaauccucagaggcugugaugugugagcugaguaugaaauaaccaggaguuaguuaggcagauaaacuccaggaugaaggaaugaaauguugaguaugcaccgaggguuaagaguguggaaugucugaagaaaugcaguaacacagcaucccugugauaggagacauuuaaacaggaggaaguccuggugggauuugaauuuuuaggaagaucauuuuggcaaugacauagaaaagaaagauaacagaggcagagcgcaguuaggaaaaaggauuuuaccacaguccagguaugaaaugaugcagaugugaaacaaaguaaugaugaugugaagauguagagaaggggacaaauucuagaguuaccaaggucuagucuagacucaguaaucuuuuuuuuuuuuuuuuuuuuuugacagggucuugcucugucacccaggcuggagugcaguggcgugaucacaguucacuacagcuucgaccuccaggccuuaggaaauuccuccuaccucagccucccuaguagcugggacuacaggugcaugccaccaugccuggcuaauuuuuauauuuuuuguagagacaggguuucaccguguugcccaggcuaucgguaaccauuuaaaggagugagggaugagcggaggauaagcacuacguuuuuguuuuggccauuagauagagauuaaugauggugauuugagagacaaaguaugggaggaggaaaaagcauugagaaggggaugagguguuaggcuuuagaguuugaacugcuacuucaauaagcuggggauucacagcuaauaggcauuuagaaagaugggucugaagcucagagaagcuggagaugugaguuaugaauuaucguuagccuagacaaguugaagccuugagaauaaaugcaaucaccaagggaagauaggaaguaagaagaaaagaaagcagaggguagaguucuggugaaaaguggcagaagaagaaguacuugaaaagagaacuguucucagccuuucagaugggccagagagguagaauucaaauuaagacagaugcuacgucacagaaaauaaggagauagguucaagacagcaauagugcuaaaugccaaacagccuuauacgugcuuacugaaguagaccgagcaugguggcucacaccuguaaucccaguacuuugggaggcucagguggucggaucaccaggucagaaguuugagaccagccuggccaacauggugaaacacugucucuacuaaaaauacaaaaauuagccgggugugguggugggcgccuguaaucccagcuacuccggaggcugaggcaggagaauugcuugaaaccagaaggcugugguugcagugagcugagauugcgccacugcacuccagccugggaaauaagagcgaaacucugucuaaaaaaaaaaaaaagugcuuacugaaguaggaagacugggugggccaaccaauuacacaaugagcuagauagaaaacaaucuuuuacugaaaagcauccacuggauuugacaauuagaaggucauuggugaccuuugccagagcaauuucagggggagugaugagaguuuggcuaagaaagaacuaaauacagggaggacauaaauagaguggcuauaguaugagagaaauuucaaguauaucauaugcugagagaagagucaaggagacccucauuggaggcaaccucaguguccauguggaugaacaaucuaucaucucagccucacaguucccuacuuccucuaaucccaaacccuucucucacucccacagucauacccuagacccuguuaucacuauccuggucauuuuucuccuaauccaucauuuccuuucuggcuauacuuuccacucuucucugaaggaauaacaaauacagagaaaaaugaaagacuagaggcccaacagucuagagagaggucugagagaaggaagagggagaacucucucagacuauggucacagaugauuaagguuucagaggugacgaagcucugggucaugaggucccuacugaauaugaacacugaaauugccuaggaucauggguggacuuaagauaauaaauuaaaaugcuuauuuauuaucauuauuauuauuauuuuuugagacggaguuucacucuuguugcccaggcuggagugcaauggcaugaucucggcucacugcaaccucugccucccagguuuaagcgauucuccugccucagccucccgaguagcugggauuauaggugcaugccaccaugcccagcuaauuuuuguauuuuuaguagagaugggguuucaccauuuuggccaggcuggucucgaacuccugaccucuggggauccacccgccucggccucccaaagugcuaggauuacaggugugagccaccacgcccagcuauuauuauuuuuuaauagagacagggucucauuauguugcccaggcuggucucgaacuccugagcucaaguuauccucccaccucagccucccauagugcuaggauuacaggcaugagccaccaugccuagcaaaaauugcuuaccuuugauauaaguucuuuacagcaguuggucugacuggcagcugaaaaauguguugcucaucaagaggauuuuguuuguaauacuuuaugcagauccugaaaaaacaaaauggaaccucuuuuggaaaaaagagccauuugacauaacguuuuucugguagucuaaagcucguaagggaaacauuuuauugaguacuacuaacuaaaacaucagcgaacacuuuuagagccacaaaaguaaacaaacaaacacaacaacccuacaaacaaaacuuagguuauguuuuuuucuuugaaaacaaaucucauucacuuuuaaaaaauuaauagacauauuucucauaaauauaaaauaaauuugaggccaaagaaaggcuucguggggagaaagagguuacagaaagagagaaacaauacaaaaaaaagaggcagaagagaaacaaaaguacagcuuccaugguuuucagaguccaaggaauuacaguuaacucauucauuccacugaucuauaauggggaaaaaaaaaacaaaacuuggagauucuauaaacaauaacaauuucaaacuuuccccucuacaacugaggcaaauuguaauuuuggaaaauguaaugguacauuuccuuccagagggaaaagaaacccaguccuuccacuggacaguucacuuccuaguuugaggccucaaauacacauaagauaccagcaguccgugucugagaauuuuuccaaauaaccucuagucaaacuaauuggaaucucaaauuacagcagucucuacaauuacagcaaugcuacugacagaggucuaguaguacuauuugauuccauuguuaucauuuagauggcuggcaaggcuauuuugacccaaauugacagggauauaaagaagagaaggaacuaguauuuacgaauacaugagguuauuagauccuuuuuacagaugaggaaacaggauucagugauggaaacuuccuaaggaaguuaggaagugaugcagccaaugucaaaucugauuccuuuugaauccaaagccuuuccugccuauggcacugacuuagacucaugcaugcuacuguaaagacaggaugaagagguucuauccuaacugguaauaaaaacuguacauauuuaggcuguaacuauuucaaaagaaauacauuucuauauaagugaagaauacagauguacuuacuguguuaaagaaaagaggaguucauguugagauuuaaugaaaggcaugcaacugacuaauauuucuagaauaugguggaguuuuuggacacgauaaaccuguucuuguauaucuacugauggagcaaugaaguauuccuggaaugaaaaaauauaagcaaaauagagauuuaaagcaccuguguaaccuuuguaaagaauauagguaugccuucuacaccuacauuuggaugcuugauaacaggcauuaaaaaaaaaaaagaccagaagaagcuagauagaauuucucaccuuucaauacuauuauucaaacuaaauuauagucaugcaccauacaacaguguuugagucaacaauggaucacacauauuacaguggucuuuuuuuuuuuuuuugagacagggucucacucugccacacaggcuggagugccguggcgugaucuuggcucacugcaaccuccaccuccuggauucaagugauucucccgccuuagccuccugaguagcugggauuacaggcaugcaccaccacacccagcuaauuuucauauuuuuauuagagacaggaauucaccacguugcccaggcuggucucaaacuccugaccucaagugaucugucugccucagccuccccaagugcugggauuacaggcguaaaccaccgcgcccggccuacaguggucuuauaagaucacaauagaacugaaaaaucccucucgccaguagugacuuuguagcuguaauguagugcaaugcauuauucccuuguuagcugugauauugguaugaacaaaacuauuccucaaaaagagccucaggcaggaccuucaggagguauuccagaaggcaccuauguuaucucauaggugauaacaguuccauguguguucuugccccuggagagcuuccagugcgacaagauguggaggcggaagacagugauacugaugaucccaaccuaggcgaaugugugugucuacgucuuaguuuuuaacaaacaaauuuaaaacaaacaaaaaaaaaaguuaaaaauagaaaaaagcucauagaauaagaauacaaagagaaaauauuuuuguauagcuguacaauguguuuguauuuuaaguguuauuacaaaaaaaccaaaaaguuuagaaaaauuuaaaaguuuauaauguaaaaaaguuauaguaaguuaugguuaaauuuuuauugaagaaacaaauuuuuaaauaaauuugguguagccuaaguauacaguguuuauagucuacaauaguguacaguaauguucuacaccuucacauucacucaccacucacucacugacccacccagagcaacuuccaguccugcaagcuccauucaugguaagugcccuguacagguauccacguuuuuaucuuuuguacguuauuuuuacuguaccccuucuauguuuagauacacaaauaccauuauguuacaauuaccuacaguauucaguacaaaaauauacuguaaagguuuauagccuaggugugcaguagguuauaccaucuaaguuuguuuacgccacucccugaaauuugaacaauaaggaaaucaccuaaucacacauuuaaaaaaauaaugacacauuucucagaauguauccccaucauuaagugaaguaugacuguauauacagauacaguuguccguugguauccauggaggauugguaccaugauccccuuuguauaccaaaauccauggaugcucaaguccuuuauauaaaauaguauaguauuugcauauaaccuaugcacacccuccuguaugcuuuaaaucaccucuagauuacuuguaaugccuaauacaauguaaaugcuacauaaauaguuguuacacuuacuguuuagagaaugacaagaaaaaaaagagaauaaugacaagaagaaauccacacauauucaguacagacauaaucaucccuuuuuuuugaaacagggucuugcucugucaccaaggcuggagugcagauagacaaaaaaguagcccacgaucacagcucacugcagcuucaacuuccccggcucaagugagcuuccuaccucagccucccaaguagcugggaccacaggcacagacaaccaugccuggcuaauuuuuuuauuuuuguagagauggagucucccuauguugcccaggcugaucucacacuccugggcucaagugauccucccaaaguguugggauuacaggagggagccacugugcccagcguauuuuuuuuaaacauuuucaaucugcaguugguugaauccauggaugcagaacccacagacauagaggaccaacuguguguauguauguuugugugugugugugugcgcguguguguguguguaguuuuugcuagaacauguguccacuaaaaauauaugcccuuaauaaaauguuuaaaauuugaauaguaaaaauuaaaccucagaagaauccaguugagucuauuuugcacaacagauauaguuuuucuaucuuguauuuucauaagagagaaaugauaaacaaauugauacuauaaauucauuuucaaaaggaucuuucaaugaacgucaaagaucaguacagacacuauucaacuuucugaaguuucugaaugggcuaggaaaauacaacaaaguucauaacgaugacccugaaacccaaaaguauacauuaaagauuauaaauuauuuggaaaauaaacuuucaaguguaauauaaaugaauaaagagaaaauaaaacaaacauugcuuuacagaaccuaucaaagaaaggcauucccuaagcauucuggauagaugagaugugugauaguacacuggcuucaguaggauauaacuauauauaaguaucacaaauuuauagagagugagaaaugacauugaaugggcuacuuuuuugucuaucuuacuaggcaguaauaacuacgggcacugacugucuuauuuauccauuucccaggaccuaagacaguggcuagcauauuauuggcaguuaauaacugcacacagaaugacugaauaaaagaaaaaccaauuuuagaauaaaaaaauaaacucaccaaaugauucaaagaugcaaguuccugaccuauuaagaaaaaacacauacaugcaaaaacacuucagguauuuucuauuacauauuaauagaaauuaauuuaaauuucuauuuaaauucuuaaauucuuaaauuacauauuaaggaaucuauauaaauuuuuuauaguuccuauaugaaagagauugucaagcuaaguaguuccucacaaaaggccaaguuuccuggcauauuauaccauaaauauauacuaauauuuauucuaaaaaugaucacagcuucucucucauuaaaaacaaccaaguguaggguauuaaaacagcaucucauaaaaggauuuuuuuauuuaaaauacuaacuuuauagaaccgcaaauguuugaacuaaaaacaaauaaauuaucaagaacuauggauauaaugcauuugauaucuuuauuggggggaaacuaaggcccagagaagggaaaugcucaucucauagugaaccagguacaaagccaggaaggacuacagacgaugagggacaagcagaaacagaaaauccgagaauaucugugacugauaacugugauguguuuuuuaauuuuuugagccaggaaagauacuuaccuaugaaaaaacugauauaaucuuucuuuaguuuguccaaaccaauuuccaaaagcauuugaacuggaauagucccacugagagaaacuguguccaugguuccaugauaagacugaugaaugagcuuacuuaguaaacuguuacuuccacuauggagcuagaaaucaggaaaauuuuauaaaaccaugaauaaauauauaaauaaacccaacaaguaaaagagaagcaaauuacaguagcuacaaacuaaaaauuauaagcuugcauuccuagucuccuaacacuauaaauuguuugaacaaaaccccccaaguuauuaacaucaguuuuuuguuuugagacagagucuugcucugucacccaggcuggagugcaguggcacgaucucggcucacagcaaccucuaccucccagguucaagcaauucuccugccuuagccuccugaguagcugggucuaaaggagcaugccacugcaccuggcuaauuuuuauauuuuuaguagagaugggguuucaccauguuggccaggcugcucucaaaguccugaucucgugauccgcccgcgucggacucccaaagugcugggauuacaggcaggagccauggcacucggccagaacgucaguuuuucaaaugccauuucuggaacugggugcagugguuuacaccuguaauuccagcacuugggaggcugacgaggguagaucacuugaggucaggaguuugagaccagccuggacaacauggugaaaccccgucucuacuaaaaauacaaaauaaacuggccgugguagcaagcgccuguagucccagcucgggaggcugaggaaagagaacagcuugagccugggaggcagaggcugcagugagccgagaucacagcacugcacuccagccugggcaauagagcaagacucugacucaaaaaaauaaaauaaaauaaaauaaaauuuaaaaagccauuccuaucucauguguuuaaguccaaagcaacuaagaaggguuuaaacuuaucauccccagauacgauuccaccaaagagaagccagagcuguuccuuugaaacuuuacaacuaggaauucuccucuccuagcugagaggagaaucuuuuccacaauugaacaucuucuucuacaccaaaaaucugcugcugcaguuaaacaagcucccucaaugguccaugcauguucauaaggaacuccucauuggcuacaauauccaacauacgaacuugauaauuuguaaauuaaaaagagcugugaguuuacaauuuaauuuguguuccaaauguuaaaugauucauuuuagguacucauaaaaugucauuuccccacuacuuucuauuucucuacuuuaacuuucaucauaaucuuugcaaggucuuuuuacaauauacacauaguuucacuuuguuugcacuaauaguacaugguaagguuaguaagguuauacuuguaaacaucucaugaacacagaaacucucaagagaaaaauucaacggcuaaaacuaaaaugccuagaaucacuaaugcccaauuaagcagagcuugcaugccuuuacucuggaauguaccuuguucacacccauaaaaguuuauaacuuuuauaaugaugaauugguagucauauuaccuaaaauaauuccuauuaaaaaucuuuuuaacuuuuuacuuagcuuuuucuugacuauaaaaguggcacaaguucacuguggaaaauucauaaaguagaaauauaacacaguuggaaaaacuuguuuuuuaugagacggagucuuacucuguugcccaggcuggaguggaguggugcaaucucagcucacugccaccucugccuccuggguucaagcaauucuccugccucagccuccugaguaucucagauuacaggugccugccaccaugccuggcuaauuuuuuugauuuucaguagaggcaggguuuuaccauauuggccaggcuggucucgagcuccugaccucaagugaucugccagccucagccucccaaagaguuggaauuacaggccugagucaccacgccugacuggaaaaagucauuuguaacccuuccaccagaggugacugcuauuaagauuuuuagcauauuuguuuccagauuuuucucuccaaaaguuaacuucauauacaauuguguauauuccuuuuuaucaaauauuguaagcauuucuccauaucauuuaucagcaucauuuuuucagcaacuauuacaugugccauauguagcuauaucauuauuuacuuagccauuccauuagcaagagaaauuuagguccuuuaaauuuuuaugccaauauaaaugaggcugagaugacuauucugauacauaaagucuugauacauauuuauguguaugagcuuaggguacaucuuaacaaaagaauuauugguucaaaggccaugacacauugugaggaucucaauacauuaccaaaauugcuuuuuagagaauaucucaacuugcauucucaucaguaguauaugagaauacucauucacagcaacacuuaacaaugacaauauuaguaguuuacacacacugggcccuuaaguaugagccaggcacuaggugcauuacauggauaacauuaaucaauccuggaacacuacgagguagauacuauucuuaccuuuacuuuacagaugaggauguuggggcacaagaaaaguaaaggaaccugccgaacuuuacacagcuagaaaguagcagagcugaaauucagacucaggcaguuggcuucagagccugugucuuuacaucaugcuaugcugcugagaaaaugaucugacacacacuacuaaaccuacccauggcuguauaucaccacguuguagacucuggaugaucaaugugaaacacuucaccaagucuugguaugaaaucacaccuuggaaaacaagucaguguaacauuauuuucaggguauuucuacagaucaaauauaucauuaaucuuaaggauacacaaaugaaguagaaagcaagaauuuguacuuugcaagcaggggaaagggaaagaaauuaaaguggcaaaaaaaaaaaagauuuaaugaauuucuaaagaaagaaaccaaauucagauugccaaaaaauaauaugcuuaguaaaauacuaaagaauaucuuuuccuuuuucaauaauuauaauuucaguaagguauauguuuugguucauauaaauagaucaugaaaauuaccuaagucuuauauuuaaaaaggcaggagaaaaggauaauucuacaaauuacuuugucuuaguacaauucuuaagcagaaugcaccaaugugucauuagaaaugaauuagauaaaguuaagaaccagacuuccccacaaaacuagugguacacacuguauuauuuccaaaagacuuaaaaauaaaccuaagaaauaagaggaaaaauuuaaaucaugauggacaccuacuacugcucauuuugcaccacaguugcucagcaaaaucaagaucacuccgaacuuugaaaagacgcuugacggaacgaucgacugcagcagugucaugcuucaaggucugaaaaagaagcaaccuucagagaauacucaguuuuuuuuuuaagugaaauaauuuaagccuucaaaugcugcucugagaaauuauggauucaugaacacacacaaagauaugaacgaauuuucuacaacuucauucacuaaugaggagauacaaaucaacagugaaaaacaagacccuuaauauuguuuuaaaauuauagugccuaaaagugagcauucagcuuucccuccauguaaaaaaaaaauuaaauuaccuuggucuccguuuuccuauuugucagaugagaauauaucuaguuuaauuuaacaguaccaucuuagaguauauuaauauaugauaguagagccauuuuauaguaauauuaacauauucauuucuacuucucugcaauugagcaacuaauaauacauauauaccaguucucuucaaaaauauuuaucaguucugaccaagcacaguggcuaugccuguaaucccagcacuuugggaggccaaugcagguggauugcuugagcccacgaguucaagaccagccuaggcaauauagugagaacccaucucuacaaaauauuuaaaaauuagccagacaugguggugcacaccaguagucccagcuacucggggaccugaggugggaggaucgcuugagcccuggaggucaaagcugcagugagccaugguggagccacugcauuccagccugggugacagagcaagaccuugucucaaaaaaauaauaauaauuaaauaaaaauauuuaucauuucuuaaggaaaacaauaaccagugcugacaauaaagaucaacaaaaauuccccuuaaaugcugccuugauaucccaaauccauuugcgaugguacaacaugaaagaugucagcauaaccgaauuuuaaaagcuauuucuguguauauuucuaacugauaauaaucacuuaccucaaccucagugucuuuuuuuguagaaucaccaaauccauccagcuuauuuaagucuagaaaguggcaaaaguuuauuagcucuugauuuuucugcuuuccaaauuauuuccauccuaauccuauuuucaaaugguaaauggggacaguagaagucuaacuaaggauuuuagcaaaucacugaacucugguggagauuauaauagauauccaucaggugggggugugaggaugaacggagguaacagaaaagccccugacacauggcaucaggcacaugguagguauucaaaggcuacugauucaucucuuuuuuccuucaaucucaaauauaaauuaaaucuuauuaauucuuaggauuacuuagaucucuaccauuagcaauucagaacaaaagcugucccucugaccauaacagaucucauagcuuuguauauauuccaaucaaaaaagaguaucaagcuuaaagagaaacuuauauuuaaacauagcaaguauaaauucucaauuaauaaaacaaguaauacaccauucagaaauuccugaacaaguucaacagcagauuuugcuuccaggggcucgagccauucagugacaccaguccucaaaccaucagccaaaaccuacaggagauuuaaaaaccccaaaaacuuguuagcagaaaacacuguuuaaucaauaaggauguauguaauaauaauauuaauugcaguaacauuucuugaguguuuaucacaucccagguacugcuguggugcuuuauguauaguacauguuauuuaauccuaacaaaacucuaugguagauauuacuauuauucucaucuuauugaggcuaagagagguucaguaacuugcucauggucacacaauuaguaacugauagucucaggauauauacccaguggucugaucccaaagaugguacucugaacaaugaugccacgugcauaggugcuacagaggacuuaagacugaggauacuggguuugcccuggagaugcuugcaacuuuggcaaagauagacggauaagacaaaugaaguagucuggggaugaauaaauguaaaaaguggaaguuuauauuaaaauaauauaaauauguaugcacauacauacaauaucucaauggacuuaagaaaaagcagucaagugccgggcgccguggcucacaccuguaaucccagcacuuugggaggccgagauggguggaucaugaggucaggagaucgagaccauccuggcuaacacggugaaaccccgucucuacuauaaaaauacaaaaaaaucagcugggcaugguggcgggugccuuuagucccagcuacucgggaggcugaggcaggagaauggcgugaacccaggagguggagcuugcagugagccaagauggugccacugcauugcagccugggcgacagagcaagacucaaaaaaaaaagaaagaaaaagcagucaaguuaggccgcaaaagccagugaaacaacuuguaacuucaguugcaacucaaaugugggaaccauaggcuggcaggaaaacggcaugaaauaagaugaagaggguggugugaucccaaccaggguagaaaaagcgacuaugaagcagcgggaaauaggauuagaagaaauaguagcuaaaccaucaagggaucuucaaaaguuuuuuaacuucauauggcagaaaacagccaauguugauuuuuuuggcaggaaaaugacaugaucuaguuaagaauuucucuaucagaaguaucaaggauggauuccuaggaaagagaaaauacaacauuucccaguugaaaugcuaucaucucccacucccggggggaggucuuuagaaaaaugugaagaugguugggcaugguggcucaugccuguaaucccagcacuuuggguggccgagacagguggaucacuugaggucaggaguucaagaccagccuggccaacguggcgaaaccccucuugaacuaaaaacacaaaaaaauuagcagggcaugguggugggcaccuguaaucccagcuacuggggaggcugaggcagguaaaucacuugaaucuaggaggaggaggcuguagugagccaagacuacaccacugcacuccaggcugggugacagagugagacuccgucucaaaaaaaaaaaaaaaaaaaaaaagaaaaaugugaauauaauuuuuguugucauaaaugauuaggagcauaggcgaacuuggggcauggaguuuggugggggccagggauguuaaacaucuugguguguguaccauggucccaaaucacaaacaauguuccugcccaaaugccaauagugccccuguugagaaacaaugaaucaucauuagcauggucccagaagaagaugguaaagauuuuaacuaagaugagcacagugaaagagacuucaaaggaggaaaagaauuguauauguauggggggaaggguagcaagguauauguggaauaaaagaaaaaauccuauccauuuauaaaauauaggggguugaacacagacagacuauggccacauguauaucuaagauucugugacuuuuuaagggagacuugaauuagacaaacacacauuuaaaugaacuugugccagcucuuccauuuaccaguuuguugucaccuucaggcaaaauaacugaaccagccagcaccauggguggcacacagcagaguggcagcuucuagcuauaguaguacguaguggugauagaaauaacaguucuuacuaaagugaaauaugagauuucuagcguaggaaauugaaggaacgaugggaccacagacagaaaugggggguuuucaaagaggauguagucuggagaagauaguuucauuuugacauacugacucuugaagcaauagcacucuacccaagugggaaauaauuugguggaaguuggaaagaugggaagugcuaucagcuuaaagaugaggguuuggagcuugcucacaaaggugucagucaaaucacugaauagaucagcucugcaggggugcagagagagaagggcagagaugugagggcaaaaguaugauggaggcccgcaguaaggguccuaaaagaggggcuuucaagaaagaagaaaggugagaaagguaggaaaacuaucaguuuuauacaaacagagaaauaauacuuacucauaggaaguaaaaguaucaaaaauaguugguacuaugcuagaugguaagggcacaauagggaaccaggcacucaaaucuaguagaggagacagauaaguaaacaaauuacuguguuuuauaaacacacugacaagagguauguguggaguucuacagcaacacaagccauucugugagaucaaugcaaccaucacagagagcucaccuagcaaagaggugggagaagugcauaccagguagaucaagaugcacacaccagaagaugauagaguaugacaggauccgagcuacaagcaaggagcuugguaugaugaggguuggggguucagugggaauggaaguaaagugugagauuaagcuaaagaaauaagcaggagccaauaagcacaugaaaucaaaacuacaaagagauaccacuucacuaccacuaggauagcuauaauuaaaaaacagacaauaucaaguguucacaaagauguaaagaaaucagaacccucauauacuacugaaagaaauauaaaauaacauaacuacuuuggacaacaguuauauuuuggcaguuccucaaaagguaaauauacaguuaccauaugaucuaguaacuccacccaagacaugugaaaacaugucuacacaaaaacuugcauguaaauguucauggaggcauuauucauaauagccacaaaguagaaacaacuaagaugucaaucgacugaugaaugaacaaaaugugguauauccacacacaauggaaaaauaaauaaauuaauuaaaaaaauaaaacaacacaaagggugagagaaaucuagcuauuaacgaccuaaugcucccguuaauuguaaggacaacuaccacagaaguaaaauuuaacugcccaaacugucagagcuucuaauggauacauaacaucugaagaaguuuugaguaacacaaaccuaaguaaaaacaacaauagcacacauguuuauaaaaacauagauuuaaggaaaggaauucuagaaggauacucacaagaagaaauuucaguucucuguagagaugauucaaaggaccucugggcucuccugauuccacuuuaauauucuaaaaaguuuccaaagucugucaguuuucuagugcuaauccuaccuucucuacauaaguguuauacuugcauuucaaacuaucuuucacacauuaaaaaauauauuucauaaaggaccaaugaauugaaaaaugaggucaacacaucauuuagaacaucuuacucagagauuuugccaucuugacccaauaaucuaaauuaaaaccacuuauccucuuucuaugacauaaacaauuguaccuauguggaacaacugcccuccucacacacuccccugccuuuucccaaggaauuuccaggaggacaagguaggagaaauuuacauaaauauaucucaagauucggugauaacuuagcauuaucacaaaccaaaaugaagucucccaauaaaucuguuuauuagacuccuucuaacuaaacuaacagugugcuguccuagccagaggucaaugucuuacaaaccuuagauugcaaacauaaaaaaagaaaaacguauaugccaauguauguaaauucccauuacaggaaaaguauaaagaauauaauuauccaugucugggcgcaguagcucacaccuguaaucccagcacucugggaggccgaggugagugaaucaguugaggucagaaguucaagaccagccuggccaacugggcgaaaccccgucccuacuaaacuuacaaaaauuagccagguuuaguggcaugccccuguaaucccagcuauucaggaggcugaggcaggagaauagcuugaaccugggaggcagagguugccgucagcugagauuaugccacugcacuccagccugggugacaguaagacucugucucaaaaaaagaauauaauuauccauaaucuugccacucugaaggaaccacuauuaacacuauccaggcuucuguauauacauuuuuuaaacaauauaguugagaucgcacuacauaaauaauuuauacuuuuucuuuuuucuuuuugcuuaauaagcacauccuauuauuaauauucaagauuuuaaaacaggcuuuuagagacuguauauaauauuucaucaugaaaucuauuuuaggccaggugugguggcucaugccuguaaucccagcacuuugggauuucgagaccagccuggccaacauggugaaaacccgucucuacuaaaaauacaaacaaauuagcugggcaugguggcaugcaccuguagucccagcuacuugggaggcugaggcaggagaacugcuugaacccgggagggaggcagagacugcaguaagccgagaugacgccacugcacuccagccuggcagacagagcgaggcuccgccccagaaaaaaaaaaaaaaaaaagaaagaaaucuauuucaacuauucccuacugaacauuccaguuuuguuuauaguauuuuggaaacacaguuauaucgcugcacugaauaucuuacacaugaauuuuuguuagcaauuuugacuucuuuuuuuuugagacagagucucacucugucacccaggcuggagcgcaguggcacaaucuuggcucacuaaaaccucugccucccggguucaagcgauucuucugccucagccucccgaguaguugggacuacaggcacacaacaccacacccagcuaauuuuuguauuuuuaguagagacaggguuucaccauauucgucaggcuggucuugaacuccugaccccgugauccauccuccucagccucccaaagugcugggauuauaggcaugagccacugcgcccagccaauuuugacugauuucuuaagacagauuccuagaaauguaaauacagagugaaagggcuuaauauuauaaugauucuugauguguuaccaauaacuccacccuuuuaagaauaagagggccaggcacaguggcucacgccuauaaucccggcgugagccacuuugggagguggaggugggaggaucacuugagcccagggguuugagaccagcuugggaaacauagggagacucugucccuacaaaaaaaguuaaaaaauuaggugugguggcguuugccuguaguccuagcuacucaggaggcugaggcgggaggacugcuugagcacaggaguucgaggcugcagugagcagugaucgugccacuuuacuccagccugggugacagaguaagacucugucucaaaacaaaacaaacaaacaaacaaaaacacggauucacuugagccaccacucaaaaacuuuauucaucacuagaaaauucuuaaguuauauuauuauagggcugagggcaacugauagaucagaucaccugacaaaaccuucacuggcugcccuggugagacguuaguggcaaggugggccuuucagaguuguccaagcucacacucagcaagugccaaggcuagaggcauggagcaccagcaacaaccaaguaagccaacauuuaggagucucaugaacccgaaaaggaaauagggcccacucuuaccagaguugcaguugaagagaguggagggauuugaagaaucucauccacaggacuccaggaaauauccaaagcgaucgcaguuugugaugcugugauuguaucauccaaggcagaggacuuaaagagcucauacugggcaaagccuuuggauguuaccugaaaagaguguacccagcagaucauuuagcugugcuuccacauggccaagaguccauuacccaaauuauuuugauccuugucccaaaagaaaaaagagcacacacgccauacuuuugggauauauacuuuccauauauuuuugggauauauacuuuccauauaucccaaauagaaaaguaagacaauucuuugaaaccacaaagauuggcuaaaaggcaugaaggcauuuuaauuuuggucauuagcugauaugaaaauaaacauaaacauuuucauacuacagaaaaauaucuagucaucuuaggagugaaaaaaaaccuguaaacuaggaaggcagguugacaacaauuugaagaaaauaauaugaguagaagcaaaacacuuacaguagacaagugaugucuuuucuuguguaaauuuuuuagguuuucaagauuuacagaauaauuuuuaucagcuauaggaaaugaaagaaagaaauguaaaggcacaacucaaaauuacauugucagagcuacaaaacuguaaucccucacauucucaauguaccacaacucaacaaaauaacuguuaaaauuaaauuuuaaaucacagauaagugaaauguuuauaagagaaugaaagugggcuggguaugguggcucacacauauaaucccagcacuuuaggaggccaaggagggaggaucguuugaacccaggaguucgagaccagccugggcaacauagcaagacccugucucuauagaaaauuaaaaaaacagccaggugugguggcaugugccuguagucccagcuauuugggaggcugcggugagaggauugccugagcccaggaggucgaggcugcagugagccaugauugcgccacugcacuccagccugggugacagaguaagauccuaccucaaaaaacuaaaaauaagaauuuaaguguaacagccaggcgcagcagcacuugccuguaaugccagcuacucaggaggcugaggugggaggacugcuucaggcugaguuugagaccagccugggcaauacagugggacccugucucuuaaaaacaaauuaaaaauaaaaauaaaauuagcuggccaugguugugcucuccuguagucccagcuauucaggagguuauggugggaggaucacuugagcccaggaguuugagguugcaguggccuaugaaugcacuacgguacccuaaccugggcuacagagugaggcucugucucuaaaaaaauaaguaaauaaaaaauaaaguggaaguugggcacgguggcucaugccuguaaucccagcacuucgggaggccgagggggguggaucuugagaucaggagccugaccaauauggugaacccccgucucuacuaaagaccagccugaccaauaugguguaaccccgucucuauuaaaaauacaaaaaaauuagccgggcgugguggcaggugccuguaaucccagcuacuccggaagcugaggcagagaacugcuugaacccaggaggcggagguugcagugagccgagaucgcgccacugcacucccaccugggcgacagagcaagacuccgucucaaaauaaauaaguaaauaaacacaaauaaaaaauaaaguggaaugaaggucaauacuacuaccaaaaauacaauuaaaugucuacgauuggaaacauauugucaguuuguaucuuccaaugaaauuuuucaauaauauacacauagaaauaaaaugaaacccaaaucaaagaaguguaaaccuccuguccagacuuuuggagaucuguuucugguguuucuggaauaccucccacaugcugcaaguuacacaccagaguagauuuauggugauuaaugcaaguucuaccuugugcacuuucaucauaacaauaucaauuuucguaaaaaaacaugaaacaauaacuauacaaaugaauaaauacacacacacacucucuagagagagcacucaccuuuacaacugaccacauauaagacaauuccuguaaugcuguuguuuguugugauaagcucagcuccuagccaacaaguaccuucaggaucugaacugucacaucuuacccaaaggggaggaagggcaguaacuggcagauuaaucuucaaaugggucauauuaggauugugagccaugguguaaaguccaauuaacugccuuuaaaacaagaguaaggacaaauuauagauagagauuuccaauucaagaauuucuuuaauuucugagagacagggucucacucuguugcccaggcuggaaugcaguggugcgaucauagcucacuacagccuuggccuccuuggcucaagugauccuccugucucagccucccaaauagcugggacuacagauacaagccacugcaucaggcuuauuuuuauguuuuguagagacagagucuugcaguguugcucaggcuggucucaaacuacuugccucaagcaauucuucugccuuagccuuccaaaguguugggauuauaggcaugagccaccacguccagccagaauuuucuuuuaaaaagauaugaggggucuuccauccuggcuaacacggugaaaccccaucucuacuaaaaauacaaaaaauuagccugguguaguggcgggcuccuguagucccaguuacugggaggaugagaauggugugaacccgggaggcagagcuugcagugagcccagaucgcaccacugcacucuagcuugggcaacagggugagacucugucucaaaaaaaaaaaaaaaaaagacacgagaggucucacagaaacaacaaccuaaaacuuaaauagcaacauguauguauauguauacuuuauccauuaauagauucaccaggcagaucaaaaugcacgcaccagaaagugacagaguaugacaggauuggagcuacuaugagcagggagcuucaauauggcaaggauuggggguucagcaggaguggaaguucaguagaaguugaagagguaggaugugagauuaaucuaaagaaauaaguaggagccaggccgggcgcgguggcucaagcuuguaaucccagcacuuugggaggccgaggugggcagaucacgaggucaggaguucgagaccagccugaccaacauggugaaaccccgucucuacuaaaaauacaaaaauuagccggguguggugacuugugcuuguaaucccagcuacucaggaggcugaggcaggagaaucgcuugaacccaggaggcaaagguugcugugagccgagaucacgccauugcacuccagccugggcgacagagugacucugucucaaaaaaaaaaaaaaaaaaaaaaaaaaggaaagaaaagaaagaaguaggacccaauaaacacaaaaugaugcugucauuagugagacaguuaacaaaauuugaauaugggcucugauuagguaaugguauuguaauaauguuagauuuccagauucucaucauuguuccaugguuauguaagagaauguauauguucauagagaauacacaguggagcauuuagggguaaaagagugccagaucuucacuacauugucaauacuucauuuuuaaaaugguguauguguguacauuacuauauauauauauauauauauauauacacacacacacacgcacacacaaacacaaaaucuauagguauaacaauaguuauaaacauauuguuaugauauauaguuguaacaauauacauauauaacuauauaugaauacauacauagcaauacacugcuuugcauauaucuaucuagaaagagacacaagagagagaaaaaggaaaaggggaagaaggagaagaaaaagaagcaaaugcuguaaaaucuaagcaauuggugaaucuggauuaaggauauacagaaguucaugcacuauucuuguaacuuucccauaaauuugaaaguguaucaaaauugaaagucaccaaaaaauguggcuuauguuuuuauuuuucaaagacaugaaaacuaaauugauuaccaacagauguccaggaaaaaaauuucuaggggauuuuacuuccaaaaagagguaaaauaaccccagaaggaaaaugcaagaagaaauggagagcaaagaaauaagcgcaugaaucaacccacacaaacacuggcuggagaaaauaauacaaauauuuaacauuuaagucguagggagaaaacaggccaaauaugacuaaaaucaaguaccuaugaaggaagaggcugauuaaacuuuuaaaacuucuaggcugggcgcaguggcucaugccuguaaucccagcacauugggaggcuaaggcagguggaucaccugaggugagaguucaagaccagccuggcuaacauggugaaaccccguuucuacuaaaaauacaaaaaguuagccggacaugguggugugugucuguaaucccagcuacucgggaggcugaggcaggagaaucacuugaacccaggaggcagaggaugcagugaacugagaucgcaccauugcacuccagcuugggcaacaagagcaaaaugccauaucaaagaaaaaaaaaagaaaaaaaaaacuucuauagagcaaguaaaaaccagcaugaagauauaauuuugugaacguuauuacaguaguuaucauucucauaccauucuguuaguauuugcaugacuauauucgccaggacacccugaagacaaggacuuuuugguuuuggaggcaggaggaggcuggacagagggaacuguacauagcuacacaguggggaggcaggaagugaagcuggagagguagccagaggcucucaaguuucuaacaggggcacuacuggcaccuggggugagauaacugcucauugugcaggagagucccaugcauugcaggauguuuaccauccacggcgcaggugcacuaaaugccaguagcuccucucagucacugugacaaaccaaaauacuccccuauauuuccaauucccucuggguaugguaccaccccugguggaggaccaguggggcuagacaaugaaaguuccugugugucauucuuaaggaauuuggguuuuaucaugaagccaaugaagaaccucuaaaggauuuuaagcaggaaagaagcuuggucaggcuuucauuugaggaagaaagacuggaggggaaccagauuacacauaaggaaaacaauugagaaacaacaauaaauugguauagagguguagagaaagggaagauaagugcaguauucuuggucacauuugggauaccuaucaaauauucaaguagaacuauccuuaguuggguauacuuaucagggggugggggagaugaaggaagauauaagggcuagaggccuauuuuucccaacguuuauaagaauguuucaauuuaaauccuaguugccaccccuacucagcauaagagaaaaccuaccuugccuucccaacugguaaagcaagugguccaacauuuucgccaguagagaaaucagauauggcaguuucuucagauugaaguucuucaauaugacuuguuucuuccuuuucuaaaggcuuuaaaaauguucuuaauuauuuaaccagacaaaagagcauauaggauagcagcugacucuuuacuaugcuacagaauaaugacaaguagaacauaauguacuuauuuuuauacccuuaagcacaaaugauuggguuuuggcaagaauagccacaaacuagcuugguaccaaaaaaucuugccaucaggagcauuucaacuguccuauaaaaagauauugaccuuaguugcuaauagcaaaggaagcaacugaugcuuuuagaaaaggaagugcucggcaggacauggugucgcaugccuguaaucccagcauucugggagacugaggaggagaaucacuuaagcccaagaggucgagacaaaccaaggcaacacagggagaccugugacuaccaaaaaaagaaaagaaaaaaaaaaucagccagggugguggcaugcaccuguggucccaguuaaucaggaggcugagguggaaggauugcuugagcuugggagguggaggcugcagugagccaugacaguaccaccacacuccagccugggcaaaagagcaagacuaccuuaaaagcagaaaaggaagugcuccaacuugcacaaaaugauuagguaaagguaaaauaccaaggaaacccagacguucuuggauuuuucacucucaaaacaggaagaccuucuuucuggacuauaaccuuaggcccacagucuuuuucucuagggcaauaaccucugauugguguuaguggguacuauuauccauguguuuacaaaauaguuaaauagcucagccuugccaauaauaacaacaagggaguuuuucagugagauaaaacuguuauauauccugauugugguggugacugcaagaaucuacauacguguuaaaauucauggaacugaacaacaaaagaaguaagucagcagggcgugguggcucaccccuguaaucccagcacuuugggaggccgaggugaguggaucacgaugucagaagauugagaccauccuggcuaauauggugaaacccuuucucuacuaaaaauacacacaaaaaauuagccaggcgugguggcaggcgccuguaaucccagcuacucgggaggcugaggcaggggaaucgcuugaacuugggaggugaagguugcagugagcugagaucgugccacugcacuccagccugagugacggagcgagacuccaucucaaaaaaaaaaaaagaaauaagugaauuuuaucgauuauuucuuaaugaggcuacaagaaaauguuaaauugcauaugugguucauauuuauuuguacuggacagcacuacacuuacuccuaaaagaaugagaacucauuuucaccgaugcugauuuuaaaacguguacguuagauuauucccaagaaaccaaauuugguuauggagaauuaaacaaccacaaagucaaaccaguacuuaccacuuuuuccacuaugaauacuaugucauuuucauuuagaauauuuuucaaaggguuugguuggccuuugcugaucaacugcacuuggacaucagccuguuaaaacagguaucgagcaacauuauacauacacuuauauauuucuacuaucuaaacacauaaagaccaguucuaugcaagucaauggaaaauuuccuuaagagacagagucucggccgggcacgguggcucacgccuguaaucccagcacuucgggaggcccaggcagguggaucacgaggucaggagauugagaccauccuggcuaacacggugaaacuccaucucuacuaaaaauacaaaaaauuagccaggcgugguggcgggcgccuguagucccagcugcucaggaggcugaggcaggagaauggugugaacccgggaggcggggcuugcagugagccgagaucgugccacugcacuccagccugggggacagagugagacucuguuucaaaaaaaaaaaaagagacagagucucacuauguugcccaggcuggagugcaauggcuauucauaggcauaugcauagugcauuacagccucaaacuccugggcucaagcaauccucccaucucagccuccccaguagcuggaacuucaggugugugccaccgcaccuggcuaauuauuuuauuuuucauacagauggggucucgcuauauugcccaggcuggucucaaaauucuggccucaagcaguccucccaccucugucucccaaagugcugggaauacaggcaugagccacuguccuggccaaaacuucauacauucucauuccaacuggaaguuuauuuaaaaguuugaaaacaggcuggguacaguagcucacgccuguaaucccagcacuuugggaggccgaggcggauacaucacuugaggucaggagcuugaaaccagccuggccaacauggggaaacucuaucucuacuaaaaauacaaaaauuaggcugggcacaguggcucaugccuguaaucccagcacauugggaggcugaggcggguggacugcuugagguuaggaguucaagaccagucugcucaaacuggugaaaccacaucucuacuaagacuacaaaauaucaggcaggcaugguggcgggggccuguaaucccagcuacucaggaggcuggggcagaaauugcuugaaccugggagguggagcuugcagugggccaagauugugccacugcacuccagccagggcaacagagcaagacuccaucuuaaaaaguaaaaaauaaauacacaaauaaaaaugcaaaaauuagcugggcauggugcugggugccuauaauuccagcuacucgggaggcuaagccaggagaauugccugaauccagaagauggagguugcagugagccgauaucaugccacugcacuccagccugggcaacagagugagauucugcacaggauaaucauuaccguuauuagccugguugguacacguuccuuuuccaagcauauaacucuguuuaaauauaaauauaugcuggacacauuggcaccuguaaucccggcuaaucgggaggcugagaugggaggaugguuugaggccaggaauuugagacuaguuacaacacagcaagaccaugucucuuaaaaaaaaaaaaaauagccagguaugguggugcacugguagucccaguuacuugggaggcugaggugugaggaucacuugagcccaggaguuugaggccgcagugaacuuugaucauacuacugaacuucagccugggcaacagaguaagaccccaucucuuuaaaaaaugauaauaaaaauagaaauguaucuauuuagauaucuaauaggauuuugccuaauaaaaacaggauucuaauaguuuuauaucaugaaugucugugucauucaauguucuuuggcagucuaguaccacagcucuuuugucacauaacuaauuccauauuauaugauauuuuaguaguuuccaguuuuuugcuauuauaaacaauugaugacaucaauucaaaugaacacuuuugaauuauuuucuuaagauuaauaccuaaaaucacacugauacuauuagacugccuuucaaaauguugcaccuacacauuuauacuuccaucacuuauaucaacauauuaagcauuuucacggcugggugcaguggcucacgaauguaaucccagcacuuugggaggccgaggcagacggaucaccugaggucaggaguuugagaccagccuggcuaagauggugaaaccccgucuccacuaaaaauacaaaauuaacagggcgugguggugggugccuauaaucccagcuacuugggaggcugaagcagaagaaucacuugaaccugggaggcagagguacagugaaccaggaucgcgccacugcacuccagccuggaugacagagugacuccaucucaaauaaaaaaaagaaagaaaaaaagcauuuucauuguuuauuuuuaccaucucacagugaaacauaagaucuuacuguuuugucauuuguuugaucaauaaugauggugaacaguuucuuuuuaucuuuuuuuuuuuuuuuuggaagacaggcucucgcucugucacccagacuggagugcaguggcacaaucuuggcucacuguagccuuaaccucccagacucaagcaauccuccagcugaggccucccaguaguaguagcugggacuauaggugcgugacaccacacccagcuaauuuuuuuuugcuuuuuguagagacaaggucucaccauauugcucaggcugguuucaaacuccucagaucaagcaauccucccaccccagccucccaaugugcuaggauuacaggugugagccaccacacucggccaagguaaacagcaguuucuaauaugcuuauuaaucauaaauauucuuauuauuugaauccauuugguuucuuaguuuggauauuaaagcaugaagaaaccaagcacagagagccaaggauacuguguuauucuaaucuacuagguucuugaggaguuucagguacuguuguggguugaaguguauccccaaaaaugguaucuugaaggucuaaccuccaguuccuauaaaugugacuuuacuuggaaauaaaaucuuggcaaauguaaucaagaugaggauuaauuuggauuagggcaagcccuaaauccaaugacugguauacuuaaaaggaaagagagaggcauagacacgcagggggaauaccacgugucuacagaagcagagauuugagugauguguuuacaagccaagcaauaccaaagauugcuggaaaccaucagaagguagaaagaggcaaggaaagauucuuucuuagagaauucaggaagagcaugcacuugcugacaccuuaauuucagaauuuuagucuccagaacugggagagaauaaauuuuuguguuugaagcugccuaauuugcaguauuuugcuauagcagcucuaggaaacuaauacagauaucaagcagcaagaauucaggcaggaagggauaaaugaguuuacccagauauaucugauucuugaguuuggcuagugagaauucagacagugaaagguaacucuauuugcauguuucuuucuugauuacuuacucguguccuuugccuauucuucuuuuauacuuuuuugucuuucucauugauauuuuuuuuuuuuuuugagauagucucgcucugucgcccaggcuggagugcaguggugcgaucucugcucacugcaaccucugccucccagguucaagugauucuccugccucagccucucuaguagcugggacuauaggcacaagcuacugcaccuggcauuuuauuuuauuuuauauuuuauuuuauuuuauuuauuuuauuuuauuauuuuauuuuauuagagacggaguuucacucugucgcccaggcuggaguacaauggcuuaauuuuggcucacugcaaccucugccucccagguucaagugauucuccugccucagccuccugaguagcugggacuacaggcacacgccaccaugcccagcuaauuuuuguauuuuuuaguagagcugggguuucaccauguuggccaggcugguaucgaacuccugaccucaggugauccauccaccucagccucccaaagugcugcgauuacaggcaugagccaucgugcccagccaucuuccucauugauuuuuaagagauauauauauauauauauauauauauauauauauauauauauauauauguagccacacacacacauaauuauagauauuacagcuucucauucaugaguauuccccccacccccagcuugucuguuaauguauacuuuauuuuaguuugcuaauuauuucauggacauagguuuuaucuccccaaguauggagaguuuacuuaugaaacaagucagcacauauuagacacuaaauaaauauaugaauguuuauagcagcucucauaaucaucaaaaacuggaaaaaacccaauguccuucaacuggugaauggauaaccaaacuaugguacauccauacaauggaauacuacucagaaauagaaugaauuguugauacucacaacaacauagaugaaucuuaaaugcauuauacuaauugaaagaagccagaaccaaaaggcuguaugauuuuauuuauaggauauucuggaaaagguaaaacuacagagacaaaaaauagauuaauguuugccaggaacuaagggagggcaaagggcucacuguaaagggacauaagaacauuuuuggagaggauagaaauauucuauaucuugauuauagguggugacuaaauaauuuaucagaaguucggccgggcgcggugguucaagccuguaaucccagcacuuugggaggccgaggcgggcggaucaugaggucaggagaucgagaccauccuggcuaacauggugaaacccugucucuacuaaaaauacaaauaaauuagucaggcgugguggcaggcaccuguaguuccagcuacucgggaggcugaggcaggagaauggcgugaacccgggagccggagcuugcagugagccgagaucgcgccacugcacuccagccuggguaacagagcaugacuccgucucaaaauaaaaauaaaaacagacaauuuuaggauuagaguuguguuuaaaaaccaaauuguucauaccucauagagaaaugggucuuuacggauuccuuucuuuucuucauuaaauuuccugaaacgcagaaccacaugugaaaaacagaacuacauuaucucucccguuauucacacucaggagucagucaucacuuuaucucugcaggacaccuauaggaaaggcaaaaagcaaguacuuacagcagcccuaagauguaguugcagagagagaaaaaaagcagaaaagaagcauuagguuaagaagaaaagagaaccaaaaaagaaaacugugacagagauuaauagacuguugcccucaauuggguacaacugauucucagaggcagcaggaaauuggguugccugcuucuacugugugucuuuucaaacacaucaccaguuaaaauuaaaauguaacuugccacaugaccuuucaaaguaaaaaugauuggauucugaucuguuacugaaucaguggguaaccacagagaaguuacuuaaggguccuaggccuuagauuucuauggcuaaaauggaagcaucuguccuccauuuuuauaacuuguuacucaaagucaguaaauuugauuauguugaccauuuccuuuucaaaauguaagcaugaaacuccaggauaucauuuaauuauuauccuuuaauucaagaaaguuuuaaaauagugaaucuaaagcacuuaaacuguaauccauuaacauaccaaaauacacaccagccugaucuacacugaaaagaaaucuuuagucauugaaggaacccaacagaacuguuucaagaaaccauuuauaucuauauuugaucuaauacuauaugacuuccugaaauagaaacagaagagcuaggccuaugacugauucacuuuugccauauugugaaagaucgugauuuauucuuacagauguuuaugucuuacguauaacucagggauguuauuuaaucagucuuuuuuuuuuuuuuuuugagaugcagucucgcucuguggcccaggcuggaguuggaguacaguggcgugaucuccgcucacugcaagcucugccucccggguucacgccauucuccugccucagccuccagaguagcuaggacuacaggagccugccaccacgccggguuaauuuucuuuuuguauuuuuaguagagaugggguuucaccaugcacuuaaucagucuugcaauaaugucuccagcauguuuaauagaggccagucacuccugcuagaugcugagaauaucaaacaaaagcauagucccugguucacaguccugacuggauuccaacaaguaaaccacaguuccauggugguaagugcucagagagaggcaaguauaggaagcuauaguagaaauuuagcuauagggcuuaaacuuuaaccugaaagccaagaggaacucacuaaaugacuuuaaaugggaaagaucugacaguaauguggaggguaauaacuuggaguccaggaaaauagcugugaauaacuuguagcacuucagagaacugauaauggccugaaugaaaagagcauggauggaggaagaauaagaggaucgacuagauaaggcagggguggggguuuuggaauuagaacgcuucagagacagaauucagaaguagaauguccaguuggaggaaaagauuaauucagcuuugcagguauugaucugaggucccgugugaaaauucccaguagugggggaaaaaacaguguuauacuuucuaugugaaguauaaaggguuuaaaugggccgggcacgauggcucacgccuguaaucccagcacuuuaggaggccaaaguggguggaucacgaggucaagagauugagaccauccuggccaacauggugaaaccucuucucuacuaaaaauaaaaauacaaaaaucagcuaggcgugguggcaugcgccuguagucccagcuacucgggaggcugaggcaggagaaucgcuugagcccgggaggcagagguugcagugagccaaaaucgcaccacugcacuccagccuggcaacacagcgagacuccaucucaaaaaaaaaaaaaagggucuaaauaaaguuguaucaauagaggacuuauuuauuuauuuauuuuuagagacggguucucacuacgcugcccaggcuggccuccaacuccugggcucaagcaguccuauugccucagccuccagaguagcuaggauuacagguaugcaccaccaugccuaguuaauaggagauuuuuauuuuuauuuauuuauuuauuuuagagacagagccuugcucuguugcccaggcuggagugcacuggcacgaucucggcucacugcaaccucugccucccgaguucaagcaauucucccaaguagcugggauuacaggugcccgccaccaugcccggcuaauuuuuguauuuuuaguagagacggggucuugccauguuggccaggcuggucuagaacuccugaccucaagugauccgcccgccucggccucccaaagugcugggauuacaggcgugaaccaucgcgcccggccuuaucuuaaauaaagaugaaacagccauagagugaaauacuauauagcagcuaaaaacaaugagauagaucuauaaggagucacaaugaaagauguccaagacaugccaguuuuuuuuaaaagcuagugcucuuucuauucaaaacguuuacaagcgucacuacuuuuguaagcaggaaaaaaagcaaugaagauaaacaaugaaaaauuauaacauuuaggaaaucaugggcuagauuacacagcgguucucaaagugugaugcccaaccagccguauccguuacaccuagcauuuaucaggagggcaaauuaauuggccccaucucagaccuacuaaaucagaaacccuggaaguggggcccagcaaucuguguuuugacaaucccccggugauucugaugcaugcuaaauuugagaacuauggauuagauuuuuacauaggaugcagaacuugauggaauccccuugguaguaguacuucaccauaagaauaaaaugaagucuuggagcacagugaaaaaauaaagguguuuucaaaaugcaacacaccaaucugcuaucauuacaauuguagcugauguggcaacuaccucgaauaauagagauuaacagacuaacaccacauuucauucuuaggagucaacaaggcuuuaaacaggggaaggaugccaacaccuaguuuuccguaucccggguggugccucuacuuauggcaaguguguccaucagcagaaagaauaaaucgccucuuggaacacuugccaccuuccaucucguuugaugacguacacguuuucuccugagacaagcaagcucccacacggucaaccccacaccggagccgagaaccggccucuccccaacuccuggaccccaggaaagcuggcaaagcgcugauccccagaguggcaagaggcuuagggcggggauccagacacccagggaaagaagugcugucccaggaccccagccaaaagaagagacuagacucacugaaggagacgagaauaaaaguccucugcugcgcaguucagccgcucccacaucccgccccaaugugagagcgguaccggaaccgccaaacugaacugcgcgccggaccggcgacgucaggggucauggccccgccccgccgggacuauuuugaccacccccuacaauaaguccuguuuguccgcaaaguuaaacuuucguuucaagccacccagagcuauuuacuaugucaauagucuucaacuuccgucugcaauaauuaaaauaagagcagugguuggggagaagauaccucgacu

SEQ ID NO: 192060 - RNA, 7481 nt, Homo sapiens
gggagucggcggcgauggcgucaucaccgagugccgggccgacagcagcccggagguuggcuaugugaccaggcaacaugcugagccggcuucaggaacugcgcaaggaggaggagacgcugcugcgguugaaggcagcccugcacgaccagcugaaccgccucaaggugaccccgcggcccucuccugccccuccuccauuccucccgagcgaccauuuccccccaaccugggccucuguggugaccaccugcugcggccaguucuccgcuacucacuagcugugguggcgccaauuuagagguuuacaaacaaacagguaucugaaucaccuggggaguuugcugugcgcuucuuaggcccuaucuuucagaaucgugaccucgcaagucuagggugaggcucagggaucuguguuuggcaagugcaguccuaccugcugcuuccuguaaauguucaucgcccucagacagcacgcugaggaagugcucccucccgaaggcucgccuagaccccucuggccaccgaccccuuccuccugagcugcuguuuucuaguuuguuuuggcgcuugaaaugcucuaguuuugccaagccagaaggaacuccuagauccucccaugcuaccaaggaagaaacugaggcccugggagaagagacuuguccuaacgucuggagcuuccgguggcucuuguuacugacgccauggccuugaggaggagucgggauuuaggcccacgugggccacuucccaaaccugugcuuaaugcagccccucagcccgggcaauauagugagaccucgucucuacaaaaaauugagacagggccucacuguaucgcccaggcuggagugcagugacaugaucucggcucacugcaaccuccgccuucuggguucaagcgauucucgugcuucaccuucccaaguagcugggauuacaggugugcaccaccacgcccggcuaauuuuuguauuuuuaguagagacgggguuucaccauguugcccaggcugguuucgaacuccugagcucaagcgaucagcccgccucggccuuccaaagugcugagauuacaggcgugagccacugcggccggccuuacaaaaaaaaauuaaaauuagcugagcgugguggugcgugccuguaguccagcuacuugggaaacugaggugggaggauggccaaaguccagguggucaaagcuguagagagcccagauugugccacugcacuccagcaugcaacuauauggggagacccugccuuaaaaaaaaaaaaaaaagucccagggagguuauuaugcuaaucccugcucagcauucuuuucagaaucuuuuuuuugagacagaguuucgcucuuguugcucagccuagagugcgguggcgcaaucuuggcucacugcaaccuccgccucccggguucaagggauucuccugucucagccucccaaguagcugggauuacaggcaugugccaccacgccgggcuaauuuuuuguauuuaguagagacgggguuucaccauguuggccaagguguucucgaacuccugaccucaggugauccaccugccucuuccucccuaagugcugggauuacaggcgugagccacugggcucggcccuuuuucagaaacuuuaaguccauaugaggugaggauuaccaaagcccuuuguaaaaggaaaaguauuguacaccugugacauaucaaaaucauaagcauuuuuccuuagggaaguuauacuuuuaguagagacgggguuucacaguguuagccaggauguucucgaucuccugaccucaugauccgcccgccucagccucccaaagugcugggauuacaggcgugagccaccgcgcccggccuccuuagggaagucauaaugcccuccacuuauuuguguuucuauauugccacgguacccuuacaaguacuuaaugaguguauugaugaccaccuccaaagcccagauuuccuuaugcuucagcaaacaccucuguuuucuauucuucuuuccuucacguucucauuacugaguaacagccucagguccagggaaucucucucucugaggaaucagaugacaccuggcuguuuuaaugacacacuuguacuuugaguugcuaggucuguagaaguggaagccaugacucagccagaacaccuguucagcccaggggagaagggcuagagucuuucuuuacucaucuccuuaaaagagagaaaaccuaagagccuacccccucaacuuucccucuagagcaacacagagauaguuuucauucccucucuugaugcaaauguuucauagugugcccagcaguuuacccacaucaguaguccagugaaauaguaaggaaaaguguccucaacucuucuuuucuagguugaagaauuagcccuccaaucaaugaucaguucuagaagaggggaugagaugcugucuucucacacuguaccugaacagucacaugauguaagcuuaaucaagugcaggccuaggagagaaugcaaagucugcucugcucccaugcugcuuggguggugaagaacuguuguaaaucacauuaccuagcccaaagggcucugagaagugcugauaacaguuuucugguuuaauaagguggcaacucuccauuaaccaccuuccuaccagcuaguuauacacuaauuaauuaaguaguuacuaauguuuuaccuccauccuccucgucauccauucugucuaguuacucagaugaacccgggggagaguggagauuuuuguaggacgaugucaaaacucuugauuuuuugugaauaaguaaccuugagauucaagaguguggcuucaaguacaaggcacagugcuaaaagaugagcuccaguucucaucauacucaucucuuaccaaaugcccucaaguaagucagcaaaaucuaaguacacaauauuugagcaguucucccagauuuuguguguuaagacauuuaaaaccaugauacagcagcacauguaaguuggcacaaaucuuauggagcuuuguguaauaauguuuguaaaugagguaacauucuacugaaucuggggcauuuacuguugccccauuuugguaauggagguggggguauaaaaggaaaguggccauaccucuuagucauaaguacuggggauagauaugcaauugagaucugauuuuaagucauuuuuaagaauuugcuguuuugaggccagcaucuuuccugcuaaucugugaugcccuuggccaauacagauguuggugcauguagacaaugaagcaucaaucaaccaaacaacccuggagcugagcacaaagagucaugugacggaagaggaggaggaggaagaggaagaagaaucagauuccuaaaggagggggaaagccaggcuggucaguuauacaaauugcauuucuaaggcucaggcuacuucuccucaaggaaaucaucuugcccugggcccugugaucugcuugaaaggaaagcaagaacuauaaggaggauguguaguugcaaaaauggcuccaucgguaacucaagcuucagaauguuaugacauacagaaaaucaaagaugcugugucuuagcauugaguaauauggguggugcugucuguaaucuggucagauucaguuaacuguucagaacaaaauuuccucugaaauacuguugagaaagucugucauuugcaaaaagagcagaguuuaaauacaagccagucuuuccagucaacaaugccucuuugaagaaaaccaauuaaagacuguuugcaugccgcugaacccuugugagcaguuaggacacagucuaggacagaaagaugacaaggggaaggacugagggccgucugagagcacaagcuguuucuaccucucagaggcauugaaauauugcaugcuauaaacugcuuuguguaucuguuaccaccucucacuugagacaucacucacugguaaaauguuuuauaaauaaauuuauaaguagccaucauggagccugcugguuucuagauagcgacagagagaagcagcaguuccuucucugaggaaaagauacaacaggaugguuugaaauccauuucugguccuuaagagagaugugccaugcuuggaagacuggauuuuuuguuuuguuuuuuguuuuguuuuguuugagacggaguuucacucuuauugcccaggcuggagugcaauggcgcgauuuuggcucacugcaaccuccccuucucggguucaagugauucuucugccucagccuccagaguagcuaggauuacaggcaugcaccaccacacccggcuaauuuuguauuuuuaguaaagaugggauuuuuccauguuggucaggcugcucucgaacucccaaccucagguuuuccucccgccucgaccucccaaagugcugggauuacacacgugagccacuacaccaggccggaagacuggauuuuuguuaacagaugacaguuacagaauaagaguuuuuacuuaguaucugaaguugagguucauuucugcauacugucccuuuuccacugacuaccaugaaauaaguaguugcuuaauuuuauaaaauuaauuuccccugcccaagcaacaguaaaagccaaacaaaacacaaagaaucaugucaagcagaacuuauguaacaguucccaaagaaaacaaagaauacuuuuuuuguuaauccacauuucauugaaguuauuuugagcugcuuuuagaggaaacagccagaaguuuaaaugagcauguuccuuagaacacacaaugggaagacaguuugggaacaaaaagcaucaagguacauaaauuuugggggucuaauuuaaaauaugagcaugaguuuuaaaagcuggaaaacuugacuaugaauuccagcucuaccacaaacuggucacuugucuucucaccucuuugcaacucacguucccaucuguaaggugaagauacucacaucugcucuagcaguuucacagguugcuaugaggugcuaaugagaucauuuaaaaauccaacuaucauugguaucucaguaagaaucuggcauugggagcucaaaacacugcaagauucaugcggggaucauaauucuuggcuaaaaauuaaaaaaaaaaaaucuaaacaccccucaaaagacacugagcaugaaaguggucagaucuagguuuuagauaccagguuauaacauuucuucuaaggauguaguauucucauuuuaaugaaacauucucaguaguggugguauccugucauuuguaaaagacacacaguguaaauguuaaaacccagccuaaauguuuauauguugaaaauguauaaguuaaacuguugacuuagaaaagcuauacuucacagugagagaaaaaaaaguugacuagcuuaggcagcaguauauacaacacugaucauuuuuuuaaaauccuggcaauaucccaagcucugguaccucuagauuggacuaccuacuuagaagauuauuuacccaaguuuuguuuuuaaucuaaaaaggaaugggccuuuuauuuauaaauauauauguuggcuuuaguuucuguaaccugcccuuucaaagaaaauaaugagcggagagguauugaccagcagccucaaauguaccuaaaagaaguucccaauggcuuugugacaucacugccaccucacaggcaugacaaagccagcgccaggcacauuccuccuuuccaggaaggugugguuaaguguaaguggugaaagaagggaaaccauugcuuaaugucgcaaaggagacagacuguccuauguugugcagaaagcucccacaccagguaggcaagcuggccaccagcaaggcccuccuaugagcaugacagccuaaaagugcaggcaggcccucagcucaacuauugguauauggaaaaugagaaauguucugugagauaagaaauguuuugucauuuuucucagauuugcucccagucccccaucagcugcuuuucccuuguauaaaagagaucaaaggaauauacaggaucuauucacaggucccacaaggaaggugguuggaagagucacagauaaggguguugggugagaagagcuggacugaguccagagauugaaauuacaggaagccccauuaguccaaagcacugaacucgguguccuguuucugccuuccagccuccuccucaucuucaccuuucccccucaccaguguugcuuggcuaaaccaguauuucuuguguacuaaagaaacugaaaagcuuaccacaaaagcaaaaguagcuuucauccuuuuuuuuuuauuucauaguauauuuauuagaauaagagauuagauuuguuaaacaucuagguuaaaaugguuaaaaggauuuucauacaauuuuaggcacuauacacguuguuuacaacagcauugguacuuggauauggggaaagauaaauccgacauuuuaauaucuugaucaauuugugacauucaaaauaauuccauuuaagaaacauuaaucaaaacuuaaagagacauaccacuaaguaucccacacaguauacugaaaauaaauauagaaauacaaccagaagucuacagaucaccacaguagacagacuggugaagccccagcuaucauggcagugaagggcucuggcuagauuuggaugucaacugcugaguucuacaugaaaagcaaauaauaauaauaaaauaacaugauguacacucucugaugcucauuuucauagcagcaaagcaugcuucacaugcacugccugugaaggaucucacaaggcucccuccuagagagaaaguaugcccagcaagaauaaaguaccaccaaaugucaaagaaucccgaaaauacaggcagacagccagucauggagcaggaacagcagugcaauuguaagaaugacuacccacauucaccaaaauuucacuguaauucagccuggcacagguuuugaucaucagcauacacacaaauagccccaagcacaaagccaauccacuuaggggaacaauaauaguaauaagaauaaagacaguaauauuaaaaaugacaagaguagaaucuuggcacaugcuguguucuucauccuuugucacaggugaaaugcacaucugaacagagacaggcaugggaaggaggcccaaaagcgacauggcaaaccaccgggcaggggacucgcucuuuguugcuucccaaacacuuagacgccagcagcauggguuggugugcugggcugguuaaggccgaugguggagcagagccaaccugcaaaauccacuuccucagcaucagaucucuugauaaaagcaugaaccugcauguaaggaaacgagaggacgugguguuaaaaagaaacaaaaaaacaaaacccaccaggaaggaaaauccaagaguuucaggucuagagcuugugcugcacuuggaaagagcaccuggcaccugccccugagcaacaguggggccagcugcaggcccaaagaccugcucc

SEQ ID NO: 192061 - RNA, 47867 nt, Homo sapiens
cgugggguaucucgaggugccggguugcaggcgcucaggagcgcuaggguuugaggccugcuuucugcucgcgccagcagagcacuaccugaggcagcgaggcgcagcgagccuagccuccccgcgcccugggcaguguggccauggagaaucagguguugacgccgcaugucuacugggcucagcgacaccgcgagcuauaucugcgcguggagcugagugacguacagguaaaggccgggucgggcggcgggaagcgcgcgggaucgcggcuccggguacccgccaggaccccugcccccuuuguccgcgugcgcgccggagagccugcagugcgccaacaaggucggcgacgcggugcgcuuacggcgugcuggcgcuuuucgaggcucaucugcagaucucgggccgggggcacaaccccccgagggcugcaggaaccuucggguccccagagagcucggccugggccucucaggcuaccccgggccucuucuuuguucgcagucggcggccuucauggagcccaggcccggcccuggcugccuggccgucgggguucgaguuggcuggggcccuucgagaugugggaugagcuuguugggucaggggugcgguugugacagcggcuugcugggccguagcugaaugccugccgcuggccugagagguccagccaggccccucggacguuacugaggcugggcgcugccggaggugggggagggggagggguggggggccacacccaccucgcaaccguucagugauggaaaucauucucauuacuuuuaauuuuaaaauucacaagagcuggaggaagugauuucccccucuguucugaagguugugagcucagguuugcugaguugcacagagaacuuaaaaaguucuuaaguuacauuaagcauuucuguuugagcuccuuggcccuuaauguaagcaagcugaaggcacguaguaguggagacuccaggaccuguguauccucaugucucuguccaaacuaaagauucugggcuuugagaaacuggaauuuucauucuggaagguucuuucuuucuuucuuucuuuuuuuuucuuuucuuuuuuuugagacgguguuucgcucuugucgcccaggcuggagugcaauggcgcgaucucggcucaccgcaaccucugccucccggguucaagggauucuccugccucagccucccgaguagcugggauuauagacgcgugccaccaugcccggcuaauuuuuguauuuuuaguagcgacaggguuucaccauguuggccaggcuggucucgaacuucugaccucaggugauccacccgucucggccucccaaagugcugggauuacaggcaugagccaccgcgcccagccucuggaagguucuuucuacagucauucuuauuggaaacuucuccuuaacaucuauggcacuuugucaucucuuucacuccauuuaacucucucugccucugaacaggcaucugcuuggaucacccguggauccgguaaaauguaggugcuuucugagugucgacuugaauuuauugaauuuaauauaaucuuugcuucuggaauauaaacaguuuuccuguugaaagaugaagacaguaguggccagaaugccuuuaaauaggcuaugacauugcauggugugucguuuaauguguucauccagacugaggcuauacuuuugggucagaguaugaguaaauguucugugcugucucccucuacugcuccacggugguuuaauagaauaggaaaaaacaaacaaaaucuuuuguagauggggaucaaaguccccgucuagagaggguucuuccagcagucaauaaaaaaguacggaacaggccaggugcuguggcucacgccuguaaugccaacacuuugggaggccgaggcgggaggaucaccugaggucaggaguucgacaccagccugaccaacauggagaaaccccaucucuacuaaaaauacaaaauuagccgggcaugguggugcaugcguguaauucacuauguuggcuacucgggaggcugaggcaggagaauugcuugaacccgggaggcggagguugcggugagcugagauggugccauugcacuccagccugggcaacaagagugaaacucugucucaaaaaaaaaaaaaaaaaaguaaccaucuaaaaauuuuuggggaaaaauaaaucauuuuucccccuuauugaguuuuuguuuucucugggguuucacaucuguaguuuugaggcacccauauuucaacuaccauuaguuuaaaagcaugauguuacccucauaaaagaguguuuacauguguuagcaauccucuaacacauguaagguaguacagauuuacaaaggugagucagacccagcuuuucaagggcaugcuaucuagaaggaggcguaucauauacaaacaaaaaguuuuguguaggaguauguuuauugguagaauuggaguuggauguugaaccagguaucugguguuaaaggaauuuguuaccuuucuuucauuuaguuagugaugacuuccagaaaugagaauuauuuuugucaaacuaagacugggagaauguuccagaaagagaaaggcauagacuuuuagacacuuguaaucucugacuuaagccgugucaaugcccaaaggccaccaauaacacacccguaguuaaacaaguuggguuuauuacucauugcauugagagagcauacuccauggggaacccugggguguuucauuaggaggguguuagaacugauuauaggauuuggguguuggugauuaggggaggggaggguuaaggagguuggguuucacuucagauaagauccuguaagaaaauaugggaguuucgugguuggguaucugaauaaaucuuaccuguagggcagggagacuaguauaagaacaaaacuguaauugcuacaggaguagcagucacucaauuuggccaaaggguguuugguauuucgugaguggcauagccacuauguauuugucugugcuuauaacaaaauugugaaauggccuuugucucauuuuaugaggauuucagaguaaccuugucugagguugguauucugugagauuguuuaugucccauaggagaauaacauggccuggcugugagugcuaugccugcuucuggagugucacggguugccuuuuuuuuuucuuucucaacugauugcucuaugcagggccuguugaaaccagugguuuuacaugugcagauuuguuauuuaaaaaaaaaaaaaagaaagaaaagcagccgggugugguggcucaugccuguaaucccagcacuaugggaggccgagacgggcggaucaugaggucaggagaucgagaccauccuggcuaacacggugaaaccucgucucuacuaaaaauacaaaaaaauuagccaggcgugguggcgggcgccuauagucccagcuaccaggaggcugaggcaggagaauggcgugaacccgggagguggagcuugcagugagccgagacugcgccacugcacuccagccugggggacagagcgagacuccgucucaaaaaaaaaaaaaaagaaaagaaaccagugguucuggcucuggaugaagcacuucauuuauuuguucaguaaaaaucguuuauggaguaccuacucuugucuaucauuaagcuaggugugggguucuuggacagcacuuuaacacucucugcuuucuauagcaugacccacagcuuauguguaagugugaguuuuaaaguguuaaguuccaguuuggaggcauuggcucugucucccuccauccugacacagggaacuguccagucaucacaucucuauucugucuuggaugcugcagggcuagugacuaugagagaacacggcugaugugaggagaaaugguggacaauaaagacuucagcaguggcaucgucugugcuugaggugaacgguagcaaagaggccagcuaaagcaggguuacuuucaagauugaauuuacuuucacgaugaacauaaugaacguguuugucccgagaaacauaguuguuaaagcauugguuuauuuacaaggugcuuguuuguuuuggguguugugagcagagaacagagcguagcuguguuugagagcuguuugaaagauauuguuccuguccuuaccuaacagagucugguggaaagagugcuaacugaacacaugagauuggguccuuguucuuauuacacuuaugcucuagugaccaugauucacuuaaccuuuaugaaccugacgcucuucauccagacagauaugaacaguagugccuaacucauaggaccauuuugagauuugaauuggaaaauggauuugaaagugcuuugcaaauucuagugugcaguucaagugagugauuaugaugauugcgauauuaaaccuuagaugagagggauggucacagagcaauggaagaauagagccuauuagcagaccuauucauauaugaaaaguuaagguaugacaagaggcgcucuuacaaauuaaugaggagagaaugacccauucaggaaauuguacugggacaauugguaauccaaauggcaaaaagaaaauaagauccugccuuaugccauacacaaaaaucaguuucaggugcauuaaugaccuaaacgcauaaagaaaaacuacuaaaaagaaauauaggagacuaucuuuauaauauuggaaagggggagaauguguuaagcaagaugcacaaaacacaaacccuaaagacaaagauuggcacauuuaagacaaacuugaagaagacauuugcagugcauaucauugagagaugacuaauaucacgacuauuuaaagaacaccuacagaccaauaggcaaaagacguauuaccuaauagaaaaaggggcagauaauauaaacauuucagaguaaaaggaaacaagaaugaccaauaagucugaaaagaugcuugacugcaauuaugaccaggcacauguacaggcauaccuuguuuuauugugcuuugcuuuauugugcuuugcagauaaugcgguuuugacaaauugaagguuguggcaacaaagucuguuggcgucauuuuuccaacagcauguguucauuuagugucucuguguuguauuuuguuaauucuuggaauaguucagauuuuuucauuauuauuauaucuguucuggugaucugugaucagugaucuuugauguuaacuuuuuuuuuuuuuuugaggcagggucucacucuguugcccagguuggagugcagcagugugaucauagcucaccguagccuugaacuccuggguuugagcaguccuccuggcucagccuaccaaguaggacuacagguaccugccuagcuaauuuucaauuuuuuaauuuuuuuagagguggggucucauuauguuggccaggcuggucuugaacuccuggacuuaagcaauccucuugccuuggccucccagaucccugagguuacaggcuugaaccacugugccuagccuugauguuacuauugugauuguuuauuauuuauuuauuuauuuuugagacagggucucacucugucacccaggcuggagugcaguggugugaucuuggcccaccgcaaccuccgccucccagccucaagugauccuuccaccucugcuucccaaguagcugggacugcaggcaugugccacugugcccagcuaguuuuuguauuuuuuguagagacgagguuggucucgaacuccuaagcucaaguggccugcccaccucggccucccaaagugcugggauuacagguuugagccacugugcccagccaccauugugauuguuuuauggcaaaaugaaaugcaccuauauaagauggugaacuuaaucgauaaauguauguguucugacugcucucacuggccauuccuccaucucucucccucuccuugggccucuccucugagacacaacaauauugaaauuaagccaguuaauaacccuacaauggggucgggugugauggcucaugccuguaaucccagcacuuugggaggcuguggugggugugucacuugaggucaggagaccagccuggccaacauggugaaaccccgucucuacuaaaaauauacaaaaauuagcuaggugugguggcgggugccuguaauccuaacuacucaggaggcugaggcaggagaaucacuucaaccugggaggcugaaguugggugagcugagaucacgccaccgcacuccaguggcagagugagacucugucucaaaaacaaaacaaacaaacaagcccuacaguggcuucuaaguguuaaagugaagaguugcacaugucucacuuuaaaucaaaagcuagaaaucauuaagcuuagugaggaaggcaugucaaaacugagacaggcugaaagcuaggccucuugcaccaagcagccaaguugugaaugcaaagaaacaauuuuugaaggaaauuaaaagugcuauuccagugaacacccaaaugauaagaaagcaaaauauccauauugcugauaugaagaaaguuugaguggucuggauagaauauaaaucagccacgacauucucuuaagccaaagccuaauccagaacaaggccccaacucuuucaauucuaugaaggcugagaggugaggaagcugcagaagagaaauuugaagcuagcagaaguugauucaugaggcuuaaggaaaggcuccauaacauaaaagugcaaggugaagcuacaagugcugauuguagaagcugcagcaaguuauccagaagaucuaacuaagauccuugaugaagguggcugcacugaacaacagauuuucaauguaacagccuucuacuggaagaagaugccguggaggacuuuuauaguuagagagaagucaaugccuggccucaaagcuucaaaggacagucugacucuuuuguuaggggcuaaugcagcugguggcuugaaguugaagccagugccccuuuaccauucugaaaauccuagggcccuuaagaauuauguuaaaucggccgggcaugguggcucaugucuguaaucccggcacuuugggaggccgaggcagguggaucaccugaggucaggaguucaagaucaggcugaccaacauggcgaaaccccgucucuacuaaaaaauaaaaaaaauuagcugggcaugguggcgggcgccuuuaaucccagcuacuugggaggcugaggcaggagaaucgcuuggaucugggaggcagagguugcagugagcugagaucgcaccacugcacuccagccugggcaauagagagagacucugucucaaaaaaaaaaaaaaaaagaauuaugcuaaaucuacucugccuaugcucuguaaguggaacaacgacuccuggaugauagcacauuuguuuacagaaugguuuacugaauauuuuaagcccacuguugaggccaacuucucagaaaaaaaaaaaaaaaaaaaaaaaaauauauauauauauauauauauauauauauauauauauauauguauauuccuuucaaaauauuacugcucauugacagugcaccuagucccacccaagagugcugauggaaaugucaaggagauuaauguuguuuucaugcccgcuaacauaacauuccuuuugcagcccauggaucaaggaauaauuuugacuuucaggucuuauuuagaaaauacuuuccguaagguuaaaacugucguagguagugauucugugauggaucugggcaaagucaauugaaaacuuucuggaaaggauucaccauucuagauaccauuaagaucauuugugauucauaggaagaggucaaaauauaaaaaugaacaggaguuucgaagaaguggaauucaacccucauggaugauuuugagggguucaagacuucaguggagguaguaacugcaggugugguagaaauagcaagagaacuagacuuagaaguggagccugaaggugugacugaaugcagcaaucucaugauaaaacuugaagggaugaggaguugcuucuuauggaugagcaaagaaagugauuuauugagauggaaucuauuucugaugaagaugcucugaacauuguugaaaugacaaugaaggguuuauacuguuucauaaacuuaguuaauaaagcaguggcagggguugagaguauacucugauuuuaaaagaaauuauucucuggguaaaacaguaucaaacagcauugcaugcugcaaagaaaucuuuagugaaggaaagacucaaucaaugagacaaacuucauuguuguccuccuuuaagaaauugccacagccacuccagccuucagcagucaccaccuggaucaguccacagccaucaacauugaggcaggacccgccaccagcaaaaagauuacaacucccugaaagcucacaugaucauuagcauuuuuuagcaaugaaauauuuuaaaguuaagguauguacacuguuuuuuagaauaauacugcauacuuaauagacuauaguauaauauaaacauaacauuuauauauacugggaaaccagaaacuuugugugacucacuuuauugugauauuagcuuuauugugguggucuggaacagaaccuacaauagcuccaagguaugccuguaaauuaaaaugauaggauacuguuucucacauuagaguaggaaaauugaaaaagccugacaugaccaaguguuucugagaauguucagugacaggacuuuuuuuuuuuuuuuuuuuuuuuuuuugagauggagucucaccgugucaccccaggcuggauugcaauggcucaaucuuggcucacugcaaucuccgccuccugggcucaagugauucucccgccucagccucccgaguagcugggacuacgggcgcccgccaucaugcccugcuaauuuauguauuuuuaguagagaugggguuucaccauguuggccaugcuggucucgaacuccugaccucaaguaaucugccugccuuggccucccaaagcgcuaggauuacagacgugagccaccgugcccagccggacuuuuuuuauacaguugguggaaguacuaauugguacaauugauuuggagaacaguuuuacacuaucuugucaagcugaaguuguaugucuuuaugaguuggaaguuuugcuuuuuagagaagcucuuacacaugcagguggagguagaauguucauugcagcaaaaaauugaaaacagccucaauuuuugucagcuggaagaauggauaaauugugguauauuuauacaauggcacacuguacaacagcuacaaugaaugaaacagaaccaucuuuauagaauuaaagcuuagaaauauaauaucaaauaaaaagcaaguugaagaaugauauaggcaguaugaaauuauuuuugugacaugucaaaucauacuguauauugugaaugcccaacguguuuuaaugaauaaauaaauacaguggaaacgaccaacuccaauccuggaguagugguuaccugcgaaguuggggcauguuugagggagagggcauugggauugagaaauuguauaauguaucuguuucuguuuuauuucuuuuuuuaaaaauugaggcaaauaaagcaaaaugcuaauggauguuagauauagugguguuugcuauauuuuucuguuugauuuugcuugaaauauuuaauaauagaaaucaauaagucuaagcuguuuauuaccacaguacaaaaacuacuuauaaagcaguaaguuaaauaaucugguaacuguugaccacucacaaugguccaggcacagugcuaaguacuagauauucaguaaugagcaacacauauaaaggcacuaccuucagauugagggagacagacaauagauauguuaauaaauaauuaccuagauaaagugcuaugagggaaauaaagagggugaugaaauagagaauaauugguagaggcuauuuuaaauagaguggucagggaaggcuuccuugaagaggugauauucuagccgggugaaacuugaaaguuaaaacaaauggugcagaaagcuggggcaagaacauuccaacaaguccacagacuuagaggcaggcaaaggcuuagugggguuccaggagcagaaaggauauuaguauguuuggaguguagugaggaauaaguuagagggagaugaggauagaaggguuugcaagauguaggucauguagagccuuguugccaugguaaggagcuuggguuuuauuguaagagcaaugggaaacuauuaaagaguuuuaagcagagaagugacuuuguaggauuuguguuucaaaaaagauuauucuggcugcuauguggauuauaaaggggcaaaagugaacucuagaaaaccauuuagggaggcuguuauaguaguauggguaagagaugagguggcucaguuuaggguuguggagguggaaagccauggacacauuugagauauaucugaagagaaccuugaggccuugauggacucguuggagaggaagggaaaagaauuaaugacuagucuuaagauuuugacuuaagcacagaguagaugacaacugaaaugauuaagacuggagaagagauuuaggggccaaaaucaagaguccccuuuuggacauacuaguuugagagucuuguuauaaacaauuuccaugugaaaaugugaacuagugauauaacuauacaaauacagaguucagggcaguagucugggugaaaauagaauuuuauaguaucuuagacuuaauugauuguaaaaugcaccacuauuuuauuuuuuucccucaugaugaggggaaaaaugcugcugauuauacugugauacaagcuuucuuauuacuuugaguauuuuuaauuuauugaaagagcucucugagaguuuauuuaaacuguuaaugcuguucagccaaagaucaccaaaacacaccuuguaguuaaauaaguuggguuuauugcuuguuccagugagggaaaacacacaucguagggaaacaugugguaucucaguaagaugguguuaaaaaagaccuuguuauauaggauuugggcuuugauuaugugauggcgggggugucuaaggaagugggguccgcuauagauuggauguugacagaaagcagggacaguucuaugauuugguauuuugugguuggcauagugaccugucauuagacaaauuuaugcaauggucuuguuuuguuuaauuuuaccauggucucauaguaaccucaaguugguugguauucuuugaaauugucuguguccccaaaagggggaauuagaagaugauacaaacuuuuacauacacccaauugaguauuauacagcuauaacaagaaagaguaaggucuuuaugagcugauaaggauuuauuuaggugaaaaaaaaagcaagauguauaagaauguauauuguaugcuaauuuuuguauagaaagaagggaaaauaagaauaucuguuuuggccgggugcgguggcucacgccuguaaucccagcacuuugggaggccgaggugggcagaccacgaggucaauagaucgagaccauccuggccaacauggugaaacggugucucuacuaaaaauacaaaaauuagcugggcgugguggcauguuccuguagucccagcuacuugggaggcugaggcaggagaaucgcuugaaccugggaggcagagguugcagugagcugagaucaugccacugcacuccagccuggcgacagagugagacuccaucucaaaaaaaaaaaaaaaaaaagaaaagaaaagaauaucuguuuuguauguuuguuugagacagggucucacucugucacccaggcuggagugcaguggugugauccuggcucacugcagucuccaccucucaggcccaagugaaccuccuaccucagucucccaaguagcuaggacuacaggcacaugccaucacgccaggcuaauuuuuguauuuuuuguagagacaggguuucaccauguugcccaggcugguuuugaacuccugagcucaagcgaucuacccaccuuggucucccaaagugcugggauuacaggcaucagucacugugccuggaugaaaauaagaauaucuaaauauauuugcaaauuuuugcaaaacacgcauauacagagaauagauaaaccagaaaugaaugaaaugguuaccgguauguggggaauaggaaugugguaaaggaggauggguuugggagcaagacuucugaggaaaucauuuuauaaaguuugaauuuugaacaaugggaauguuuuacauauucaaagauaaaauugucuuaaaaaaaacaggccgggcuugguggcucaugccuguaaucucagcacuuugggaggcugaggcgggcagaugacgaggucaagagauagagaccauccuggccaacauggggaaacccugucucuacuaaaaauacagaaauuagcugggugcgauggcaugugccuguaaucccagcuacucaggaggcugaggcaggagaaucgcuugaacccaggaggcagagguugcaguaaaccgagaucgugccacugcacuccagccuggcgacagugggacucugucucucuaaaaaaaaaaaaaaaagaaagaaaagaaaaaagcaaauuaaauaaacagaaccaaaaggaccuaacuguguaucaaauugaugacaaaaucuuacagauaaauuaaucaauacacauaauauuugaacacaguacucugguacuuuaguagaucauguccuuuuuaaaaaucaaccuuccccccuuuuaguggaauauauucuaaggacaaaaagaacugcaauuaaauguuacacuuacaaggguuauuucucccuuuucuuuuuuuuuaaauugaauacaaauuuucuuuuuucuuauuuuccacagggaaacuucugcaaguaauuaguagguuuauuguugguaaaaaauauugauauucuaauucugaaacuuuuuugggauaaaacaaauauauaaauguacuaauguuauuaggaagcuuuucacuguaaaagauauaaaucuuaaauaacaagguagggagaagccuuguaagagcuugaauuggaaacuucacuaugacaucguuuuuuaaauuccuagcuagcccacugaaagaugaacauugacuauaccucaguguacuuagaucauggcuucuacauuaccauuuccaaccaaagaaacuaugccuccuugaaaaaauggccaauuauuccaaaucugugccagaaaaagaacaguauccucaaaagcuacacggucaugucagaaucauacaggacuugauuugaagggauuucuacuggccaaguuugugacaauuugaacaucaacaagaguaauaaugguaauggaauuuggcugaguggaucacaaaagaaaaucugugagucggcggggcgugguggaucacaccuguaaucucagcacuuugggaggccgaggugggcagaucacaaggucaggagaucaagaccauccuggcuaacauggugaaaccucgucucuacuaaaaauacaaaaaaauuacccgggccugguggugggcgccuguagucccagcuacucgggaggccgaggcaggagaauggcgugaacccgggaggcggagcuugcagugagccgagauuacgccacugcacuccagccugggugacagagcgggacuccaucucaaaaaaaagaaaaaaauaaaaagaaaauccgugagcccauagugaaaguaaaaaagaaauauagaccagagaggguacaggcuggugguguuugcgaaggcaucaugagggaucuagagcuguucagucucuuuacugugacaguugguagaugaaccuauacaggugaucaaauuggauagaacuuaacacacagacgcacaugcacauaccugcaagcgaaugcaaguaaaacugggaaaucugaauaacauagguggguugugucaauggcaguauccugauuuugauuuuauacuauaguuuuguagaaugcuaccauugggggaaacuaggaaaaguguacaagggaucucucaguacuauuucuuuuuuaaaaauuuuuauuuuuguggguacacaguagguguguauauuuauuucuuagagcuucaugugaauccauaucucaauaaaaauuucaauuaaaaaaagggagaggagaaaaagggaaaacuccuuuuuacagaagaaugccaacuagaaaaugaaaaaggaaugauugaauuagaaaauuauaauguugccgggugcgguggcucacgccuguaaucccagcacuuugggaguccgaggccagcagaucaccagaggucgggaguuugagaccaaccugacuaacauggagaaacccugucucuacuaaaaauacaaaauuagccgggcgugguugcacgugucuguaaucccagcugcucgggaggcugaggcaggagaauugcuugaacccgggaggcggagguugcggugagccgagauggcaccauugcacuccagccugggcaacaagggaaauucugucuaaaaaaaaaaaaaaagaaagaaagaaaauuauaauuuugugaccuccaguguaaaauugcaucagguaaggauuaacaaugguugaccguaccauuggaugaaagaguguugugagggaauggcagauuacauuauuagguaacuugcuaauuacaaaaggaaacacuacaguggaaaguucuggcagucaccuucucaauuuaaugaucaaauuuauugucacccucuuaacauaaggaugccauaaguaaccauaucaccuaugaaauauuuuuguuaaaaaugguuaauaugaaggaauggccagacaaauccagaauaugauacauuuuacaagacaauuggcaugggcuaauaaauaaaaguguaagucuguauuaaauaaaaauaggcauggcaaucaagaggaaugcaugaaccuggauuggauccuggauuuuuuuuuuuuuuuuugagacggagucucgcucugucgcccaggcuggagugucucagcucauuggaagcuccgccucccggguucacgccauucuccugccucagccuccugaguagcugggacuacaggcgccugccaccaggcccggcuaauuuuuuuuuuuuuuuuuguauuuuuaguagagacaggguuucaccguguuagccaggauggccucuaucuccugaccuugugauccgcccgccucggccucccaaagugcugggauuacaggcgugagccacccguggccgauucuggauuuuuuuaaaguguaaauguaguggcuucaggauaacugcaucaagagugccaucaaaauucgcaauuuauuucuucuuucccugaaucugggcaggcccucuggcagcuuagugaauagaaugcuggagaaugaugcugugaccaguuccaggcuuacucuuuguaagagaacugccagcuuccgcuucuucucucuuagaccacuugcucuugagacauucccucucggaacugagcaguccuguugcgggagacccaagccacauggaguggccaaauauaguuauucuggucuuagcugaacuaccaaaugacaaccagcaacaauuaugagcuaagugagcgacccgucuugaauguuccagcccaauauacuauagccccagccaacaucacauggaauagaacuauauagcugagccccagucaaccuguagaaucauguaggauaauaaaauaguuguuuuaaguuaaguuuuagagugguugcgugcauuacaguaaauaacaaaaacaauugaacaucuuugagacaauuguucauguagauuuuuuauuagauaauauggaauuauuguucuuagguauuagaaagcuuugguaauuauacaagauaauauaauuucuuaggagaggaaauauguggagguuaaguaugaugucugcagcucauuuugaaauaauucagcaaaaaacuaugcauauaaaaggcaaauauugggagcuuucauuauauuuuguagaauggaggcuacccccacccuaaaaaaaccaaauaugacauuuagcaaucaauugguagaagguauaugaguuuucauuauauuauacuauuuuuucuuuuuuuacuugagacagggucuugcucugucacccaggcuggaguccaggcuggucccaaacuacuggcaucaagugaucugccugcuuuggccuuccaaagugcugggauugcaggugugagccaccaugccuggccuaguuuuucaauuuuuuuguagauuuaaauguuuucaaaauaaaacauuggggugaaaaggaucacauuaaaaauacacagaguuuugggguuccccggcagccaccagugugcucagugauuugcucgaaggauucaugggacuuaguauauaauuguacucaugacuaagguuuguuacagcuggagaauacaggacaggaucaguaaaggaaaaaaagcacaaguggagucuggagaaauccacguauaagccucuuuaucauucuuccuccugugaggggguauauuugagcacacuccaccagcgacgaaaaaugcaaugacuuauguauaacuuuucugcccagggaagcccguuagugauugaguucccaggauuuuuuuuuuuuuugagacggagucucacucugucaccgaggcuggagugcaguggccugaucucggcucacugcaaccuccgccuccuggguucaagcaauucuccugccucagccucuugaguagcugggauuacaggcgcacgccaucaugccuggcuaauuuuuguauuuuuaguagagacaggguuucaccauauuggucaggcuggucucgaacuccugaccucaugauccacccaccuuggccucccaaagugcugggauuacaggcaugagccaccgcgcccggccaaguacccaugauuuuuauuggggcuuguuacuuagguaaccucugccuaacauguaccaaaauuucaggcuccuagaaggaaaguugauauucaccauaaaucacauuguuuguaggcacaguuuaggaacauuggaccacccuuauuaguuaggugauggaggaaagccgaguuucuagauagaugccagccaaaggcugaucuuggaagcaggcccuuuuaaagacugcagccucaggcuugcuauauuaacucuucugcacacauacuaaucacauaaauuugaagauaaauacuaaugauuugaaugagaaaggaaacucuugucuaaaggguuagauagcagguaguuuauugugaacucuuuguaguucugccagagauucugaaaaugggaugaauugauuucaguucacuuaacaguuauugaggcauuagguauauggaaaugaauaagacacagucccugccaucaaagaagucaggucaagaggggcaguuaaaugaucaacaaugauuguggaacagugugauaaguauuauaguaaaggugaauacaaaguaggaaggaaacuguugauucugauguuagggugaggaggagagaacaggaauuaacauuugaccugaacuuugaaagagaaguaguguucaacaggcauggaaacuuagaugggcacuuuagucagaggaaaaaaagcaacuggaaugugaauucuuacuaguugccagggucugugugugcuauuauaacuuaauccuuacagcagaccugugauguaagugauuuuauuguuauuuuuaaaauuauggcugggcaugguggcucaugccuguaaucccagcaguuugguaggcugagguggaggauuacuugagcccaggaguucgggaccagccugggcaacauagugagacuugucucugcaaaaaauuuaaaaaagauauuagccaggcauggugauguggaccuguagucccagauacuugagaggcuaaggugggaggauccuugagccugggagauggaggcugcagugagccgagauugcaccacuucacuccagcccugggugacagagggagauucugucucaaaaaaaaaaaaaaaaaaagaugauuaagaugauuugaaaauuuucguauucccuuuucccucuucacuccuuuuuuugagacagggucuuagucugucauccaggcuggaaugcaguggugcaauaaaagcucacugcagcuucgaccuccugggcucaaguuguccucccagcuuagccucccaaguagcugggaccgcaggcaugugccaccacacuuggcuaauuuuuuuauuuuuguagagacggucuauguuguucaggcuggucuugaacuccugggcucaagugaucuuccugcguaggccucccgaaguguugggauuauaggcaugagcuaccuugcccagccacucucuuucucuuuuuauuuuuuaaaagaauuagagacagggucugacuacuugcuauguauguuccccuagcugcauuugaaccccuggguucaagugauccucccacuucagccuccccgguagcugggacuauaggugcauggcaccgggccuggcuguucacuccuccuuucauaagcaaaggcacaguuucuuuucuuguaagagaugggcuagguuguguagauugagcuuucuaauaaaaacaacuaaaaguguugaauaaaaaugucuuaaaaacaucgaaaaguuaacacgguagaaaugaaauugggaacucagauaagcugaacguggaaacugcuuuugccuugcgaacauuugcucaacuaagugaacuugaacuuugguuuugacagcccaacagggcgcaggcaauagaaguaaggucaaacccagccuggugcgguggcucacagcuguagucccagcacuuugggaggccgaggugggcggaucacaaugucaggaguuugagaccagccugaccaauaugguguaaucccaucucugcugggaaaaaaaaaaaaaaaaaaaaaaaauuagcugggugugguggcgcacaccuguaaucccagcugcucgggaggcugaagcagaagaaucgcuugagccugggagguggagguugcagugaauugagauggcgccacuguacuccagccugggugacaaagcgagauuccaucucaaaaaaaaaaaaaaaaaaaaagaucaaagcccaagacccaccaaagguguaacauguaauaggaaaucuucuccauaaaccguauuucagagaggacuauacacuuaggguuaggaugaacuagaaauaagcccauuccaucugccugucuccaguugccuuaacacuuagcuaaguauuaauagaagaaaagguccuugagaaguuaaaacuguaaguuggcucucaaagguuauguagcccaaauucacacaauuuaggagaaccaaaacucuaaacuugagaacccucaagccaugcauuuaguuuaaaguggccucaacugguaggaccccuaggucccuggcagaagcaaaugcagaucgauccucuguaguagcuaugcugauaucacacaaaauagacuuuuaggcacaaguguauuuuuagagauagaaagggcaguucauaaugauaagguuucaguuuaccaggaagauacaacaauauuaaguuauaugcaucuaggcuggacacaguagcucaugccuguaaucccagcacuuugggaggccgaggcaggcagaucaccugaggucaggaguucaagacuagccuggccaacauggugaaaccucgucucugcaaaaauacaaaaauuagccgggcaugauggcagucgccuguaauaccagcuacucaggaggcugaggcaggagaaucgccugaaccugggaggcagagguuacagugagccgagacugagccauugcacuccagccugggugaauuuuucaaaaaaaagaaagaaaauauuaaacaaguucauaucagauaaaauggauaaauuccaagaaauaaagacaguuucuauaaaagagauagaaaaccuggauagcccaauaaccauuaaauacauggauucaguagucaaaaaucuucccacagggaaacuugcaggucuaaauggcuucaccuggaaguucuaccaagcauuuaaauaaauaauugcaguuaauaauuauuuguuaaucuguugcuacauaacaaaucacccaauauguaguggcuuaaagcaacaauagucguuuauugucucucacaguuucuguggguuaggacuucaggaggggcucuguuggguuguucuggcuuggaaucucaugagguuguggucagaugacagcuguaguuggggaacacagaaagcuaagcccacagaagaaaaacaaacaccgugacacugggaaggagcugccucuugcuuguuaaccuugagcuggaaguaggaguuggguuguuucucauccacuggaaaaaguguuaaguaguuucacuuuacauuaugaugcuaaauugaagguauguagcaacuucugggaaucaaugagcagucuggagaauuuugaccucucccgagucuuguuuccuuuggggguuaagagagucuggagccucuaaguuagagacacaggcacagcguguuucauuuucauucaccaccugcaauccucugcccuucccucuaccuguuggaauuaauuuaucauucagguugcaguacaggucucaccuuuggugaagcuuuuccccaccacucuauuccuguugugcucucucucucuccuaacucugcuaacacuuacugccuuuuaccacccuuuucgucuugaccauauguuucuuaauaacuauuugauaucuucucacagaaagugccucaucugucccacuggauccucuguucuacagcucagggguugaguccuggagaucucuguauucccgugucauaucucacauagcaccuugcaugacuggccauuuucagaauggacuaauucaguacuugauuguuugcacaguuagagcagguuaggguccuucuugcaggagucugcagucuuagauagguacagacagacauagagaaagccuacagagaugugaauaaaugacuaaauauauuucugggggaggcacagaguaggaguuugaguccuuaugggagagggaugaggggaagaagccccuuguuuaaucucauuuuuucucuucauuaaaaugccuucuugcauccuuggucucuuuucacagaacccugccaucagcaucacugaaaacgugcugcauuucaaaggucaguaucccagcaaaugcucccaucucuauacacaguuaaggaggugugguggugguuucccuuuuuuaaaaaaauguauuugucuuacuuguuuuuugcugauguucacgccucugauccucaugagguaagcuaaauuguuuugaaauauaugauuagaaaagucaaagaauugguuuaaaauccuguuucccccauggagaggcaguagauacagugaaggaaaaaaaaaaaaagaauccuggguuagaaaucaggagacgugucuucuagcucuaauucugccgcuaucuuggacaaguuauugacuucucuggaccuguacaaugaagaugcuggguuuuaaucuguguuucucaaacucgaggacccguggacaccaaauaauguuuccacaggacucucaagggcucauggacccgagauugagaaacgugaagaauuaaauauggucacuuuaagugauauuuggcuccacugcagcugugaauacagacacacauacagcuacugauugcauggcaguacuugauuaugaaguggccaucuagaugauccagaauaugcugcuuuuuuuaaaaaaaaauuauuauggaaacauaaaauagaaaauuuauuuauuuauuuauuuugagauugagucuugcucugucacccaggcuggaaugcaguggcaugauuucggcucacugcaaccuccgccuccuggguucaagugauucucgugccucagucucccgaguagcugggauuacaggcauccgccaccacguccagcuaauuuuuguauuuuuaguagagacaggguuucacuauguuguccaggcuggucuugaacuccugaccucaagugaucugcccaccucggccucucgaagugcugggauuauaggcgugagccaccgugccuguuuuuuguuuuuuguuuuuguuuuuguuuuuuuuaaauauuuuucuuuuuuuuuuaaauuuauuauuuuuuuauuauacuuuaaguuuuaggguacaugugcccguugugcagguuaguuacauauguauacaugugccaugcuggugcgcugcacccacuaacucgucaucuagcauuagguauaucucccgaugcuaucccuccccacuccccccaccccacaacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauaaaaauauggaacgcuucacgaauuugcgugucauccuugcacaggggccauacuaaucuucucuguaucauuccaauuuuaguauaugugcugccgaagugagcacauauuuuucuuuuuaaacauuuaaaaaaauaauaauuauuuauuacaucccuucucacuauuccuaagaaauuuucuugaugagacuuuguggcucccugauacuagauuagcagaccaguuugagaaacacuacacucuagaugaugucucaggccuuuucagcucugacagucucugauucugugaaucugccucuaucugccuucuccucagucccucagcagauuuacugcucuacuggagagggugggauuuccauucacugucacccagugggguaggauucucucugcucucuguuccaguuccugggauuauuggagcauaaagaguuucugcuuuaugugaaauuccaucuacuguaauauacuugcaugaaaguacagccuggcuuuuguaucugcuuuucaagaugagaguagucaccacucagcucagguuuuuugggaauuauauacauuuacaugaaaauuaaagugauaaaagcauaucuugccacuuagaccuuauauacuguccuaccuuaaggaauuuaucgucacagagaauaauugcuaccuguagcgaauauuaggcagguuauuagucuacauaugaucagauaaggaaagagagucccagaagggaaccaaaugguaaaugaaucagagaggagaguggaagggugguucagcagcagcugcuggguccagcagucacuggcaucuaggcauggugccagcuagaauuggggaaaggagccaugucaaggcauagggauggggcauuggccaacucagguacuucccuccuaguuccaccuguccuucauaagcugcgaaagauuguauuucuuuuuccuuguuccauuugggaugugcuaaaggaggagucagcuucugccuucauucucucucccugguugggagguuuuagauucagagcuguccaagacaacccagcauuuccauguacccugcagucaagaugauacacccaccaauuuuugucugcucuagauuuagagccaaaguaauugugaaaguuaaauuuauauccguguggcuccuuuggcauugcuuucucuauucuuuuuccugccuguuauuugugugggguaucaucagggucacaguggaagauuggguaaauacgccaaaacugacaucagaggacauauggagauaaacuugugucaaagauuuggccuaucuagcuguugaggagcucugcgcacaagcccccacacauuuuaacaggacccauuaagauuuguggacuacgaugcuucuuggccuuuuggcuacaaucaaguaugauauucgugccagguacaguggcucaugucuguaaucccagcacuuugggaggcugaggcggguggaucacaaggucaggagaucgagaccauccugguuaacacggugaaaccccgucucuacuaaaaauaaaaaaaauuaucugggcaugguggcgggagccuguagucccagcuacucgggaggcugaggcaggagaauggcaugaacccgggaggcggagcuugcagugagccgagaucaugccacugcacuccagccugggcaacagagcaagacucugucucaaaaaaaaaaaaguguaauauucgcauacuugggaaagaacugcaccaagcuggcuuuuggauggccuugcucugcucaaguuugcaguaacccacauuucuuucuuuauagcucaaggacauggugccaaaggagacaaugucuaugaauuucaccuggaguucuuagaccuugugaaaccagagguauguucuuuccuuucucacuucccuucccauuuuaggaaaugaauaccaguaguuuagugaaauggggagcaggguuuguggagagaagaagauaaaaaccaaaggggaauaauagaguucuuuuauuuggaacagagcccagguuuuagcugcagaggaaugggaaagucagagaccccaaguugagucagggcccugccauuuauuagcagugugaucuugaacaagucucuuaacuucuucgaguucugguguucucauguguuaaaugaaggucuggacuaagugauccuuccagcucugauauucucugguuuuagugauggcagaggaauauggcacccauugagaacagaguuacauagagugguugaagcccccaccagggguuacuuucaugugacuuugccacaguugcaggugagaaaaauagaaaucagaaagggugaaggcagcuggccuucagaaagaaugcugcagauaucaucaaaacuucccuucccuuagagccugaggaagcuucucucauaagcagggagagaauccaauagaugggguauuuuggcuucuggaauuacacuuagcucugguggcuugagcuucuugauuuccgugcgcaggugcucaguuguuuugagaaagcaugaauaauaaccagugguacagugggcagagaaccugucauggagcuuccuuuggagaaaagggacaggacauguagacaaacaaugagcuggaauggccuauaagaauuugaguuuaguugggaagacuccccaaauugaccccugugaaaaaaucuguaacugauccaauacaguucugaucuugaugcagguguuucuaaaaccggggucugcugagccaggacagucauuuucaugggaggaaaauuuauaagcugaggguaauuggaugcaguacccuugagagggugauuggacauaguaccuugcaugauguggcuguggcaggagguucaugcuaguucccuccagccuaaccaggaacuauuugccuuucuuauccugauauccuccuguaucauucacugggggaaucagagaaggacauuauguccuuaccaguucuccaugccagccguuggucuagaucaaccuuuuuggcaccagggaccaauuuuguggaaggcacuuuuuccacagaugguggaauggggaugguuucagggugauucaaaugcauuacauuuguugugcacuuuauuucuguuauuauuacauuguaauauauaaugaauacaacucaccauaauguagaaucagugagagcccugagcuuguuuucuugcaacuagacagucccaucugggggugaugggagacagugacagaucaucaggcauuauagucucauaaagagugagcaaccuagauuccuugcaugcacaauucacaauagaguucacgcuccuaugugaaucuugugccaaugcugaucugacaggaggcagggcuuaggcaguaaugcaagugauggagagcgagucuaaauauaggugaaguuucacucacuugcccaccacucagcuccuccuguguggcccgauucccaacaggccauggaccaguaucaguccauggcccaggaguuggagaccccuggucuagauguucccuuugcaucaggacuugcaggaccagagaaagaaggagaauaaauauauccugcagcuucuauguacggcgccccuggcauggugcugcuucagggaacagaagagggcauucucacauuuucacuuucucuccuagccuguuuacaaacugacccagaggcagguaaacauuacaguacagaagaaagugagucaguggugggagagacucacaaagcaggaaaagcgaccacuguuuuuggcuccugacuuugaucguuggcuggaugaaucugaugcggaaauggagcucagagcuaagguuaguaaggauccuaggaucuagccauugaggacaaaucauggggaacccacguuauucaggccacuucagauaccucucggucugaaagaauagcuacaaaguuacaaauucauuuaaagaccuggugaugugauuuucaagaaguauuggcuauguauuuuauagacuuuccuucgguugaaaucugucugauguuucucuuacaacuagacuaaggugauagauguugaggagaagaccacugaaguaaagugcaauucuuaucacaucauaucaagaguacauacggccgggcacgguggcucacgccuguaaucccagcacuuugggaggccaaggugcguggaucacgaggucaggagauagagaccauccuggcuagcacagugaaacccugucucuacuaaaaauacaaaaaauuagccgggcgugguggugcaugccuguagucggagcugcucaggaggcugaggcaggagaauggcgugaacucgggaggcggggcuugccgugagccgagaucacgccacugcacuccagccugggcaacagagcgagagucucaaaaaaaaaaaaaaaaaguacauacugucaacgugacacaucacuguugauauuaaccauggguuagcuggcuugaggugacgcuuaucagguuucucuaccauaagguuauuuuccucuuggcucuccuuggaaggaagucacuauguguagccuacauuuaaggagcagggaguuaugcuuccuguccuuuagauggagggaguaucuacauaauuuauuuggaauucuucugcauaggagaauaauuaugcaugucuauugucucccauuuauuuauucaaucauuuauaucaugugaguacauggguauuuauuuuauacuuugaguuauaaucuaauauuauuuauuuuguugcucaaauucuuccagcuuuggcacuaacuggccuuugguuauguccucauccugcccaucuuucauuuggcuuuuguaucuuuuugagaaagcgccaucauuaugggacuguuuuuuuuuuuuuuuuugagcacuuccuuacuuucuggcaguauaagcugcuccaggcuuaucuugcauguauguuuccugcuccagcccuggaacagccauuucuucaagcaucucuguucuuauuguggaauagcauuggaaaccaagaucugggugccggguaugcucauugcuaccagguugccauugccuuuaaguucucuucacugacagaacaagaaaauauauguuuggauaguaacccaugcauacacauacaccuguaaauauuucuguauggauccaucuguaucucuguuaagcuaaacgugaguucauagugauguuggaaacaugaucuuagcuucuggaaaaauuauacuaaaauucuagaagucuugaaaaauaaaauagcagucuaccuccugccuuaaacuucuguuuuauuucucugacugcgacagaucuucuggauguccuuuccagcuuuaagauuccaaggucacuugucaguuuggaagccagcucacuggguuaauuuugugaacaauggaugggcaccugugaugcuaaugcugcuuaguaagcaggagucaggcguuuggcccuaugaccuagaauauucucccaaugaugcacugaccccaacuggaggaguuggcuuugagggagucagauuacucagccagcauauggacuuuugcaagcaucugggaauucuaacuuguguucuuggaaaacuuuugucuaaauucuaggaagaagagcgccuaaauaaacuccgacuggaaagcgaaggcucuccugaaaguaaguugugcugcugccaugguaguuaccaguuaacuugugcuaguguuggaaguauggauaauugugauguggcaggagagcuaaugauuucaucccggugagcugugugggugaguuuaugaaaaagcuuuuagguccagugcuuaaggucugcacuacccacgucagaauccuuaccuuuaauguguccuuuguguuuugguuguuauuucaugaguacaccaaggcuaguguagcagaaugaaagaacuccuggacuggccucauggcagauggcaaccaaauccugcagagacuuguggaaaugauugcauggauccaaggcuacacuccuucagccugguguuuuucucccagcugaaaucucaaaggcuguaugauacauaagugugguugucagccugaaagauggagaguauucuguguaguccugcuauucauuaaccuuuaacaaaucaauuucuguuuccgucuaaccacuuuaagcaggaagcucuguaaguguauuaucuucugggugauguaguuagauuaaauucagcagcuaucuguuaaagucaugcuguguggcaagcauugugcugggcccuugacuaagagccagagggauccaucguagcgccuauacucaaaagggcuuacauucuuagugagggaacugcagguguauguaaaacuaccucugaaaagcagaaugaaauaaguccuucuuacuuguucuaaguugaaauuuuucaaauuuuagugguacuuaucuagcaugccauaaauaagggaggggaaaguuuuggagcaguaguuuucaaacuguguuccauggugccccaggggguucccagagaugcuuuggaggaguagaucacacaaacaggucuaccucagucagagcagcucucuuuugaguguuauguguuggcauuccgaauaagguuucuuuugagaaggaauuuuaaaaaauauuugaauagcgacuaccuuaggggaauauucuuucaggaaagccgaggaggggagagguucaguggaggcaaagaauaacaacauaaaaaagccacuuugagauuuaaauuaauguuuuggugucuuaaagggauaaacuucaaaaauagauaaaaauucuaauauauggauuuuuuggguguuagguaaagcuuuaacuguuuuaccuaaauucauaaaguuuucugaacaaggaaguucuuuaugguggggaaguguaauagauuuuuguaguuuugaagaaauaacuuuuaauuagcuaaauguugcuagaagucugacauuuuuuggagucuuaggauaaggcuguguuguuuuuuuuuuuuugagauggggucuugcuaugcuguccaggcugaucuuaagauacugggcucaagugauccuucuaccucagccucccaaguagcugggauuacaggcauaugccacugugccuggcuuaggcugcuuuugauugaccacauuauuaaaugugauuauuugaggaccaaccagaugucuuugcagaauaucuguagccuaggaauaaauauguagcagcaaaaucugaacaccauagaucuccucuuaagaacuguccuuuucuuuacccuacuccuuugacucaacaaugacucugucaaagccucuuguuucuuccuuuacucuguaauuggcuguaucuucaugaaucuuaggcugcagauaaaauuaaugucccuuauuuuccugcauguugguuugaaauuguccugcuuugguuauguccucagucugcccaucuuucaaagcccagaucaggccaaguaugauggcucaugccucuaaucccagcacuuugggagacugaggcgggaggaucuuuuaggccaggaguucgagaucagacugggcaacguagcaagacuguguuucuacaaaacauaauggaauauaaaauuagcaaggugugguggcacagaccuguagaacuaacuacuugggcggugaggugggaggauggguugacuccaggaggucagggcugcagagagcuauggucccaccacugcauucuaaccugggaacagagugagacccuaucucaaaaaaaaaaaaaaaaaagcccggauuagauaccagcuuuauccauguagacuagcuugaugccuacuucuccagccuaaugucguuuuuucaccuugaaaguuucacaagacauuacuuguuacuccccaccugguauuacaguuuuuagauuguaagcucugagggcagccuugaacuaccuuuguaucccaguaguucuucucacaguaccuugcacauuguagguauucaguuaaugcuugguugagugaauauauaaccaaauaucaggguuguuuuuuucauuuacuguaucugucucuuugagcuaguuugaccucagugaccuuaaagaaauuccagaaaagaagaaacuauggauuauauuaagaugacuggagggccaggcacgguggcucaugccuguaaucccagcacuuugggaggccaaggugggcagaucaccugagguuaggaguuuaagaccacccuggccaacaugaugaaacccugucucugcuaaaauacaaaaauuagccgggcgugguggcggaagccuguaaucucagcuacucgggaggcugaggcaggagaauugcuugaaccugggagguggagcgugcagugagccgagauugugccacugcacuccagccugggugacagagcaagacucugucucaaaaaaaaaagaaaaaaaaaauugagccggagcugaggaaaucuuuauuuccuuuuuguaaugccucuucagauggccacucauuuuuuugccagguguuauggaaaaaauacaacacuacaacacucaacugcuuuuuccuauuuucuuacucaacaacaaucaacacagaagacuucugugaccaaguggguggguuuuuucccccacauaccaagcaagcaaugaguucugcagcagacaccagcugggugcccucugguucaauucugacacuguuuaccuagagauagcaucagguucccacagauggagggcucaguccccaagacacaccccugcccccagccugucccgagucugaaccuccagaacuugugaccaauaggcuguaaauuacgguucccacaacccgcuccugugguuugauugauuugcuagcguggcuccacagaacucagggaaacacauuuguucauuuauuauaagggauauuaugaaggauacagaugaagagauuaggaggaaguauggaggaaguggcgcggagcuuccaugcccuccccaggugugccacccuccaggaaccuccguguguucagcugucuggaagcugacuaaacccuguccccuugggccuuuuauggagacuucaucggauaggcaugacugaagcguguugaacuguguugaaaugugauuggacaaaaagggucugaccuaaacccagcaaggccugucuguccagauucuucucagccucucugugcaguguucccuccuccagaguaugaggcaagacccucucuggaaugagggucuuaggacccacaaucagauuagagucgugccuugggcagcugaaaggaaggcagggaaggucauagagggagauucuguugucugaggccuaaagugucccaacauuauaacaaaaaacuguaacaagggcugugggaguuauaagccagaaaccguugccgaaaaccuauauauacauauacacauaucauaauaucacaccagggguaauauuuuuuucuuggguuuguuaugucuguauaccuauucuucaaggcugggaaaggaaguccugcugaaaauacaugcuggagagcaauguuccuuguauguuucucugugggaguaggagcccaggcuggugaggaccuggaccagguauuugugugggagcuuaggagcauucaggaaggaaaaaggguugaagucauccagauaugccucauacaccugucuccugcugggacuauugcuuuuaauagcuuacugcuuugcuuugcuuuacagcucuuacaaacuuaaggaaaggauaccuguuuauguauaaucuugugcaauucuugggauucuccuggaucuuugucaaccugacugugcgauucuguaucuugggaaaaggcaaguaagacauuuuuggauuaauuuucccuuucucaguaguuuggcccaguauucaccaaagggagcacucucugccuuugauguuaauaauaaccccugcauuugugcagcacccucuacuuuucguugugcuuucauagcucuuauuucccauggccuugugaaauaagcugacugguauucuuuccauauaacagguaauaaaauauaggccuagagauggucaaaaaugguucacauccauagcuagccagagccacaucuugggcuagaauccuuuuguaaaaauguucacuaacaacuaaauaaauugaugugauacuuccagugccaaaguuaugcaaggccaaaaggguucucacccuuuuggagccuaaauacguucuaaaaugaacuauucuaaaacagaauaaaaagagcaucauaaagauauuaguucuucuuaaauuaauuuauguguuuagcaggauucuggcuuugaccaguggcauuccauugguaaaugccaaugggaaauuuuugagaauuugaucuaaaguauucugaaacuuuauuugaugaauaaauagguaauaaaauuuaggagaagaaagauuaaugggagaggauuuuucuaccugauaaugaaaguauggaccagguguaguagcucauaccuguaaucccagcacuuuaacaggcugaaguggaaggaucucuugcgcccaggagguugaagcugcaguaagccgugaucaugacacuguacucuagacugggugauggagcaagaccuugacucuuaaaaaaauuuagaaagguggcugugcgugguggcucacgccuguaaucccaguacuuugggaggucuaggugggcagaucacgaggucaagagaucgagaccauccuggucaacauggugaaacccccaucucuacuaaaauuacaaaaauuagcugggcaugguggugcgugccuguagucccagcuacucgggaggcugaggcaggagaaucacuugaacccaggaggcggggguugcagugagccaagaucgugccacugcacugcagccuggugacagaguaagacuccaucucaaaaaaaaaaaagagaaaggcauauaagguguacguguuaacuuucugguaacugguagagcuuacuauucaugaccccauuggccugcacccuuccugcuuaguuaaguaagaaacuugaaucugacuggauguuuguuauuccuuucuuacaguuauuuucacgaaaggaguaaucuaguuugagaaauaguucuguuggaauuuaccaacugauucacccuuaauguauauuuuugccuauagaguccuuuuaugacacauuccauacuguggcugacaugauguauuucugccagaugcuggcaguuguggaaacuaucaaugcagcaauuggagucacuacgucaccggugcugccuucucugauccagguauugaauaguuaagcugaaggguggguaauggaaggucccauuauuugucuaguggguauguguauuaguccauuuucaugcugcucauaaagacauaccugagacugggcaguuuacaaaagaaagagguuuaauuggacuuacaguuccauguggcugggaaggucucacgaucaugguggagggcgaaaggcacuucuuacgugguggcggcaagagagaaugaggaagaagcaaaagcagaaacuccugauaaacccaucagaucucgugagacuuauucacuauccugagaauagcaugggaaagaccggccgcacugauucauuuaccucccccuaggucccugccacaacacgugggaauccugggagauacaauuaaaguugaaauuugaauggggacacagccaaaccauaucauucuagccguggccccuccaaaucucauacccucacauuucaaaaccaaucaugccuucucaacagucccccaaagucuuauuucagcauuaaccccaaaguccacaguccaaagucucaucugagacaaggcaagucccuucugccuuugagccuguaaaaucaaagcacacuaguuacuuccuagauacaaggggaguacuggcauuggguaaauacagccguuccaaaugggagaaauuggccaaaauaaagggguuacagugcccaugcaagucugaaauccaguggggcggucaaacuuuaaagcuccaaaaugaucuccuuugacuccaggucucacauccaggucacgcugaugcaaaagguggguucccauggucuuaggcagcuccacuccugugacuuugcagggagcagccucccucccggcugcuuucaccggcuggcauugagugucugcagcuuuuccaggugcauggugcaagcugucaguggaucuaccacuuuggggucuggaggauggcggccucuucucacagcuccacuaggcagugccccaguagggauucugugugggggcuccaaccccauguuucccuuccucacugcccuagcagagguucuccaugagggccccaucccugcagcaaacuuuugccugggcauccaggcauuuccauacaucuucugaaaucugggcggagguuuccaaaccucaauucuugacuucucugcacccacaggcucaccaccacguggaagcugccaaggcuuggggcuugcacccucugaagccacagccugagcuguacauuggccccucucagccaaggcuggagcagcugggacacagggcaccaaaucccuagguugcacacagcacagggacccugggccuccgcgccugugaugggagggacugccaugaaggccucugacauggucugguuacauuuuccccauggucuuggggauuacauuggggauuacguuaggcuccuugcuacuugugcaaauuucugcagccagcuugagguucuccucaaaaaauggguuuuucuuuucuacugaaucaucaggcugcaaauuuuccaaacuuuuaugcuguuucucuuuuaaaacggaaugcuuuuaacagcacccaagucaccucuugaaugcuuuucugcuuagaaauuucuccugccagauacccuaaaucaucucucucaaguucagaguucuacagaucucuagggcaggggcaaaaugcugccagucucuuugcuaaaauauaacaagagucaccuuugcuccaguucaccuuugcuuccaagagguucuucaucuccaucugagacuaccucagccuggacuuuauuguucauaucacuaucagcauuuuugucgaagccauucaacaaaucucuacgagguuccaaacuuaccuacauuuuccuaucuucuucugagcccuccaaacuguuccaaccucugucuguuacccaguuccaaggucacuuccacauuuucggguaucuuuucagcaacauccaacuuuacugguaccaauuuacuguauuaguccguuuucccacugcugauaaagacauaccugaaaccaggccguuuacaaaagaaagagguuuaauuggauuuacaguuccauguggcgggggaaggucucacaauuguggugcagggcaaaaggcacuucuuacauggcgguggcaagagagaaugaggaagaaacaaaagcggaaaccccugauaagcccgccagaucuugugagacuuauuuacuaacaugggaauagcacgggaagaccagcccccaugauucaguuaccucccccugggucccuuccacaacaugugggaauucuaggagauacaauucaagcugacauuugaauggggacacagccaaaccauaucuguauguuacauuuugcuaagaagucucaauuaguaaaaacaccuauuuguacaggaauagcauuauuuuaccugaacaagaaagaacauuuaaaaccccaggguuauuuaccaaaguagacuuuuacuauuucaggucuuuuucauuuuuuauaauauccuuaugaaaucacaaaguuauaaagagcuuuaagacuagggaaauuugacucuuaggcaggagcugaaaaaccuaccuucagucuccuuaguuagaaauguauguggucuccucccaccuuguguagaugaaggcaguacuucuuaaaaacuuguauuaaugaaaaguacaauaaucaaacuuuaaaauuuacagccaggcaugguggcucauuccuguaauccccauacuuugggaagcugagguaggaggauugcuugaggccagcaguuggagaccacccuuggcagcauagugagaccccauuucuaaaaaaauaaaaauuugccaggcauggugaugugcaccuauauucccacuacuugggaggcugagacggaaggauuccuugagugcaggaguucgauguugcagugagcugggauugugccacugcccuccaaccugggcagcagagcgagaccccugucucuaaaaaaaauaaaaaauaaaaauuuaauggauaguuuguguuguagauuagacauagcugaagagaaaauuagugaacuguuuugagauacaggaaggaauagagagcacaaaaaguaaauauacagacguaauuuucuugaauuauaagacucaauauuauaauauuguuaguucucauauuucccuguagauucaauacauuuccaaucacaaucuaaaaaauuuuggaaugugaggagaaaauucugaagcuuuuugaaaaaacagagggccauccaggauaguagcaucauuuucgauaacuaaaaugugcaagcaacccaaguguucaucuacagaugaauggauaagaaugacuguuacauacauacaaugggauauuauguagccuuaaaaaugaaagaaauucucucguaugcuacaauguggaugaaccuuaaggaaacuaugcuaagugaaauaagccagucacagaaagucaaauacuagaugauucugcuuacaugggguacuuaaaauagucaaaaccauagagacagaaaguaggaugguguuugccaggggcuggcugaauggggaguuauuguuuaaugggucauaguuucuuucuuuuuuuuuuuuuugagagucucgcccugucgcccaagcuggagugcaguggcacaaucuaggcucacugcagccccugccuccuggguucacgcaauucuccuaccucagccucccgaguagcuaggaauacaggugcccaucaccacgcccagcuaauuuuuguaguuuuaguagagaugggguuucccauguuggccaggcuggucucgaacuccugaccccaggugaucuacccgccucggccuuccaaagugcugggauuacagacgugagccaccgugcccggcaaugggucauaguuucuauuuuacaagaugaaaagaguuguggagauggauggugauuaugguugcacaacauaaugaagguauuugauaccacucaacuaaacacuuaaaaaaugauuaagaugguaaaguuuauguuauguguauuuuuuuuuuuucagaugguguuucacugucacccaggcuggagugcaguggugugaccuuggcucacugcaaccucggccucccacguucaagcgauucuccuaccucagccucccgaguagcugggacuacaggcaucugccaccacgccuggcuaauuuuuguauuuuuaauagagaugggguuucaccauguuguccagucuggucuugaacuccugaccucaaaugaucugccagccucggccucccaaagugcugggauuacaggcaugagccaccgcacccagccauuauguguauuuuaccacaauuuuuaaaaugggaaaaagaaaaaagcaaaaggucgagaauauucuuuaaagacgagcucaaauuggggacuuacccuauaaaaaaucaagacaguauaaagauuuaguagcuaauaccacguuguaugguacaaagauagucacacagaccacgggaacagaauaaaacccagaaacagacaacccagauaucuaugaagaauagaaugucuaucauauauuggaaugucuugccacgugaaaaugaguggacuauagccacaugcaucaacauagaugagucuuggccgggcgcgguggcucaugccuguaaucccagcacuuugggaggccgaggcggguggaucacaaggucaggagaucgagaccauccuggcuaacauggugaaaccccgucucuacuaaaaaauagaaaaaauuagcugagcgugguggcgggcgccuguagucccagcuacucgggaggcugaggcaggagaauggcaugaacccgggaggcggagcuugcagugagccaagaucgugccacugcacuccagccuggacgacagagcgagacucugucucaaaaaaaaaaaaaacaagaccaaaaaacauagaugagucucuggcccguaacucugaguaagaaguagucacagaaugauacauauagaaugauuucagaaaguuuuaaaacaggcaaaaugaaacaauauacuguucaggaauacauacacaagcaguaauucauaaagaaaagccaugggccaggcacaguggcucaugccuauaaucccagcacucugggaggcugacgcaagaggaucacuugagcccaagaguuugagcaagcuuggccaacacagugagaccccgucucuacaaaaaaauaaaauuagccagugugguaguacacacaccugugaucccagcuacuugagaggcugaagugggaggauugcuugagcccagaaguucaaggcugcagugagccaugauugcaccacugcacuccagcccgggugacggagcgagaccccgucucgauaaaaaagaaaagccauggaauuauuaacacaugauaguaguuauuuauaggggucccacguuuguagugcucuauuucuuaacuuggguuauauaaacucaaauguuuauuuggcaguauucuuuagacugcguuugaacaugugucuguauuuuaaagaaaugauuuaugauauaguuacacaaaauacuguaccugucuagucacaaagacugguuugggcacuuuacuuguuccagaacuggagcaggauuaaacuggucgaggucaaucuuuucuauuugccuugcauuuagugggguuagauuucagauaacacauuucuauaacuuuacauauauuuuauuaacuuuuuucucucuuuugggucuuucuaauagcuucuuggaagaaauuuuauuuuguuuaucaucuuuggcaccauggaagaaaugcagaacaaagcugugguuuucuuuguguuuuauuuguggagugcaauugaaauuuucagguggguagaaaugccaggaugguguuugaaugcugcucccuguuugcagcagcucuguucuugagggaguuguuaucuuagccagagucucauuugguuugggacuaagauuacauauguggagaauucugguugcaccuaugugcucugcaaaguugagacagauuuuuuuaaagccgucauuggaucauaauaccagacuggauacuagggagcagaagaggagaaccagagaaagggaagacucaucuuaccaugacuucaggaucuugcagucuuggaaagagaggacccauccacauggaaaaauucuugaaagggcugaagaaacaggagguugaaggagcaauccagguuggauagaacuaauuuaagacuaaauuucuacaagggaugauagaaaugaaucuuauaccacaagauuauugaaguuugaaauggccucuaacccaauuuucccguucucgguuguuaguagcauaaauaucuuuuaagaaauggaucuaguuaaaguagauguauucuucuuuaccagaccauacacacuccauaugucuucccuuucagucagcuggagcaaggauuuugcaaaugaacuucucagcuccagguuuggugguauuuugacaaaguugcuaguugagagagagaacaggccauagcagccuuaaauugugucuuaaccauggucugugucccauggcacccaguguacccucuaauagccuuaauacaaagguaaaacagauuauagguccuauguuuuucaaaucagacacguaaugugcugauguaacaagguuugagggaagcacaucucacacaggagagugaaaauccaguuaucacacuuaugagcuauaaaaggaucagauuauggguccuuaaugcaauguuuacuguuugagaaggaacauuuauuuucucaagggaugucuuuuaaaauagcauaugucugauucuagauuagaggucuucuguauacuuuaauuuugguaacaacucacuuauccagaaauaaaguaucuaauauccuuacccaccgggaauguauaucagcacuaggaauaaagccaaaaaacaucugaguauccaguccguuuaccgaauaaagaggguuccuuugagaccuaaacuuagucugccauuaaagagcguucagauccuuugaaaauuuagggcgcaguguggcaggaguuuauggguugauagccagcguuauaauucuguucugaagaagccauguguggcugagaaauagaauucuucuauuuaaaugauauucuaagguugcauucggaaccugaaguggcuuuucacauuggaaucauuuauuuucaauagguacucuuucuacaugcugacgugcauugacauggauuggaaggugcucacauggcuucguuacacucuguggauucccuuauauccacugggauguuuggcggaagguacucucagggacucuuagcuuucauagcuuagcuccaggggguacccagaggcugagagaccaguccuuucuuccccggccuuaguccgauaaauggaaauguuggauuuuucagggauuucuuuccaugggcuuccuuccauaauacuccugguacccagacuguucgagaaaaguagcucauuuuguaacauuggaaagccaggugguuauguccugcaugcuucccauuuguaugaugcuuuuaguauuccaaaggggguucuuacugaugacuuuauuuuauucugacaaacaucucauacauaagucagcuagggauuuuccucuccauuuuauagaauagaagaagcccacuaccaugacuuccucaucugucucucuguugacagguuggaggcugaucucuuagaaaaguaggggaaaaaaaggagaggcaugagcuuucuguacaaagggaggagaaagccuuuccagcacacccagaacugaaacuuuagaguacuaggacuggaaguuccugucauuaaaugugacuguuucauuugcuucuaacaaguucuuguuucuguuuucagcugucucagugauucaguccauuccaauauucaaugagaccggacgauucaguuucacauugccauauccagugaaaaucaaaguuagauuuuccuuuuuucuucagauuuaucuuauaaugauauuuuuagguaaguauugauucuuuaauacagacuuuuucuugucacuucuuagacaguagaauuaaaucauucagaaauguaaaaguccauaugagaauucuuuugggacagaauuagagaaugauuacuuugcaaaaacagacccacuaggggaauaugcuaugguaaggaaauauuucuuuucuaaaucuccagcaguuaaauuauguucuuuaagugcucuuggugauugggaauauaccauaagauauuucuuguuuaaaacaauguaaggggacaggcaugguggcucacgcuuguaaucccagcacuuugggaggcugaggugggcacaucacaaggucaggaguucgagaccagccugaucaacguggugaaacccugucucuacuaaaaauacaaaaauuaguugggugugguggcgggugccuguaaucucagcuacucaggaggcugaggcaggagaaucgcuugaacccgggaggcagagguugcagugaccugagauugcagcauugcacuccacccugggcgacagagcgggacuuugucucaaaaaaaaaaaaaaaauaaauaaauaaauaaaaauuaaaaaaaaaaaaguaaggagccuuuuaaaauagacuaagaagcucccacuuuuacuaauuucaguagcauauuccucauccagaguuuauagaggugauaagacaaccagcagcaaggaaggaagaagggaauaaaggccucugagcagccaaggguugucauaaagccuuccaccucacaauaggaaaguccccugcuccucauggaaaaccugcugaccuauuaauuuauauaaaaucauaaauuccugccuuuauaaacuaacagaagggaaaaagaaagaaaccuaaauuauuacaaauaugacaaauuuaaaaggcuuccuaacuauaaggauuuuuuuuuguuguuguuguuguuaaauucuuauuagaggccagguauggugguucaugccuguaaucccagcacuuugggaggcugagguggguagaucacuugaggacagaaguuugagaccaaccuggccaacauggcaaaacccugucucuacuaaaaguacaaaaauuggcugggcuugguggcgcaugccuguaauuccagcuacuugggaggcugaggcaggagaaucgcuugaacccaggaggcagagguuacaaugaaccgagauugugccacugcacuccagccugugugacagagcaagacucugucucaaaaaaaaaaaaaauuuauuaguaaucaguauuugguaauuucuaaaugcaacuauacaugauucuacccauauuaucuauacuauacucuauacauagaugugaaaauacauacauucuuauguguagguuaaauacaauuugagaaaaauaauuuuuuccuuuuaagagcaaacuaauacguaucgauuuuaguaugacaacuaagaacauaaaaacagaaugaaaggaauuuugucauuaaauauauuugagaggagaaaacacugauuaucauacauagaacuuuacauguuuaaggauaagacaagcuccuaacuauaaggacucuuuaaaguucugauacauuuuagugguaauuuauauauuucuccuugcuuuauuucacaaaagacuuaagguggcccuaaauaaauauaacuguccagucuccuagccacagaaggaugcaacaauaguauauuaguucucuauugcuguguaacaaaugacccccaaaacuuagcagcugaaaacaauaaauaguuauuaucucacauaguuccugaaggucaggaagcagccuggcugggugguacuggcucagggucucaugagguuucaguuaggcugucagcuggggcugcaguuucuguagacuugacuggggcuggaggaucugcuccaagcucacucuuguggcuguugacaggaagcuucaguuucuugccauagcccgucuccauauggcuacucauggcauggcuucccccaaagcaauugguuagagagagagagcccgaagccacagugccuaaucucagaagugacaaaucaucacacagaccaacccaguauaacaugggaggggacuacacaaagguaugaaauaacaggagauagagguuguugggaucauugucacggcuugcuaccccagacagugagaggaagaccacgcaagguaagcccaggaagccagaaagcccaguggucuuggucauuuaguguugcgggaggagagacuuauaccauaguauuaggagccccuuagugugccagugccuggcagauguacaguuaaauaguauacauuguaggcccacgucauuugcaaaagguuaaaauuucuuucuuuuuuucuguuucagcaaaggguauaauccauuucagaaauauugccaaccaaaaauauuaaaauguuuugcccuugaagagaggaacccucaguucagaaaauguacuaauuaaagacagcuuuuuaccuuuauuacuguauaaauucaguauaacuaggccccaugaaaugggcauaagauaaagaggaauaaauauuggaaagacauuuaaaauauuuuagugaacaggguagagggguagaaauauuuuaaagugcauugacuuaguaucuuuuuuuguguuguuuauauuguacacucuaauuugcaagauuuuauguucauaucuacuuugcuuauagugaauauguaguugcucuuuucuuauucuuuagaaugaaauaaauccuaauuucacauuuauaauuuugaagcaguguaaacagccaguuaacauuuguauauaggucaaaggacuuuuuaguuuuuuuuuuuuuuuuugagacagagucuugcucugucacccaggcuggagugcaguggcacgaucuuggcucacugcaaccuccaccuccuggguugaagcaauucucuugccucagccuccggaguagcugggauuacaggcaccugccaccaugccuggcugauuuuuguauuuucaguagagauggggcgucacaauguuggccaggcuggucucaaacuccugaccucaggugauccacccaucuuggccucccgaagugcugagauuacggucgugagccaccacgccuggccauguucuugaguaggcuugaauuaaaaauuagguuguuucugcacuuuagauuugugcauuucauuguaaauuuuacuguaaaagaaagaaagaauauugaacuauaccuaccugaagaauuaggggggugagguguauugauaucugcaacuuaacacugaagugcauaaaaaaugagauggcuggagggauagaugaauagggaugugauauagccaauauaguaaaaagcaguaaaucuagauguucccuguauaaugauuuaaucuuuugcguguuugaaaauuuuauaagagaaaaaaauguuuuaaacucacugggaggcugggugugguggcuuacgccuguaaucccaguacuuugggaggccaagcugggcagaucauuugaggucaggaguuugagacuagccugaccaacauggugaaaccccaccucuacuaaaaauacaaaaaauuagccaggcauggugguggacgccuguaaucccagcuacucaggaggcugaggcaggaggauugcuugaacccaggaggcggagguugcagugagcugagauugugccacugcacuccagccugggugacagaaugagacccugucgcaauaaauaaauaaauaaacccacuggggaaaaauugcuuugugucuauuguauuguuaauuuguucuaaauuguacuccuuccugagccgcugcaauaagcuuuuugcuguggaauaugacgacagcuagauacugucccugccacaagagcuucugguuauaaauagacaaagacucuaauuucuaauugaccucuuuucuuuuucagguuuauacauaaauuuucgucaccuuuauaaacagcgcagacggcgcuauggacaaaaaaagaaaaagauccacuaaaaagaaagauuuagauggcuucuugccaguuugagccuaaucugauucuuacaguuuuaccuucuugaaccaauguaaaaguuuuuuuaauguuaaaugauuaaauucucagugaggcuaucuuccuuuuccccaguaacauuccugaauuuacuguuaucuuauuguaguacuugcaugacauggauuccugauaucugaugagagguucauucuuguguauucaguuaaugacaccaaaaggcucagcccaccccaacccuaucucauguucagucugucuaauacaugccagagauuuuuuuuucaaaaagugcuuuaucccuacaauguacugacaguucuuacaguugagauuuguucuuuucagcuauugcuugugaaaaaaagcaagacuaugucacucuauagaaggcuguuaaagugacucaggcaggaauuaauuauucuguaccuaagggguuacuuguuuaaugggauggcauugacuuuuugaaaaucaaguggacugagucauugauaaaacauuucuaagaguggggcuagagaacauacuuuacaucugacauccuuuggccuaacaacaucuauuauuauagugcucagcagugugggcauugaagaggcgcagaaugcuuugaaagaaacuaaucagaaucuuggaacaucaugaucaugccauucuuaaguaaaucaacuauuuucaacacugaagaaaaaugaaacauuauuuagaaaacaaugagauuacaaguuccaaacucagccaggaauguggcucacaccuguaaucccagcacuuugggacaccuaggugggagcaucgcuugaagccaggaguucaagaccagcuugggcaacguagugagaccccuaucucuacaaaaaauaaaaaaauuagcugggugugauggcacacaccuguugucccagcuacucaagaagcugagaugggaggauccugagcucaggaggucaaggcugcagugagccgagauugugccacugcacugcagcuggggugacagugcaagacccugucucaaaccaaaccaaaccacacacacacaaacacacauacacacacacacacacgagguccaaaugguagcagggauccaaagggaacacaguauguaggucaaacuggcaguaacaguguacagccuuugacaaacuagaaauauuagaguaggccaaacacaccuccaaacuguaaggcugugcacaaacauaaaaaauggcagccuuccaucuccugcacuggcugaguccauuuacuuguguacuuguucuagugaguggugggacuguacauuuuugaauagaccucaaaaauacuucauucugcugcuguucaguuggcuuuuuaaaccugucugcaguaggacacugaaaacagcaagaacuucggggugaacacccgcugauccuuuaacaaggauuucuggcaggaaacucacaaaaaggagaacugaaaauuuagacauacaguuggccauuguaaaaaacaucaguuuccucucauacauuccaaguaaaccaaguaaaauaaguguuggaguaacacuugcauaaaagaauuuaaggagugauagcucuuucuguucugccauucccaacauuccugggggaaaggagacucaaugaguuaauacuauuucacugagcccaagauggaaacuugguuugaccuaaaacaucugauuaauauaggcuagcugauuucuuaaaaauucguugcauugaaggauauuuugcaugucuguaacaccugucaauacuuguuuguauugauuucugauauucuugcagcugacuacguguaauugggcagaucagcuuugcaguagauuaugcugcauccucguggcaaaauucuguauucuuagugauuguuacaaaccccuuuauugcugucugagaaagugaaagauuguguauuucuauuaaaacauuuacaaucaaaauucuaa
